United States Patent 9,328,346 (POLYCOMB-ASSOCIATED NON-CODING RNAS) - sequence listing, part 109

SEQ ID NO: 21451 - RNA, 1112981 nt, Homo sapiens
uucaagcauguucuuuuauuaagcauaggaugcgaggcacagcaggagguuuaaguacaaugugaaagcaagagaacugagacugugauugacagacaaagggauuaacuaacguuuuauucucugccccccaaaauauccuguguauucuuaaguauauacgcuucccuuccugccuuucaagguaucuaaggaaugauuugaaaaauuuguuauaaucucuaaagaauuuuuugcauagcauuagcaaaggagucuaugacaaguacuuugccaccugguaguucugcguauucuacucccucugggugucacugucauccucacuggcugggacaagguucugagauuugucuccccagcaguugcuaagcuggcucagucuuggucaggaugaaugaaacaauuaucuccuggaucaaugcagcaaggagcagugaacacuugcuuuuucuucccuaaguaggagaaggccagcccccggcugcagugguggccguggugguagcuggaugggacgaggggaccucaggcuauucuauaacaguaaaagaaagagaauugcuggugcuucuccagggagauacggaaccuacacaccaagcagguuuuuacuuucaaacaggccaccaccagaaagcaaagagaccuaugccuagcccagccccagaaaagugauacuuuaccccaggaauucccugcuucccauugguacuuaagauuuuucacucuguugugacugcucuuauuuccuuuacucuugcggaucuguguuggagggacauuuggaaggggcccagcccuggcacuugcgugaggggacacacacagggcgggugugugugcccauccgcucugagcuccacuuagccggacuggcugccaagccguucuuggaucagccucucgcugagcgcccacaggguccgggccgucucuucgcucugagcuucuggugagggcaugcagcggcagcaguuguugaaguacaucccucccagacccuccaguucugggacagcagcacaguacacggugguggcagcucccuguugcuggaaauccaagaagaaagacaaaaaaaaauuuuaagaaaaggagugaugagauggcgucauuucgacugccugggcauuagcaggccucccccaccugguucaguuucagcuggaucuuggcauagcaaaggguacugggcugaaagcacaugacuguaaaaaguauaaugugacuauccuggaaaaacgaguucauaaacuccgcuuguaaagcugguguaacuuuugacaccucauacagggacaggcuuggaaaauaaauacacauaucaauacgucguggcaggcgccucuuccacacagagaaaaagaugguauccuucugaacgugcaagaacaaauucauccaaccccucaacuucuccauguauaauguaauucgauaccaaaucguuuguagaaccuucugucugacaaaccaaccacucuuaauugugguccaucagguagaaaacccaaguggggcugcugccagaucaucccuuuaugcuuugcccacggugcugcuaggggaaggguuggcaauguuguguuaaaacauuuaaugcacacacacacacacacacacacuccucaccauacauucauacuuagcacaaacacauaacacauuaauucauccagaucccaugaaaaccuuuuucuaaaugucauauuugacccagauuuacaaugggaccacagguaaggggguacauuuccucccagcccacuucaaaauguaaguugcaaagagugcagcugaucacuuucauucaccuuuugaguaacaguugcggcuguggcuagggacgugugcagugaugaggcaucauaucauccaaacugacagaauacugucagggaugcuauaaagagggcaagaaaucacuuugcuuugcaagccauaauuaaaaauaauaggcugcuguucagagggagacauggucggcacgucucuaauuuaaaaccaauacaguuuaucuggcaucuuaugauuauuuauguguuucagagcccuagcugcauccacuaauuuucagcugaugagagggagagggguugcaagagaggaccggaaaagguaacugaagauaagcucgcccccacaaggaaaacacuaaggaacuuugauugugggggaaauggcuuuccgacccgacccaaagcuuaucauuuuucugccccugcaggguuuacauugugaccaugcagggugcuuacuggaggaguuucccucaaauggucugguuugcaaucacuaugcuugcauucuaggaucccugggagagucagguccauacugagaaauagggucccaaggaagguguuacgacgugaagaaucugccauaaggcagacuuggguuuguuguugucauuguuguuugguuuuagcuucuucagugucaggauaucuaguaacaauggaguuggucugaaaacugaauggucaaaugcagucaagugauacgacucugggcgggguguggaccgugagugagacaaagacuuggguuuugauaauaacuggcugcuugaugauacuggacaaguuccacugguccugaauuugaauaacugacaugacuugaacuuaauaguagcugguuuguuaccuccccaaucucccuccauuaucaugcccacuccaaauagccagauauuauccuggauucagcuguuucuuuucccauugauuuguguggcucaagucuaauggaaaugaguucaugucauccaaauuuccuuucacugaauuauuauuccuaauaacccugagcuuagcaccuggcacauuuaucuaaacaacuucaagggguuuaucuggcucuucugcaucccauguggggaaaagggaagcagaagugccucuaaagacaaauuggagaauugagaugcucauccagcuaacucaagccaaguauuauuuuggccuggaaucuuagaguucugguggagaugguguuuuguaucaacuuccagauaucugucauauauuuucauuuuaccuugcagcugccaaaacgaccagaguggccaagugacuugccauuaacucccgaguggugggagaauccagcucacccauuucaaguccagccucccgcccucuaugccacaaugguuauacuauucagcauucaaacgucaugacagacuggccuuucacuguucugccaagcgugaggaaagaccaaagcaguccguuugggaaagcaaaaagcagaauucuuccuaaccugauaaaauauuuugccacuaugaccuacuguaaugauaccacguugcacucuugcauuacuggaaugguauuuuugcuaagaaauucugcagucccauugauucagaaugccauuguugcaggagcuggggaccuaccuuuuccuuccacggaaucuaaaggcaauuacaacuggcuucauuucaugccaaccuacauuuggcuacaaugcugagagccauaccuuuuugaaaagccuaacuuuuuaucaggagauggcuuugauuccuuugccacuaggcuuggggugauuuaccaucuaaauuccaucacaaguggcucuggcuuuguagaacacaguacacaggaggggcacccgaaagcaaagacgaccuucucuacuccaaaaaucaaucguccaccuuuggcaaauucuccuucucagauucaugcuuggugcucauggguacucacucuacuuuccucccuugcuggacaauuaagcaguaacaauaucuuguuggucccauacacaccacaccuuuggucucuuggagaauuuucagccguaccaauggcaaccucugagugacaucuuaauaugaucagaugugaugacaguuuaguaacagguucucauuuuuggcucaccagcuuuucggccuacauaucaucagaauaagacugaggcacauuagugaaaucucaauaguaaacaagcagguacugccaauaaaagagaaagcauucuuaaacugauuaaaaaaaaaauuuaaagagcacuuuaaucaccaucagaugacuuucauucauaccaccuuuuggggcaucaguucauaaugcagaaaagaugaaagagccaucuaaaggaaauaauguuaacaacuccguuauaaaauaucugaagcaauaccuugccaguugucaucaaugcuuacugauccauugugauaaauaauaauaccuugacauacaaacacuggcuggagcuauggguuccccuaaacgauuuuuuuuuuuugagaaucaaucauuuaucagaagccuguagguuguauaugguugcuaaucaugggaaacgggggaggugucuaucccgcagcaauggcaaugaguuagguuguugacgacacaggacugagaauuucugggaagcccagaagaaucuuuuuaaucaugcccgaaugccauuuccgaucuagucaaacauuugugagcugccagaggagaacugugcaaucaaucuugagaguauauguaaaauuacccaggacucuuguuugggauuaagaguaucuugguaauaaggauucaucauucucuuucaaaaaucaucugucagauuugcagcacaaucuucaacuacagaaaggugggauuuagaaagcaguugcuguuuauuuauaguugaggcccucagaucuaaauuauccauccuuccaaaacucgguguugggaugaaaauguuaaguagcugcuuuucaucaacauucauuugauaacugcuagccaucaauuuauaguugucagcacagaauacaaaugcauauugacuccuuuaaaggaaaggguacagagguuucugauaaacaauauaugguaaagaaaaaaaaagcacccacauauugauauuuguaaugcauugguuaguacucuaauauaauacucacagggacacauguuacaccguguuuugcuuucagguuuuucuauuuuaaaaugcaugcucauuuaaaagaaagaggagauuccugucuuaaaguagacuuaacuaugagauauauaaaaaauagacacaauaucauggcauaucuauauauucaaugauugugagagaguagauguucuaagauugcuuucuuacagggacauugcacagcaaaugcugaauuaauccacuuaugcaaaaaguagaguuaugaaaggaaugaacccuggaaguuagauuaggcuuggaacaccaagagcagggaaggagaacagcccuuuugaagacggcaguguucccaugacuaacgucccaggacaaaguggugaucugaagugagcagguuuggcuaaaaggaaagacacauaccucuucaaacccugccuacuuccauuguuacucaucuggugucuguuggacaaagcaaauacuucucaaaugcaaagccagccaccuuauccauugacucugugaauacaccacuaggaacagaaucauuuaucagagagcuacauuuaucagagagcugcugcgguggagaugagggggugagcccucaugucacagguggaauagauggccgucuacacgcccugucuuucccugucucccaguaacacucccccaggagaggcuauaaccacucucccagaacagugcagaggucaucuccagauaccucggugcuugggauacagccauuccucacaaacaauuacagcuucaaucucucauuggaaacacaaaugaaagcaaacugcuccaaaaggccacuuguucccuacucacuauccaagagcaaucuuuuaggggacacauuugccacaaauugcauuuguucauaaaguaaugcagccuauacaggaaugaggcucauaggccucccuggcuaggugaccacaccaguaagucacccucuucuuccaccgugauacuucuauaaugaaauuauacaauucaauuuggaauaagugcuaaccaacgaacacaccaacuuccaccaaaaugaugggaagcagcagacgagaacagagaugucuacuccaaaguccucagcccugcaaacugcccggcuuuuucagugaguuguagccaacgaguacuauucaagugacaucaaugacuagcauuuauugagagguuacgauuugccaggcucugcauggagagcuuuguaagcauuguugccuaacccucacagagcucuaugagccagggacaguuaguauuuccauuuauuuagagagaagccuaccugauaucagagaucaaaagcaacucguccaaagccauacagauaauuacguagagugagugacuucagacuccguguccguugguacaugaaaccugcuccccaaauaugugacacaaauauuugcacguggcccauuuccucaucuaugucuuccacggggcuccggcuuccuaugccucucugccugcucugccgccuucucagccaggccaugucuggccaugaggugaugcccuaacauggccuaaaaugaaaugugggggcugucguguguucacccgagaaauguuaaaaggagauuuuuuuuuccauugauuuacucauggagcuaaauugaaaugauauccauuuggaugaacaaaaaugaagacucagcacccccuucgaugauccaacagcaagugacccuuacuaaaaaggucguccgauucaaaaugccaucuccaggugccagauuugcagaacuaagaaaccuacucuuugaugauagaauuuuuucaaagcaccgacaucccauacaagugaaguggacacaacccccaucuuaucaguucccacgcauguaggugcgggcucuggaguguuucaucagguuugcagagaaaauacugauccaucccucugacucccucuccuccaaugauuccuaacacagucauuccuacaaauuccugacaacugacucccacaaaggccuucaacaauccagccuuagacacaugcaaauacuuccuguagguauugaaauguaacuuucuucauaaaccuuugggaguuuugcuaacucacaggcuauucuuaaccuuuauuauagaagaggaaugcacucaauuucccaaaaagaaacaaugaagaugaucaggaaagcaaauauuuguuuucaggcuuuagaagugugagaaaguguucuggagaauccauuuagaucccaugccaacucuuagcccuccagaagagaacaugcccucccuaacaaauuagacguggacaauguguuuagauguugaucuuuugccacaaggaaaaauauuucuuugcuagcaacagguucacaaagguagaaaaaccucaggcuccuuuucaguugccucucccaugacaggugaagagugucauuccccaggugacacuagggacagugucuaugacaggggcuugauggccguggcucagagagaguaaagugccaguccaucaccauaaaugcaacagguucaagcacagaccacaaccacaaauuacaagggacaccuugagagaaacgcaugcagggggaagagugccaugcagcuuuuaaaugacaggcacgugcucacaggcuucuguucagagagaaccugugagcuguccuguggccuuuccuguuuacggugcagccaucccaaauaugaugcccccaaauccgagucuggcuagaaggaagugucauacaaaggccaugccauucucccugacaaaagacaugaguuucuugcaagagcacuaagaaguuuuaagagguggacucgaagagaggagaaugaauuggaaagccagcaagaauguggcucuuacuccucugugaaauauuugcaggaacgagccuggagaccagcagguucaggauggaaagcuggaaagaauucuuuccuaaaacuuaaguuuuagagaaaaauaggcagccagucccaaccacccaaaggcguccaaagccauguuuguucugggaaggccaaggcaugggaggauguuaacuugggcuaucagcaggauugaagggcagggugaccuugguacgcucucagggccuguguuuccaagucgacaaacuguucugagcuuuuccaugaaacgagugaagcccuuuucauaccuccuucguguuccagaauucuugccaucgauguuccaaaggaucugugauagauuuaugucuagccuuaaaugggacgaguuguaacauucagaauuauuuuaucuuucugagaccugcuauuauugugagacccuagacaugcuuugcugggguuagggugaggguacuccuaacgagggaaggaaaaagaaacggcuucaaggcaauccaugugggucauuacaugcacacuuguuccaucuuccauuugugccugcccaaagcguucuagaacugaccggaccugagaggcugucucauuagaacuaagagaagguauuguugaugaugucuuauauccauggaagaauucccugggcauucccucugaugcugccugggauaccuacauugcucaaaguacaguuucuuuaugaauagggaugaaacaucgcauugggguaucuauucuuccaugguugguuugaaauagccaagcagaagugccauagaaauuugccaacaaaauaagcaucuaacugauagugucguccuucuacauggaacaaaucugauggcaugucacugaaauuuuccaacugggccaccuugaugcccgugcuaaaggacugcuggguguuuauaagauauaaaagaagauauuuaguguguguuuauuugaaacauuuuacauuuuuacucuacuucuuuaaccucuguuaugguuauagcuagcucguguacugcguauaaauguaugcaucuguauucgccaucuacaccaaaauaaaccuuugaaauuauugccaggcagaauuaaugagcucaguucuaacagcgcaaagaauaucuucauacuacagguaaaacaaacagcuucucccuucccuucuucugcacagaauggcucuacgaagucugccugcaaaauuacgucuuuuagaaaaccaaguagcuggcuguuuugugagcagggaggauuucaggacgaaccacaaacaagcuguuuguuuagauuuuaagguugacaguucauuuacacguaugccccauaaguauucuauaacauaguccugaaaaagcacugaagaaaaaaaaaaaaaaaaacacaaggucuccgcuggggccacaucaugggaaggaauuaacucuuaacucugccuuccagaaacaaauuaagaggauguacuuugcaauaauucagaucucacagguaggcccccaauguccagccccgcuauuucaaaucgggcaugucugaguuagguguguggauuuccauacagagcucacuggaacagaccauuucucagguuccaagacgcuggccuuguuaauauuucauuuagaacauacuguggagagugucucauuuauauuacuuccauaauuaauggugauagcuuaggcacugccuuuacacagagagaucucuucacaguggucgauggguaaugagaaacaauagauauuucauucaccagcagcguguugcuaguuaguaggaaaugaucgugugugcuguugcuuuaauugcccggguaaauaauucugccucgguguuagugagcauuuuaaagcacuugaugccaauagacuagaaacaaacaaaaauuaaccuugauuaugcaacaccuuagcauagaaaguuacaaagguaugucuuuuuuaaaguuugcauucuaucaugcaaauauuaucuaaauaugcaugugcugacuacucaucuacuguauuuuaggaaauacaauuaggcugccuuucucuuccccuauguagacuguaaauaacuguagaucuuucucuuguuucccuauguaaauauauguaaauacuaacaagcuaugcaugcugcuauucuaggcaauuucagguacuuuuauaauaugaaggcauguacuugaacucguuuguuaacagaggggaaaaaacucucucaaacucuuuaaagcugaauagaaauuaaagauuucuuccuagacuguuguggcuucuuuuguuugccuucucuugccggaaucgagugccccacuccagcucugaccuucucccaggaaagacacacagcacacacaggcccgggaacaacaguggaaggacuuggcuugggcuuuuucauacuuucuuuggguuuccuaaaaaacaucuagaaucacaagguagguuucuuuggaucuuucuagcaaaagaaucucgacggaauguaauuccuauuuguuguuccuuuaccgugugccuuauaucccaaaacacuacugagggucccgucauucccaucucaacaauacggagacugagucaggucaaggccaaugacaaaagugacaacacuacuaagugccacccaagcccucauucuuuccuguauauaauaggucaguaaacuacuucugcaaagggccagagauuaaguaauuuaggcucuguggcccauauaaugucuggcacgaucacucaacucugcuauuguugugaaagcggccaucgacaacgucuacccaaaugaacgugucuguauuccaauaaaacuuuauuuauaaaaaaaaaggcacugggccagauuuagccggcaggccauaguuugucaaucucugcucuacacacgauuaagacuguuauuaaagacugagagcauuucccuuuuuaacuuguguguuugauggaucauggaaaugauuugaucaaaugaaaauucuucuuuuuccugcaagugucaugaaauaaacaggugaacaaaaaugaaaucaccugagcuuauaaaacaggcugccuuccucugacaaauuacauugucagguuucaauuuaguuaucuuuuuguuuucauaaauagggauggaagaaaaaagucaggaagacaaaagugaaaaaaaacaggaaaaaaguaacugagcaacauucacucuucaaugagaggaaggaggcuauuaccucagguauccauggaaaccaagcagcgcauaaacuuuuuaaugguuggaaaacagcguuugcguuugaagauguuuuucccaaauaugaugcuucaguguaaaugcauuaauugacaguuuccuucgggacuuuuuuauugaaguuuccaaacuuaauuugauggcacaagggacucucuggagcccuugaagaaugcugcaaaguuaggucuuuagaaaaccgagccagcucaggcaucguguacaaauccaacucucuugcaaagcaaaugaagaaacagaucuuauucccuguaaguuucccauuuaaaaaaaaaaaaaaaaaaagaaaagaaaaaggaaacccucucuauucagcuagggaagggagaggcccuuucuaaccucuaucaagugagaaucaauaucaucucuucaguccuggagggagcugagaaucagcaggaggaagauagauccagguauuuuugcagaugggguggcaauaugggaugguaggaaaauccccugugcugaagccagaaguccuuacauuggacuccugucuuugacaccuaugacaagccacugagccucagucuccucaucuggaaagucgacauaauaauauaaccuucauguguuucuuggaaggaugagugauaacauuuggccauuuccugggcacacaacaaguacuaguucaaaagcagcuauaacucugauuuuuacaaguuuaaagcagcuauaacucugauuaucacaaguuuaaagaaggaagcauacacaucaaaguauagaugaagccugcaccuccauuuuuugggccugccguauagagacucgccugucaccuggccccagcaccucuccuuuagccagaccacugagcccagguacaauaucagcacagaggcacuugccaguccuuucaccauuucuagaucucccuuccaaaucauccagaguuuuucaugucuuuguccagggagugugaggcucaauagcugcuuagggaggguuagucuaaucccaacuguaauggccaaaaaaaaagacgacgacgguggugaugacugcugguuacugagagucucuuaggugccaacgaccuguuauuacuucugauucgcacaauauccucacuccccaccaggcagguguuauuguaguggaggggagacagaggcuaaaggaggugaaguaacucacggccaagcaacggggcagugcuggaacucagauucaaacugaggucuggguucaaaacccauauucuuguugacguguaauguucuaacuccauacucuauacccuuuguagcaccccagaaucaugcauacacuugaaaaucuggccucagaucugagagcgggauacuuauuuccugccugggccauuugaucccucugguggccaaggcccucuccacagaccagcagggaccuuucuccuccuuucugagcuccauuucuagugccuaaaacccuggcuucccaccaggccucuggcggaugucaugugauuuugaacaguacagaccagaaggggucuauggugccuccccugcaguguucucuucugcaaauugcucuucgugcaaaggagguccugaaggcuggcagggcucaggugaggagcuuggcauuuguggaucaucuggcagcaaccaccggggcagucucacaacaagccaguugcaauuggaacucucugcccccacaguuaacagaaaugaugaacucaugacaaugggguacaccaaggaacaucuuauucuucucccugccccugcccucuggcugccauaccuguuaggauucauccucuuagaaaugccuggcaaagggaaggcacacaaaugcacauugcuacucagggaggugucagcgaggaacacaagccaguuguguagcugaccuucgaacugucaagggguugaaaaucuguccucuaccaguacacccucuggaucccuaaucaaaugacuuuacaaggcaguccucuucauguaugaaucccauacaggggccaggauaccuucugugacauguucuagguggcaagguggagaauuuuagcugaacucuugcaagagcccuaugaaguuacuacagucucauuguauuaauaggaaaacugaggcucaagucaguaaaugacuucauaacauaauucucaaugaugcaguuuugauuuugugccaccuggcggccuccugcuaagagauucgugugucuuugacgcuuucugugaggguccaccuuacgcaugauagauccuuuagggggaauucugcacacauuauccccaguuaaagacaggagaggccuggcaccauggcucacaccugugaucucaacacuuugggaggccaaggcagguggaucacuugaggucaggaguucgagaccagccuggccaacauggugaaaccucaucucuacuaaaaauacaaaaauuagccaggcgugguggcgcacaccuguagucccacuuacuugggaggcugaggcgggaggauggcuugaagccaggaggcagagguugcagugagccaagauugcaccacugcacuccagcuugggugacagaaugagacuccaucuugaaaaauaaaauaaaauaaaaacaccggggacugaagcccaaagaggcaaaguuuucugccuaggucaaagagcaagugacagaguuaggagcugaaccaaaucacauggcucuagacacccagucucaacaacugcacuaugauaaauaggaacauguccacagcacaagugaagcaggaacauagcacaccuucaggucaggauuuugagccaucaucauagugaccuuucaacaacaaagacuagcaaacauuuuaugaggguuucugguucacauuaaguguuugauggguacuauuuacaauauuuauaauaauaugguauuuccaucuaaccaauguggaaucaaaaguccagaaaaguuaagcaaccugccccaggucacacagcuacuacguagggguggggaaauuuggaccugugucaucugugcccuugaccccacugcuacuaagcauccugagccacagaaaucagacacucacaaugcauuugucaauuaucccguaguaugauuaaugucucuaguuagguugcuccaccaaggggcaccugagacucuuagguuugaugugaaaacugcaguggaggccagggcuuuaauugcccaugggaaaauaauaacucaaaccagugagcagaggaugcagccauacccaugaaggagcaaaaaaagcgggaggauuuauuuucuuuacuuguuuuuaaucuuacucuuuucuuuucuuuacuuuucucuuuuuuugagacagucugucucucacucaggcuggaguacaguggcgcaaucucggcuuacaucaaccuccgccucccagguucaagcgauucuccugccucagccucccgaguagcugggauugcaggcacaugccaccaugcccagcuaauuuuugugguuuuuguuuuuuuuuuuaguagagacgggguuucaccauguuggccaggcuggucuccaacuccuguccucaggugauccaccugucuuggccuccccaagugcugggauuauaggcaugagccaccaugcccagcccauuuucuaaagcugcucuuguuccucagauuuugguagaugaccaauugauuuaaacuguuguacacauaagggaagauuuauaacugccccagauuucaguucuccuuaacuccuaugcuuuccuagaggcugggaagcauaacuuccugcugauuggaaagugagagccuuauaucaggacacaagaucccuggaguccugauauaaggacuucccaucaucauggugggaugaaacugccucccaucgucauggugggaugaaccuugcccuuuguccuggguguuuguguuuucaccacaauccguagcaaacauugggaacaaauaaauaaauuaccaagcaauauguuuuucaugucauuacagaacugccuuucuaaagcgaucaaaaaagcccagauuaucaccacaaccaccuguuuguggcagugaggaaucuaaugaaauggucugauaauuaaauuuacuuucccaugaauugcuuugcuuaaaggacaugucuacaaaaagcaggguuggugacagugguguaccaguaaguguucaagaacucgcucacuggaggggggcagugcaggggguggguuugauucacagugucugccaauucccaugguaugaauacucucaccacaagcaauuuaaacugaaugcagaguugggaggaaauguacacacucagcucuuggaagcugcuaugauccaguucuagcagucccuuggugaugaccuguggaauacagcuguaagaauuuuugaggaagaucaagagcuaugauaaaacagaucaggaccucaaggucauaaagccauugggaugugguaggcacugugggaauguauaaacccaaaccagcuuaggguaccugaaggacagaaugguacagacuugugaauuuuaagcauguuucaacuuggucccuauaaccuaaaaguugacuccacucagguagcuccccuggcccaagguaacuauacuuccuacugggucaauaugagcccuaaauaucauucuagaaacguugcaacguugccucaguuaauacugcagcaccucugcagguagauaauaaccccauuucagagaugaggagacugaaguucaaggaauugaaagaugcucagggugacaccgaacucccgaaaugcauugccaggauucagauccagaucugccagaccuuagacuucauuauuucccuagcucuccagggaauugugcucccuuugagcucuguauccuugaaaauagaacaucucuacaacaagugaaaucuacauguuguaacaaauaauuuggcucccccuaaaaaaaaaagucucucauugggggagacaggaucugaaucccugggggucuggagguaguguacaggaugagaacuggagggugggggaagaaggaauggagacuggguauguggaguaucaggagaagagaggcuagggcugcuuaugggauuggaaaucuugcgauuuaaauuauuucucaggcauuaauggaaguuggguccgaauagacucagcauuuucuccuuuugcccaacaucacaaaccuaagugagcagagauaacccuggggccuccaggagcuuccagcacacagagcacauguuccucagcugaaggucccucgguucaaacugguauaaacccaaaccagcuugggguaccuggaggacagaaugauauagacuugugaauuuuaagcauuuuucaacuuggucucucauugugaaaucugcacguuaugacaaguaauuuguauauguguaauacacaauguauguuguauacauguaauauacaauguacauguguaauuuccgagucucucaccuuggucucucacuguucaccaacaggugaagaacagagaagaggaugauuuuugcucacacugcacuucuguaacuuuaucagaggugccaaaccucgaagcuacuuuuggcuuugguacuuccucaaaugaacaugcaaacagguuccuacugauuaaauugcaugagaagcgucaguacuagaaauuaguaguauuauuguccccacuaacagaagaauauuuuaaacaaaggcaucuuuaccaccugagauaaccaaauuuuucccacuugagaggaacagcaucuccaaauaagaaaaacagugacgcaggaaaugaaaaacugaaauguucuuuccccuuucaacuauaauuccucacacauuugcaucuacaaugucaaacucacccagucacugaucuugugcuaggauucuauguaccacuaccuggaguguuuccccaaaacacacuucuugaaucugacuuaaccauuaucauugccauuccuucacaaggagcuagcucccggucuagacaagcuggcuuaccuuuguagcuuuaccuucucccuuucccccaucccugcaccucacuuacaugaauauacccugaaguuagagaggcauggcuucagagcaagcccaagaaacuguaguggauauuguagugugcugcugagaucccccauucugggccaggaggcacucauuuccucagaugcuaggcuguccuaugagucccuccucaggaacugcccacagccaaagcgagcucccuaccaaagcaacacgcacuccaggagggagcccacaucaaugacuuccugaccuccuugcaucucugaagaauaauccagcuucagaguuuccuugggauugacuggagcauucgcaucucccacagcacagcucaauccucccuccaccccauccugcuugcuacguuccccuacagguguggauccuagaacacuccccaguaaucuuccuacaugccaaucucaguugcagaaucuacuuccugggguacccaaccuacaacaaacaauagcugggggacuuagagaaauauacauaaccagucugagccucuguuuucuccucuguaaaucugagauacggguaugcucacacuuuagccauccggaaugaccaaaucacaccauaugcauaauguucucauauggaacaggcauauaauccauacucagcagaagacagcaguggcgguaguaguagaacugacagcauuagcaguagcaucuacucaucucauucugccugcaugguucuuucucauccuuuaguuuggggaguauggcaugggggaaaaaagcauagacucugggagcaucugcuuagacgugguagauucaguuaggcguuuuuguaugcacucucuccagaaacucuacugaauguauaauacggggaaaaauuauuuaacucagugaucaagaaacaucaacaaaaauuuuggacgauggaaagcagauggagaaaguagcaccuccugacucagcagagcgggggcuguagaacagaaaggcagugagaaaugagccaguucacacaaggggagccugggaacugaacggggguggagaaggauggaagugggaaaagguaaggugaggccccacacugcugccuguaacgucggagccgagaucucauaugggccaggaaacuuguuaaaccacuuguguccuuacaaaguucagccgucacuuccucugugaguucauaaccagaaccuuucuucaucuucacaguccaucuauauuucauaguugggugugugcuguuagacugugaucucacugagagggguuccagguauccaacccaaagcuuggcgcacgguaggugcuuagagaauauuucucuaaaaggaugaaugaaugaaugcucaaauuuccuuugaaggccaaaggaaaaauauaucaauccaacucaguugauggauaaacaaaaugaccagucaaauuauuuccuuuccaaaucguuuuuggugugguuuugacauagcuguucucuacaaguaacaacucacauuggagcuacacuuacauaauaugcauuacgugccacacgcugcucuaaacuuucuuuguacacauacacacacacagacacacacacacagaaucuucauaacaaccacguuagcuagauuuacuaagauuuuccccaguuuacagaaaacugagacaaagagagguccagcaacaugugcaaaucuacacaauuacuaaguggcagagcugggauccaaacucacguccugugacuccaaaggccauguuguacagaaggcaaggagcuaguugcuucuguagguuacuggggccuucucuugucccugaacucguuaaaccacaaucuugucugucuacugauucagcuucuccccagcugccacccccuuugugaggagcugggcuuugcaaucuucagguauccuaaauuguuuuugcccaaguggggacuuuccucuccuuccuccaaaccagugggaucucaccuggggucuuugcuggcuaggugaccggcaguaagaaaagaugugcgagggucaauuugcaauauuuuuaaaaguugaaugaaacgcuuacuuuauccacagagaccacgcagauggaugacuggacuaaaucucaucugcuggguaagcagcacuuucauacucugaggucucccugaagaagggagcagaaggcaucucugugacgcaagacccagcaguacugcccgguggcaaagcucuuuuuccuccagccgcuuuuugauucaaguuucagugaggcauaaagaauaaaagcaguuuggggagaugcccuacaucgacugaagucuccucuguuccaggcuuagugcugagaucuucugugcagacaacaaagaguucuuccagugagccucagaggugcuuacuauuauggucauuuuacagggcccccaaggguaagcaacuuguaugcagagggaaucaaauuuggagaugaacuuuggucuaucugauuccauaaccugugcuuucuguucuguauugggagauuccagcagaaagcacccacaagagaaugaagucuaauggaauggaaagugcuggccuugccccugggaucacagaggucaaagaucguagagaauuggcaacucuuuggcaguucacagccauggacacaaacuucugucuccuuuuggugagccaaagagaaguagcagaaaggaaugugagacaaggaguaaaacgaggcccuuccuucauucaccuuuucuucaaccacuguaccagugacagcagguccuuaaccucaguccugcggcccugugaggaaauuagagcucagagaggcuaagugacuuucccaaggaugcacagcuggugaaugacagaguugcgauucaaaugugaaacgggaugggugggcucugaaguucacguucuucucacucuacugccucuuuugugcugagaauaagcaaaggggcuggacuccacaaaggaaauaaaaagugagaggcaaaagaaauaaagcaaaaaugagggaaaggcuccacuuguaagcauagggccacacaaaucaguuuuaggggugcuucugaauaccuaggcaccuuaagagaaaucucuccaugcuaaaccuuuccuugaccaauagagaccuuaccagguacaaccucacaucuuuuucaguuguuaaauuauuucuugcacuaacgagaugaggcuaaaaugugcagcaggcaauaagcuccuugaaaaugagauuuuguucacacacaucuccccaguauuuggcacugggucugguauacaggggugaugaguugccaugugaugagugaaugaaugaauggauggguggaugaaugaaugaaugaaugaaugaaugaaugaaugaaucacugcgaaaauaacagcuguuuggggcacuuucugccccauuucacgccaaagggaggcguauuguggaaaugacucacagugcuuacccagacuuuaaaaauacacacauucccuauuagagcuggcaggagcaauuuugguccugagagcagagcucccugcccaccuaauauuacacgagguguuaacuacauuaucuggaaauacccuaugacuaauuccccaucccuuaucuugaggagaagaaaauugucucuaacgcgaaugccccagauuccuggucaguuuauguaaggcguuucaagugauugcgguauuuuaagccauuuuuagcuuaaaucaccugauguguggugagcccagaagaccugaucucuugcucccuuaaacucccuguuuuuccacuaauuuuguuuaaacuacuuaugcgcauaaguaauucuccauugaagaaugggcuuagaaguguauauccccuagacgcuaugauuuuuuuaaauagacauuuauucaguggauuuuccagucacaucucccugagcuugaggcuccacuacuuuugggugagcacacauuugccagguugggguaggugguauuuauucuuuaucauggccuauuuggugcuucucuaguuugaaaacauuucacugcaguccagcuaggauuugauagaaaccuucuccaaauuaugucucaaaugaucaucaguaauugagaaaaacgugagcucccacaggaccuucgaccagcuagaagcaaaaacuuggcuuuuauaaaguagcaggagaggacagcccauucuuugugcaguuguagcuacuuugaaauaagcaaaauguauggaaaugcaaagauaaagguguuagauuuaauagaauccauguccugauguccacuuacuaucucgguggccuuucucucccauaaagagaagucaugggcugggcgcgcuggcucacgccugugaucccagcacuuugggaggcagaggcgggcagauugccugagcucaggaguucgagaccagccugggcaacacggugaaacccugucucugcuaaaauacaaaaaaaauuagccaggugugguggcaggugccuguagucccagcuacucgggaagcugaggcagaagaaucgcuugaacccgagaggcggaggcugcacugagccaagguugugccacugcacuccagccugggcgacacugcaacagagcgagaccccgucucuuaaaaacaaacaaacaacaaaaaaaagaagucaugcuuugcucaucuucccagcaucuuauuauacacacaucaccuuugauacaugauuuuauuugaauguguagacaaaugagagauuuagccacaauucacaaaauuuagguaacaccaacuaauuagcugucuaacucaagaguccucaaauuuaccugcaaaagggcagauaguaaauauuuuagacuuugcaggcucuacauuuauaaguacucaacuuugcuacuguagugcaaaagcagccauagacaauagguaaacaaaugcaccuggcuguguuccaauaaaacuuuauuuacaaaaacaaacagcaggcaggauuugguccaugaacuguaguuggcagagcccucuucuaccuaaugccaaguaguuaaucaucuaaguaacaccaacuaguucaucuucugaaugaguucccucccuugacaaaauggacuugacauuugacugaacugucgugccaguuuaauccaaguuggaaacgugaagugaauuucaguggagccagagggugugaggccucucucuuggggccucucuguagcgggguaaggccucugugggucugaauuuucagagaccuacgaauauuccaaaguccaguggucuuuggaauucauauccagaccuuaggcaggaaucuacgccuaauagcuacacgcuaauucccgauuuuuuuuuuccauaaaaaaggauaugaggccgggcacgguggcucacgccuguaaucccagcacugugagaggcugaggcaggcagaucacuugaggucaggaguucgagaccagccuggccaacacggugaaacccugucuuuacuaaaaauacaaaaguuagccaggcgugguguugcacaccuaaaaucccagcuacucgggaggcugaggcagaagaauugcuuuaaccugggagacugagguugcagugagccgagaucacaccgccgcccugggcgacucagugagacucugucucaaaaaauaauaauaauaauuaaaaaacaaggcguuaugaaaacauuuccaugggaagaugauaaaauaauggagcaaucaaaugcuuccaaauuaauaucuuuauccccccccccuuccccaccccauaccagcugucaccuaaaacuagguagaauaugaaaccacuggaaguuuuuaaggaguuaaacuaccuacuaaaaucacucagcuccuaucaauugcaagaugccaaauaaauauccccccccucccaccgggagcagguaacaacuguguauucgcaauuucaggacagccaagcaaaugaacacggcgggaugaaaccccucccuugcuccauuucuuaucucuccuagcuaacaucuauugucaaaagauaaccucaaaccccuuagauuagaacagaaauuacuagaaauaauuauuccucaaaaauaugcuuuccuaggcugggcacaguggcucaugcagguaauccuagcacuuugagaggccaagguaggaggaucgcuugaagcuaggaguuugagaccggccuggccaacacagugagacccugucucuacaaaacacacacacacacacacacacacacacacacacacacacacacacacacacacaaagcugggagugguggugcaugccuguagucccagcuacucgggaggcugagacaggaggaucaccuaagccugggaagucgaggcugcagugagccacaauggugacacuguacuccagccugggugacaaagugagauccugucucagaaaaaacaaaaagaaaaaaaaaagaaauaggcuuuccuaauagaugccuguuccaaaugcucaggcaauuuuuccaaaauuaaaugccauuauggaagacgacagaccaugcuggaaacagaaaguccaaugucccaggggcaauaccaucucucucccuagguuucuagcagacaaguuuuugucuuucucuauauauacacguaucuguauuuuuuuucuuuucuuuuucaccugcaaaucucugucaacucuuccacacagaauccaaaagcuuuccacuaugugucacaauauagauuugcaugcaauaaagacuauaauuauugagcauuuaugagaaguaauauuuucccucuggugcauguuagcucagcugcucacacacaagugugaauacuaaugccuucagcuuaccuuggcgccacagaaaugcaaggugagagaaccgagcagccccaggaaaagcaaacacugaaccccaccguugucuguagggaagaauguggauuucgaggagaacuuggaaauaaagguggcaauucgcuugcaggauuuaaacaucaggacuuugugcuaagagacuuggaggacccaacccagcacaugcaaccaagaggucugcagauccugccuagcaacagauggcucagaagaaaugaauugcuagauaaacauuuaacugagaguuugacuucguaaguguggaaauuaggugaaacaaaaggagaaugauucugaggcauuccaauuagucaucugugauuucucuggcaaugcgugcugaaccuccuacugguccugacauucucaaagaaagaaauuuuggaaauccgugaaaggaaauguaaaguaucuaagagaacuuuaguaacacaguuaccgaaaaaagagagagagcauuugcaagggaaauaggucuuggccacaccggucacgacucaaagcugugucuaaaaccacaaacacgaggccagcuugaacgccugccuccaccgacauuuccuuuuggguacagagggcaaaaguguguguuuccauuuuuaucccaugcagcaccacuaccgccucccaccuugucccuucucccaucucugcuucguuuagcucaagacuucguggguuuucuucuguggcacauuccaggaaggagaugagaaaaaucaaagugacucuacacuguacugcccacaauuagcaaccucagggaagaaaagagcauaacuacccaggaagugggagaaggaauuuguguuugaagagcacagcuugacuccccgugcaugggagagagaguggacauuucgagauaagagggaacauuaucaaucgugccuugccauccaugccuggugcacaggaaggacucacagcucagaagaauucauucauaauucuuucuuucucuucucaaaaaauacaagugaaagggggccaggcaugguggcucacgccuguaaucccagcaaugugggaggccaaggccagugcauugcuugagcccaggaguucgagaccagccuggccaacauagugaaaccccaucucuacuaaaaauacaaaaauuagccaggcaugguggcgcaugccuguaaucccaucacugugggaggcugaggcaggccgaucacuugaggucaggaguucaagaccagccuggccaacauggugaaacccugucuccacuaaaaaucagcugggcgugguggcggugugcgguguggaggggccuguagucccagcuacuugggaggcugaggcaggagaaucgcuugaaccugggaaauggagaaugcagucagcagagaucacgccgcugcacuccagccugggugacagagcgauacucugucucaaaaacacaacagaacaaaagcaagugaaaggaguggauuucuaguaccugguucguaggggcauaggagguauuugaucaaugcuuguuaaauccauguuugggggcaccacgauauucuuucuaguaauaauaaccacuauagauaagcacguuuagcuuucucaaaaacuaugugauaagugcugauauuaacccguuuuacaggggaggaaaaugaaguacgcagcauuuaaguaacuuucucaaagucauucaauucguaagugguggagcugggauuugaacccaggggguucggcucagugucuaugauuuucuaaugaccccccuaacaaacacaauacccaaagagucauucuacuuccugcucugcacauuuaggguguuuucuuuuacugcacaauuuauauuuucucaagcacuucuggcuuuugaaauucuucauauuaugauauagugacaccugucacuccacaugucuacuuuugggcuugggagugaacauucacugcagugagcauguggugaaaaaccaauauguugaaaaacuggcugggggaugggagaaaaggagaaaaggugagaaauguggacuaagcuucccugacccccaguuuccucauuacuagaaaugcuagcgugaggauuggagaaaaauucccagacuaaugucccaaguauacuagauacuugagguauggcaacuguacuguuuacaggagugagaugauuacuaguauuacuuguuauagguugaaucaugucccgaagaauauauguucaagucccaaccgccauugccucagaaugugacguuacuuggaaauagacauguaauuagauuggaauacagaguuaaacaguuaagaugcagucagacuggaauaggguaggcccuuaauccaaugugaccaguguccugauaacaaaggagaagagauccagaaacacacagggagaaggccgugggaggacagacgcagaggucagauaguugcagcugcaagccaggaaacaccaagcguugccacugaaccaccggaagcgagaggagcaaggagaguucucuagagaaggagcauggcccuguccacacuguggucucagacgucuggcuucuaggacugugagauaauauuccuguuguuugaagcccucuaggcugugcaguuuguuacagcagccaugggaagcacacacugaauuauuccuguuaucaucuggcucaugucucuucucagccaccccaaauaagucagcacaguccuggauguauccuuuaggaacauaugaccaucugugugaacacagaggcccacagccacaggcagaaaacacccaacaucauuuuuugacaauacaggccaugugaaaaagacuucagaaaauucucugaauguaccuucucaaggccagcagacauauuaauaauacacacacacacacacgcaugcacacacacacacacacagacauggcaucuguucuaaauguaugccuuaccguauuuuuccuaauaucaggccucagauaucugagcacuaaauuuaucuuuuuuauaguacuuccuagaaaacagaugagucccuucucacacuaggcaguguccgaugcauucuacccugagaaccacacccucucguuuauccucacucucauuucuuuccugauucccuuuaaccugccaccuucucugcucucaagacaacacagaaggaaaucuaugaugucuuagcacaggcucugccaaacgcucaucggcagguguuugacaaaaggcccucccugcauccugacaacccaagccgugaaagacagacgcgccugucuuugacaugagaucugugcggcgagcucucaauccguucugaggcuaccuggaugacaaauggaucuuggcuggccagggggcaggaggugucacaucuccuuuaacuaacaaguaauauguccaaaaguaauuguuaaagaaaaaaauugucucccaguuagaaaauauggucaaauacacuuucaaguauuaccucuuuuuuccccucaaacuguaaauaaguagaggugagaagaugaacugccugccaccaaagcggaggauggguugaaauuuuguuuuuuauugagacugccucugcucuuauugaagagaggcaguuuccugucugguucagggggcuucaccaggaaaugaugcuauuugggacuguaaguccaaguauucugaaacuaggagaaaagaaaaacaacuuuucccuauauuucacagagggaaggggccucucccccucagccauucucaauucaauaguucaguaaaauucauccacaguuuuucuuaucucaagaccucucaaaucacaaaaggaccagaaggugagcguuaaucaaauuauuuguguguuuccugauuuuuauaaacagcauaaauguuucauugucagugcuagggacagacucaaccucaucccucuuuaaaauguaaaggagaaucccuacagccaaugauuauccaaaaaaguaacacguucuugauuguuccuugacugauuccuuuuuaucaccuuccucuggagccaacugucucacugccaagagcauggggaaaucagaacuaaauuagcuggaggaauuaacaacccaaauugccauuggugccuccucuucaaacuccuaucuuggcuauuugucuuccuagacucccacucuucugggaaagguggaaaauucucagggucagauaugaaucaccacggggugggagacuucaccaaggcuggaugccauauugacccucaggagaggcagguacaggcuggcacuacagggcuggagcuuggagaguugcagagugggugcacaacaccagagucagaggcagggucagggaaagaugcuaaaauccaaguggacaagaguuugucuugugcuuuuggucagucugcagcaaagacaacagaaacauacaaggcguggaaauugguggucuggugaauuuccuuacauggugacugauuauuccaggucucugcccccauggacacacuuuguuccuacaugcauugccacugucugucacagugauggguguucaaaagcauuuguugaauaaaugaaugguaggcucuuugugcaaagaaaauuggacucuucuguguggacucuacaaacuaauagucuacacuguuacuauagacuguuacacuaacugcaucugacucaaugaauuugaauuagucaauucaacaguucugagcauuugggggaggguuuaauuuacaauccauucagaagauuuuucagugauugugcuggcaauugcugccacuuuuccccauuuugaguccuuuugacaauguucaugcuugccuccuccagcaaaagcacuaauaaaggagaguuauaaagaugcagucacagaggugaggagaguugagaaagugacaagggcaaaggcaagcacgacaccaaagcguguuuucuucuggagucaucugaguggcaggucucgaagcucuaaguauagagaccagagcagugagaaaaggacugagugacaguguuagugugaugcagagauaagaauacaaauuugggaggcacagaaccuuugguucaaauuccagcucugggaccuagggcagaugauuuaacuuuuugugccuccauuuucucaucuguagagugggugcaauaguagaaaccaccuccguagguaauggguauuaaaugggcugaaacaugcagaguucacacauaguuauuugauacauuuguuauaauaauuauuauugccacuuaguauguuauuaaguauaaggaacacacugauuuacucacagcacuggagagggagaguaagaauacaguaaauuagcacaaugauuaugguuggaugccaauucagagacacagaaaaaaauaaaauguguaucuuccaaaagcagaaauaagacauuuaaucucuuugagccuaagcuuuuaugucugcucacagggcaguucugaacgucaucugcgcuagcauuucauagcacgguggcugacaaaaugcaucuucuuuucuugugucccucccuccucucauuuuuuuccuucugggaggacaaagacuagaagguugaaggugcuaugcaagccucacagggagccuugaccuuguaccuacauuagguuugcaagaaaaggaaaagagucuagcuggucagccacagacagugggcaaggcuagcccugccucauggugccugccaccugcucugcucacgccuucuccccucggcuugggucuucccggugugguuccaccugcaugaaggccagcaguggaguacccauaguggguugccagagaagagcaccccaacauggaagacggcaggggugaccccuccugaaauaugugugucagacgagggccaccacuaugcugacccgccuaguacaugucuuuaccuucuuaguccugcugccuuaaaagagcucccucagccuacuuucugaggaugcucaucagcccagaaggcuuuuguuaaauaugucuuugccuagcuggaauuacggaaaacagaaacacacccacccacauauauuucuguaacacacacacagugcucguucugugccaggcacgaagugucucagaaauagugacucauuuacuccucauaacaaaacuaugcaguaaaaacuauaauuaucccauauuuauaguaaaauaaaggcauaaagagguuaauaacuugcccggugucacaagcuugcaagaggaggggucaggauuugaacccaggccuucugacuccagaaucuuggcuuuuaaacacccugauauucuacuuuaaaagcacaaauaaccccaccaaccccauuauaacaggccccgcuaauuacuuucccuccuucugaucccuuccaaucccagugaagaaucacugcauucucagagaguucuuacaccaaaagcccauaaacaaagauggcacauauuuagauaacauauauuaacgggauaaggaaaaauauagaugugaauaucgagaccaagggcugacauguuaaaaagggaaguagggagacacaaaaggcauuuccggucguuuugaugacaacauggcgcugguauaucauggggcagggccaggaauccuggauacccuacagugugcaguacaaagacguguacagccccagaugcuaauggugccugagucaggugacacagggcaugaccugaagaugaaaacgaaccaccagaaagaacaagagucccucccuugccaccgagaaguaaugcucuaaugucuccagcuggcuggugugagcaggaaucauccuuuggguaggguggggauguuggaagguuccccugcgguacccuucagcacacgauaaccugucugcugcagaauccacaaacugccccgggauugucagaagguucacuaaugagcuguggugaggcuggauaaagcuuucaaacgaaugauguuuguaaaauuauauuaauaacaaugcucuaucccaguggggaacagaauuauuccuaggguuuaugcugugguuuguaaaaugcuacagcugcaaauggaugaaacaugcagccuaaaccugcagugggauuguuugcaggcugagauuuaaaagaccucuccauuugugaccuccgacccaguaauuccacuucuagaacuccaaguaugucaaaagaaggaaaaagagccaugcagaaagauguucaucucagcauuauuuaucaaagcaaagaacuggauaccacccaaaggcugaguaauaagggggauguuaagcaaacuuugguacaacuauaugaugaagugcuuccagccaauuaaaaaaaaaaccccuaccaagaguuuucaacaauacgaggaaaucguucugcauaguguuaaguaaaaccacaggauacaaaauuaugucaccugaccuuugacucagaaaucccaucuguccuacaaaauuaaaaccagcaguauauaauaacauauauugcuguaguauucauaagggcuaaaacaacaauaauaucaaaauugaaaagaaauggaaugcccauaaacagaggaaugauugauuuaauuagggcuacuccacagcacagagcaguaugcaagcauuuuuaaaaauuuuuguuugaucuauacguguuccguaugucuugaccaaauaaagcaaguuuuaaaauaauggacaaaauauuacgcuauuaagucacauacauuccacuccuauagugcauguauaaucugcauguuugcacggucacagaagguccaaaauugccacuuagcaaagggaagagguagagcauaaauuacgagcguuuucuucuuauauauucauauuguuugacuuauuuaaaugagcauguauuaacuuaauaauguaaaaaaucuaauacgcuaaaaaaucagacauacaauaugaucucaacuguauuaaaaugcaugugccuggaauagggaaaaagaccagacacaaauguccuuguauguagcagugguuauuauuaaguauuggaauuagaaacaguagcaauuuugucaagguuucuugcauuuuccuaguuuuucauuuuguauaucuauauuagguuucuauucagaguggauaaauggauugaugaauggauggauggauggauagaugaauagauauacacagacagauagacagggagacaagaaaggaaugaagaaauggagggagggagggagaaagagagagagaagagagagaaagaagaagagaaaaagaaagaagcaaauuaagcaauugaaugaaugacugaccuuccuuuucucuuuccacuucuucaggguuucuaagguuccuauuuccccaauuccuccugccccuaucuccuucccacauuugaggguccacaaggaggcucacgaagacacacagcugagccugguuacagaggcagcaccaucaccaccccaggcuuuauguccauuuuauaaugggugaaacccucuggaauuaauaucugaugaagaaauaaaccuguuaacggauagauuuauaguauucaaaucacuauugauccauucaguacacaacuaauaaaaagcuuccuugcgugaccuuccaccuugugcacacuuaagcaaauuaucuguaauaaacaaguauuauaaggacccaaggaaaaugucagccuauaaauuacugaucucucucucucuccuucuuugucuggaacuagaaguuaggcaccagcgucguuuugauguacccgugaccaagacucuggauuccccagagucucuucuaacauagcaaagauucuuucuuguugaacugggcaaaagugcacaauagaaucucucaaaaagcaacucaguggaaaccucaagacaacaaccaucuucuaugggauaaggggaaaaaaaaaaccuggucuaggaauccaguaacauggacuuaagucuuguauguaaacuucaucaccuguguguccuuggacaagucacuucacaucuaugcuguaauuccaaccuaaaucaaauguguucauaggguacuuagacucauuugguuaaguuccaugacagcugcugaaauguuuaaaaacagcuuauacaucuccauuacacaucccaaggaguuaagggauucaagguugagaucuuucaguccuuucccauucaaacaucuacuggauucacugagccuggccauacccaacuaaagaaggaucugguaaagaaagaucagguaauagauuuccaguggcucaaauacaauggaagggaagcucugcuccacauggucacucaaggaaccagccagaagcuacauugcuuuccacaccuagauucuaacaucauucugaauguugccuucauuuuagcuaggcugaaggaaaaacaaaaacaaaagcaugaaggauugcauguuugcagguuuucccuugguucggacuggagcugccaggcgucacauacugcauuaguuaggauuccauuaguuggucaggcauuacugcuggggaggguggaaaguguacccaagaagucugccuaggaauaaggcgugauuugcuaagaguaccucucauggcugguuucagaggaaacauaaaaauggaaaaauguuguaaucgguuuuuauguucauucaccacccugguccaagucaaguaagcauugcuuaccuggcauuuagacacguuguuuuacaucucugaguuuaaugcuacacuuuuggaagacaggacuuuuaauuaugucccuuccagguuuugugaguuuaaaugagaugaugaguuucugguaguucccccauguguccuuagcaggaccuugguccccuaacucuugaccuccaggcucacagaauauugcugaggcagggccagguuuagcacaguagacugauucuucucacugcugcauuuaccuugcaggaguaugauaaacucacauuucccuagaagguccugcauagucaaugggaaauauaauacucagucuucuaacuaaacagcucucugugccaccaugaaguuauuucuuaagugaaguacuucaagauauauuaaacaaaaaaaauuguuucuauuauucaaaagaaagcaaagaggaaaaaaauuguaguuggaaacugucauaaaauuagucgaccaaacguuuuugguaauauucucccauccaggaagagcauuagguaggcacaucccauaccuuuggaagacaagagcuacuuaaaaauggacuacggauucuucgaagauuggagagaugaaauuuuuaauauguaaaacaggaaucaggcugggugugguggcucucaacuguaauucuagcacuuugagaggucgaggcgggaggaucacuugagcucaggaguuugagaccagccuggacaacacagugagaccuugucucuacaaaaaauuuagaaaauuagccaggcaugguggugcucaccugucauccagcuacucggguggcuaaggcaagaagacugcuugaucccaggagguugaagcuguagugagcugugaccgcaccacugcacuccagccugggugacacagugagacccuaucucaaucaauaauauuaacuaauuaauaaaacagggaucagcaaacugcagcccaugggucaaauccugcccacuguuuuuuguuuuuuguaaauaaaacuauuagcaaauagucacuuguucauuuguguauuguccaugguuguuuugcacuaugauagugcuauggucugaagguuugcauccucaaaaaauucaagcguugaaaaggaaucuccaaugugauaauauuagaagauagggccuuugaaaggugauuagaucacaagaguggauuugugccuuucuaaaagaagccccagagagcugcuuuauccccucccacuaaguugacacagcaagaagucaucaucuaugagccagggaacgagcccucaacagaagcugaaucugccguugcuuugcucuuggacuucccaggcuccagaacuuuaagaauuacauuucuguuauuuauaagcuaccuaguuuaugguaucuguuauagcagccugaacaaaguaaggaaaaugguaacauuuaguacuuuugacacaggcccuaugguccacaaagccuaaaauauuuacuaucugucccuuuucagaaagucugcugacccuuuuuguaaaagaauaaguaaggcugggacuacugaauauggcucaaauguaagugccaagcaugagccagaacugaacacacauugagaaaccuuaguccaaauaaaguggguuuucagcugaugcucccacuuuuuucccccacuccaucacccauuuucaaauaaaagagccggugaauugauuagagacaagagaauuauugaaagcuggaaggagagggauuugagggaucuguaaugaccccauaaaagcuuuguuggguugcuuuuaugagccugaccauaagagguuagcggaaguguguaaaagccuugccuuuuggauaaaugcauauccaaacccagccacggagggagaguggaaaaaagggaaauaaaugacaaguacaguacuuuaacagggaaaauuuccuccgaaacgaagcgagcaaugaggccaggcgaggaauaaaugguguagaaaugacagucgcuuuucagucggccacaacggcacucgcggcugauaagauccagcaugugucaguugccacgucucucuuuucacacuucaaugugaacuucacagcaaaaggggaaccggaggcagcgaaggggaaaacagugccucagaaggacuugugcacugagugugaagccauuucaauuuuauauucgaaaggacuuuguaggugaucccaugaaugcaauuaugcccaccuaauaaaagcaacauaugcuaagacaauuaaaagauuuuauuauacaucuauucauuguacuccauuuucagcaggagggguggaaacugaugagagggaaagggugcauuucacaggaaggggagccaaagucggccuggauuaugccaguggggaaauaaauggaugaugauauacuuuucaaauaaagaugaauuacuauauuacucuuuuccaggggucuuuuugccuuacaaaugccaaggcucagguuuccuaugacucuauauuaugagaaaauacagcugaacauaccacuaugccuccuuaaagcccucgguguuuuguauucuaucauaaaaugaagaccuccaaacuaugccagaaagaaaaagacauguccauagauucaaaguuuaaugacaugaagacacacagacaucaguuuaacuuucucacauccauacauucuauguauauuuaucagggaccaaagagaagacucaaguuuauaccagagacugcagaugcuaauggggagaaaacuguguguauccucaaguagcuccugugacagacugccagcuucuuaacaaaaauccauuugcucuucuuccugagcaaagggcuagaggauauuugacauccuacuuuucagugggagauagccaugugacuagugcuuaccaauagaaugagguuaaggcugguaagaaauaccagaugacuggaugcagauaucagcagggagaauggaaccacuaaguggcugcagccuggaucccugagucacuuuguggaacguagcugccauuggccaggacuacccacuuauguugcuuucuguguuagaaaucccccuuuggggguuucagcuauaaugcauuuugggggcuauuucuuacuguagcucagccuauccuaacuaauacauuugcaacacaggugugcaaacaauccauauaggggucacuucaaacuguaacagcugcucuaaugugcagcuuagggaauggagacaaagggaaaauccaguuucauagagcagguaacauuucugcuaaaauucaaaggcaugaagcuaaggaauuugacaggcaaggguggaggcaggaauggaacucagguagagauuacagcaugaccaaaagcucagaggugugaaaggauguggcuguuagugcaaucaugaguaauuaggggaguggggagcaggaugugugggaggaaggagugagacaaaaagggcacauugggaccaaacagaguuggagcucccaugggaauguguaagucguaugaguaacucugaaaggaucuuuuuuguuaaacaucggugccaggacacagaacaggcacacaggccugccucuaaugcuaacauccuucaucagaaucagagcacguccucaucacagcugaguuagacacaguccauggaaggucaggagcccuaugaacuaccuacauuuuccacucccugggauucuuucacccaggaaugaagaucaaaacaaggacaagugagaaaucuaccuaguaauauccacggagcuaaucacagacacagauugucacgugauuccugcuaaagagagucagacugaccagagccacagcuuuguggccgaccugguggccauguguaaacaugaacaaagcucauccaaaauauauuuaaaacccacacccagaagucuuagauaccuuacaguaagugaaaaggucagucuuuaagcuccagaguauauaggcuuucuuauguugaauaaaguuggauuucaaacugaucuguaacauuucaucacugagaagcacuucagcaauuuucaaaugccuucguucaauucaagcaacuagaaugaggcauauuaaaaauuagcgccauuaaggcagaguuguucaacuuuuauggggucauagcuagacccaguagguugccccaaaucccaaacacuagagaagugaucugcacaguugaugugguuguacuggcagagauuggugggauaaugagagggagguuagaaguuaauaagacacgguaugcugagggagagaacgcgugcauguugauauaagacacauccagguaagaauaccaaguccucaggguuacugcuaauauuagauggaauacauuuugcaaaaugacaaccauuuaugcaagauggcaucuaguaaaggcucaauaagugaagcuacuuuauucaucaucuuuuuacucuuaauuaguauuaauauuucuguuaaaguuaucaaauauauacuuauuagcuucuaaaauuaaccaugaguacugcucacucauauucuaaaagaaccaucuaggcuucauuucaccucagugcuuagggcggacauagaaauucacuggacaucagucccucuuaauuuuuguuuuugagauggaguuucacucuuguugcccaggcuggagugcaauggugcgaucucggcucacugaaaccucugucucccagguucaagugauuuuccugccucaggcccagaguagcugggauuauaggcaugcgccaccacgccuggcuaauuuuuguauuuuuaguagagacgggguuucacuauguuggucaagcuaaucucaaacuccugaccucaggugauccaccugccucagccucccaaagagcugggauuacaggcgugagccaccacacccggcuagucccuucuuaaucuugaaggauuugcuguaacuugucuggccaaggcacuaauuauuguauuugggggaaaagauaauuuuucaguaacugccugacagguaaggaaacagaaacaaaguguacagcauugguggccaagaggcauuugccacugaaaacugggcugagggaagcuugcuuuaucaaccugucuacaauacgugucccgguaucgucacuaaccugccucucaggaccuuucacucuacaaagccaugggaaccaagcccucacaagaucaaggucaaauaaacauucugacuguaugugagcaccacuuacaauugcguaucuugaaaauacaguauccugccaguuuauaagcugccacagauuucacuagggaggcauuuuaaguuagacauuuucaaauucuaaaggcugugcaacacauuaaacacuuugaaaagugaaaaaaaguaucuauguagauaauauaucacccaccguccucucccccauccaucuuucuuuuaauauaguucuagucagagaguaucucucauuuugaaccccacuuugucauuaaaccuuuuaucauaaguauuuuuuccaacugucauuuuauuuuaguggcuaccuaguauuccauuaagugaauauacuaugauuuauggaaucauucaccugcuguugaaccuucagguugauucuaagguuucacuagguggguuuuuuuuuuuucuucaaauuuuucaagagaaaggcuuuauuugauaggaaauaguuauuuccaguggcuuugacugugaguguugugagcuacagucucuuuuuguguggcugaagacuuaucaagggaaacugcuucucaggccaucagaagccaccaguucaacugcuugcuuagaaccacagugagcuucuggucccagucucugccuguuugcucacuugggucaugcacgugggugugugaaagagacccaugugggccauccuaagaaucacauaucugcaccaauggguuacugaguuguaccccaaacauacaaaguguuuuuacgucucuaagauggcacauggcacauggcacauggacaugcaggguucccuuccuguggaaugugccacucucacaccccucaggaggcccaggaggggagcaggugaugugaaccgaaaggguucacucugcagugacguagaugccuauggacacaggcccagagacaugggcacacaugugugucaaaugugauuaacaauggauuuuauguugggaaagauucuucugcagagaauccuggaggucuuuccaaugcaaugaaauggauucacagaggcauuuauuuacuuauuuagagauggggucuugcucugucacacagccuggagugcaguggcaccaucaugguucacugcagccuugacgucccaggcucaagcaaucuuccugccucagcccccugaguagcugggacuacaggcgcacaccacuacaccuggcauuuuuuuuuuuuucuuuuugcagguagucuauauugcccugacuggucucaaacuucuaggcucaagugauccucucaucuuggccucccagagugcuggaauuacaggcgugagccaccauaacuggccgugaaggcauuuagguuacaauuuuauauuuccauggccuuuuuacacacacacauacgugcgcgugcacacaaacaaaaaaacaccucacaguuugucuuugccauugguagugagaucaccagauuccgagggagggcaaaaacacacuccuaaagaggcuccacagguucuuucccagaguagacaugcuggaugcaauucaugcagccacucagugaggaggagcaaacauuuauguagggccuacucugagccagacacagggcucgggacuacagguaccaagauaagugguugcugcucuugaguuugcagcccagagcagaaacacaaggcauugaagugacucagauacagguuuaaaagggcugccugcucugaaaucauggaucuuugaccaaaucugaaguccgcgcuuccugcacgaaagcagcugcauuuaauacauuccuacgugccaagugccaugcaaagcugugggauauacacaguuccugcucccuaaggcucagugccaaguggggaaauaaaacaagggcauuauuuuggauauaauuaaggaaaugagagaaguucauggggcguacaacuaaccaccaggaacccaagaaaauguaguuccuggccuccaccugcuacauggugacagaggacagucacgugcuaacacaggggaggaucccaacuugcccucgcuccacaggcuucugcaggagcuccguguuccugagagucaggaugaccugucugacucauggcaaacugccaacugcaucugaaacccaagcuuaugcguauaucgaaaugcaggaagccaucuuaaaaggaugcacuaauuagcuuccugggauuucagauuuuaaaagcuucugugaucauauuuguuuugguaauuuuuuuuuuuauugaaaaggauuccgaagauugauucugcugucaggacaucagaaaacaaaacaaacaaaaaauaagacaaugaacuuuacucguuuccauagcgaagugcuuucaacgugaaugaagaaagaacaucugcugauuggaugauaaaaaagcaaaauggcauuaaaaggccaugaugcacagugaagaaccagucucccuuggguggcuggacucaacacugagauacucuugaagagcauuuguaagcccacugugaaaucagcacccacuguuaggggaccugggggcuaccauucuuauuucaaauuaaaacagcagcaaaaaaggaauguuuaaauucuggguagcaaacugaugugaaagaugacaccgacaaaaaacuucuuauaaaccaccaaccacuguuuucauuaaaaauggagagagcuaauaauggaaaggguguauaugauaauuauauuuguucagugugggaaauaaauaacaacuauagugcuacacuauuaagagaguauguaaucauguuauuagauauguccuauaauugaaagccauuaucagaauacuuccuuauagaguuaauuccuccucugagcaaccccuaaaccucgucuacauuuuccccgggugucccuauguuguaauuaucugucgcuaugugugucucccaagucagugugugauauccaaggcaacuccugcaagcauuccaucccucucacucucacgugccuagcacugggucagcaaauaaucaccacugaauaaacauaguuccucuuaaaguucacuucucuaggcugacuaauccuuuggucuauucuuggaaacauuucccaacaucucacauuuuucuuagauuggggagugugcaugcaggaauauuuagauaagucaauguauuaaaaauuuguaggcaaggcacuaauaaucagcacacaggaauccacgaagguuuggccaaaguugaugaagaaucacgagcuaucacccucaaaccuggaaagaccucaucuccugcuuaaauuucuuuaaaaaaggaugaccuugcaaauuaccuccuuguaaauguaacuucuaaauuuagaaacauacagaaaaagaaaaaaaaaucaugaauugagcuugcaacaucuuaaagagcgcauuuacuguaaaaaaaaauagaaguaacucuugacugugaaagugaguuccauuuuuuaauuugugugguuuaaguaaaaaauuuuuauuuucuacaauagaaucaagcaaucauuugcuccuagagaaguaauuuacagucagauuucauuuucuuaaucuggcauaauuuaggguaugaaacucauugauuuaugagagugguaccauuuuuaauccaaagauaacauuaaguggucuuaacaguuguauugcaggaugcucccuauaagaaaauguauuaggaggcaaaagaggaaagugcuucuggagucagaccugggucaaauuccaucuuugcuacuuccuagcugggggaccuugcauagaucacguagcuucucugauccucuauuuccucaacuauaaauuggagaugacacuaucaguuuuguggugaggauuaaaugagaugauguuuguaaggagaaaugugcaaaaggaacauaggacauucuaccgggaaucauuuccacuggaaaaacaugguuagacuggguuauugaaggacaugauagcaacuuuuccagagaugaugaaaaauacuccuguauuuucaccagacauguuaggagauccuaacuuguuugagcugguuggcgcucauuauaaaaucuccuuuuaggagggguaaugaagguguccuaaagauugcaaugcccugcaggagagcacccaagccuggucaacagagccaguucugcugagccacugugcauggccaucaacauagaggguuguuuuuuuccaucuugauuucugggcccaucaagcccgcuguaagaacuucccugcaauacagcaaucucaaaccagacuuuucccacuauuuagagucaggaaaaacgucuggggaggaaaaggguagucccuagagugacaaaaggaggcuguggcaagguugggcacuggcgaucccagccauccugcccacccacccauuuggcagguccauucuaaacugcaauuugucuuggacaaccuaccuuccuaguuguugguuagggcuugugccaucauuucugucuuuagcuauuugugugaagcaggaagcacauucucaaaauuccucuuccccauccuugauucugggugcuggggacuuuacccuggcuuuaaaaggacagccaggagguggcugaaaggaaaugcaaaaaaggcuuacaggcccagcuuuuaagaauuccaagaauagugcucagugagacccucugcagcugcagggaagcacugcauuucuccaaguuccuccaacuugcagaugaagacgugacaggcagccacgcaguuguugugguuuaugcagucauggcccucuggggcuugaucuugugaucaaaguccuuugugcuuucuaacacaucacaagucucagacauuugaugugcuaaaaacaaacuacugucuagagucagaaaaaccuggagccaaaugccccugucucugaaaugggagacuuuggacauguuauuuaauguuucaagucuugguuuccuccucucuaccaugggccaaauuuguugacuuuucagaauugugaaguggaggauuaagugggaucauguuuauaaaacagcuagcacacgccuugcccguauuaauuuguaucuaauagauucuccauaacuuucacuuuaaaggggugaaaagauuuuuaaggaagcuccggaaucaagauuuuuacagugggccaguuuucaaagugagauaguuuguauaaggaaaaccuuuaacuuucuaaagggauuuuucccaugcaaaaguuuuuuguuuuaaaaaauguuaaggaacucgaggccacagcugauggagguguggagagagugaauucuggucucaacuggaucucagcuggauacaaacaagcuccgggaucuugggaaacuggaaugacuuuccugggacuugguuuaccccucccccuugcccagcuuuccuccucuucccugaggggcuucacaaaagccagguaagagccuagaggugaaaguaccuggaaauucuagucgacaaguguagauggcauaauuaucacucucuugccucccuccacauuucuaggccccccauugucccuuccuggguaauauggagcuucagaggugugggcagggaggcggggagagacugaaauaacagggacuggaugccugccagauauuucaguugcacaugcacaacuugaguaagucccuggggguugauuauaguuaccugagaacacuccuuaacucuuucugcagaaaugaacuuaaugaaaagccuagugccuuagaacacauccagaaguauuaaaagcagagauuuucuguaaaaugguacaggcagccacuguggauagcaguuugucaguucaucaaaaaguuaaaccuagacugaucauaugacccagcaauuccaccccuaaguauauacccaagaaaagugagaacauguccacacagaaacuuguauacaaauguuuauggcaacacaagucauuauaccuagaaggcggaaacaacccaaauguccaucaauggaugaacagauaaacaagaugugguauauccaugcaguggaauacuaugcagccauaaaaaagaauaaaguacugacacaugccacaacuuagacaagccuuggaaacagcaugcuaagugaacggagcuagacacaaaaggucacauauucuuugauuccuuuuaugugguauacccagaauaggcaaauccacagagaccaaaagcagagaaguuggaagaagggaauggggcagugaugacuuuauguguaugcuuuucuggggugaugacaaaguuuugaaacuaaaaagaggugacgguggcauaacacugaguucacuaaaugccacugaaguguacacuuuaaaaugguuaacuguauauuacgugaauuucaucucaacuaaaacaauguuugcagggaaacgaaacaaaacaaggauacaaggguuuuugaagucauuguggccugaauuugaaucucaucucugucuuauuugacuuggauaaccuugggcaagugacuugggcacugugggcauucgcuucgcugccuuaagcugaugggaauuacgaugcguggaggccauggagcauuccaggagacucuggaagcaaaacaucuagugcaggucagugcaugauggacacaccagagaugccagcuccuuaccucccauuccuucacuaaaugucucccugucuccaaggucagagccaucugagcccucagugucauggagggaaacuacacacuacagaaaaaaaccaaauacuaagaauaauauaauaaucacacuuauacucaccacucagaaguuauuagcauuuuggaauuguuagcauuuugucauauuugcuucuuugcuaauuuuuuaaaauagugaaauaaaauauuucugauggccgggcauggugguucaugccuguuaucccagcauuuugggaggccgagguggguggauugcucgagcacaugaguuccagaucagcuuggccaacauggcaaaaccccgucucuaauaaaauacaaaaaaauuagccggccgugguagcacacaccuguaaucacagcuacucaggaggcugacgcaugagaauuguuugaaccugggagguggagguugcagagaguagagaucaggccaugcacuccagccuggaugacacagcaaggcucugucucaaaaaaaaauaauuauuauauauaugaugaaguugaaauuuaccgaguguuguauacuuagcuuaaugucucuucugaacaaauaagcaaguucacuaaagaauuaauacauggaaaaauaguuuauuuguucaacuggucuuuauucagggccuacuauuaacaagauauauacuaaagaaugcaaacacaguguuaaagagcuucauuguaaugaauaaucugagcaggugcuggaagugguaguucagcggucuugagggacaguagucaccaugugccuugguuagcucauucuauuaaaugaaauugguaguuugcuuccuaaacuuggauugcaguuaaccagcacaacucgaaaaauaagucuaccugacauagucaauucaauuguuagcuaccuaacaauugugcuguuaggaaauguugaaaaugcggacuacugcccguauggugugguucugaacucucguugaaaaauaggauggucuaugaaaguacacaguggcucugugacaaaggagggaggauuuaucauuggaaugaacuaaagaggaggcaaaagggaagaaaagcugcaaacuaagaaggauuuaaaacacaaucuuugugguggaaauaauguaauuccauccuccugugucagagaaauuaaggccuggaaaagcccuggcugaaacacccagguugcugaguugggagugaggggaaugagguggggaggcaacucagugcucugccuccagaagugauugaagucaauuucuuuauaauuucauguuuuccuaaaaacaagaugauuuguuugcacuauuaaaaaaagucaagaauggacuucggcaauaccccaacuugucugaagacuacgcugggagguaaagcuggucuaugcugcugggacgcagccuuuuuaaaggagaucacuguaccugaaaugcagauaguuaugaaaaugacauuaauuugcuuagaccgaaagauuuucacaggagagcaacuaccagaaaacauuaugaaaaugucugagagggcugguaauugaguugauuaguaugaccuugguuaugaagguaauagaagagggacgggugcuuagacugaguuauaacccuguucccgguucggcgaccgagugagggauguaauuuguucaggcugacucggagaagccaagccugccugugacaaaguaaugcuuugacuagccgagcuuggccugugcuuuucacccugacagaguaaacaggacagagucaaauaagaaaucauggacuggguuugugugcuacuucucugcguaaaaccagcuguaggcagaaucuucuggacaaugaguccugagaagcacgcuuucacugccucugaacuagcaaagagggaacagaauacaacugcaccccagcugaaacaacacaaaacaaaacaccaacauaaacaaagaauaaacaucccaaggaggucuaugcugaauuugcucugauucuauuuuucguauuuuuuuauagacauuuaugaagcaauaugcuaccggcugcagugggaaauuuagcugcauuaaucauaagaaaggauuccaugucuggcucuaaagcccauguuguuuccacgacaccugcuucaaacaggcaaguuucccucuguaacauauacgcacccaugugugcacacacacaugaaauugaccuccgcaauggcaaggucauuggaugccggaagccguuaccaugaguauaugaggucacuagcauuguaacuacuucuacaaaaguucauguccagggagauuuaucuaguuuuuuuuuuuuuuuuccuucguuuuaaucugugaagaccuuccauaucaaguuuacccuaggaaagagaucuuacauggaacguaggauaagugauacuucagaaacaacuaugguccucccagagacccucaaauagagguuaaaagucuauacauaaggguguggaacauuuuacacuuacuguuuauacaugaauuagagaguuguacugggugaauaacaacaggguaucuuuaugcacacuuugccucuucucugugguguguggguuugccugguuuguguuuguguguguauuuguagguuuuaugagucuccgauuucagggcuggugcuacauaaaugacaaagggcccugaaucccuugucuccuugccucugucacugaguuugcugacccucuagugaaaaggaucugaccaccacaugcgaguggaauaaauuaucgcugacacuccaguauuuaauuaugcagcugucagagcggcccuuucgaaauucauuuuaauaaagugggaacuuucccuuucaagguuagagugaggggagucaccuuuggugucagccggaggucuccaccaugagcucugcauucuugcucuggacgccugucacuuggccugauagaagguccugauaacagcgcugaugccugguggccuccccccauccccccaucccugccugaaugaacauccuucauuuaaacccacaauaaugaggaccucaaagucagagaggcgggcacaagggcagccugucggggaaaaaauggcuucuuauuauaaaauucacucaauguggaaguggcaaucuaaaagcaaucauggccaucuccccguuuuaacugguuaaccagcaacauuucacaugguggaaggaaaaaaacaaacucugagcuaaguggcgugguagugguggggcauccagacacuggcaagccucaauugcuguagcucccaaacacgucaaacagacaugaaaguauugauuuauauuuuucuauaaaauaaaaagcaguauuaaaguuuuuguagccuuguuucugggccauaaaguggcaccgaggaaaagcuuuuauauggcaaacugaaugggugaacgcgaucacgccugccuauuauguauaugccuaaagucuauguuuagcuuauacuucucacuguuuauuugcaaaccaugcccacagacacccugcagagggaaaaccgugggcugggcuagaaacggcagaagcaacucgacagauacagccagaucaguuccuuuuuuuuuuuuuccaauucucuuccuuacuguugcuuucacuuucucucuuuucccccucugaccuuauucucucucucuuuuuuuuuuuuuuuuuuuuuugagguggaguuuugcucguugcccaggccagagugcaauggcacgaucucagcucacugcaaccuccgccucccaguuccagugauucuccugccucagccucaaaaguggcugggauuacaggcaugcaccacuaugccaggcuaauuuuguauguuuaguagagauggcguuucuccauuuugggcaggcuagucuugaacuccuggcuucaggugauccacccccuucggccucccaaagugcugggauuacaggugugagccaccaugcccggccuuucucuaacaucaugaugaauaugcauugauuacugacugugugcaaggcacuguccaaaguuuucuguaugcuuaucucuuauagagcucagaguaacuucauaaauuaggcgccuuaaugacgauuccuacuucuacuaaacugaggcucagggagacuaaugggcuuccucaagaccccccaguuaguacauagcuccaccacgcaguuuucaaugcuuggauguuuaaccacccugcuaauguuuauuucuuuucucuuucucuggucucuuucucacuaagccuauuccucacuuucuucccuccucccaaucucucccuccuagguuuguauacacagugucucccccagcauauauaacagcuccaaguaaacacacacaaugagccaucuccugcacacaaaugucgcuugucaacaaacacugguuugacaaagaggccucauccuguguguuuggauaaaugccugaaagaauacuugcaugugacuguugaaaggcgcuuucucuaaaccauaagcaauaacuaaaucuauccauaaggacuuuuucugggggacaacauucucuucccagagaugggaaagaugguugcugagaugaauuacagagcaacaggaggcagagagcaacaccuuugcuuuggcuuagaagcucucugggaagacaugguuugcagaagguuggggaaggaccuccagauccaccugaagucucuacuggcucccccagcacagcuuccagggcagcaaauuugcaggaugcccuuuugucucaauucuugagccucugaauggggacucaggaaggcggugaacacaggaccuuggcaugaucuguugagagcauaaggaugaaagcagaagacaugguccaagggcaaacuguuugcaucucccaaggccugaucuuuauuguccugucccuaaggucuccgccccaaggguaucccugugucuucagggcuagagguaacugaggccuuccaugacuuucuauguuuaccaucaauguugccuacuagaggaacaccaguggcaucaggacagcugagagucagcauccuaccuacggaauccagaagaagccccuaacuugaaucaggcaaccagggacaagagagaguauuacaaccugugcacguaacucuggucugcguggccuuaacuccaaacuugcaaggcaggaaacuguacuuugaagaaguaaauuccgccuuagagccccagaaucugucacagaggcagacuuccgugaugacuuacugaaagaauggcugaacgaaugauacauaccagcaucucaucaacccaaaggcaaauauaaaaauaucucuugggccaagaaaacacuugugcaaaaccaggcacccuuuacucacagguaggaacacucaguaaaaaaucagguaaugauucaggggguagccagugaccaauucaauaacuacccguaacuucaagcuauccaagaaaaggacagaucugggagacagguguccugguucugguccuggccacugccaauuuacugagacacucuguguagguggauuccuaucuccaggcuucucuuggccuuuccaaggccugggagggaaaauuaaagccucauauuuccccucaaagaaacaaauccaagacaguccagggaggugacagaaaaagcauuucuuaaagugaaaaaaucucaaccacgugagguggcucaugucuguaaucccagcacuuuggcaggccaaggcggguggauugcuugaggucacgaguuugagaccagccuggccaacauggugaaaccccaucucuacuaaaaauacaaaaacuagccgggcauggugguggguguaaucccagcuacucgggaagcugaggcaggggaaucgcuugaauccgggagacagcagcuacagugagccaagaucacgccacugcacuccagccugggcaauggaacaagacccuguccugaaaacaauaaaaaauaaaaagugaaaaaacuuagacauaacuuauucagaaacauuuucauuuccucucuucucuccuucucuccccuacuccuccucucucuuuagucaguauucaucgggugcuuauuuuaugugucaagcuuaugcuguggacuuuucauuucauccuuaacaacaaccuuaggugggaugaagggaguacaaugacguccauccuagagauaagcugaggcuuaggaggugaggagccagcacaaggucauuuagcugggaaaagacagagggaggauuugaaaccaccuucacuugccugugugcacucaaaugucaugucauauuuuuaccaaauauauugguacuugucuuugccuucuauccuggaagugaguccagaauugccuuaucuaauccauggcaaaccuauuucaugaggucuguguuaaacaauaccuagagguguuugugcggaaaagugaucuccuauaucagcaguguugccauagucagaguaauggaaauuguaguauaaucccagcaacauuauugaaccaaacaaggugccaggaaacgugcuacauuauauauagcauguauacacauauauguacauauguguaucagaauauauguauuguauguguauauguauauguguauguacacaauuuauguaugugugcguguauacguacacacaugcaucuauacaugucuacauauacacagaacauauacauauauguacacacagacauaugaaugcacaaaucacauuuuuuucucuaaucugcaccauuacuacuguucccauuuuaucacuaaaucgauggaauucagcuaaguaucugccaagauuguaugggacgugaucagugagccgagugugggcugcagaucugcuugacccauaccucuucaaaaaaagaauaaaugaaauaaaauaaaacaaaauaaaaugcauccauaaugccuccacuucaccucagaauuuauaugacacuuucaaguagguuacaucauuguauuuaauccuuagagcaguccuaugaucggcucuuauugauauuaauaucgaggguucaucugaucucuguuuuacagaugaugagaucaaggauccugaggugcugugauuugucuaggggaaugcaggugacaguagguggagccgggacuagguagcaacccuccaccucccgcuuggugccacacccacuguguugcauggagucuaucuuccuucuuucucacgaaauagucugccuugcuugguggcucuguggaccagggaugucuauacaucaaaacacucuucccauaggagcucucacaacugacagcucccaucuugaacaaacagaccaguguucauuuggauguucucggccucacguggcacccacuccaacggcuucuugccgagugaauuuagacaaugugcuugaugccagcacucucacugcaaaugggaacagauucacagagcacccagcagcagacauuugucaggaauuuugcagucagaaauaaugacgggucaaagucagccccaaaucccaaagcccccuagguaugaaucccggugcuuucaccuggggaggguugggagucagaucaccccuccaaaugaagauccucuucaaagaggaggugcggcauacaccccaagcugacaagcccaggcuagaaggcgagaauggagaaauaaauccugacucaacuagaaggauuagaaagucaccuagcaugaggagaauucgcacuccacaaauuuuucucgacugaguaaauuugaagaaauaaaacuagauugagcaugcguuuaauacugccugcuaucuuucccccuguucugcucaguggcuuguuaaauaugaaaagauuuguccugcaaggggacacggggagagacaaucucugggggacucaucagcuacccugagccuccucuuuguaacccagguaagaaagagagcauuuuccaauuccagcaucugagugcccuggucuuguguacaagucucaaauauaaucagugguauaacaaccgucucccaguagaaggugugauauaaagagcucauucgagaugccaggagcuucccuuucugacccuggcugccugagaggcaaauugcauuagaaaaugacaugccauucaucuagccaguacuugcaggaacauuuagcuaauuaaaugauuaauaaauuuaacacugcuuuauaauuucauuuagcuguguuggaaaucacacggugagcugcguaugcaccgaaugagauuaggugggagugaggguuucagaggcugcccugguaauugagauuagucuauuacuacagugaccuuuuuaacuuuuauauucucuuguuaaagcgaaauaaaauuuuauucacuuuuaaggcauauuuacuuagagaaauuuacaugaaauuaaagaaacaccaagcccagaagccuacuggggcuggaauccaugcacuauuucuuucguaauuuucagagcugcuuuaggaaauuguucuugaguuggcugcaggcagagugaagagcaaugugguuuuuacacuguucuuucaucuauucaauaaaugucacguuccugguguguccugggcacuguuguaggaacugggacuacagcagugaaaaugaccuagguccuuguugucacaaacuugaguucuagugggaaaauacagaugacaagcaaaugaauaaacaacaaaauaaacgagagugagaagcacagugcugagaacuggaggagguggcuucuuuagacuggagaguuaagaaaaaucugucuguaaaggcgacaauuaaucugagaucugacuuacaaaaagcaaucaggugugcaaagcuggggaggauagcagguggggacagagaggcugaaggugaaggcccugaggcgggaaugcaggaacuugguguguucaaggaauugaaagaacagggaggcgugaagugauccagcauauguggaaagggucagauuaagcaagccccugcugacaggauaaggaguuguauuuguaaguguggugggaagccaugaagggguuuaaagcagaguuaaacgccauccgcugggugauuccaucuaaagcaagugauccugcagcugcaauucagaaugguguuaaagccugacuugguuucccuuaccuucagucuccuguccaacgugugauuuuuccaccugaaaacucuauuugcuagucuuguuucucugucuuuuucuugaaaugugguucuuuguuuguuccagguauuuugaaaauguuucugaucaucuccuccuuaauaguucuucccggccaauuuuuugcucaccucaucuaugaaaucccaacauauauauuuuuaaacuuccagaggucucugucuacuucucucuugugggaaccaugcuguuucuuuucuguccucccaugcuuugacaucugggaucuccccucccagggucaauaaauuccuagaggcagcaaacaacucacuugggggcaccccuuuugaaugcaacccaaccaauccagaacuuacaccccaccaccuccuuuauuucucaugccccaggccaccauccacccuuucuaaucacccagggccagguaccagaaaaauagggacagccccucuuccccagagccugcugaacuuacucaaacccuagucuacuuacccugccucguucaguccuccccacagaacccacgguuugacccucucccucugccucuugaccaguccuggugccuccccaugucccuccacucugacauagcauguccccuucccuugcaaacuguaaaggacacagaucacaaucaucacaacucucacaaacugucuuuucaguggucauugucuccugaucugcuggucuuagcauaccuaaauaauaauaaaaccuguauuuuaaaacaucuccagauagccaguuucaucgugcaccaaauaauaaaaacuacugauuacugagguuccacuacaugccaaaugccuuagagaugugauugacuucaaccuauucuaguucaaccuuccuuuacacaacccugcaaagaagguaugguuuugugguuucuuucuuuuuuuuuuuuuuggccauuguauaaaugaaaaaacugagacacaguuuaugagacuugaccaaggcucacuguuuucuaacugugagagcuaagagugaagcccagaauagagaugguauaguucuuaaaaucagaaaaagaucaguuuucuugcuacuaaaaugaacuaaaggccaccacuuccugacagacucuugaaugcucuuguuuugucuuuuuggcucauccagccaaacugguuuggaauucauagucacaauuucuugcucacuuuuucucuucucccugcuuugccuaguguaucaucaggaauauuucuacagaauuacucuguuuuuccuaauacuuucucucaaguuaauauaaguacaaacaaaaugucuaaaggaauggccagggccauuuuaccaugugcccugugccauucuucuacaacaagggccaguucuucaggguaucugcaacaaucaucaaagaaccucauucuucugaugauaauucacauauuguaaaucuacauauucgacaugaaaaguuuuucuguuaguuguuaguuuuguuuuuucuuuccuucagccuguagagaagaugaaauaaaaggucuucuuucagcaaguguuuaaacuacaguaguuucaauuucagguaauuaugcauacaucauacaucccuuggauauucuuaagacuuugaacacaggcccccaccccccucuuaaauuugaaauccugugauaccugcuguaaacccuaaaaucugugagcaauuaccucuguaagcaguguuucuggaagauaacagcugugugugcuucacaauuuuuuuuuaacuuguuaauugucugguuuuuaacucugacuacuaaucuucugaagcuuaagaauuccuaauuuuccuuccaacaccuucuacuugguguggcaaauuugaacccaccuguguaauauuuucugccuuuaaaaacugcaauuguugcugggagcgguggcucacgccuguuaucccagcacuuugggaggcugaggcgggugaaucacuugaggucaggaguucgagaauagcuugagcagcauggcaaaaccccaucucuacaaaaugcacaaaaauuagccaaguguguuggugcgcaccugggucuuagcuauucuggagguugacgugggaggauugcuugagcccaggaugcaaagguugcagugagcugaaauuguaccacugcacuccagccugggcaacagagugagaccuugucucaaagaaacgaacaaccuccaauugcuagaccuacagacaaucacauuagcacuguuaguaguaacagaugggccuaugaguagugagacugugcaaauuccagucguugaagaggugguggugaccugucugauuuccuggaaauuguaaacuaacuauuuuucucuuuuaauagugaaaugacuaagugaguuaugagugcuuaggugcuuuaaguauuuccuucaucuucauucgauguuuagaaaucaacagagagacuuguaccuagauuaaaaaaaaaacaacuggaauuccuccucccucccuuucuccuucuuauauguauuaguccucuauaaaccugacaccaugcuaggcaccacugguauaagacaagggaaaaaaaaacucuggcuuuuugcauaauccuuucuauucaaaaugcgauccauggauuaucagccuguuaggagcuucuuaggaauguagaauugaggccccucccugaccuccuauaaccaaaucugcacuuuguacacaaucccccaagcaauucaugcgcacuguaucauugaguaaaagcccugcuggagaugagggauuggcucucuaugucaacuuggccaaauccagccaaccauguaguuuuuccugcuguuuuuuuauggucuacgaucuaaaagugauuucuacauuuuaaaaugauuacauuuuaaaugcuauaugaauaccuacauaauaaccucaauuuugucucuuagacuucaaagucuaaaauauuuuacucucugcccacccccccaccuuuuuuguuguuguuguugaaacagagucucccucugucgccaggcuggagugcaauggcgugaucucagcucacugcaaccucuuccucccugguucaagugauucuccugccucggccucccgaguagcuggaacuacaggcacacgccaccaugcccagcuaauuuuuguauuuuuaggagagaugggguuucaccauguuggccagaaugguuuccaucucuugacuucaugaucugccugccucggccucccaaagugcugggauuacaggcgugagccaccauucccggcuugccuucuuaagcaaaagcuugccagugccugcuguagaaucuagaagaaucuagaacccuaagucugggugaaggcacagaugaagcuaucuuuugaaauaagcaugacaucaugacccuaauuccacugaaaauacuugucagaggaaugacagcucuuccucuucuuucuuucuuucauuuuuuccaaaaccaugauauguauuaaacaggaaacaggcacugagagccuaaaccuuggaucaaguuuauaaaagcacagguguaauaggaauuucaugguucaugcucagagguucaugaggaccuaaaaaaugguuaucuucagacucaaaaggacccaaaagacaugaaaacugguuuaacuggcuccauccacauacacuaugaaagugauuaacaguuuaccaaacgugguuguuuuacaguguacauccaucagcauaaggguuguauuuuuuuuaaauguugcaaacuuuuuaguuuuuccaagugaagaaaacacaaaauugccaucgaauauccccaucacuucagaaaagaguggcuauauccuuucaacuaaauucaccucuuuuuuuuuuuuuuuuugcaaaagaggauuuuaaaaaauuauuuauauguccaugucuaucuuugagagguagauuuagcugaggaagugaaaugaggggccaguauugaaaauggaugagagugaaagaagaggagacaggaaucagagucacagagaacagagaacuggugucuaggacaggcaaucuucagaaaaggaaacucagcuggaaacaaaaggcuuuguuccugcccagccauucccacggugaccucaccgguguccagggcagaggacacuuacacaaauacuuguugcacuagacuaaauuaaaaggauuuagugggugucgaucuguaguggcaugacccaaguugccuauuuuucauaccauuuagggcucugacauugaauagaugagaacuuguuuuuaaaagacuauccaugaugcauccacucagcauguuagaauggaggccaaagggagccaaaguuguuuuggauuugggcaguaugccuugcuccuuuuucucccaaauucuaaaugcuucuggggugcauccauggcuagcaucacgggaggcaggacaagaaauuguggacaguccagccuggccugacagcaggccuggaaaacgcuuucaaaccuuaggggccauaccuugccaagagcaucucuuuugaguguagguuacaaccuguucuuauuugaagagaugucccuaaaagagcacgcauucuccuacccauaaacagcuaaacaacaacaacaaaaaaccccccccaaaaaacagaugauacuaaagguugcuuucacuaaccuuuaaaugguacugggaggaauagaaaaguauguacaaugagauuaaggccuucuaugauccccaauuuaugauuaauauggugaccacaaaaucuagagguucuuuauugcuuuuuggacaggcaacugauugugugcagguauuauuaggauuguuacucaguguaauccacaguccgaauuuccacaagugcauugccgugggcuguucuccaggggucuagacauaacgacaaaaggcauucccgauguaaaccaaaugacuugguaugaccccacacaccaguggcuaccugaggacaccuccacaguucccuaaguaaguacccacagcagaggagggcucugcuuggauuccuucgcacugaaagggcggcuuggcgugacucaugugacucuagacccuccagaaaaauuguacaggggagucucacagcuggagaaaggaagucagguaggacuggggucaaacuuuagugcuggaaucuuuucgcaagccacuacgcugggccugaaucuccuccuccucacauggagaugauaaagcugccucucaagauuucuuggcgguugaaugaaaaauauagcaagcccaugacccugagcguguacucaagugaguuuggauuuuccugcccugugcuucacagaaaccaggccuccgcucgcucugcaggucuccuugcccggcucuuuugagcugccugcauucucuuccuuccuuguauuucccccagcaagcuucccugacacucucacgcuaggagcaguccucucuuuccaccgucuccuagacccggagcccacuucuaucccugcucuucccucagugcaacuggguacuccguucuaucucccagggagugagcucacaagcugucucggccuccaccccagugcuggcccaccugacacaaagaaggugcuagauguuagcugcacugcagaauaauucccugagcucugcccacacuaagcugacugcuggccacucuguuugggcauggcugggcagggcagguuuuuguuuuuuuuuuuuuuucuuugagauggagacucacucugucgccaagcuggagugcaguggcgugaucucggcucacugcaaccucugccucccggguucaagcgauucuccugccucaaccucccgaguagcugagacuacaggaacacgccaccacgcccagcuaauuuuuguauuuuuuaguagagacaggguuucaccauguuggccagaaugaucuggaucucuugaccucgugauccgcccgccucaucgucccaaagugcugggauuacaggcaugagacacugcgcccggcugggcaguugguuuuuuaaagcuuaacugucuuccccuuggcuucaccccagacuccucuuccacuccugauucaggaggaagccuguuccaccugcauuccccaucgcaugguccagccagccuguacccuucucugccucauccaucacccguucugccagcaugggucagcgaaucccgcuccucagggccucgccucgcgugggggagggaugcaagcaaguuccaaggcagugccgacagaaacaaaaucgauaucuuuuacucuacaggaaaaaguagaggauaaacuucucaauaguauuagaggaaauuuaacaagggauaugguaagaucaaggucuucuaugauucccaacuucugcuuaauacagugacaaugaaaacuaguucccccuucguaacagagaccuuucuguugccuuuuaaagacucagagcccagauauccucggcuauuuacaugugauauuucauggcuaaaacaacaaaaaaagauaaacaaaggcaaguccccagucaaagaaaagagaauuaucaucacauuagcgucaaaacuucaacacuggggcuggaggccauggauuuucuugccauuacagcaacuccaggaucaaauaggcccauuagguggcucuggcugucaggcacccuggcaggccguucggagacuagcaugcucucaacacgagauaggguggccacuuacuucuugccuauccucuagcaccccugaucugcaggcauggccucugcauucugcguuauuucacugagaaaggcaugcagcccauaagcagagggugaggucucagcucugucgccuucuaaaucacaacauaauuggagcccuguuugucuucaaccugaacacugaucauguagaaggagcgguauugguuacuguccucucccucugccaccuccugccaaugcaagccagugcugaggaaugucugguccaggguaaccaaaaagaaggcgcacauacucuucaugucuaggaaauaagagccuacggauuugggggaauccacacaacaccugcuggagacguuuuguuagugaccuccaggagcacaccacaaagaauaacgccuuuacuuggaaagaaccucaaaggcagugaaaagucaaccaccguaggaaagaauguuccagauuucaaaugaucagaauagcuggcuguuuaagagguggugccacuuuuacaguuaacuauauaacauauggaaagcaggaggggaauuuucuggggaaaugagucaaauuuguguuuccucuuuaguauuaaaaugauagcuuuacguauuucauagaugugccaauagcagaguugcacugguaaaaugaaaacuaacguuuaaaagggaaauaauuccugugcaacguccuacaaagccucaaaucagggagaaaugaaaagagccuagaauaaacuaggcugaaaaagucuucuacaccagugacagcagaaugauggccugcagguugaaucuggacugcggauguauuuuauuuggcucacuccaaguggccuacgcaaugauuucauugccaccauuuacaaaucggauaacuuaagcuggaugcagugacacacgccuguagucccggcuacccaggaggccaaagggguaaagucacuugaguccaggaguuccaggguggccuggacaacauaaacgguggccugggcaacgacgugacaccaucucaagaaaaagggaugauuuaauauuuaaaaauauaugaauuucuaaucuaaucucuccagaaaaacuggagguucuggcaaguuuauagcuaauuuccacguggcaacauucagcuggacgucaauaauggcugccccuuagagaugaggcaugcacacuaucuuuggcacuuucuccugucuucccuauauuggggacauagauuuagcaccauuuaucaucguauacacagcaacuucauuccuuuauucuaccuaccugguaguugaagcaucugaaacugcccuaugcuaugcuauauaauuaugaauuauuaacagggcuuuaucuccaaguuccugaugcaugagucagagaggugaaaucccuuguuuagugugaauuauccucaacuggaaaaauuaaggcauugaguacaaaguucagugcugcucuuugacaguuccaugaaucuaugguuugggaaaggaucucuucuaccucuaacaagaagaguuuucauuuuuaaucuucugcuaaagguagacugagcagagcuaagcuuggugaaccagagccauugccagugaaucacaucugugagucuucucaacugccuuaaaaugagaggccuaaucagagaagaacguauuugaccagaaaagcauuuccuucuuagguucccauaaaaaacauaaaugggcucuuuugugcccacagauguggucuuacuggucaucggcaucugagagucccuuuuucagugauguggauggguggguugauggauagaaggaucugaacccucuuaucugaaucccugugugauccaccaaacccauacugcaagauggcugaugggguauaggaggagcauccaugccaacagaacugagugauguauaccaagcaacgugaggccagaacuuggagucuggucuccugcuguaacccacuggcugcgguccuaaauguagucuguggcagaaugccagcugagagaaguacagaugaaaauauaagcaggcagauuauuuaugagacaugaaacuaaaugcucauugguucuuaugcaacuaaagcugagcucccugguggcugauggggacucauuugagaccgucccuaggaagggagcuauauucuucuccuaaccacaaaaauggaacccacccaacaaacaguaugcuuuccuuguugggcacuaaacugagacggauguuuucugaauaaaaguuggugagcuauccacaaaauguuagcaaacuguauccaacaauguauaaaaaaacauauaugccaugaccaagugggauuuauuccaggucuucaaggcugguucaauauuuaaaaucaauauaguccaccauaucaaaaagcuaaaggaaaaucauaugaucauauagauuggcauacaaaaagcaguugauaaaaaguacacacccauuaucauuuucaaaaguuucuuaguaauuuaggaauugagaagaaucacuucaacuugauaaagaacaucuacaaaaaauuuacagcuagcaucaaauuuaguggugaaaugguaaauaacuucccccucccuaagaucaggagcaaggcaaggauguucucacuacucuuguucaacauagcacaggaaguucuagccacuacaauaaggcaauaaaaaaagggcacacauauuauaaaggaagaaauaaaauucucuauuugcauaugacaugacaggcuagauagaaaaucccaagaaaucucaaaaaaacuaacaaauacaaacaaaaauaaaaaacuccuggaacuuuauaauaaaugcaaucagcaagcucauaggaucaagaucaacacacaaaacucaaucauauuucuagauauauguagaaguuggaauuaaaaacacaaugccauuuacaaucgcuccaaagaaaaugaaaugcuuagguacacacuccaguggguuuauacuaaauaaauagaauuacauaccauguccacaaacuggaagacucaacauaguaaagaugucaauucucccgaauugaucuauagguuuaauguuagaccuauagauuuaaaccccauuaaaacugcagcaaggcuucugguagacauagacaaccauauuguacaauuuauaugaaaaagcacaggucuuaggaagcuaaaauaaucuuaauaaaaaagaauacagugagaagaaucacucuaccugacaugaggcuuacuacauagcuauaguaaugaagacagcguauaauugucagagagacagacacauagaucaguggaauaaagaagccagaaagauacccacacaaacaugcucaauucauuuugaauaaagguaaaaaaauucucuggaggaagaucauuuucagcaaauggugcuaaaacaaugagauguuccuaggcaaaauuuauuagacuugaccuuaaccucacaucuuauacaaaaauuaacucaaaauuuaucaugggcauacaugcaaaaugcaaaaauauaugacuuuuaggaaaaaaauauuagaaauuauuugggauauaugguuacccaaagaauuauuagauuuggcaacaaaagcucaguugaugaaaggaaaaauugauaaauuggaccucauuaaaacuaaauacuuuuauuuugcaaauguccauguaaagaugaugaaaagacaagcuguagauugagagaagauauuugcaaaccacauauccaacaaagaaccaauaacuagaauauauaaagaauuuucaaaaugcaacaauaauacaacaauucaaauagaaaaugagaaaaaaacauuaauagacauuucaccgaagaggauauauagaugacaaacaaaugaaaauauguuuaaaauuauuagcuaucagggcaauuuaauuaaaaccacagugaaauaucacuacauguuuaccagaauggcuaaaauaaaaaacugcaacaccaccaaaugcuggugaagauauagugaaacuagaucaccaaaugcugguggaaauguaaaauagcauggaaacagcuugacaguuucuuauacaaacuaaucaugucauuacccuacaacccaccaauugcauucaugggcauuuaucccagagaaaagaaaacuucuauuuacacaaacacuuguguacaaauguuuauaauagcauuacuuucaauagccaagacuagauuuccuucagcgggagagugauuaaacauacgaucacuuauauguacaauaccauggaauacuacugagcaaugaaauuaaacaagcuaccgacacgugcaacaacugggaagaaucuccacggaauuguaccgagugaaaaaagucaguccccaaaagauuacauacuaugcuauucugcuuauauaauaauuuugaaaaaacaacauuuuaaaaguggagaacaguuuagugguugccaggggucagggaugaggcaggcgcagaaggaaggugggugugguuugcaaggcaacgcaagggaauuuuguggugaugcacuguucacugucuugauguaguuguguauaaaggaagcuacacauuugaugacacuguauaaaacuacauauguagacacagacacacauauacacacuugaguacagguaaaaugagaaaucugaauaagauccauagauucuguaagugucaacacugugauauugcacaauuguuuugcaaaagcuaucacugggggaaacugagcuaagaauaugaggaaucauuguauauuauuucuuacaacuacaugugagucuucaauuaaaauuucaauuaaaaaaucagugaacuagacaugaagggacacauguagaaguacaagcgaaggugccuccaaccuccuuaaaccucacacaguauuugcuacuucugcuggggucuccaauccuagcacuaaaaucucuuguucaguagucuucgcuuccuagaauguaagcuccuugaaggcgaggaccacaccuuucugaccaccuaauucucaaaacuucccauaauauaaaccagaugcuuaguaagcacuugcugagugaaugaaccuuaauucucaggguacuggcugcauucucccacuuaaauauuaauacgaacucuaaaauggcuguuauuauccuuauuuuauccugugugggagaggaaaugaagcuucagauagguuaaaugacuugcgcaaacuguaauauaguuaugaguuuugaaaacucguuacgacuccaaaucucaagacccuucuacuacgcugcccaggucagccacagaccugugaucggaugcagcaacacaggaugauauaagccaguucuggaggaaaagucucuaaaauagaagccucagagaugggaaaacauggcagguugaagacggggcaucaaagaaggcucugcugguaggagaauaccuucagggucaggcugacauuccaagaaaaagggaccuauugauaagaaauaaaaaugcaaaagacucuuuuuguuuucuccucugcauuauauucaagguaacauaauccaagagcucaucugacuaaauuauaagccuacuucauaucauacacuuccuuccuugaaaaaugcaaguuaccaggaauacagauaaaacacagcauguuacuuuacuugaaauauuccaaguucuaccgguauuuauguuaucaaagaacuaaggguuagaaaauaaucuuaauucacagcugagcuuuugcugacugcccccuuuuuagcugauauuuuaugguaaaauuauaucauuuuaugggugacuuucaaaaaauuccuuucaauaaauuauauaauuuuaauacagguauuugaucacucuuauacauuuauucuuaaauaucugauaguuguguuaauauuuugaaugggguuuuuuucuaucuccaucuuaaauuauaacuaguauauaccagcuaauuuguauauauuuaccuuacaucuagccaacucuucaaauuauuucauugcuaguaauuuuuacugaauauuuuagcuucucuaggauuauaauuacagaaguuuaaaacaaagaacauuuugguuucaucccauuacuuaagacuuuuuuugucuuacuguauuuguuaaaacuucuaaaauaaugugacaauugacagcuaucaugaauauucuugucuaguuucugauucuaauggaaaacauuucacgauuuuacaguuuggaauaauauuugugggcuggaugcgguggcucauaacuguaaucucaacacuuugggagguugagaugggaggacugcuugagccuaggagaucgagaccagccugggcaacauagugagaccaucucuaaaaauaaaaauaauuaacaaaaaaauccuugacucuacugaaaguguuuuccuuucucccaauuuuaguuacaaguauugcuguuucguugguugguuggcuuuaucacgacuucugaauuugagcaaaugcuuuuuuggcaucacugauagaaccauaaaauuguucuuuaauugguugcuguaauaaauuacacugauagagaauaaaaacaauaaguaaagaaaugacaugaaaauuuaauuaguuuuaguaaauaauggauuaauacccuuucaacaagcucugacccauaaucaguggcaccauucaacaaaauccaagaacgcgcucacuuacaggcaaauuuauguacaguagccuccgcuucugcacaggggauauacuccaagacccccaguagaugccuaaagccucagaugguuccaaacccuacauauauuucauuucuuccuauacauacauaccuacaauaaaguauacuuauaaauuaggcacaguaagagaugagcaacaauaauagaacaauuauaacaauaaauuguaauaaaaguuacauaaauguggucucucucucucaaaauaucauauuguaaguaauauauuuguaccacaguugacaauguauaacugaaaccuuggaaaccaaaacuguaauuaaggacuacuguacagaacauuaggucaauaaaauuuauauaagaaucuaagagagauaugaacgaacuuaauauuauaaagucaaaagucggguuuuuccucccuaagaaauauuccuuuuuccacucgauauuuuuuuuaaugcacuccaaaauucaauagcuuagugcuuaaaucauguuacaaacaggaagcugaaauagaguagaaaaggaacuagcaggaggcaagcgugaagccaggucuuuucauggacauuauuaucccauuucaucuucagaauguuccaguucucucuguacaaggagauaagcagcagcuaucaccugagaagugcugggcauucguaacuccugggucccccaaaaagcuggccuucucaggcaggugcuauuaauuucucccaucuaucaguugaagggacugaagucuugacaggcuaaacagguugaccaggcccacacagcugggggauuggagagcugggaugaaaauccuggugugcugaagugaaaaagcugaccuuggcugugugcaguggcucaugccuguaaucuccacacuuugggaggcugagacaggaggaucgcuuugaggccaggaguucaagacaagccugggcaacauagcaauacuccaucucuaccaaaaaauaauaaacuuagcuggguauggaggccugugccuguagucacagcuacucaguaagcugaaaaucacuggagcccaggaguucaagauugcagugagcuaugacugugccacugcacuccacccaggguaacauagcaagacccagucucaaaagaaaaaaauuaagcucaucuuauuuucaugacuauggguggguauaacaugguggcuagcugcaucggcuucauaucagcagaucgagacuggaauauuggcuaaaacuccuaccagcuguguguucuugggucacuuacuuaacaccucugugccccaguuucccaugggcgcauagagacaaaccggcaccuaucccucagggcugcuauaagguucaaaugagucaccacacacaagacauagggugugaaacauaaugggcacucuauacauauuggcgaauacucuauuuauugucaauauuauuaucauaauuuuuaucaucccuaaaacuauuuuuucuaacggaucugaguaaaucauugguauguaucaagaauaaaacuccaacagaagccacucaaaugguuuguccuagcuaguaaaaucuauuaaagucgaagaauccacuuagccgagccacagaauacaccaccguucagguaagucauaaagccuucccugcagcuguuacaaugauugaucuucaggcacaguuaaaauucaagaaauacacugacauuuuaauagaacaaauaauuuaaauacauuuaauguguuaggcgguaacaguuuuuguaauauauacugacagauuugggaacuucccaaaaaagaguguagagaaagacuucauccaggagggggaagcagggaaagacaauaggauugacauucuuugagagaaacuauaaaaucugcagcuaccuggaaugaggcauuaaauuuggaagaccagaccccaugacaaacagucccuuaaacuuuuuuuucaaagccaaauacuucugaaccuuaaacuucuaugagcguucucuuuccuuuauuuuuuuuucugucaucuccaaaaugcuauuuaaaaaacagauaaauggcugggugugguagcucacgccuguaaucucugcucuuugggaggcugaggcaggcugguggcuugagcccaggaguucaagaucagccugggcaauaaggcgagaacuugucucuguaaaaaaauauauauaaaaauuagcucagcaugauggugugucccuguagucccagcuacuugggagacugaggcaggaggaucaguugggccugggaggucaaggcugcaguaaaccauaauggugccacugcagucccgccuagggaacggaaugagacccuaucucaaaaagaaacaaaacaaaaacaaaaacugauccaggcacuucuuauauuucuauuaacguugaaaaaauguuuugagauauacugacucgaagaggagaaauaaauggacucugugauuuuucaugcuacaacugaaauugaaaauucucucuaauaacaauuaagaucaauguuaccucuucccagaugccuuccagguauguucuagaaaauguuuaaugaucagcuuugguggggaggagggagcccugauguguagcaugugccaauuuccguggugaaaauauucucacuauggcugaaaucaagcuaucaacaugaugucacuaaacaugggagauggguaaucauuggcuccugcuggugcagccaguuccagcacaaaauugagccauuucuacucuaacuucccaucucacuacccuguuuuauaugcuuggaggcacccgucacuaccaggaauuaucuucuguauuugugauuugugcuuccuuagccugucacuauggccaugucugcuuggucaccuccaucccuggaauaucuacacuguggccugacacagagcaaggacucacuaaauaucugugaaaagaauaaauaaaugacaggcaggaagaaguaagggcaggagauggagaagaaggagaaaaagagaagguaagauauauaccucuuaacugggccccauccuguccuuacugcucuuuucugagcaguuuggagaacaccguguagacaucuccucccugcuagacgggcuuaucacaauagccaagaagcacuggagagucauacuaacggacacugcuuccuucuggcccgcccuguuagacgggcuaaucacaacgccaagaagcacugaagagucauccuaauggacacugcuuccuucuggcccuccgugcuagacgggcuuaucacaacaccaagaagcaauggagagucauccuaauggacacugcuuccuucuggcccuccgugcuagacgggcuuaucacaacaccaagaagcacuggagagucaaccuaauggacacugcuuccuucuggccaaauaugaacaagaaacugucauguguuuucaccccaaacuucuuuggaggacauuuuugaaucucuuaaauuuggagaacucgaccuucuacaaagccaaagagcugguaaaacuuccuuccgauuaaaaugagacuugaaaacgggugcuaucaccacugacaguucauguugacaggucugugaacccugaaaaucugagccaggucucagcuaauuuagaaaguuuauuuugccaagguugaggaugugcaccugugacacagccucaggagggccugaugacacaugcccaaaguggucagagcacaguuugguuguacacauucuagggagacaugagacaucaaucaacauaugcaagaugaacacucguucggucuggaaaggugggacaacucagagcaaagguaggaagacuugaaaugaggagggggcuuccaggucauagguagauaagagacaaauguuugcauucuuuugaguuucugaauagccucuccaaaggaggcaauccgauauguauuuaucucagugaacagaggggugacuucgaguagaaugggaggcagguuggcccuaagcaguucccagcuugacuuuucccuuuagcuuagugauuugggggcccaagauuuaucuuccuuucacagguccuuucuaagcguacgccuauauucuuccuuuaauuuugauuuccuccuguugaaagucagagguccaaccaucucuauuucaaaucccagacaucagcauccuucccaacagagacaugcagaacagaggugugaaacugacguacggaaacuguuugagugacaagaagacucuccggaucccccuacuuacucagaaguauaaacgucagcuugaugaaacaagcagacuugccucugcacaacucaccuugaaagcuuauguuuaacagacaaaagaccaugucccauuuugugugaaugagauguuuucugaagccaacuggccucuaaauccagaucuagagaauugggagcagcgcuucuugcuucuuaauuaccaccugguggcuugccugccucagggcacccacccuucaugcggucaaugcugagagagguuugcaaaguucaggggagaucaagaggaggcugcauuguuuucugcugauuuuccagagacaaggaaucuacugaacuccaaaaggacuggacuucucaggugucagugcuguaugguaggagagaaagcagcuaaaaacucaccaucagcaaagggcaagugauuauaagagcuggcggaugcugcgguggaaguucgauucaauucuaacucccucuguacaaaugaagggagaugucacuugccuaagaauguagcaaguccaagaaaucggccacaccaccgcauccaauagacugcucagagcgugcauuucagggcagggucugcaaguuuauuuuugguuuagccacgaguuagaauguuaacguaagucaauuuguuaggacugcagauaaaguccuuuaccagaaagaaaaacaauaacaacaaccacaaaacacagguaaggagcuuaauguucucaacagcauugagaccaugggggcacugugaguaggaaaaauccaaaaaugcuuuaucaggccccauggugcugacagcgcagcaaagcucagcuggaacuguggucggcugccagaguuugaaccaauguuggugcuaaaaugaucagaaauguacaaguccguauuuggagaauuacaacuuugcuucuuucaaauaguuuauggggagggucuuggguaugcgccauaacacguaacagaauuaguaucaguuuuaguagauacugucacuaaagucauucgggcaagugcccagggacauuuuucaagagcccuuucugccucuuuuauuggacugccccucugcccaugaugcauauaaaucauucuggugaaagucagcuuucauaagcaaacacccuaaaccuauuuuauuauuuggagauuuuaaaaacauuucaacaagaucggccugcuuuucuucugugauccuuaaaaaaagaaaagaaagaaagaaagaaaaagaaaagaaaaaagaaaaagcccacgugacuuccacagcucgauuccaaagaagcuaaagacaucguguuuggacaucaguaaaaaugauggacaaaucuuuuugcaaaaauuucacccuggcuugccuugaaaaauauaaagcagcucucuggcacuagaugucaaauuaacugcaggcaaaguguguuacaguaauucacuuggcaguuuaagcaaaaccaagagaacaacauuaaaguggauccccacaugccaacggggcaccaacacuuugcuucuguagcuggaauuugacuguaaaucucuccuggcuuaacgugaucagcagcagcacaaagaaaaucuguccuucucucugcauuguguaaaaugguuuauuugcccucuuaggaggcacgcugaaauauaaaucccagguaugauuauuauuauuuugaacuauuauuaugaguuacuauuauuacuuuccugagacagagggaauggggccggggaagcugguggaugagacggaaccaugugugaacgcugaggggggaccaucuaucuucguucagggcaguuucuguaauauuucaggagagaaaggucaucaauacuaaagggaguuauauguguggaugggggaagacucugcagugaauggauugccuguaagccuuacccuggucgaauucuccuuggcauccagccugcugugcucucugcuccuguggauagcauaucuuuaaggcaucuauggacaauucccucacccugccacaucuggugagucccuacugugggccugcaucucugcugugacugcaaagagaaaugagaugucagucucacccucuggagacucacagucuaauuaacagcagggcagagacaucuaaacaagugugugcaagcaagugaccacguuagagaguugugaucauggcuguacauggaggaccccucuaaguguuggguuaaaaaggugcaucccuggcacagguaaacuuacuugcccagagcacccuaauaacgggccuaaucaagacugccugccaggucugaugccagggcccauguucucuaaccugucuauggcacaguggggccacaggagugaggcaguuguuccaacaggaaagagacgaggaaugugucuggcaagacuucauagaggaggugauacuuaaacuguggcagaaaaucuaagucaaauggggaaggcacugggcagcguacugaaggauacaucaugagucacuaagggacucccaaguugagaaguggaccaccgccauccucuccacacaaaaggaucaugacgaauuacacauuuuccuaugaguacagcaccuugcucuuagaacauaaaaccuuccccaacuggaaugacucccugaaacaauuucuggccuuuggaaaguggggcauccaagaaaaaugaucaaggaccauuugaaggcacacgcaguauucucggggaauuauuucuggcuguggccccugcuguggaucacagggcuugggcuuucaaucacaagguugaacaguauuaacaagaacccacaggguccauggaaacaguuuggguaaaacauuucccuuccuuggaauguaaacgggucuaucuucaucuagaauuauuuuuaccaauuucauccucaaaacuucaaaguuuuuuuuuucuuccucugauguuguacuucuggagucccccacccccuaacuuuggucuuguguuuguggaggcacagacccagccuccccaggacggggccagaagccugacccagcaggcacaccuggaagucauuaaggauacaaggaagaaggggaggaacacagaggggacagaggccaggcuggagagcaggaggagugggggcaggaaggggauggaggagggucgggggaaggagacggaggagggaggagaaaagagaagcagcccauuucuuucccaacacauugacacuuuuuuuccaugauggcaggucagagccaaaggugaacauguucaaaacaaacagcuaacagacaaacacucucuaaaaauuccacaacguugccucgggacaaugccacggguccaacaugucacuccaagugagagaaaggaaacuaccugaagagaauccuaaacuuucugacauuuuagaacauucauaagugaauucugucucuaaaugcuuacaucuccaaguuaucagcugugauaaaaacugaauuuaauaaaaguaguguuaacuuaaggcuaacacaugaauuuucuuuugauaagccuugccaagauugucaagcuccucagcucguucuccaugugauaccaucauuuucuucuaaaaggaagcauggugauuucuauaaggucuaucgaggaaauagagagcauggguauggcaugcauaauaaaaccgccacauuaccagcagggaagcacuggacguugcaugugccugcuacagagauccauaacauuccaagaauuuccuucuggaagcgugagaauauucauauuaaugaaaccggaauuagcuggcagauggagggcuacgacuaacccuuggcaguuuaugguaauaaaacaucacaauagccuccucucaguugucuuuuccuccaccuuggagcucuauuuucucuccuauucucuguaagauagggggaggauuaaucacauguaauugauugaucuacugccuccugcagguuggacaguuuacacauaauuucauauugcauguaacaaauaugauuacacauauucuggaaauguuaagaaguucccggcauaacacaggcauguacauggcaugugccuauugaauuuuguuggcuucaagggauauuauuacuccugccauaugucaggaagcugaggcuuagccacauaaagucaccugccccaggucaugcaacuagaaaggacccggugaggaacuggugcccacccugucucuggaauccaugcacugaccaccagugaagggcagguagcuuuccucugcuggcuuuaaguuccuguucacuuuuuccucccaaucacaauuucacagaaauuagccuaagaagugacaucagggccaggcaugguagcucacgccuguaaucccagcacuuugggaggccgaggcggguggaucaugaggucaggagaucaagaccauccuggccaacaugguaaaaucccgucucuacuaaaaauacaaaaauuagcugggugugauggugcaugccuguaaucccagcuacuugggaggcggaggcaggagaaucgcuugaaccagggagucaaauguugcagugagccgagauugcaccacugcacuccagccuggcaaaagagcaagacuccgucuuaaaaaaaaaaaaaaagaagaagugacaucaguaugccaguugcaccuucauggcuuuccugacucucaccuggacgcuuucagguauaaauauuuccuguucaggcaacauuggcaguuggacguugacuagcuuuggaaaauacaagacuuaaaugguauucugccaaauucacugugcauucagaguauauuugaauauagaaaguuaaaauugcugcacaggaaaaaauuacaagguugcaaacaaacgacaaacauuaaaauauuuacaauagucagccauucgaagguggugaugguuuccuuaauuuacacagagcucucaccaguaaaugagagcaaucuuauagaaagcuggaccgagaauauggaaaggcaguucagaaaagaagaaaugugaauggucaauaaaaguacaaaaaucuacccaacaucacucacaauuacaauguaaaauuaagaaauaauggugaggauuuuuuuuacacgacugauagcuauauuauuuuuuuaaaaugguaauacuccaaaucagcaucuguguguuacacagacacuuagauuuggugggugugugaauacauuuugggaggucaauacugaaauaucuguuaaaaauuugaaguacaucucauugguccacaauugaauuucuaggaauauacucuaccuauugauguauaugucaaagaaagucaagguauaagcugaaaugcaacuuauaauaugcaaagauuagaaauaacuuaaaucucuuuuaauagauggauagaugaauagauuuauauuaaaauuauuuaacagauuuauuacauaaguaaaugauggugaagacagacaaugggauaacaggcagccuuuuaaaagaauuaacuaaauauacagaaaugaaaauaaauguaauccauaaaauuaugggaaaaggaaagguauagaacaauguauauaaaucaagacauacauguaaauuaacaaguguacucauacacaaaauaugaaugcauauuuaugaguaugcauauuuacguguauggaucaaaaauaaauauuuuuuucuagcaagguuaacaauacacugucaacagugguuauuuuggagguauaagaagaaaacauuuccugagaagaagaaaaaaauuguuagaaaauucaagccacagugaaaaacaauguuuauguauuauuuguauauauuuuuuauuuauaagagagaaaaauuaauccaaugaacagcauaagcccucauuucaauuucaaaucauccuaauuuucaaauguauguagcuccugucugcaaacacauacccuguuuggaacucauuauugguggcauucacuccacuuugcuacagaacaccuuccagugggaaugcaguugcuuucuccuuuccaagccaccccugguggggacccauuaggccaucccgugucaaaugaaaagaaacaggcaacuggagccaucccuggguggauuucuaaauccccuggcuaaguacuguacagacuuagcugaguuacuucauuucucugagccccaagucccuucaugacaugucuauaagaauguccuugugaagaaaucgcgaccuaaauguguauauguuucugugugugucuguaugugugggugugggugucuguaugugucugcauuuauaaaaaaucuacuguggaguucuaauaaguaagcagcaaugaggaagaggccccagguaggagugggccccggguagggaagaacaacaaacaauccgcaggcacaaugaccucgaccucauucugcacauagcucccuccaacaggacccuguauaacuucagucccuccagccccugccucuuugcagacagccccuuccaugcugggcugccuguugcaaccuuacaguguacuuucuuaucuucuccaauaaauccaccuuucuuuaccuacaacugucuuggugaauccuuuacugccugugccaccagucccagauagugacuaccugcaacauguacugcccucagcaguuauuuauaacaaauuggauucuuucuuuuuccuuuguaagaaaauuaaagagaaaaaaaaaucauaagauaaucccaauuauucccuccacugagaauagcaaaaugugaccucacccagaucagcauauuuuuaaaaaaaaacacaggcccauucuucauagugacaaccaaaccucuauggccauagcaggaagaaacaaacucuuccuacaugcuugcuuagauaguccagcaugagauccuggcucacauauuugcuccuuaaauuuuucuucuugaggacuugccugaauucacugaguauuauauuaaucucuucccugacaaaugcccccaaaaaaaucuaccuccaagauuuugcacauuuuuugugccaagccuuugaaaaaaacauuuacugaggauugaccaaugucauuucauuacauccugcauuuccccucaauucuauacgccuaguuaaguaauacguuugaccagccaccauuaggaaaacuucuucagcugguagaacacuugcuggcuuuuaaaauuacugauacaauauacaacuccccagugcaggccaccggcaaggacagcagaaauauaaaguagcacuuagcuuuuauaaggccacauucuacaucuucaaaaagacugcaccuugcacuccauuaaaauaauaaagaaacagaaugaaggaaaaagaaaagaacauuuaaggaccugaaguuuaaauauacuaaaaugagaaccaccuguucuguacuuuacuguuagagaccguacucguucuguguaaggauuucuuacccuuucugcaauaugaaugugugucauaguuuauauugacaucaaucuuugcucccauuuaaggaacugauauuggguuccccguuaauguugagggggaccucaaauuuggcaagguggaaaauuguuaaguggcgucucauugacgaaaguaaagggcugugaucugaaggggaaggucagaagaugaagggcaggaggaaccaugaaaugcguuucauuagaucaauaaaauguaugacuucacucgcuuaauuacauaaauaaaguuguuaaaaagaaaauaaacucgggcacacaccaugcuaaauuagcaggggcuuuauguaagacgaagaaacuagaaacaacccuagaaaggucacuugcauguauguguuuucuuuucaaaagcuucaugcaaagccagaaggaaaaucucacagagcugugugccugccaggacugguaagauccaagugacagaacagacccaggcaagaucgaggaggcgaaacucagaucagccaagaagccccaccacuaauccagugcuccauccaucugguuuaaaucgugguuugaagcauauuuaugugauaaagaauuaaagcuguuucucuuggccaccuaaauaauugggacacucucuuuugaaaagucauugacaucaguacaagcauauucaaaacugaauuuagaauuaaagaggcuugagugugcuuaacuuuuuuaaaguaugccagagccucuuuccaaaguuuuuuuuaagcgacaauauaaguaauaacuuagcaagguccuaagggauuuauucuuguuuuaaaaaaagaaaagcgauguuugagggaaaaagagagacacagagaaaccagacagagagcaaauggaaagguugcugcuaucgagaucaagaaacaaacucagaauauuccugaaaagacuaccucccaaucaucugaaacguggcaaguaacucucccaaauaaguaccauuauuuuaaucacgaaacacuauuucuguaacacuggcuguggcuuuauuuagguugucucucaugaagcguuagacaaagagaaaacuauucuugagcaaaauccaccaaccggaagucccaauacugggaccuaacaaaaucuugccugaaaucaaagccuaggugcccucuuccagcuucaccacugcugccuuuuuauguaaaauguaacuuauaaagucaacuaaaguuccagcagcaaugauuuaaauaugauugcuuuccaaguacagggauguaggacguaggaagggguguguguguguguguguguguguguguguguguguguguuucugcaaguguugggugggagagugauacgguuugacucuguguccccacccaaaucucaucuuguaucucccauaauucccauguguuauggaagggaccuggagggagacaacugaaucaugggggugggucuuuccuguacuauucucaugauagugaauaagucucgugagaucugaugguuuuaaaaacagggguuucccugaacaagcucacucucuuugccugcugccauccguguaagacgugacuugcuccuccuugccuuccaccaugauuguaaggcuuccccagcaauauggaacuguaaguccauuaaaccgauuuuucuucccaggcuaggguauguuuuuaucaagcagugugaaaauggacuaauacaaggaguaaagagauauacugcugcuugaucacccauguccuguuuuugaaaaguuaagacacccuguguuaauucacugaugcugacaccauggcagagauaaagccucaauauauauccuuccagugugacuuuaacuaugacaagguuaucacuuaauacaccaucauucaagaguugauuuacuggcuccuggguguccccgucuugcacucaacucucaacuuuccugggacuaggacauucagggguauugcuuaacauuucauaaauugcauaagaguaugugauagaucuaauuuccauaaaugaacacaaacaacauuuuuuuucccuccgaaucaggagggaaaaaaagaccucaaagccuccugcuuuucaggcucucuuuguguccucaugugcaaacuaauuuuuuccaagcacauaacucacucaaggauccaugccucuugggaguacagcuucuucuuuugcuucuaauauuuugugucucacucucacaaauggcccuggaggaagggagagaccagcagucuucuugcugaaucaccuugcuuguuacaugcagaggagagcucaucccugcuugggaaggaaggcccgggaggcaggggcagcauggagucuguccaacucucacagaaagcccacuuuucaggagugaaaucaaacaaaaaaagagaagccugcuggucauuguguguucugguugugauauaacuucauccaaaaaaggauuaugucaauguucuuuuuaugauaucccacacaucucacuaguuucacuuauggccaacaaugcaguggucucuucgguuggcaugcagccauuucccccuuuucuauuucaagggucacagggcccccuuggcucacacacccgcaguagcuccgcacugugcggagaacauggaaaucucaaagaacugcuggggagcauauguacuugaucacagcccaacaagaugaagacucugcaucuguaauacauuguggcgauuacaagucaaaucuggaaggacgccaguaccgcagcacuucauuagggucuaauuagucauuguuucuuguugcccuggguuaauuuguucuuggcuuccuaagugaucagcauaggaguuucaacuccaugggggcaaccucaaugucccuggagucuucugagcaauguaagauuaccaggaugugaauguacagguuccacaguccuugaguccugaucucuggagucucaagacucagcucaaaggacaucuucucucugaggccuuuacuaacccuguuuuuacguagaacugacccuacccuccucaugaucugugcuguacuucauacugucuuuugugccuauaauacuaaugcacuauuuauuaguuguauuaaucaucaugcuguauguuauuuuauauuuaauuauccaaugaaaacaauauauuuugaggucuaaguggcaggcacuaugcuaagcacuuuauauagaaauuauuuuguccccucuguuguaugugguacugaaggaagagacaagagcacagguucaggaaucagacacucuggguuugaaaucccaacuccaccagccugugacugugagcuugggcaaauucccuuucuauuacacaucucaucuguaacacacagauggaaauaaaaauggcaaccuuacacgguuauuccaauaaauacacccauuaauuaaugaaaacugcuaacaaggaguaagcucucuguaaauauuagcuguuuuuauuaccucuauuuuacagaugaggaaacggagacuuaaaguggcaaagugguaaagggaccuaccaaagaugacucagccagugaacagcgacgcuuacacuucacuccagggagccugaccccugccugugugcucagcaccaauuugacccaggcugucacccuccuucgacugguccaugagcucuuugagggauggacugugacugucuuugaaugagcuagauaauucaaugcauggauugaauaauuuauuuauuaauggcuuuagauuuuaauaaaucauaggcacagugccaggcauggaaugcaguccauaaaggaauguugggaugcaacuaaugugaaaugaauuucauuugagaauuuauuuucaguguaugcuuugcuugucccugcaaauauaccagguagagguaauccuaauuauuuaagcauaaauacagcagucuuucggaauaaaccgccauuuucugcagcuuaaaccuaauguauguagcuuuuaaaacacaaucauguacuccuuuauuaauaaacuuuuuacacauuuuaagugguuuuucucccguguuugauagauacaucaagaucguuccauacgagauagacugcaucauaacaaauuuuaaggcacugagaggugugugacuaugugcauaacgaacauaucaggaagugugccccccucauuuauacaaucuuuuaauauugggcagcacgcuaaaacuacaucucuauuuugcguuggagguuuuccaauccuaggcccugauggucucuccccaccuucucuuagacuugucuugauacuugaugaaguucaaaugcuugaacagugccuacugagauacaggaggcaacauuuuauaacuaccguuguuugcaagcauuccuaucaagauccauacuugcaaacucucagcauaaaagaagaaacagaguucugugucaggacaaugaacuuggacuguuguuuaccagcaaauggaaaacaacauuucuaacccagagaagggacgcuuggcccccuuuggugaugccucagcucccuucacacugggcaacaauggcaccuuugugcggguugugggaucgugacaccagucaggccuuacugcuugggcaacugaaucacaaccuucauacucugcagaguguucuagucccauugugaacaaaauauguaaggagaccuagccuccgcccccggcucuguuaucccugacuucagauugaauccuacuggcuuacaaaugcacuuuucaaaccuuggcaaauucaccccaacacuuuagaaauaaguaggaugcuguuaaaacauuagaauuccucaguugagugaaaucauucuuuggaaauaaaugcccagacccuucugugccacugcauuugcuacugaaaucaaaccguuauaaagcucaggauuuaaaguuaaccuggguccaagacaugguaccauuccuuaauagcugugugaccuuggccaaguuauuuaaccucucugagccuuaauuuucuuaccuguaacagggggaugauaaugacuuuacaggguugcugaaaguguuaaaaggacaaauuugggguuuaguguuuuuuuuuuuguuuuuuguuuuuuguuuuucacacuucuaagaccuauuuuuuuuuuaacucuuagcuauuaggggacguuguacuaacaaaauuaguguuugucugaacacacguggauuggaagugauaggaaagauuucuccaaugggaucaggaguaagugacauugccacaaacaacauuaagcuuuugcucaaaugauucuggcagggcguuuuaucuucaucaaaccacagccauugucuucuucuuaaaucucuucuucucuccugguccuuacuggauaauaacaucaguggguggugggggauggagaaggggguaaccaaaucaucagcaucuccccugcuccauuccucacauccagucacucaucaaugaugggucuuugccaugcacuuucucucucucuuguuccucuaucagaccaggccuuugcguaacugucauguggacuacugcaaguuguacugauuuccugcccugaauccaaucuucuccuucuugcagucuaacuucugugucccaacaaaauauuucuccuuaaagcacauuuugagagcauucacuugcaccuucccauccacauguacucucaguccaccccuccacccagcuacaaagcauggagucaggaaaugccacccuaacugucguauguugcuuagugggaauguaaaucagaacaaccuccguagagggcaauuuggcaauaucuaugaaaacgaccggagugcauacucucucagccgaugcugcuauuucuaagacucaauccugcaaauacaugcaugcacgugggaagcgaugucggugcaagguuacacguugcggcacaauuugcaauagcaaaaggcugggaacaacccaaaugucuaucaauagggaauugguucaaugaauuaugaaacauccacacaguguaauacucagcaguuguuaaaaaaugaagaaauaauuuauaugcugauuuagaaccaucucuaagauauauugucaagcaaaaagagcaagguguguauagcaaagugaaggggagggcagaagaauauacaaacauauugccuuguaaaugcauaauaaugucuagaaggaugcaccaggaaauaacaucgguucagaagaggaauuaggugcuaaaggaaagggguagagggagauuuuaacacacauaaagaaaaacauagguguguguguguauauguauacaaggauuuuauauaugcacauagguauauaaauauauauacauauacaccuuguuuuuaucuucuacuuuugauuuuugaaccauauaaaaguauuaccuauucaaaaauaaauauuuuauguguauauguacauuuuuuaauccuaauuuaaaaaaaaauaaaauuaaagaaauaaguuuaaaaaaaaagcaguggccacauaagccaggcaccuauuuucugucuucucuaggcaacugugauacauaaauuacuucccacucucuccuuuucucugucuuacacacagaggcuguauuuaccuccucaaaauucagcuuugagcacaauuuccuguuccaaaauucccuguggcuuugcauguccuauaggacauccagucauucugcauggagucuaaauuuauguaggcuggagucuaaauuucuuagucuaaccuucaggguccaccacugaccccucaacucaguuuuccagccugugcuccaucacugcucccuugcuguauuagucuguucuuacacugcuacacagaaauaccugagacuggguaguuuauaaaggaaagagguuuaauugacucaccguuucacaugacuggggaggccucaggaaacuuaccaccauggcagaagacgaaggggaagcaagaaccuucuucacaaggcggcaggagggagaaugaacacagaacgaacuaccaaacacuuacaaagccaucagaucucaugacaacucacucacuagcaugagaacagcauggggaaaaccacccccaugaucaaauuaccuccaccuggucccuccuuugacacguggggauuacaauucgagaugacauuugaguugggacacagagccaaaucauaucacuugaucagcucccaaagcuaaaucacucauguugacuaggugcuuacccuucuuaccucuguuuccagcauucuguccucccagcaccccaaagcccaagcucugcuugguuccaagccucagcucacauccucuuuccccaucacaucauccagaaugacagcucaccuccauccccaagcuggaagaaagccccuucuucugugaaacuccagggcacauuauguugcuucccuaccauauuuaacacaagggaucauaauuuuguacauguuuauccauucauucaguaaacaucuacuaagcaccuacuguauguauguacugaaagagguguuagaguaaaaacaccaccagccggauuccugcacucacagagaugacagucuccuggagaagacagauaguaaagaaaccacgccuucgacgauaaucuuugauaauuucaacauggagaaguaaaaagcuauggcaaaaaugcuaauuguuugcucaaagcaacaccauaauguuucaauuuagcacaaggggcucugaaguccaaagaacccauauuaaauccuggcacugccccaaagcuauguuccuccagaucagggauucacaaugucaacauuguugacacuugguccauggccuggggguugggguugcucuagaguuauggcccagaacuugucuccuugggaggaugcaggaagggucuucaucccaaggguccagcuacauuugccacacggauggauucaaaaaguugggacucccuacacuuggauguaggaguugaaaugucuaucauuugagccugggcguacuggaucccauaaaaaugccacaugaaagaaagcguaauuaagaagcuguuacaaugucaggcuucagauaaugcacucucuucaaaggcuuauuuugcacaucccaaauucuccucauaaaccauuuacuuucccaugcuauuggacgcuaugagcauuuaggaaauguucucaggguguuugaaaucaacaagacaauuacggagguuuggaagauucuaaaauacaaucaacaguacucuggaaaugccaaucgaauucuuggccuggcagacuacagcuguaauauacaucuauaaggacauuuuaagaugauguuaaaaugaauauucaucauucugaauuccaggauuucuuuucaaacugagaaauggauagagggaugggcagucucuagcaggaucugcauauaguuugggagaaauuuaucccuaaaaaaaaaaaaaaagaugggaaaauagguuucagagucagacaggcauggauuauaaucccagcuguguaacagaaaugaaugugaaugaucuggagaaaaucauuaacucucucagagcuugguucuucagcuugaaaaugaggacaguaauaccaccuuaaauuaaaauauguaagggucuggcaagaugucuuugcaaaccuucauuuucauuccucauccccuuuagggaacagaguccagacucauugguuuauacuuuuauaaagcuugcaaaauugcacacuuucuaaccaauuuaguuucucuugaccaaaacacuuuaagacacaaauguuucacaucuguuuugcuccacuaaacaauauaagcccaacccaucacccuucuuuucuugccaucaacagccucccugaacauauucaucauuccacaagaagucucgcuuaaaaauaaaggcauuucuuucuauggcugggacagggccauggaaugcacuucggguauaacaaaagaugcugaaucugaacaagaaugaacucaguccuaacgugacaggucagacagagccgccuuugugccacaccacccuccugcccugucuuccuuucccuuaacguaucaugaugaggaaccucgguuguauuuuaaaaagcauaauaauuacuuauacuucucuaugguuuccaauaaaccagugauuuuuuuuucaaaaaguccaugaauaaaacaaaccccgucaccauuggaaaugcauuuccaugcaagcgcggaugcuuuuaagaccauuugccgagcgcucugcaccguuugaccaguucuggggcagggggcacgcucuaauuacugauuguggaguuugguaucuauagcaacgggcagaauugacaacaggaagcuucacccucuggggcaccauccgaaguuuauaaaaucaacuugaggccaaggcuauaguuaaucaggagggcuuucagagcacgagugcuccgaguccacacuuaagaggcaaagaaauuauuuaauaagacaaucaggggcucgagaaggcagaguuuauuuagcuuggcuuugcagugccucuuguaguaauuuauccuaaugguaccaauucgcccaugauuugauacagcaggagacccaggguaucgguuuaaucaaaccuccaucgaugcugccuguuucuuaacuauuguugcuguauaucaaucaguuucucuugauucacuaaucggauggcacggggauaugaauuguccugggauucaagaaaucagguugacauaauucuuuauaaugugccugcuuuuaaauggcauuauuucaccccacucacauuauuucauguuccuacagcugacagguaaaggguccagauugcaauuggcugugggugagaaagaaauagggaaaaagccuggagccuuggggucaaacuauuuugacugcuggcucuacuacugccuguuagaugagacccuucugggucucaacguccuuaauccuuacauaaggacaagaaucuacucaggcacagaacuguuaugaggaugaaugaacugguguaugaaugagccuagaucagugucuggcaagcaggaaaaagagucucaacaaacgacagauucacuccccagcugcccucauuuccacucccgaaaaccuggggaguuacgaauguaucugcauuauuuuuauagguaagaugccaagaugugcaguauuuuaugggccugaucacgccuacguugguaauccuaggagggcgucuaaacuuagauccuuaugcucagcucuccuguccccaccgaggacagagucaggcaauugccaucaugcuuuauucauguggugcuggccuggcuguugagcacagaccagcgguguccucccucucacuaguggguacucuguugcuucccuacccaaaccuucuuccuuauacagcacgcacagaccagaaauuacaagaccagaccuuuuccccuuggaaggcagcaacuuuugaaggcggagaaggcccauccucaccuugcguucacauuguucaagagagaagaaggaaaagggcaacuggaaucccaaauuuugaggcaaugaccauguggauggcgaggccccggcaagggucccauugcugccucagagaccuaaaaguugagguggccauugcaagccucaguacaacagcccucaguugcugcuucuguaaaaugggcauaugaagauguauuucauugagcucacuucccaaggcaaaaaugggcaagguauucuggcccuuuuuccuacaaugagaacuaaaucugggccuuucaccauucagcuuagcuguacaaauuuuaccucaguuauccuagcuuacgguuauuuccugcgagcagacccaaaaacaaauuaaggaauuagcgugaaaacaaagggaagggaagaagaaaaguagagaguaugggagggaggaaagaaagacggagaaagagagagggaaagaaagaaugaggggaaggaagggacaaaaaggaaggauagagagaaggaaggaaggaagggaaggaaaaagaaagaaaggaaauagcaagagaaggaaagaaacagaaaaagaagaaaaagaaagaagagaugccgugcuugcccacaccuuuuccacacuccuuuucuccguucuuaauauuggaggauuuugugcggcuuuuagaagcgcuauuguuccaauagccaggguaaggggguuaaugccgccugaacaagggacucguugcuuccucccucccaccuccucccuuuucuuuuuuggcucagccuaaauuucuaacacuaccugaugaaauguaguauacagcuuuuaauugugcccagaggcgguacaacuucacagagguuuagaagcaaguggcggaugauuugagaaacagcuguguucccggcccacgcgcuccgagguggaacagccccgucagcaccugugcccgcugagcacacacccucacacccuacaugcgugugcacagcugggacccaucaggguuguaaggaauuaaugcucuuaacuugguauuuuauuguaccuagaggagccugacgcuauauuaaauccguagcacguaaguaggguuuuguucaaucuuaggguuacuggggcugggggcuggaugggauauuaaaaaaacacaaacacacacacgaccucuuuucugaugcugagaacgaauuguuuuaauaucccaauguuugguuuauuuauuauuagggaugaguggccacuuuuaaagaguaauggaccuuaucuggcacuaaccuaguuuucccaauugaaucuaucucagacucccagcaauugugggaagccaccaguucggauucuuuucucuucccaaagcccagcuucccuuggcgcaugccccaaaacacaccucccaccuuuuggacuccauggagucuuugaaauccuacugcaaacuccaccucucaccagcacggucucuuguuauucaacugcaggccucccgagucccuggaaguucaaguagacgagugucuauguacccaucccacagccccguaaacagagccgaacagaaaccaaugcccaagucauggcaaaccgacaucggaccuuagaauuccaucuacuggccauaaguaaaacacuuugucucuaagccauguuauauauucuguuguaaacacaaugcguaaaauuuuuuccacagcagcugguacugacugcgacuauggagaagauaucaugagcgaguuuucacaaaugcuguacucauguaauuagcaaugcaccucaguaucugugguaggcagaaaagugcccccugccccagaggauacccaugucaacuccccggaaccuguaacugugacucuauuuggaaacaggguauacgcaggugugaguaaacauuuuuugauacgauaguucuggauauuccaaguggguccuacauuuaaagacaaguauccuuacagaagaaacgcagauagccaggcauggugacucacgccuguaaucccagcacuuugggaggccaaggcagguggaucaccugaggucacgaguucgaaaccagccuggccaacauggugaaaccucgucucuacuaaaaauacaaaaauugaccgggcaugguggcgcacgccuguaaucccaucuacucaggaggcugcggcaggagaauuacuuaagccugggagauggaggaugcagugagccaagaucaugccacugcacuccagccggggcaacagagugagacugugucucagaaacaaacaacaacaaaaaauaaacgcagagggaaauuucagacagacagaagggaaguccaagugaccauggaggcacagauagaguaaugugaccaccaguuaaggaaugcuuaccgcgaccugaagccgggaagggcgaagaacaaagucuccucuaguguccccagaagcagugucaauuucagacgucugggcuccaacaccgugagcaaauguaucucugcuguuuuacgucacucaguuugccguuauuacagcagccacaaaaaacuagcacaggguccuuugcucugggcaccaugugagauauauuuugcugcuaaugggggcucuuggcaggaggggcgccuaaacuucggguacuguggaagugcagaaagggccacauugcccacuguuaccccaucuguaccuacuuuugaggaaaugguaguucagcucuguaggguaaaugcgccugacagcaauagcuugagcauaccuugagaaugacucucugaaggguauauguaccugaaugucuguuccuagcuagggaaucugggaguggccaaucaggagauacauucccugucuaugaggaacaacugagcccccuggccucacaggccguauggaaaauccagucccugaguuuuggauuaaauaaagguugccagguggaggucauuaacggcaggauguuaagugaaaauguuaucuaaauaaacugcacucuuccugcaggcaguugcgguuucccugcccaggccacggccacugggcugugugguuauguuguccagccacugacacuggacuguaggaaaguggagucuuguccauuccacggccccugaaccauuucuguacauaaggcaguucuccugcccagcccacugccacuaaacucucuccuuuguagguaaaccccuaauaaaacccuaugucuuguuugcuggcucugggucucuucucuggccucuugauccuagugucuucccuaugagguuaauaggguucagcacaacagcaucguggagaagccagccacugccaucaugauucaaaccaaacaguucucagagaaggguacagagggaggugaaaagcauacuguccucccggcuggacagucccguucucuucguggcuggaccauuugcuaugugugugccgcuggcacauuauugaauccaugccuuaguugccuuguuggaaaaaugagauucucaauguaaaacccacuuugaaaaaacugcaaaacaucauaugaacgucacucauuugcuucaauccauauuuauaaagcaccuacaaagugucagacucauggagcgcggauggcacuccgauuuugagggaggacacaaucucuaguagguauuauugcaacuuucuccaaaauacacuuuuucuuaaguauccacuugucauccauuaauauaacgaaaccucuuuagaaacccuccaauccaaaaugcuggguuaauguagcccauaaauugaauuuccgcuguguuucucuggauucuccaaauuugcuucuuucaacccaacaauaacacaccauuuguuuguuuaucauauuaguaaugauuuuuuuuuuuuuaaugagcacucaauacugguuagacgaaacuggacuucagugcugcuucugaucauuuaaauugcuacaaaccuuuuggagagcaauuuggcaauaugucucacaaaccuuuaaaaaaugugcccaaccuuugaccuaguaauuccauuucugggaaucuauccuaaagacauaaugggaacuauagaaacugcuuuaugcacagagauguuuaucacaacacuccuuaugacaccaaaaguauuuaaaaccauauaaaugaccaacaacauagaaauggauaaauaaacagcaaugcuuccccucuguggacuaucacaaccacuaagaauugcaguuaagaagcauuuagaacaacaugaugaaauguauaaagacagggaaaaauaagcaaugugccaaaugggcguauggcaaugaucucuaugugggacaaacaccacacaacacaacacgugguaaaaagacuggaaggcaggcauggguuaauugugguugccaugggcagcagaauuaugagugauuuucuuccuucuuuuuaaauauuuuuaagauauucuucacugagcuguauguauuaucggcauaccucauuuuauugcauuuccuuuuauugcacuuugcaaauacuguguuuuuuacaaaucgaagguuucuggcaacuuugcauuaaggaagacuaucggcaccauuuuuccaaugguaccugcucacuucaugucucuguaucacauuuugauaauucuuacaauauuucaagcuuuuaaauuauuauuauaucaguuuuggugaucugugaucagugaucuuugauguccccauugucauuuuuuggggcaccacaaacugcacccauaucagauggcaaacuuaauugauaaauguuauauuuaugaauaccacacuggcuccagcaaccugcuguucuccuucucuuucccccuccuugggccucccuauuaccugagacacaacaguauugaaauuaggcaaacuuacaacccuucaauggcuuuucagugcccaagagaaagucagaguugcaugucucucacuuuaaaucaaaagcuagaagugauuaagcuuaacgagaaagccaugucgaaaacugacauaggcugaaagccagaucucgugccaaacaggcaaguugugaaugcaaagaaaaaguucuugaaggaaauuaaaagugcuauucuagugaacacacaaaugauagaaaccaaaacagcguuaucacccauaugaagaauguuugagugguuuggauacaggaucaaaccagccacaacauucccugaagccaaaaucuaauccagagcaaggcccucacucucuauaauugugugaaggcugagaggggugaggaagcugcagaagaaaacuuggaagcuagcagaggucgguucaugagguuuaaggaagaaagccgucuccauaacaaaaaagugcaacaugaagcagcaagugcugaugcagaagcugcagcaaguuuuccagaagaucuagauaagaccacuaagguggcuacacuaacagauuuucaauguagacaaaacagcuuucuguuggaagaagaugcugucuaggacuuugagagcuagggaggagaaggcaaugccuggcuucaaagcugcgaagcacaggcugacucucuucccugcuggugacuucaaguugaagccaagcucauuuaccauucccaaaauccuaggguccuuaagaauuaugcuaaaccuacucucccugugcucuauaaauggaauaacaaacccuggaugagaccacgucuauuuauggcaugauuuacugaauaauuuaugcccacugucgagaccuacuguugggaaaaaauuuguauuccuuuaaaaauauucugcuugguccagugugguggcucacaccuguaauuguggcacugugggaggcugauuugggcagauugauucaccacaaguucaagaccagccugggcaacacggugaaauugugucucuacuaaaaauacaaaaauagcccagccuaguggcaugugccuguagucccagcuacugggaaggcuggaguaggaggauaauuugagcugcagucaugccagugcauuccagaccaggcugucucaaaacaauaacaauaaaaaaaauaaaaauauuccacuuguugacaauguaccucguaccuaagagcucugauggagauguacaagauuaauguaguuuccaugccugcuaauacaaugcccagucugcagccuauguaucaaagaguaauuucaacuaucaaguauuauuauuaaagaaauacauuuuagaagccuacaggugccacagauacuguauucuucugauggaucugggcuaaguaaauugaaaaucuucuagaaaggauucagcauucuagaugccauuaagaacauucgugauucauggcaaaggaucaaaaauuaauaauaacaagaguuuggaagaaguuuauuccaccuucuugggugacucugagggguucaaaaguuaguggaggaaguaagucuugagccccuucaagacucauaugugguagaaauagcaagagaacucgaguuagaaguagagccugaugaugugacuaaauugcugcaaucucaugagaaaacuugaauggaugagcacuugcuucuuagagaugagcaaagaaagugauuucuugcaauggaacuugcucuuccugaaggcgaacacugaacauugucaugaacaacgucaugaauguuguugaaaugacaacagaggauuuagaauauuccauaaacuuaacugauaaagcaguggcgaguuugagagaacugauuccacuuuugagauaaauucugcugugaguaaaaugaugucaaacggcagugcaugcuacagagaauccuuuuguaaaaggaagagucaauccaugcagcaagcuuuauccuugucuuauuuuaagaaauugccacagccaccccaaccuucagcaaccgccaacuugauccaucagcagccaucaacaucaaggcaagacccuccaccagcaaaaagaugacaacuugcugaaggcucagaugaucauuagcauuuuuuaguaaugaaauauuuuaaaauuaagguauguacauuguuuucuuacaaugcuauuguacacuuaagagucuauuauaucguguaagcaacuuuuguaugcacugggaaacuccaaaauucaugugacuugccuuauugagauauuugcuuuauugugguggucuggaacgggaucugcaauaucucugagguaucccuguacuuuuaaauagagaaaaauucauuaaaaaauaagagacucuucauucuaacacauccgaauuggguggcgaaagcugguguauaugcucucuguuuccuucaggacuuuaaggauuuggauccugugaaguguuuuucuuguaacuugaaacuucuacacgcaggucaguccuaucacuguuuuuuucucuuauuuaaaagugcaaccagugcgggggcugggagaggcccccugcagcucaucaccagcucagaaaauauucuccaugcauauacucucauaucacacuuagaucuuucuuugugagaagaacugggcuuuuucugaauuacuggcuuguuuugaguuuagagauauuguaaacugcauaacugaugguuucucccaguuuguggcagcugcuaaaaggcucaaagacaaauguguggcuggcuuauaacaagagcagcaccuguggguuuuggguccuggcuucacucugggcuuccuguucacuuccaugccccgaguuucuuuccuacuuacugaccacccugcaccauauaaguccugauguugcuguuuccaauucuuguuggaaugagaugaaguauacauugaaaguuucuuuuucacauaugagacaggcuacaugcaucccuaugagcuguguuuccauugauuguuagagagaauuccagccaaguaaagggcaaaucaaaucaagcaaccccauuugaauccauggcacaacaaccauacugacuaagaacauggggaacacgaaggaguuaaauccacguggcagcacagggugggaggcggcagcauugagggaccuggucccuucccacacuggaggcacaagaggucaucagagcaggcaggaacuugcacuuggcuuugcugggaaagcagauacugugcuuauugcaauguuccugugggcgagcuaauugucuaacugcccuugagauguauauaauuuagucugcagccccggcuccugccucugugucaucaccaaugggcugggaaacaugaacaacaacaucuacgcccauuaaaggcagcagcaggccagcccugucacccacggccccuugaugagugaucuggaagcugugcuccugcucggggcagcugguuuacuuggcuaaaggguauaucuuuagcuccccuugguuuguugacaggggaugcuguguuccuuuccuggggcugccauaacaaagugccacaaacuagguggcuugaaacaauacaaguuuauucucucuuuauucaggaacucaaagagucugaauucaaggugucucuggcgcugcgcucccuccgaaggcucuagggcagaacauauccuugccacuuccagcuccuggugguggauggcaaugcuugcuguucccuggcuuauggcagcaucgcuccaguaucugccuccaucuucacauggccuucugcuugugugugugcacacgugugugcauguagguaugugcaugcauguagguaugugcauacauguagauacguagauaugugugcacacacgugugucucuccaaaucucccucucuuuucucuaauaaagacaccagucacuggauugaggcuccaucuuaauccagccagaucucacauuaauuugaugacaucugcaaagacccuacuuccaaaugagguuacauucacagguaacaggaugggacuucaacauaucuucuggggggaugcaauucaacccauaauagaugcacuuaacaagcagcaauuaaaagcaugaacucuguagucaucuggguucaaauccuggcucuaacccuuacuagcaaaugacuuaacuucuuccagccuuccuuccucauuuggaaggccuuaggccagcaccuggggcugucaggaagucaaacaggaucaugugccaugcgagcacaucgccagacauagacauggcuugucaagaacacguuguggcugggccuuaggacugccacucagcccugcuacuccgauucaaacauuccuuccacacacugagagacccugguucaagauuacagaaagcaaauugucauuaagggggucuagcucuucgcaucugguguuuaaugugcacuuugccuggaaaucucuccuuugcccuccuuaacccucccucuuccccuccucgggugaaaaguuggcuccauccgagcccucaggacuugccuuaauugacaucuacacuccaagaucuuccaggucacccugcugagagcaguuuagugcaacuuauggucagcccuuccuucuccagccaacugcuaugcuggggaccuucuuuggcgacagggauugcucauuccacccaggcguaagccuaaguuugcccuauaaaauauaggacauuccauuuaauuugaauuaacauauacaaugaauaauuguauuagcaugucccuaauauugcaaauguuguaccaagguguggaccagaagugccuggaugugaauguccugagagcaguccucaaccaacgacagaugaggaucugguggguaaguacuccaguuucuuugcccccugauggggcauaacucagagacggcauguuccacauggucuccccaaguuucccaggugaauucuucacccgucauccacagcaguaccugcucccuaacgcacccugggauggcuuuugcuuccccuucccuuucuccacuuccugggaaaaugccucugcccucccaccacuagucuccacauugagcuuguauauuccccacaaaacccuuaucacaacguguaauuacacacacauauguuuuucugauugcuuaaucucucuguuccaccagaccgaguucugguaccaugacugugccguucaccauuguucuucagcaccuggcacugggcuggcacucaacaagaacuugcuagaucaugaagaugagcaagaaaaugaaccaaagcacagccaucuaugccagcagagagcaaaagugguuuucagcugugcugagcugcgcugcacagaggcuagacuguccaagacuugaguuugggucucacuuggcucacuucagaaucugaccuuggacggucuccugagcugucuucaccucaguuuccucaucuguaaaacgaggcggcgaaacuagaugauuucucuccugucuuccagcucuaaaauucuacgacucuauauucuaggcaauaaacuuuacgacuaugaauaaauuaaugaaaaugaauauuuaaaugaugugcaaacauucaugcgagugcuuucuuaaucuuuuaugcagugggagagugagaaauaaaaccgagaugaaaagaucagaaauaucugcaucagugaaaagcuggugucuugcucccguuugccggggauguugguuuagaagaguauuuguugaagaacucgcagggugggggaaggagaagggucaaaaggcacgcaggcaucuggggaagcuggaagcccccagauggauggauauuccuggcaacaguucuugguccaggguaugagcaaaggaaauuauguuccccaacucucuggcucuuuuggucugucaugagccucaaaaauauucagaaugaagguuuggugacuugacaucugagugccucauguacuuaucaagaugaucuguugccuguccgucaaguggacagcccuuuuguugggucaguagacacaaaccaagagucuguuuggcauguauaauacuuacaaagaaagaagaauuaauuauuuaaagaugagacccccuagcuucucauguugguaggaggagcaaaaugggaaggagggagagagagaagauucucagaaugagccuguucuguguccagcccuggggaucaggcaagucuggacauugagguauggcuggggaguuuguugggauauucaccaaaaagaauggaguuuggggauggugcuuaacaggguccuaugagacaacucaucaucaagaaggagacaggccugaucuugacccaguugcaaagcuugaguuuauuacccucaaagcuugaggacuggaauucaggauggagucuguuacauaaauuuguccccugccaggcccaguggacacacaucugggcucaugggaugguguggucuauaaaucauaaucaauuguucuuuggaugaaauucuaauaugaugagccuaaauacuuuugucacugugaccuccugaucuuuuucuauccuguuugccuagacauuacccaugcugauuugccuccagaauuaccuacugcccuuuuuacaagacuuuuuggucucuugacaauugcagcucuuuucuauuuuuauuuuuuaacuuucuggcuuuuauucccccaucguacucuuucaaaagaguacauaaaaaaagugaaaccaugaugacuauucauuaugaauuuaaaauaauuaggauacucgagugcuugauuucaguuaggucuacauuuucaguccuaaacaauacagaaaacagugucuccaaaccaguaaacgauuaggcaaaagaccccagaaaaaggaauugcugcaaagccagaaguccugugaacacacugguuggauuuucugcuguuuucaaaaccaaaaauuaaacaugacagagaaacaaugagaaaaaggaaucugcagauacagugucaccugugucccgggucucagugccugaacugcuuacaaaucaugagcccuuggucauaccauaaagaugcacgaauaagagauacuuacuccuccccucuaacuuuguggaauacuuacaugacuuggcauuuuuauucccugccauugagucuugggacacccuccuucagugaaagcaucugugacucucuguggguguuaaggguacaaaugaucucugcuggucgauuacaucuacaaauacuugcugagaaccuacuaugugcaagggugggaauggaagggggaaaaucugccauuucuugaccaugaagaagaauuaaggccuugugccaggcaugucucgauaucucauuucucaaaacaaucccgaaagaccaauaacaguguucucauuuuaaugaugagaaaacucacaaaagucagcuaacuugcccaacacccagcugauaaaaggcagagcugggauucaaacuggguacuggcagacuccagaaacuccugcuccagccuccaucccgaagcaaaacaucccauauuucuucuucagaauuguugaaaguggcucuucauuucccugacuacaagagaaaugaacgugaguuuaacaacaaugaagagaaaaacagccaagagagacagaguggggacggaguguguguuggagguggagggaaaugacugcuucucuuccuucacacagggacaagaaugacuugagguacaaacuauuaacucucuuuacuagucagaauugggucagauauucuagcagagagaacagcauguucucugcuccagcuguuaucugagcuacacagcuggaggcaggacuccaacuugcuccuugggcucagagcucaagguuucuauagcucuccaagcuacauuugauggccucucccagcuggaaugauggggggagguuggcaggggcaugucggggagaaaaagguaagaggagaagagguggcggggaaguaggaggggcauucucauuucuaguggugcaaccaauuaucacaugagucaaaccuaccugccuggugguugccaaucagugaaaguuuucugacagauguucaugggugagaagaauuauuugaaagagagcccccaaacagccauaggagucgcugauuaaauggggguccugggugcaaugagguugcuaagcgaaagucugaaagcccaauaacaggaucacacccugcucaauaucuaccaggcuagcaauaaauugagauuucccaaagcccuugcgacauaacgggcuggacucuugauuuggaggguuggcacuuucauuuccaugcaacugacauuuuaagcucacauacuacuccaaaguuucuguuucuaaacaaccccaacaugcagaaugccaaaucuuguacugcaguaacaugcaugcuugggaaaccucugcuucugugcagguaucaucgagccugccuuagagagaaaaugacucugauuucuuccuaguuaucugaugcgaacgcucagauaauucuagauucuagauucuuggugaaaaagcaaggaguuguucuaugaauaucauaauuuagagauaaauaaugaacaccaaacuuggagcgaaauaccccaguguucauuuuauuuaauauucuccauugguggaaauaaauuaaaaaugaacaaggcuuguuuaugccugccuuacauugcucuccacuuuugaauagcaacugcauauuaauuugccaagaucccauaaauuauaauuagcccggaggauuaacaacauaaauccuugaauuuaaaaccaaccugcccggcucucucuucccuaugcccuaaaguaaaaaagagccauaaaaccuaucaccgcuacuugauccauuaaacuccggagacauucuuauuucagcuuagcuaguggagguagucuuuguuaaaucuuuuuaaaguuacaguagcucgauagaaacugggggucugggagacaaggaucugugucaacucccagccacagugcacacugcccagauguggauuaggaggacagcggcaaaagggacaaaggaauacguuucggcuuaguacaguuuacacagaguccuggaacuggccugagaugaaaagugcccccugccucuauauuguucucauuuauugucaagagcucuggaguaccugggagaggaacccagggcacacacacaugcucacggacacaaagacaacacacucacacaggugaugaucugagcuugcaucugccaagcucaugccaggcugauggggagaagaaggauaauguugcucagaugaccaaguauuucacacaagauuauggcgauuaaaaaaaaaaaacuuuuuuuuuuaaauuuuuugagacaaggucuugcucugucacguaugcuggagugcagcggcaugaucauggcucacugcagucucgaccuccaggacucaagcaguccucaggccacagccucccaaguagcuaggauuacaggcacacgccacuacaccuaacuaauuuuuuauuuuuuguagagguggggucucacuguguugcccgggcuggucucaaacuccugggcucaagcaauccuccugccucagccucucaaagugcuaggauuacaggcuugagccaccaugcccgaauaacuauggaaaauuuuaaagcaauguuuuucuugaugaugaaaauagccaaucacccuuaaguaugaauggcauaugaagugcccagauggugguucauccaggacugcacagcucagccuggacaaucccuucaucugcaaacauaccugcaccuugcaaucuuucgcucccauaccuuuuucuccccuuugaguuuaucucuccccuggagggguggucagguagacaccagaaaaaugcauggaugugugguuagccauacuuaauacgcagcucagcuauuuagaaacaagagcucuggguauacacugaugugugugucaagaaggcacugcaggaccccgcugaugcuuuugcagaggauauagucuugcuuguaagagggucuagucaaagccagaauuaugaagcuaaaauccauuuaacacuuagacaguggacuagugggcuuccuugccaccaacagagugccuauuuuaugaauuuagguuuccccccaauuauaaaccaacaaauguucauuguagaaaauccugauaauagauaagacaaucaaggagaaaauguaaaugucagcaugcaguucucauuuaucccagauauuuuguaauacauaugcugaauaggaauaaauauauucuacacucaaccugacucuuuucacuuaauuuuauucuaugacgacuucaccaugucccuaaucauuuuccaaaauccccaguuaugacacuucauccuauaacuguaguaucaucucugucacuaaugucgaauuauuagacauuauggcuauuuuaauuugugauuauaauuuugugaucauuaccugauacauaaacuuucauguagcaccuaaugauuuccuugggagaaauuuauaaaucuagaauuucugggggaaggaugugaacauuuucaagaaaaauuucauuuuuaaaugugacaugaaaaugugcaugucgccuauuacgaagggugagggugggguuucaguggagaucugcagagugugaucugccuccagcaaagaaaaaucaggcugcuaagucaggcuggucuuugggcuauccaaaagauaaaaagugaaaaggcagucauuucacacugugcuugggcaguaugcccaacagacccugaguagauuucuuuucuuuucuuuguuauugauauaacugggaaaaacagaacagcaaggaugagaacaaaaauaacaaauaaaaagucauuuugggcugggcgcggugacucgugccugucaucccagcacuuugggaggccgagaagggcggaucacuugagcucaggaguugaagaccaaccugggcaaaacagaacagcaaggaugagaucaaaaauaacaaauaaaaagucauuuugggcugggcgcggugauucgugccugucaucccagcacuuugggaggcggagaagggcggaucacuugagcucaggaguugaagaccaaccugggcaacauaguaagauucugccucuacaaaaaguuaaaggcugggagcgguggcccaugccuguaaucccagcacuuugggagaccaaggugggugcaucaccugaggucaggagaucgagaccagccuggccaccauggugaaaccccaacucuacuaacaauacaaaaauucgugggacaugguugcggggggcacccagaaucccagcuacucgagaggcugaggcaggagaaucgcuugaacccggggggcagauguuguagugagcagagauggugccacuucacuccagccucggcauaagaacaagacuccaucucaaaaaaaaaaaaaaaaaaaagaaaaaaaguuaaaaaaaaauuaucuggguaugguggcacacaaccuguagucucaguuacucggaggcugaggcuggagaguugcuugaggcaggagaguugcuugagcccaagaguuugaggucacacaguggagcuaugauccugacacugcauuccaaccugggugacagaaccagaccguucuccaaaaaaaaaaaaaaaaaaaaaaaaaaaaaaaaauuauuuuaagaaagagucauuuuagggucaugaaguucuugaaaaucugauagguauacuuuccccaaauacgcacucauacuccaaaguuugcguauuuuauuucagggaccaaaaaguguccccagauucaucccagaaucccucaaucuugauuaagucaguagaauuuagagguaagaggaaucaugccaugagaaguaggugagugugaacacaagcuucugaaugccaaagauucuuucaccugaacugagugagcacagguaaaaguuuugaggucucaggucaaaaauucaaaaugugcuccccuaggaaguuugacaagggaugaagaaguuuauuuaaggcaguaggcaucaaacuuuagcaggcacugaagucucuuggaaggcuugcugaaauauagacggcugggcccugcccccagacgcaguaggucuggggaguggccuaagaauuuccauuucuaacaaauucccaggugauucugaugcugcugauccaggaacuuggcuucgaacuuauuacugaaaagcauauaaugggauacuaugguaucacugaaaaugauguaaaauaauauuuacugucauagaaagauauuccuggcccagugcaguggcucaugccuauaauuccaacacuucgggaggccaagaagggcagaucgcuugaguccaggaguucaaggccagcuuguguaaaaaggugaaaccccguuucuaauaaaaauagcaacacaaaagaaauuuagcugggugugguggugacugccuguagucucagguauuugggaggaugaggugggaggauugcuggcauccaggagauggagguugcagugagccaagauugcacuacugcacuccagccugagugacagagugagacccugucucgcaaacaaaaaaaaaaaaaacaaaaagacauucacaguauucuauaaacaaaagaaagcagauuauauaggacuguguacaauauaauuguuucugugacuuuuuuuauaaaagcaaaaauagcuauauaugcauuucuagaaauaucuaaauacacagauuuaaauauagauauugauauggguauagguauagauauaaauguggauauugguuuagguauggguguggguguagacagggacagggauaagggaagguguauagauauggguaugaauacguacauggguacgaauauggaguuggugcccuuuucucugaguuuugagaugaugaccguucugcuuuuguuauuuucgcuuaucuguauuuucuacccuuucuacaucuaaaagaaauuguuuucacuaucaaaauaaaaaaauuccuuugaaugauucaaaacaauagcagacugcuguuacugaggacccuuuugucacugucaccacucggggugcugguucuguuccuguucauagcucaucgagaggcucuggggcuacaggacccacccaaagacccccagcaggugaggggcugcgucccugugcugguuccagucugucauaucacauuuuccacuuuuguaaacugaaaacucuagacccagccccgugcugaccggagacugccuuccaguaucaugaggaaauugggguggcggacaggugcacccucccccugaccccuaacgaccugcuuugcuccugaguaauuagccaggcgcagagucuaugauggggccuucucuggccgcugucugucgagguuuggacaccuuuggucaaguggggauugcaaguacgcacaguauuucaacguccugaaaucucuuaaugaauucccagcgugcauucuuggcauuuuuuucuguaggucuccaaaugacucucugaaaaggacucaugcuggggcccagcauuuguguucacugaucaacagaggaacggggauuacacaucaugaccugcauuuuuaaaugcaaggagacacaaagguacauggugacauacauaugugcaucuaucugccucaacacuuaauauucgugcguauuuuuguaucaauacuuaaccguacauaauuugaugucaaguugucaacuaauauuucucggaaauuacugaucuauccuuuguauauguuuggcauuaaaauauuauuuguuuuacaaauaugauagacggaugaauggauauaugauaaagccauuauagcaaaauguuaauggugguucgcuguaaaauucuuucaacuuugauguaugcuuaugaguuuucauuguaauuuugaaggaaaaugaugugucuuaugaaauaacaguaauagcagaugauaacugagguuuuaccaaaacauuauuaauguccuuacagaccaaaauaagacacaggcaacccuauguuaccacauuuuuuuucaauguuaggauauuucaagguuugaaaaccauugcuuuagaguaguucaccuauuugugggguugugaaucuuuuugauuccagcuuuagagccucccagggcugaaaaagaaaaauuguugauuaucuuaggcaagguccuuaguaaguacccccaccacccgcccccccccccccaaaaaagggcaccaccacauagcugugccuaccuuugcucaggauugguuacugacuauaguacauaaaucuccccauuccuagacuucucucuugaaauuucacacaucauuuucaauuaaggagcucuuugccugaaggacagagccaccugguuuguccuacagaguguaucuacaggcagauguguagaaacgugcaugauggcauaagaugccuuugcuugagaagggagcccauuugcagcucuccuuaccauccuugaggacucagaaacugaaugccuugaacggacuuaauaguuuaaguaacauaucuaggauuaauaauaauguuuaaaacccuuuaugaauagcuaauaugcauggacuggauaggucauuuuaaauguuacuggauuuguuaagaucuuaaaaauuaauuccuuuagcaaagucaaacuacagauugaaucagauaguauggaauaaauuggagcugacaaucacccuuuucuccauguuccauaaugaaacggguguucuccagcuaaggguucccagugggggccucaggaacaggggaagaggcacaaaauccaaggaaggagugaauccuugugguugugcuugagccccuaaacauuucccacuaaugcguuugcuuugugacacucuaagcauuuuuccuuacugaggauuucagcugcuggauuccccuaaagguacuuuaauaccugugcugggaggagaacagucacuucauacagaaauuaaauacauaaauuaauagaugccucuucagaaaaccuuucaaacacggaguccagcugcuucggcaacacugcagucaauaggucaaggccuuggcuaauggcuagggagaggcagaggagggaugaaaacgggcugagagacucagcagagaucaacaaauaugcccagagacuuaaccacuuaggugaauauuugccuuugccagaggguuauggugagaacuugcccaaagcaagaagcaaauggaaacaaggacacaaagaagagggaagaagaggaugaggagaaaggagaagaggaggaggaaaaggaggaugaggaagaaaaggaagagaaggaagagagggaggaagaggacagagaggaggagccaccagccaggguugcaugugcgugcccaaguacacaggacauucugcccuucaccugucgucuucaaagaccagaaaagaaugccacucucaaguucugccuuuggcaggagugagcuagaaagagucuuuagguguuuaaugaaacaaauaaaauuuaaacauguacccuuuagcuucagaaccuccgagauauuaggauuguguccaaaagacuugacaucuuuaugcaguggcuauuauaugccuggcucuuuccuagguaggcacuguauauauguuucuuguuuaaugagaucauuuucaaacucuuagcaacucuucuacccguuugcuauauauugagcuucaaaguaugauuuccuucaaagaaggguuucagcaacuuuuaacaaucuugaaaagcaugauguuugguaaaugcgacagacagcaggcauucucucacauuucaaaucuccaauggcuccuagcaguguauuagcacacaccagcucaauaauauuccauacauucauaaaaguuuucaaauggaaggagauguugcaugcagauaaacacccucccaguuugcccauuuaacagaugagguagcugaguccuagagucaaacaccucuuguccauagucacaagacgcugacccaauaccugaacuaagcagacagcaagcuuuuaauuuuauguuuauaggcaaguuaucuuucagaaagauugagaagagacauucagaugacauuucucacugauuccucaaaaacuauaagcacuccaguacauuguuuugcuuccggccucagucccugaaccugcccacccccgccccacccuccccacacccccucccccccuccccccuacucccugccccccacccccaccacccuccaccuuuggucuucaucugcugggaggaggaagaugaugcagcuugaauuaagugucaacuucagguaacucuuccagaauuguuuagcuuggaucucauggaucuccuaccucccugaguguuucaugcaugaaagccuuccacucucuccaaaacgcuguacuucuugaaaaccacagccauaaaacacguuucucuuauguaccuccuaccucuagaaaaaacuaucuggaaaguagaugugaaagcaggaaguauuaguccuuuuuuuuuuuuuuuuaaggcuaaguaauacagagaaagagagagaggaugagaaaugaucccagguaauucccuuuggaaaguuucugucuguugcgucuucuggaaagcacggcguguucuguggacauguauuucagaggacuacuuccugcauuggcuugaaugaaaagauucaccagggaugcuagauaagaagcaaauucccaggacccacuguagacccacuuaaacucauucccuuaggcugggauaugggaauagggaguaggcauuuuugaaagaaucucucccaaaugaucuuugucaucaaguaauuuuggggaauuuacccaacuuucaucuauuuguaaauuuggggaauuuaccaaauuccaccuuaccugacguguuaaauccuucuauaaccugcgaacgaucuugugucagcagagagaccagcagaguuguuggauuaagaaggauggguaaacagaaucaagcucauuucaaaacauuccacugucauacaagcugcgaauauguuugaauaaaaaccuuucugaaaugucuccaaagaucucucuuugcaugagguccuuucaaacgaggccaauuucuggagacuuuucuccauuuguccuuccuguacagaaugcaaaauaaaagacaccauuucugaguggccguuuuggaaggauagcuucuguaaauggucuuugcugaacucucguccuggguccuggguccuggguucccuaguucucauucccccauucacaccccccugcccaccacaagaccuuucuacaggugccaaguuuaccaaagacguuacgccuaaccccuauggagaaaaccccguugggugcaacauacaaauggagcuaguucuugccaguggacaucuuguuaauacauuccacugcccucugcucuaaaaggaucucgugugcuccacggggagacuggaaaaugcauuguauguuccaaagggaagaaggccuauuucugcaagcccagccccagucccugaauuauuuuaauugcagccuggugacgccaaggugcugaagcacccccuuaggcugagugcuuagcuaggagguacugaauuaaacugucagaacaugcagaaaaauugcaacgcggccugucaacaacauuuguuaagagacacgggugaggcuggugacuuguauaggaaaagagcugucugugcagagccaucaaagcacagccuggaacuaacgggguauucagaggucuuguucuacuucauuggucaaagccaacacaagccuguaagauuugggcccguuugcuguuuauuacugugguaauaaaggccacuuaaagauacaaacccaucucguauuggcuuaaacccagggcuucuuuucugaaucggaucacuaaugucucguuucucaggcuuuuaaaaauaaucuuauguuuuaggaacaaaaauucagaaaaaucagacauccuaucaaaagaagacauucuaaucuugaucuuauuuaucuuugguggguaucuuuuuuuuaacaucuacccugggaugguccauuuuguuugccacccuggcuaggcuauaguuuccaguuauccagucaaacaugaaucaagguguugcugggacaguauuuuguagaugugauugaagcccuuauucagcugccuuuuaggaagggagauaaucuuagauggucugagugugacggagucaaucauuuggaagauuuuaagagaagaacuguuucuuuuccuggagaagaagaaauucugccuguggauagcagcuuuagcauaugccaagaguuccugucugccucucucgacugcccacuguauggauuucagacuugccuaggcaacccuacuauugcauaagccaacuccuugcaauaaaucuguuucuauauaucuccuacucaugcuguugcucugauuuaacccugaaugauccacaaccuuauuuuagucccuugucucucauacuguaaccaaauaucuuuucauuagaagucucaaauuagagauuuguacacugcaaaaaguucauguuauuuucggcccauacccauguauuuggugcaauauguuaaaaacagaaauaaauugaauuaguugccaauauuuaaaacuccuaaagauuucucucucucucucucucucucucucacaaacacacacacacacacgcacacacaaucuacauuucuagauucuguuagaagagaaaaaaaauuaaagaaacuggccagcauaguuguguauccucauaugacaacagucagcuagaauggaaagugaccuccucuguuaacagagugugcgcgcugcaguuuaccacagucuccaccacuccuuauggucuccccggcaguaaggcuaauugucacgggaccuuacauuguuuuucuuuuuguaaagagaaaugugaaagauauaucauagucacuaugguuuggaucugguuugccuguccccaccaaaucucauguugacauuugaucucuugugugaagaugucaggagauggagccuaccgggagguguuugggucauggggacggaucccucaugaagggcuucaugccauccucaugguagugagugaguucucccucugugauuucccacgggagcugguuguuuaaaagagccuggcacuucccuucucucuugcuuccucucugcccaugugaucucugcacacacuggcuucucuuugccuucugccaggagugaaagcagccugaggcccuccccagaugcuuaaucuugaacuuuccaggcaugagaacugugaaucaaacaaacuucuuuucuuuaugaauuacccagucucagguauuuuguuauagcaacacaaaacggacaaaacuauacccuuuacucuaucagaaguagaaauuuuaaaagauauacagagaaggcaacauauugcaaggaaaaaaaggagaauguacauuuuucuuugcagaaaugaagaccauuucuaugcauuccacuuuccaacaaaguguaucuggguuauuaccugccucuacucauuuauguugaccugccuaguagacauguauugugugcaauuccuucuucuacacccugcacauuuuaggaaaaauucacuaugaaaccauucuucuuacucuuuaacaaaagaaaacgcuaaggugauuacaagggaaguuugcucaacacacaggaacacugugauaauugcuuuuggagaaauccauugaaaugcaaccaucaguaccagggaaggggugaagaagauuccaaugaccuucuuuucuuuccagacaguucuuaauaugcacuccuuugcccauggugaccccugagggguuaguuaaugggcuuucuucugcugguuaagaagcagaaaugcacucuaggagaaaauaccacccacugggagucaggugucuguguucaauccccacugucugucucagacacugagacucaguuuccuccucuacuaaauaaaaggaguccccaaaugugacugugccucugcuuagagcuucuggauucaaucugcaaucaaaugaaugucucucuggauggugaggcccaggcaucuguguguuuucaagcucccaggugauucugaugagcagacagguuugaaauuugcuggacuaaagagcgucucaaguuucuuccagcucaaaaacuugauguaccuaggaaucaaauucugcaggcgccucucuagauauuggacaggcaauguuccagacauauuaaugcuuuggggccacugggauaugguuuuaaaggcuugaagcauugccacacugccuuagucacccggcaggaccugacuuaucauuuugccuguaaugcauguugccuggugguuugaaacuucaccugaaguucagaugugaggcaagaugcaauggucaaaaucaacagaucugaacugcgaucgacgggcaaaaggcuugaaucuccucaguucccacucucagccccgcuacucucuuaugcccugugccaacaugaucgccuucccuaaauaaaagacagaaaguauccuuuauccuccaaagaucuuuuggaaacagaauuaaauugcacagcguucaccccuagcacacaaaccuaacccccuuuggaguacgauguugaaugucgucauucucagaaccugaggggcucucucugguucucaguaggagaggguuauguuuuuuccuaauacaaacaaaagacauuagaaagcauguggagcauaugauagcgcugcggugccacugcgaacaaaauauggauuuugcuuuuguaaugugugacuauuagaucacagcguugguugcaauaaauuaucacuuucaguuccugcuaauugcuagacucuucugccaugggcugcagugaugugggccaaaaaaaaaaaaaaaaaguuuuggagccagauacaaauaugcauccugcuggauugcgaauggcaucucggaucuugaauaaaugccuaaggaaacagcuaggcaugagggccugggaaucaaagacgucauuaugcaauuauugagaaaagcaggcucuuuauaaaagagaauucugacuucucugugaauccacugacccagagcagccuucacccuacauguauuccuguccauaacgaguaccuacaggguaugauggaagcaaguaaguuaacugguguugaaguuaaaaaaaaaaaauccaaccugaccuuuuaaaugaagagauccuucuaugccuucuaugccacagaaaguugcaaaacccacgaaugacagcaugcccccuuccuggcuucuuccuggcccccuccccaauaugcccacagauguccccacccgacccugauccuuucuucuccccagaguauaaagaaucuagugagaucuucugggcacaaaccucggcuucaagcuccuucuucuuauucugugagagucaauuucuguauuaagaucaaaaauuugcuaagcaccuaugagguuccuagugauggggaugcaggcauaaacaaaacaggugaaauaccugcccuguuggagccagcauucucaaagagcggggagaaagcaaaauggguaaguaacuggaaauugugcuuggauugauggcaaugauaauauggagaaaaauaaagcaggugaagggggucagaggugcugcuggggauggagaaggaagauugcuguuuuaaagaugguaucuagagaaggcuuccuccgaagguaacagagaaaggaugggccagcccuguagcuguugaagggcacucugagugggauaaccaggaggggcaugggucucauuccauugaacagcagggaggcccgcacagcuggaacccagugagcagggggaagagcacuggcaggaagaacagagccaaugggggaagggagaggacgcaggaugccauggccagcucgagagcauggcuugcacuccgaguaacaggggacgccuucagaaaguucggagcaggagaaagaggugaucuaacauauuuucaaaggagauucugguucuccguggagaaagaacugaaagggucccaacauggcugggugccaggaggcccuuaaaagaaaggacuguggucaggcucuguggcucaugccuguaaucccagcacuuugggagaccgaggcaggcggaucaguugaggucaggaguuuuagaccagccuugacaacauggugaaaccccaucuuuaccaaaaauaccaaaaaaaaaaaaaaaaaaaaaauuauccggguguggcagcgcaugccuguagucccagcuacuagggaggcugaggugggaaaaucacuugaaccugggaggcagagguugcagugagcuagaucaugccuaaacaacagagcaagacucugucuuaaaaaaaaaaaaaaaaaaaaaagagagagagagaauugagcagugauccaggcgggaggcgagggcaaccuggaggaguaugcaagggugaagucggcuuucugaggucuguauuccuauuugugagguuugucccuugcuccucucacauguaaacuccguugagaagaacucagucccuggcacacagaacacaugugacaaauaaugguuccauguugaaaaaccugccagguuagagccuacucaugucccaagaagaucgacuuccgcuagaugagugauaacuaaauguggcuccauuuguuuuauuauuuaugcaaugucagcucccccgcgccucacccugcaucuccucaucugaagaggacauucugacugauggaccagggcagaaaccagaagccauccugcugcccccaccucuucugcugccuggcucucugaccuuccaccugccauuuauuuuguccgugccucaauuucuccauucugaaaauaagaauaauucugccaagggaccauuaugaggauuaaugagguaauaaggaaaugccugaaagcaguuugagcuccuugaaggaacagcuauaaaugcaggguccauuuuuccaucucuucugucuucucccgcuaaauaaaacagccagagggagaaagcccuguugggguagaaaggaaaacgacagguggacaaagacagcagcucuuucuccagcaaaaauacccuuaaguagauucuaaggcauugggaagccuuuuagagaagccuccuuugcaauagaacggggcuggggcagagaauauccaagaaauugugaggauuauuuugccucaauuuguggaccagaaaucaccucaaagggacuuagaaauaagccagaaccaugucgccccuccugugugcccgaagaauucagaagcugaccaggcgauuggcaaauccccucagcaguaaagugaaaaaaaucgcccacgacgcugaucugguuugggcugaugacacucugggguagacacaguguaaaccuguuggcucaauaaauauugggcuccuuuuaaugaaagaaacacugucauucucuucucguuuccucccucuugucucuuuaaaacuccuuuaaaugagagguuguuauuccucauuccagguuuaucuucagauggucacuaaguuuauauauguauccuuguacauauuuuauaccaaaacuucuagaaaaugcuaacuuaaaaaaaaaagaaaaaacagaccugagauggguuuuugaaacgguuacucugaugcaguuuguuguuguuucuuauuugcuuuuuaaaacugaggaaauggccuggugcgguggcucacacccgucaucccagcacuuugggaggccgaggugggcagacugccugaggucaggaguucuggaccaguuuggccaacauggugaaacccagucuccacuaaaaauacaaaaaaauuagcuggacaugguggcgggcgccuguaaucccaacuaccugggaggcuaaggcaggggaauugcuugaaccaguuggaguuugcagcgagccgagaucgugccauugcacuccagccugggagacagagcgagaccccguaucaaagaaaaaaagaaaaaaaaaaaaaaaagaaaaaccucaggaaaugcagacgagagcgcuggcaaaagugguaaugaaauaucggcacacgacgaacuuuugcaagcaacccuacaugcacaguuguuuguaaaugaggaauuguauuucugcauucacaggauagaggagugaggaggugggaugagugcuaggugggcacuuuaucuggcuaaauuaugccacuacuucugagugaccccauggacauucauucauucauacauguauucguucauucccuagcauuuguggaagugguauaugacacgguacuaagugauagaaggcucugggcuuccuccccuuucucucuuggaaggagagagcgagaaaguggccaggaagcugcggugaggcccacucugggcugagucacucgguuccccuuuucccuuuuuacuucaggccugucacucugugucgaagggcagggggaggggaagcaagagagaaaaguaucaaugauuggagaagaggaacaaguuuaacuaauaucugauuauccuuuugauguucauucaaguuaccaaaaaggcugaagcacugccugugccucgacaggaagugugcgguaaaaguaaugucgugauguuuguugugggugccaaugggccacccugcaccgggcacuggaggccugcugggaaggugaagugggcccacugccugcugcgggugguggcugagccacugugacuguuaaaugacucuuuuucauuuaauaaaagaaaaaaaaaucaucauauauauugcaagcacaauuuuuaggcaaauaaaagcucuaucuaaaucaaacagaaaaauguugggucacaauaagccacugaacauuucuuuuugaucucauaauugaaaggacucauuuuuuaaaaugagaaaauuuaaauaaacaaauuuagagucucauccccuaaacgcaacuacugucaguauuaauagacagguauuuaguguuucuguguaucuuucgccuccaaaaucugccucucuccccaccuccucccaaccacaccgugacauuuguuuuguuuuucugauagauguaaacacauaauuuuugcccauuuuuuuuccuuuagaagugucauucuuuucauugauguagacuugucuaugaaauggcuguaccacaguuacguaaccaacagcucagcaucuuucuuuacagcuguugaacugcuagguaaaaaguaguggugcaaaaguaauugcgguuuuugcuauugaauauaauggugaaaaccgcgauuacuuuugcuccaaccuaacuagaaaauagcauucuauauuauagaugaaaacucacauguccauccaugaaaaugggccuuaucuaguugaaauccaaacuccacuccuauggagcugggggguuaugagggcugaggggccugagugagacagccucgggauggccuaggguuuaugaaggagccauagaauaauauguuuucaacaacguuuacauuaauuccagagagaucuccaaaaacccucauuuuuguguucagucuuggggaaauuauguccaugaaagguacauacaucugucucuguuuccaucacaauucacuccucgccaacgacuuuuacuggaaaaagggguuucgccagaugaaucagaucaggcuaaagaccaauuacacaaaacaaggaacguggcugcuggccuuuucccugaacugcagcugaaacucagagaaccauuuccaggggaaagagcugggcuccuggaagauguauagggucagccugguggugagauggugaugagcaagggugcacauccaugaggaaccaaucauguuggaacaacuaagugauaucgccucuggcuuuauuaauauuaaagaccacaggcuaggcggcugccauuuuacugcccuguuuucaagccacccagcacgauugauuccuagcucccaaaggcuuccccucuguuaucucuuuagguuuuaauauuguuaaagccuuaauaaucggugggcuaaacacacauguaaugaauccuauuagucauaaauggcucccugcacacaagaaaaugaaguaggaagccuucucuugcacacaggcaaacuccccuaauucagacuaccugaaagcaagacugaucugaauuacacauuucuuuaaaagaaaaacgugaggcccggugcgguggcucacaccuguaaucccagcacuuugggaggccgaggcgagaaaagaucacgaggucaagagaucgagaccaucuuggccaacauggugaaacuccgucucuacuaaaaauacaaaaauuagcugggcgugguggcaugcaccuguggucccagcuacucaggaggcugaggcaggagaaucacuugaacccaggaaguggagguugcagugagcccagauaauaccacugcucuccagccuggugacagagcuagacuccgucucaaaaaaaaaaaaaaaaaaaacaaagaaaagaaaagaaaaagaugcggucgggugugugcagaaacccucuugagaaaaccaacuuuuaucuagcaaaguccuuaggcgagcugcuuuaacgaagagguaagaauauccuugagucaguaggagcuucuaaauugcccgaggguacuuuaaaacugcucucuugcaaagggcacaguucccccagauuguucugggguguucuuugcuuaguaaacccucucuccaagaugacugcacaggcuaagccucaagccaagagccaaauccgaagaucauaaaucccagauuccugaaguccacaugaacaaaaauuggguagaaugaacacccaguggggaagcugguauauguugcuacugccuggcagccuucaaauucaucugugcucacgaaagcagugaaagagcuucaacacaggaaugagauuacaaaaaaauuucaugcacugggaucagcauauagcaaaaggugagaaaaaaaaaagcagcauuaaaauaaaaaugccccaacuacuacuuaguuuuuuguuuuugcuuuuguuguucacauuguuuguuuuguuuuauaggaagaggaaaaagucugggggaaggaugugguuaugguggcuggucacugggcagaaccaaauaaaaccucgagagccucccucgcucaaucaggguaaaauccagucuuucuaggccuggagcgguggcuugugccuauaaucccaguacuuugggaggccgauguggguggaucaccugaggucaggagguugagaccaggcuggccaacaugguaucuacaaaaaauacaaaaauuugagcugggugcgguggcaugaaugccuguagucccaacuucuugggaggcugaggcaggacaauuguuugaacccaggaggcaaagguugcagugagcugagaucaugccgcugcacuccagaugucucaaaaaaagaaaaacaaaauaaccaaaacagagucuuucuaaaaaccaacaaggcagggcauggccaagccuccucagucucuccuccuggccuugguggcaugccugggccccgccgagcaugugccucacucgggaccuugauacuugccguccccuccucccuugcacccugcaccucuucggacaggaaucuguccacaggccacucaucacagaacccugucuagagccauacagcaucgucuuccuguccucagcccucuaaacaggaaugaauuaucuuuacagcacuuauccuugcuugcaugucuugauuucuuucacgucucuuuccccaaguagaaugaaagcucccugagggcagggauuuccuuuguucacugcuguaucacuagguauugcacauagagggcccuccagaaacgugagauaacugaaugaacggaugaaugaaugaaauauauaacuauauacugagcauggcuuuagacaccaaugcaacacauuauaucacacacacacacacacacacacacacacacacacacacgcacacaguagaaucugucaggauggcaccccacgaggcuagcaucuuaacccgacccuggcccacucagacccaccaagucaagaaacagcccuuuuuaugggccuuccaguaacauuaauuguuggucauaaaacuucaaagaaacagauauuuauagcuugauuaaagccccuuuuuuccacacacacucaccacagcacuuuccagcuggguucccaugagcauacugaaaacagccuccugcccacuuccugucaaagccaguuccuuaaccgcuuagguccugaagcucgccggcccccccuuuuuuuuuuuuccaguguucacucuuucgguuucucuuggguuuucgcaguuggguuuuucacucuuuuucucaggcacccaagccccccuugaaccgcccccauauccagcaugacaacaggggccaaugaacacaucagaacuccgaggaaugaaaagguuccuucucagaacagccucccaagggaaacaaacaaacacuaugaaguuuugcaaggucugggcaacuaauaugguaaucuguuuaccaugcuuaaacgcuuaggcgacuggaaaacauuucucuagugcaccaauucgaagaagucauuccuguuuuuuauguauaaagauugccaccuuagcagggcgugguggcucaugccuguaaucccagcacguugggacuuugaggcgggcagaucaugaggucaggaguucgagaccacccugaccaauauggagaaacccugucuguauuaaaaauacaaaaauuagccaggcgugguggcgugugccuguagucccagcuacucgggaggcugaggcagaagaaucgcuugaacccaggaggaggagguugcagugagccgagaucaugccacugcauuccagccugggcgacagagcuagacucugccucaaaaaaaaaaaaaaaagguccccaccuugaacguucaugaugacgcuaauuuauaaucaaaccuuugccaggaacuuuacaaauauucuaaucauuacaaaaaucuugugagaugacuaaugucuccauauaaaacaugaguagagacucauaaaaggucaagaaaccaguuaugcagcuauaaaacggcagagcuaggcccugugcccaccauaugcggccuuccugaugaaaagucacauucgcacccuugguacagcacacgaacuguauuaacugcauacagaaaagacaccaaagggcccuaauucaggcaaaaugaaauuggcuucauuccugacaacagcuauguucaagguacauugaguucauccuauacucccucauuacacuaaacauuaagacaaaaaaaauagauuuuaaaaguacacuccaauaggaaguauccuuuggaaaagaggugaucaauauguucaguaagcuuuaaaggaugagggucagaaugcauccugggcuucuauggacuuugccguuggguggacgaugaauucucuuugaauaucugcaguauaucuaaagcagucuuagcagcccacgguaaguagcaacugugguaauuaauaaguauuaugcgguucucaauauggaccacauauuugacaaaugauguacccacagaaggagccccccugcagauguuaucaucugagaaaaauggaaaguaaaguggucuccauggagugagucuagaaaaccucuuuuaguuucaaaaagaaacccccauagaaaacaucgcauuucuuuauguugucauuuuucugacuccgucauauuugcagcggcccagauaagacuugcugaugacugugagguuaucccuugcaccauucaccugugcucaucaggcugcccacggcucagggccagaccuacgguguucagcaaacccugucuuuaucugaucagagucucaggggagcaacuccagcugcaaaauuccugccgcuacauggauuuugcauggcugugcuggagaaaacaaccaacgggcugcaaugcucugcguccucccuuuaccuuaaaacgucccauccacaggcugugcuuagggauccaagucuaggcugcuugaaggccaccccguggacugagccuagcuaguucaagccuggcugaggcccaguggcauggccuggggagaugagaugcuucuaucugaugguucuccuucaggagccugagagagucaagaguaccagaugagcucacacuauacagagggcucaaagaggccaagaccaggaugcaccaauuucauaggaagcaaaagugaugaauaagcagaagaagcuagaauggaagagagaagccaaggagaugguaguggagccuuggacuacagacccaugaaugccuccugccaagggucccuaggccuccuugaguccagaacauccuuccacauccuguccuuuccgaggccugaacuuucagcauuuccugguccccuugagcauacaugcucacauuacgugagguggcuucagugauuuccucgcaaccaagagaacguacuaaacuaaaagagcagagaaauggccaaauuccagagaaaguguugcaaguaccaauaacucuauaacuuaagucuccucuuucagcaggaccacaaaugcaacgaucuaggguguugccaugggccaacagccaucggcagguaauucuucucugccuccaauaugaagucaacuccccagugcucaggacuucuuguccagcacagagucuugcucuggcuuucuccuguuggcuggcuccuuccaagcuuguuguucuagcacaggguuaagaugaggauucuuagacaaguuauuccaagccuugccugacuggcugugaaaaugaaaagcugccuacaaaccacccaaugugacucucaaacacaguggugucuacggagauaagcauucuuugauauguaacuggcuuucuucuccccugcccaugcuagcuucagcuucuucccugcucaacacaggaagaaccaagcauuuucugagaacauuccggagguccccaugcuucacacgcuccuggcuggggaagagaggcacugauccaugccacuuuugaagauuuaggugaagggcuugaaaucauggcauuucccccagacuguuccauaaauuucaugaauacucuccucaucaugccacuuggcuucuuaccucuaaaaugcaauucccaucuccauccuuacuccaucagugccugguagagggucuuggggucaucugagcuguccaucaggagcagauggggacccccagguaucuccauucccuaggcugccucucucaccauaucccauucagacacggggcuuccuagugcucugcagagucuguacuagagaugugacugcagcucuuacugaacacauaaacucuuuguuuuauuuuguuuugggacagggucucacucugucacccaggcuggagcgcaguggcacaaucacaguucacugcauccuucaccucccagcgugaagcaguccuccugccuuagccuccuacauagcuaggacuacaggcaugcagcaccaugccuggcuaauuucuuuuuauuuuuuguagagacagagucucccuauguugcccaagcaggucucaaacuccuggacucuagugauuuucccaccuuggccucccaaaguguuggaauuacaggcaugagccacugcaccuggccaggacacaaauucuuuauccacaccccagagucaggucucuaacuccagagggagagaagcauucauuacuuuagaauuuggauaguacuguacugacaaagucuugcuuccaccacaaguuuugauaaguuaaucuauuuucaaaaggucaucuuaaguaaauuagagcucaauacccucaaaauguaucaagaaacauaccagaagacacgcuuucucaucucaaagcuugcauuuucuuugcacaaauuugacuuuugcauaucaaucaaauuaaaauaauaacaguaauaauuuguaauaagaaacuagaacuuaacaauuggaaggaugaaaaguugccugaacuucucagacagaaaaugcucaauuaacauuuauugagcauguaauaugugcugggaauuuucauuuuuacaaagagaaaaaaguggcaaugugauccguuuaaagaacauugagagcagccacaauauugacuguuaguuuguuuucuuucuuacugacuauacugcucuuuuuuuuggagauggggucucacacuguugcccacguugaagugcagugccacagucauggcucacugcagccucaaccuccuggaugcaagcgauccuccugccucagccucccaaguagcugggacuacaggugaguagcugggacuacaggcauguaccaccaagccuggcuaauuuuuuuguuuuuauuuuuuguagugaugaggucucacuguguugcccaggcuggacuugaacuccuggccucaagugauccuccagucucagcuuccgcaagugcugggauuacaggugugagccacuaugccuggcuacugacuacauuucugcuaauacuucugaaugccuuuugacuauaggguaacugguuuugguaaggaauaaaauguaugcauuuuucuagguacuaacaguuauuauaaagaugauauaauuuugaaaacaaaauagagaaacagguuuuucuauguggaccacuuuuaccugucagucuuugaguagacucaaccuauugagaaaguugcauuuccagagaaauuuucuuuauaggaaauuaguuuucuagguggugaaggagcaaaggagaaaaaaaccaaaaccugaggcugugcccacaucggcccagugaacugggaagaagaaaagcucuuuuucaaagcucagcaaagcagaccacccagugggaaccucccagaagagugaaaagcaucaucuguccacuucaaccucauaucauuuucuuggccacuauuacuacuguaauaaccuagacaguagcuccuucaucauugggaaaaucuaagagaccuccagaaggugguuuggaaagagaaaacaacuaauauagcucccaacagagucaagugagagaaagagagagagagacaaagacagaaaugguacucccguguuuuugucccuaaacauguauaugcagauauauuuacauauguauauuguauauauauauguauauuuaaguguauaauugaguguggcgacucaugccuguaaucccagcacuuugggaggcugaggcgggaggauugcuuaagccuaguaguucaaggcuguggugagcuauaauugugccacugcacuccagccugggagacagacaacugugucuguauuuugauugcaaaauuauaucaucuuuguaauaacuguuaauaccuagacagggugaccgugucuguaaaauauacauauauguacaaaugaaagguugaaucaguaaaugaauacauguccuacuuuaugucacuuccacagacuccuuucuucuuuguauaaaaugcagcaaacccuaacaaggagucacugugaggauuaaaagaaauaauacuuagaaauuacuuguccuccaggugcgguggcucaugccuguaaucccagcacuuugggaggccgaugcgggugcaucacgaggccaggaguccaagaccagucugaccaauauggugaaaccccaucuuuacugaaaauacaaaaaguagccgggcgugguggcaugcaccuguagucccagcuacucaggaggcaggagaaucgacugaaccuggguugcagagguugcagugagccgagacuguaccacugcacucuacccugggcaacagagcgagacuccaucucaaaaaaaagaaauuacuugucauaagcuguuaucaccauuuuaggaauuauuuauauuuuacauuauuuauuccugguauuauuuguuguucuuaugacuuauuuuuggugugauuuauugaucuuuacauauuuucucuauuuagaguucuacuucucuuuguacagcucuagcacagucaguguccuuccucaccucuucacuaggaacaagaaaugcauuugcaaauaugcacaucuuucuucaagcuggccuucugaacaccaagagugccugagagcugcggccccacccuccuuuggucuccucaaucagcuccuuccuguuucucccugguuucucagccacucuccaccaccauguaaaucaagaaguucacgauggucugguucugccuguggagacuuaaaacugaugcgagugguuaaccaaaacagcccccacagaaacuacaagggugggcuccgaucgggagucagaaauucuuucuaugaaaaugcaaagcacgaccucauaaaagaaacccaccgcaggaagaugaagaaaugucaguuugcauuaaaacaaaauaggaggaugaacauuucaaccaucuggcaaaagagucuccuauacaaauacauaaaaguugccaaggaguuagacaagaccucagaugggaacuccggagcuccacacggcucccuuugugccuuagugaaaacuuugaagcaaauucagggccggguguuagugaucgguuuaccguagcaguauauucccucugugccgugcaauugucuuuguuuuccuucgaaccuaacugucuuaucgugcauuagagccuguaaugcauuuuggaaggauguugcagccauacgcgugcauaagcagaugaauaaaacaacacuggugugagguuuugugagaaagaaaacguuugugucaggugagauaggcuagguucuacugcaacagccgauaccuccaaaaucuuagugacuuuacacagcuuuguucuugacauuaguaauggccaacagggaagcucuguugacuguggucacucagggacccaggaggaagacauggguuucaucugaacauugcuuccuuaauugcuggggcauaggaaggggucagggugaaccacacacuggcucuuaauauuuccaucuggaagugucacucacauuucauuaggcaaagcaaaucacauggcaauggcaaugcuuauugucaaaggaggcagcaaagugccccuaccugcgcccucaaguaggggaaccgcaguguuagggacucgccauaaugacucacacugggcucccaacuauggaguuccuuaaaugugucagguucuucauucauuaucuugucuagauuuacagugaagaugaaaauggcugaaacaagaggccccaaguucucugcugugucuuugguaggagugccagguaggcauuuugggaaccacucacaccacucucugauguagauuuccacauuuuaggguuaucuucuaguauccccggccucccaaaaccgagccccuccugaacuuauuaugcacaucugccacggauuacacauacaacagcggacaauucaugaccucuguaagcacacacaagguauaaagcugaaagcaaaaagaaaauacucaauaaauaucaccucccucccaucuucccuacacgucccuucucaaaaguuugcaucacaugaacaacucuucaccugcccugggaacugcacagauguccaaaugugcuggcagaagcuaaaagagcagacuguggaucuuaaauggccuguaacuauagguauaggaugaaaucaaaacacucgcgacuuucuggcgggcuguguuucaugaaacagugauaugaaccacaaugaucaacccaugaagauggaccaagaugcgaggcacacaguuccuuugggcuacuuucaacaucuccauaggucuauaaaguggccagagaaguagccauuccugaguaccugcuucuccuggccaugggaaggugaccucaugacccuccccugauguaacucucauaacaaauccaugcaguugguauuaucugugucuuacaaaggagauggaugcucuggaacuccgcugaggucacacccugggaagaagcagaaacgggucucaaaucaaaguccaucugacucuuuccuguucuccucugccucuguuucccaaggcgacauauauuaauauugcuuuuaauuuugcugaaucuuguuucaggugagugucagggaaucagauuuguuacaaccucucccgggcuuuacccacuagcuggugcugagugaagagguucuaggcucaaggauguaguugaugaugcuguauuuucgcuuggcaaggaauggcuucacuccaucagauugauuuugacauaaaccacacuccugugcuuacagaauuucucacgaguggucuucugguucuggcguaugaaucugauaucaaccaccccuuugcaguuaagccaaaccuugagguuuugcuacgguuucacugugagugaacucgcccaucagagugaaacuaggauagaaaaagggguccuaacccacagaggugggaggaagcaaucugcuuugucacucaagcacgacaggucuucugcuggagaccagaggcagccaggcaggagcauccagcgugagacaggagcccccgcaagccaugguucacacuuggcauggucuaaauuccugucacugggcuauuccuggucuuggguuucugagaauuucaauccauugauacgggucucacucaaauauaaugcagugagaaaagucuugaccaaugaggaagcgaaggcucaaagagaguaaagauuuuuguucagggccccacaaagagcagauagcagaguugagaauguuugauuccaaaguacaaggucuguccuguuauaacacaucgccaugaaaaugacugcagaaagcagauggcuuaaugaggauaguuaggcucaugccuguaaucccagcgcuuugggaggccaaaguggauggaucaccugaggucaagaauucaagaccagccuggccaacacggcaaaaccccaucucuacugaaaauauaaaaauuagcugggcauaguggugcacaccuguaaucccagcucccuaggaggcugagacaggagaaucacuugaacacgggaggcagaaguugcagugagccaagaugcugccacugcacucgagccugggcaacagaucaagacuuugucucaagaaaacauagacuuguucucucagcaccccacacuccacuggaucucgauuuucuuaucuccacacaggggauggaaacaaugaccccuggcagcuauaccaaaaaacuucuauaauauaauaguuguuuucaaaucuaugagugagaaguaaagaagagccuggugggugugcaugugcguguguguguuuggagguauaaaaaucuuuucaucacuaucuaacuacacuagaagaauucacuugccaaauaaauuauuaucuuaauuuaagagacugggugaugcaucuguugggauaccugccaaauauacaaaaugccuuugcucuuagaauaaaagccaugcuuuuccuuuuuauuccuuaaaaaauucuuuuagagauguugccucccuguguugcccgggcuggucucaaacuccuggcuucaagcgauccucccacuucagccucccaaguggcugggauuacagguaugagccacuguacccggcuaagccaugguuuuucaacaagaccccgaugccggauacagaugacuggaccaaauguagauacuggguccagauugaguccauccaaauccaggaauuuggauucgagauucaguguuagacaaucugguucuggguaugguuguggcuauaaugugcaaauuccugaucuucugcaacgugcaaagaggaguauaaacagcugauuuguggcaagagaagaauugaauucuaucucccaggaauuuggauuugggauucaguguuaggcaauuugguucuagguaugguugugacuauaaugugcaaauuccugaucuucugcgacgugcacagaggaauacaaauagcugauucguggcaagagaauaauugaaccagauguacagagaaaagcagagaugagagacagagaaaaggacuccuguguggguuucugucucuaucgcuagugucaccccucccaaggcuuggcugugucacugugggauuccacgggauucucugguauccugaugcaucaucacacccacucuuccuccuuggcucccuaaccuuuuuuccuaaguuagauugaaagguuccuauuacucacaaccaauaauccaugagggccaugauuuuucuguuuuguauauccugcuauauucccagugccuaaagcagugcgugguaucguaagaaauaaauauucaacaaauacccguagaauaaauaaaaucugaaaucuuaaucagcaucccaggggguggaaggaacagcuugaggaucuuuccgcuuauuuucagccugccaaauuuucuauauucgugcaauggggcaaagcuaugcccagagaagcauauguuguaaucacauuuguguccaacccucucuccuuuauuccaaagauacaugcuugcagaauuuguugugucugcaaaauaaugauauaguucccuguugcaaagccugggguagacauaaacaauuauguuguaaucacaauuacaaucauuaaauuuaugaaaugccacagaagaaggagguaagaugagugaaggauggugaaagacuuagugaaugacaggucaaagccgaacauuuaaggaaaguuucagaagguuacaggcaaaaauuaaagcaccaggugacuaggggaagugcaaacaaugggaaacauaugguucaagaauguaacaggggguuggggcaaacaaccucuaggaagaaagacugucucccaaggucacaggaaugagucaccugggaugccuagauggauggauggaugaauggauaccggauugauggcuggcuggcuggaugggugacacuucugucauauuuuuuuuugucggggggaacccaagaaaaaaagagaggcaaaaauuggauaugguagucagaagugacgugagucacuuaugggcuaaggugauuaaauacccacugucuuaucuccauucuuuccuucuacuguugcuaagaccgcggaugcuaaaaauaaaggugguggugacagaagauagaaggagcccgugucccuaaauaucuacuuggaagagagcauugcaacuagguacagcuaccuuggauguuacaugaacaagaagucauuuuauauuauguuaaggcacuaauuguaaaguuguuauagcaguuagccuaccuugaucaaugcaggucaaauguauuauauuuuagcaucucuacugauuucuaucaaauuuggggggaaaaauaacuucagggccaaucaucuuugaucucugguugggagaggccuaacagggaaauaaaggaaguauuuauugagcaccuauuaugugccuggcaauugguuuaagcacuuuaaauggaccaugucacuuuaaccguuagggauaggucucauuaucaccacuuggagaaauaaaggccaagagaagugaagacauucuaaaagauggaccagaaaucaucaugguugaguccaaucuggcuauaaacuguuaaaucucccuuuauccaucaaguccuuuaaacacagacaacaaauucaguucaauucaacaagugcuuaugaaguuuuuacucaaggccaggaacuguguuaaaugcucccaggaacucagauucuccuauggcgagggaugcuuaaugaauguacacgguacuaugcagucaagguuaaaaauggaguuuggacagugugcagaggacaccuacagagagaaauguugcguggcauucaagggacucuccucucaacuccagccacccugccaucuccacacacaggacacuuucuccuucccgagccaugagaaucagagaagugauuccaaagcuaugcauggccaggagcagcccugugaugccugccuugcaaguaacaaaacccuaacccaaacucaggggaauuugucaaccuauggaauucaaggaagaguugugucaccaaacugugaaaaggucagggagggagcaagaccuagaaaaauacuggagccacagacuuuaucugaaugucugaaaugaccucucuucacauuaugggcagccugaaggccaucggcucccaaguuuuauguccuagagcuuucaccagugccaggaaauggaaacuuccaguucuaaaaaaaaucuggggaggggaccuuuuuuuccccugagcuugugggaaggugcuuaaccacacacuaaccuugauaaaaauggcaccucccaagguagccacaagaggagcagguaggaacagaguuuccuggagaagaaggggucagggaugggugccaaaaaccaaccccacaggcguccacaaugccucucgggagaguugaguaagaagaacgaugcagaacacuagugaacgauccuugcacaggacuucuuugcaggaguuuaggagaauacaaacuucaaucuuugaauuuucuuucaaagaucucuauuagcaaaugauaacaaaacaaaaggauuuggaaagauuauuauuucuuacaccaacacacaauucuugcugguauuucauuagaugcuacgagagauguaaauccugugguuugaaaaaaaaaaaaaaggggggaccauuuaaggacauuggguggaggcccuuucagcaacaauggaacuuuaaguacuugacaauuuguaugcugucgguauguaagcaaugagccucacaaaccccacagcugcauguuuacaguuuagaccaucucugugaauugcauccuuauguucuguauuuuaaaaggccauuuucagcuccuacuuagcuuccacucagaaauaccauucacaucaggucucugugcaugcaugugguuuuuuaauccacacauugucgggaccggccacggcaauuuuccccauuguguuugcuuuccaugcccuguuccacgcugaaauucagaauucggauguuugucaaaacgcaggggcccuguuugaucuuauuacuuuggcacauuuuaauagugggcaaaaauaaaacaaaaaagaaacuaauggguuuuaagcuccugauuggugucaggcccagggucaaguacuuuagagcuccgauuaauucuacaaagcacgggcuuagggguuggagagcaguggguucaaauccucauccggccaccuuuuugcuaugagaccuggacaaauuauuacguggaaccuuagggaauugaugaucggcuacuguuuuucccuauaaaaacagucauuucauacaguucaaccuaauaauugaccucuuuaagccucaccugcaaaauaagaauaauaauaccaccuuucucucaggguaagcaugaggaugaaacaggacaauacgcauaaaacaauaaacacuaagacaagcgucugauacauguuagccauuguuguuauucacaugcguuaagcaguuucaucuucauuauaacccuaugugcuagguauucuuauucccauucugcaggucaggaagcugagcaagaagauguuaccaauaacccgaccacagucacauaacaccuaaguggggggcuaaagacgaaguucgauccgucugacucucaaguuuguggucuucccauaccgccuaccuagcugugguagguacagauagaaucacugugacugggucaugaaggggccuggauaggcugagguccagaggccagagcucaucggagaguuagcuuagaugguucuaggacagcgggggcuggcacggaggaugcaccggacaagccaaggagccagcagcauuuuuuugaaugcugugaaaaagauacuaccuugagucuuccauagauucacaauagcuucagaaaauucucaugaaggaaaagggugagaaugaacacuuugugaauuaagaugaaaaggcuacauuucaggguuuccaagaaggcccaagauaguaagaaaucaagucauccagauacuaggaaaaagugauucuuuuacuuagauuucuguaaagggagcaaacacgacacuguguguggucacacauaacccacagauuucacuaaaaugugacaguuuguucccugauaugaagaugggaugugccucauaauauuccuuugagaaaauaauacucagcguaggcuggucuuacucuuacaaaucucggcaauguaucauuggcucaaaucuucuaaguaacaaauuucuaagaaacauuuucaagaaaaugguucuacauauacuguaagaagaaaaaaaccccacuucaacaaauacuuuauuuuuaauguugaaaacuggggacuccacacaugauccaacguuagagcagauguuaacuaaauuuaagucugcccuuuacagucaaaagcaacaggaaaaaacauaauucugaaaaauaacuuaauauguuuuuuugagauaguuauaagggaaggaaacaggcugccgagguauauguacaccauguauguaaaccucucuugcuuccauuaccuuacuugaaaaaucaccagaugagaccccaucucuacuaaaaauacaaaaaguagccagguguggugauguacaccuauagucccagcuacucaggaggcuaaggcaggagaaucacuugaucccagaaggcggagggugcagugagccaagaucaugccacuaaacuccagccugggugacagagcaagacuccgucuaaacaaaagaaaaaaaaaaagagagagagagaaaggaaaaaucgccagagguuguuauuauacagagacaaaauuauuuaacacauguaagcaacaaugaaagcaacaaucauauggcuacaacuauauuguaaauaaaaacuuagguauaggggaaaaagacagaaaggaaguacugaaaaguccuaaagguuucuagguuaaggugguggaagcauaagugauuuuuuuucccuuccugugaucugccggugucuugaacauacauguaugauuuuuacaauggguuaaaaaacgaauguagaauaaguaacucugcuacuauucugccaguaguuuucaaacuuagggcugagcagaaccaccugggaagcuucauacaaaugcagacucuuaggaugccuuccagagauucuaauucaguugguuguaaucuuccaagugacucaggaauuauauuuugagaaacaguguuguagugaauuccaaacaaaguaauaacuauugcacuuccauagugauuuuucauacugaguuucucuggggucuuuggggucacugaggaguagggaauagucgaauguguagaaguugagagagcugacguuucccacuuaaaacaauguccuucccucacaucuguuguauauacuacacuuuggcaaaacguuuauuuuucuuuuuuuuuaaagguucuguaucuaaaaacuaaaaucaaaagccuugcaagagauuuaucuccauuuucugaguucagaauggaaaugguuacaucagcauuugauuuugcaaauaacuugcuauuuucugagcugggggaguuaggcuaucucagcuuaguuaucuuuguagagggaagaagaggauaaauaacauaugcugaucaacuuacuauaucucagauucuuuacaaacauuaccucaucuaauccucauggagacucuuagguucuuaguauuccuagcuuauaaagggagauacuuaaguguagaaugcuacuccauuuccaaguaggaguguagagauccccucauggucacuguuguccccaaaaucccaggucucuccauucccccacacugcccauugaugggucagccagccucuccaaauggagaaaauaugaccaaaaaaaaaaaaaaaaaaaaaaaaaaaaaaaaaggacuagugacauuucagucaggaugagauucggcuuugagugacaacggugguuuuaggaagucagauguuuacuucucucauuuaaagugugggaaaugggggugacagccaaccaucauuagaaacccagguuccugacauuuggggcuggaugauuuauuauauuuuuuaaaaaaauagaaauccagguuccuuccacauauuugcucuucuaucuucaacacacagcuccaacuuggggucggaguugccugcucgaacucuaacugcuuuaacgucaacauucuagucagccgguaaaagaaaagggccacaaagcacccauccucagccuguauacacucguagcagaaguacuguauugcugugcuucucgaacuaaccauggugaaaggcuuuuuuuuuccucagaccuuuggcaaauaacuuugugaaggguacccuccuccagaagagauuuuaaaaaaacauugagaauugcuagaaaaaggaaauuaaaaaggacauacaaaauauaagcccauuuuaaaauuacuaccuggaacagacauaagcuuaauuuugacaaauaguuacgaacuuuucuaaagguugacucucaagcucucaacuuaucucucaguggaucaguuauaaacccuacggaagcccugagauacgacaguucugcuaacgucccauuuacuagaacuucaucaaaggaucacucuagcugcaaaggcaagcagggaaauauagucucuucccaggcuguugaaaauuagguauuuuauuaguagguaauaaagggagaacagacauuugaagacacucagcagugucugcaacacugaucuuaaaaugaaacaaagucuacggcugucuguaggagacauaaacucaaaucuccaccuaaaaugauaaauccauauaacucuauaauaacaaagccaggcgcgguggcucaugcuugaaaccccagcacuuugggaggccgaguuggguggaucaccugaggucaggaguuugagaccagccuggccaacauggugaaacccugucuccacuaaaaauacaaaaaguagccgggcauggcggcgugcaccuguaaucccagcuacucaggaagcugaggcagaagaaccacuugaacccaagagguggaggucgcagugagcugcgaucgugccauuucacuccagccugggcaaagagagaguaaaacggugucucaguaauaauaauaauaauaauaauaauaauaauaauaauaauaacgaauaacuacuauaauguaaaaaagcgauagaaagcucuuuuauguaccauaaugaggauuucuagauaaaggaaaugaauacacagauucugcaacucucacugaggcuagcacacgucuagauaugggugugcugaugaacagccacauggaagcacauuucaacuaaaaacagugaugacguuugucaaugacccggaguccaaauggggaaaacacuuccacuuagcugaaaguggcaacuaaacuucucaucaucucagcccaaauucaggccagaaaacagcuacacacauucugguucuaaagacaugcauuugaaaauaagaaaucaaagaccaagcauuuacuaaauacuaggauuauguuguaugauaaauauacaggcaaaguugaagaauugcuggaagauuuaagagaaaagaagaggcuguuguggcccugaugaugacgauggugauggugauggugaugaugaagaugacagcuaaaacaaguacugcuaacuuugaucauuaauaauuauagcuucgauaaugauacugaauaucuuguaaagcgcuuaauaaauaaaaacgucaacugcagaaaagcaugucaaaaugaauacagauuaaugagaucuagaugaaugguguagcuuuucucuguccagaaauaaacucuuaccacaucuccucucugaaucuucaagucuauguugcaaaguagcaacaccaaggugaacacucaugaaauucuguccauguggaggucucaugccuaugggaggcagugcaacuuugcaggaaaugugacccaggaccucugcagaguugagaaugcauaugauaggaauacuguuuucuguuuuugggggguuggggggacagucucauucuguuacucaggcuagauugcagugguaugaucauagcucacugcagccucaacccccuaggcucaagcaauccucccaucucagcuuccugaguagcuaggacuacaggcacacucuaccaugccuaacuaauuuauuuuucuuuuuuuguagagauggagucucacuguuuuggccaagcuggucucaaacuccuagacucaagcaauccucccgccucugccuuccaaagugcuaggauuacaggcaugagccaccauggccggcguauaagcauuuuuaagcuaauacaaaaaagaacgaguaaacgaaugaaugaaugaacaagugagccagcucacacaagguuuggccacccuaccacccaaugagaccaucuggugcaccagacauggaguugguugcaacacugcugaccauugucuccagagaagcagagcucccaacacacuugucccuaggcagaaucugguuuaacuccuaccucugaaucagagccacucauuuuuaggccaacagaucaauuacuugaagcaaucaagggaccaacuuaaaaagcuacguuuacaacgugaaggggaaugcggggcaggaggccaagaaagacccaagagugguuuagcaaaaccagcagagaguaacugacuacaagccugagcguguaaugggacaggaggcuggcagagagccagugaagccuuucuuaggacucuaaaaaccugaaacagcucuccuagacaaggagaguugaagcaauaaaaacaguuuucaaacuagagagaaaacaaaaugaaacuugguuuggguaauuggugaacucucuuggguaacagggcucuaagagaugaggggggaagaaacgcacaaccccuucuguauuucacacccucucaaaugguugaaaagcuuuucuggcuuccuuuaacaaguacaccaacuucaaaagcucagaguauguuuucuccaaauuaagacaaaaaagucauugucagguugucaaaaauguauguagcaaguaauaauaaaugcucuuaggagaggaguacaaugugagacucaccugaacaacaaagccccuuaacuguguucaucagaagaaagugaucauacauuugauuaaaaacugcuagccuggaaauguacaggcagacuucacagucuauggaauaaaugggaaucauaaaaagagaaggucagugcuuugcaaccuuauaugcugccuccaugcauucacguaugggcugcaucccucgagaguacacucccuacauucugagucccaaaguauguggggguagggagggacauaguaagaaaccaccugcccuggaaguguauugucaaaauguucugugcugagugacgaugcuacuucaaaaaguuucuguggagaauauagucaacacacccacauuucucuuccacucccucaccaauauagaaucacuaaucuaaagagaugagaaaaacuucaucuguguucuuugaagaaacaaaucaaauguuaaaagaggccuuuccauugauucauuugaauuauccacuugaagcuugcaccacugacuaaaggaagaagcaagccagcuccuggauuguugacaucucucgcauacccucucacgcccugaacuucugugccucuuccuuccucccuagcagcagccuaccugcugcaccaguccgaaccugacugcccgucugccucacucauugccaaggagcuuugcucaucuguguacaaucaugauagaaggcagacgcuccacccuuccagacuaugagaauuuuccaucgguggugaguaaaaauccuagcaauccaucaagaaaaagggcaucuggacugauacgucauuuccaaagacagccaggagaccauuuugcuggaggacacuuuaaaagcacaauuuacuucucaacaguaaucucagcuuagggcccuucccaguugguuucuggaaaacacacacacacacacacacacacacacacacacacacaucagaaacacauuccuaagaacaaacuggagcaugauguucucucagaccaaguguggguuucaacauuuacaaguuuuauaaacauuaggcacugcagcugaccugcauugccuugguauuagggaaauagcuuaacuuuucucuuucaagucaauuugcccaaucuuugaaugauaagucuugaggaggaacuaucaaacuauauuaggaauauucugcauuuauuuuggaauaggaaauaaauuguuuuucacagaagauguuucaaaauaauucuaaaugcuugaauacuaauugguugccuugaacauccuuaaauaugugacacaaagguuuggguaacuuuuuggucauagagggggaaaaaauuugaaacaagguguuuuucaaugagucaauuugggccaaaguugguuuacauagagcucuuaucugagacuaacuaacaccaguuagcaaaacacagguuaaccccagaaaccuccuccuccuucccggcuucucuucuuucccuaauaacacagacauuggccaucuauggugaccacacacugccucauuuaauugacugcuacuuucuauuugcacacugacauuuagauguuuucuuuauuuuuuuucaguccagaaacccacuuacuucaauaaugguugauaacagcauacuuuccacuagcacuguuuauuagcuuuaaaaaaaaaaaaaaaccuaccaauaaagauucuuuuuuaugugacccuuuuccugccaauagguugugauaaauaagucgguucuuaguuccuaaguuuacguaaaugacuacaguaacgugugaacaagacagagauguaaaggucuuuaaaccacaguuuaacaaaaagguccugucugucaaugaaauaaagcuguuuugaauuuguucccaaucacugggcucuuuugcuggaagcucauguuggcuugguggugauuaaugcgaagccacacggccuucgcugagugcguaagagaacuggcaacucuaaacagcauuaaucguacucacaacuacuugcuacaugcugaaguuuucuuuauuuuccaccauuccaggucaagaggauacccaggugcauuuaccuucgccaagcgcagcgcagggcccaccuuuccccgaagugagaugucacacguggggaguuccggcacuuucuuuccagguaguucaucugcucugcgcuuuacugaucaaaugacucuaccaagucaagucggaaacuuagacauaacuacuucucaggugcacaccaagauagaugcauaucuuacgccugugcguaagacaacugugaaauguuuggcugggaaucgguuaagcgugggcaucagacccaaggaaccacuuucggcauucauucccuaccuccucucucgcuuucuuuauuauuauuauuauuauuauuauuauuauuauuauuauuauuggguuuuuuugagacaaguucuggcucuauagcucaggcugcagggcaguggugaggucauaucucacugcagccuuggccuccugggcucgagccauccucccaccucagccuccugaguggcugggagcacaggcaugcacccccacgccuggcuaauuuuuuuuuuuguuguuguuguuuguagagaugggggucucaccauguugcccaggucucgaacuccuaggcucaagugauccuccugcuucagccucccaaagcguugagauuacaggcaugagccaccgugaccagccacgucucugucuugagcuuccuacacgugcagugcuuucugaaaaccauguggcacgugaacauaugauugugcauucaggaggaaggagugugucaggcagcacagagcuacucucaggaacacggguuuaaguccugacugcaccuuaccacugaacaacuccugcaaacacagacacauaacacaaugggacauaauuguccucacccccaagaugguuacaggcuuuacaugagcuaguuaugggaagugcuugacacagucauggcauucuuaggcaguucauaaacaucauuaguuaccguugcuacuauuuuuauaaggauuacagggucauucacccaaugcucucuccucaaucacucuuaccagauuccacuaacauaaaugguguguccacaauggguuagggaucuuccggagccccccucccauccccugugcacuuguacaugcagcuaauagccccaaagacugaccauggccaaggcaaaggcaggaagaucaaugagaaaaucugugaguucugcuuuugugcaggcuuuuuucucaaaacuaauuauuuauuggcugauuuaggugccuugccuggaucacaggcauucccaggagacgcccucucaggaggcuagccucuuuggaagguuccagaagggaagagaaggaaggacuuuucauuugcagaugacucgcaacacugucagcagcacacucauuccauucgaaccacaaaguccucaguaauacccacuucugugcauuugccaggcacuaccauaggcacagcgaauacagcugcagaugaguuuaccuucuugcgggaaagaccaaccugaaaugcacaaaagcauaauaugcagguggugauaagugcccccccccgccccccaccccacccacacgcacaaauuaaaaacccagggcaggcagaggaugagcaugaaguauuaguacuauuccauguggcaguggucagggaaggucucuagugaggagauguccgggcagacacuauaaaggguaaagggguagcccucacaggagccgagaagagcaucucagguggagggaagcccaaacguggaguuuucauaaaguuuuuaagaaaggucaaggaggucaggacagcugaagcagagagagagaaagagagagagcgagagcagacaacagccauuuugaugucaagggaggaacagggacucaagucaugcaggaccuugcaaagguuuuagcuuuuacucugauuuuagaaaacuuugaucugauguguuuuaaagcaaucguucucgauagugaauaucagaaucaccagaagcaaagacagaucucacccagagcaaaggggauggccggcccuaugaaagcuggagccccagacaggcccuagacagggccuccaaggauugcauccagcuaugcuccuuucagggagaccucacuaauaaccaccuucuuauucauuucgcggaugcucccuuccagagccguccuucaacagagcacuuaacuguggcaugcagaaugcccuuucagagauaguucauaucucugccaucucugccaucucugccaacaagccagucccaucugccagugucuucgacugcaaugguagcuaccuuuucagcugcuacuguagucuggaaugaaaucgaggcagccaaggcuugagaaaguuaaacuggaaaauggugacaagccacauuuguaugguaccucguuugaccuggaccauugccagagggaaauucuccaaggagcaaaguccuucugguagaaggcagguggucccuugaggcggcaggcucucauggcacagagccugagaaaugcaaauucgccgauugaauuaagugggcaccugaaugcuugcuuaauccggcucuauuguucaguucugcuggccuugccagcuguaaagaggugagcuuucagaaauaagggggaaagaaauccaaugaggcuuccuggaaauuauucccuccuuccuucccucccuuccucccuucuucccuucccccuuccuuccuucuguccuucuuuccuuccacagauccuauguugagcucaacugugagccuaauugcgcacuugauaaugaugucaaaauggugacgaaggcagauuccuucccagcccugauggagucuacuaugucccacugggugacacagauaauaaacaaguacaugaguaaagcagguacugccugugcucagugugcgggaggaagcagggccucaugacugaggauaaccagaggagguauggaaggugggcuuaagggaggccucucuggaaggaacgucccacguggaacaguggagggaggggagugauuuaggaagagaggacggcaaacucaaagauuaguagaugaaaagguucuugggcagugcacaaaaagaaaaagcaggagacaggagacaggugugaaggagaagcuggaggcugcgauuaucaaaggcuccacagaucaugaugaacagacuggauuuggacuuuaauguccaaggcaguagggaaauguuggaaggugguacaaagaggagagacaugagcuaaugaaacuuucuaagguauucaagaacaaugccugggagcaauggucaugagaaugaagccaccuuugugaaauugugaccauaagaggaauaugacagcauagcugacuccaucuugcuucuagccccacgggcuggcaguccucacucaucccugggcauagggcaaaguaacacugggaagaauuuaguuuauacuuuaaucuuaaagcaagaaugauaacagccuuucccgaaaugaaaccaccuuuguaaagcuccuaaaaggccacaagguuaggauuaggagaggggucugaauucagcuaagauguaggcauaggaggucacaagauuuggaacuuccccaauuauuccuguagauaacaucacuauuguagaaccuaagacugguuuuuuuggaaugguuuucagacuuuugcauuuugaugacccacugaccccaccuaggccugggacuugugauucaacuggaacugaggcugacccagugcacgaggaccauuuuccacacuucaaugauuucauccccaaccaaucagcauuuuccauucccuagcucccuuccugcuaaacuauccuggaagaacacuagccuccaaauuuucggggaggcugauuuggguaauaauaaacuccuguccuuuugcuuggcuggacuuguguuaauuaaacucuuucuuuccugccauaaugucaucucagugaacuggguuuuaccugugcagcaggcaagaagaacccauugagcaauuauaagaacuaaggaagcuuccgaagccuuuguucacucuaucaaguuuuuacgguuuaucugcauuuccccauagcgaagagaaacaagaacacuaauaauaaguaaggugggaaguggagagugaguccuagagacacacacaggcauacacguaagugcuucccuaaacaaccgacgaacucccagcaacccauucacccuucgcacacacacaggugcucaggggcauccaugcuccaucucuauaaacacagauuccuggcgccauuugcacuggccaucagaacguccguuauaaacugaguauccucccagcacauucuugucucucuuccaacacaacauuagaaugccauuccagggcagauaauucauaaauaaguuaagcuuauuugcauccuuccucacacccagugcugugaaugccuuaagcgucuccugacccacacacauggaauaguagcccaugaauuguacacuccucccucagggcugacucucuacugucaccaucucucauuuaauccuugcaggaacacgaagagguuggcagugccggauggacggcuaaauaacugcuuugcuccaugucuuuccaggaaaacuauuuccugugcuugauaagccacaugagaauccgcagaaacagcuccugaagaugcuccaggugucuccacaucugcguuccuagacacgccucaaaucccucaacaaacgugaugaugacgacgcauggguucugcaggugcugagucagcacuuuucacgcauuaucucauuuaaucuucaaaauaaccuuuaggucuagauauuauuccuacuuuuacagauaaggaaacugaaacuuacagugcaacccaucgaauuccacaagcuaugcccuaaaccaucaucuuaaauucucaaccagguugucuuucuaaaugacuaaggauggguuuguauuuucuuugccuuguauuacaacacuucguauaugucagugaaaggaccccacucuuguacaacaauauuacaaauugcaucuaaacccacauuuugccugugauggaagaaaacucucuaucagcuagaggauuuauaaagaucauuuacauaaacacuagacauguugcuguagugccuuguugagaacuagaaaauugugcacacuucugaggcuucuaaaauacaaauauuuggcaacuuguccucaaauggccuggcuagagucaucuccaggaaaaucugggguucuaauucaugcaacauucugguuaacugaaaauugccaguuuuugcuccauacuagucucauuaucuuugacaauuccuacuuuaaaauugauuucaggaagagcagcaacagcuaucaucaucugguuguuuagguuucccaacucuuuaggucccacagaaauggauguuugcucuauuuucauuuucauuuuuauuuugagcuauuuuuauucuguuuucuucugguucuugaagaccuguggauuuuucacagagguuucuugaggugcuggcacgucaauccaaaagagaaggaaaaacaucacucuagcgcgcaagagucaguguuucuagugauggcuuaaaggccaaaguagacccaaccuuguuuccaaauccgcuccuggaauucuccauuugguuuuccagauaucccugaaaggggcccaaacacugcaggcuuuuguuugguuuuguuuuauuucuugcuuuuguuuuguaguuauuuugucccuccuauagcagagaccaaguuaguuuauaucguuuugacuaauauuccauauccagacuggcaaccuguggacagcauucagccuguugugaugugauggggccaagauacgcacgccaggaaauauuccgauuucggaacaaaaaauaagaacacuucaaaaacacggcuauaaagagcagaggcggcuugggcuggguaaccauaucuaaaacacgaauguugcuuuuuuauccaaaauaccucgaggucuauuucacauacugcaagcaaugugaacauuuccuaucccacuccuucuacugaaaugaauccuucuucagcagaaguggggaaauagcucaaaagcaccauccagauuuggugggagauuuggcgcggcaccaacuuucaaacaguauaaugguuuaucaaccucccucuucuuugcugcauucaacaagcaggguaccugccaaaauccugcuaaaaauauccucggcaucuguagcccaucagccaucucuggcugauuuggguggguaauugaccuuuugagcagguggacagccagaaauuuauuuuuuuuccuggauugagucuaaguugacuuaaaacagauguuccuucaaugccgauucgacauuuauaauggaaauacucucaagcacuguucaaggggcuguuagaacccagaaugcacaaagaagggcccugugauguuccggggcugaaggaguuaaauaaagccaccuuccuccucaggcugaaaaccaggagguaccucuugcaagggaaauaggaaaggaagcugucacuucuuauuuucagguuugcagaaaagccuuuuuuuuuuaaauguaaacauucauuaaacuaauuugaaguugucauuacucuccaccccugcuguuuuauaucagauuauuccuaagugcuuggugaagaaucccauaaagucacacucgauuccucugcaggggauaaucgcauaguuugcacugugauuuacaccgcacggcaccgggaaguguccucaacuuugaaaggccuugguucccuggcaaacagucucugccuucccuauggaaauaaaucccaguugucccuccacgacuauuaugagguccccauuaccuuuucuccauccaacugaagauaauuaaaagcaguucaaagcacaugccagaagguauugggcauuuuauuaauaaauggagaacuaagaaaaugauaugucccauuaugguuuuaaacuguaagauacacuuacgcuucuuccucgcuuucccucuccccagucuccccaaccuugagucuggggcccccagucucccuaaccuucagucugggguggccagucauucugugcuaugagaucacgugggguggggagguguauuucacccuugcaucuucuagcugaaguuuugcugauaagggcaucacaaaccauacucucccuugaagaaaaugauucuaagguggggaggggcugugaaaagaaugcaggcacuacaaggggaggcuagcgucugaagucccacuuucccaauaucacagugauccucaguuacuguacauuccauguauguaaugggaaucauagugucuaccaaguaaggcugccaaaaccuugucaggagguggugaguauacucaaagaacccaguacagagccugacauagaggcauauuagcuaugaucaguauugcuguuaauaugcucaaaaccuuaacgacucuaagagaaguagcccugagcaaaauuaggacaugcccaguuuguuuucagugcagcuauaacuugucuuuuucuuuccucccauucuuugccccugaaccaauacugucauggaucagugcucacacagccuuaaaauggaucuguucucugucccagugucucugaguguuacuuucuaaauaaacuaacucucguccagaaaucagcagcuucuaauuguugaauggguauccccgcagguaaaauuugcauuuugcaagagaucugaaugcuuuacacccagagugccaagugcuuugcuacuuauaccaguccucccacacucacugcacacauuccaaguggaucguggaacugcauucuucuugguuugccaagcccuuagacgggaguaaucuuguaauucaucaccagucagugccgggcuaauauaauaagauacuacuaagcacaaauuguaaaaauccagucugcaccaaccauaaauuuggaauccagauagggcuuuagaguccuuccuaacauuuuaggcagucaagucaggcuuucggguuggcacacaaaaugagaucugguuaucauuucucccucaacauaaaggauugagagacugugagcaccauggccacccaauguaccucucuugcguucaaggggcacgucccuucgagaggcugugugguaugaaugugaguguauaagucugaauuccagucugaauguucugccauuuacuagcugugcaagcuucagcauauuccuuagccucucugugcuuguuuuuccaucagugaaauaacaacaucuauuucauagugcuuuuggguggauggaaguucuuagaauggcccauggcauacaauaagcuuuaauuaaccaauauucauuucaauaaaauuauuggccacuaucccucaaaucacagcaaacaccuaacucuccaaaggcaccugcaaggagacugagagucuuaaaaaacagagaauauggacuaaagcuauucuccauacagugacaauggccucauugguuacauuaaacaaagauaaaaauuguagcuccgcucguaauuggguuuacaaaaugagacuagaaaauacucuucaaguguccaguugcuuuugaagacauaagacauaugucacugcauucuucuugguuugccaagcccuuagaagggagcaaucuugcuauucaucaccagucagugcuggucuaauauaauaagaugcuacuaagcacaaauuggaaaaauucagucugcacaaagcauaacuugaagcuucuauccaucuucaguggcaucagaaagcacgggcauccaugcugauaccaucacuucaguuuucaagaaccuuaccaauuaacggccaguggccaaaagccucacuggagagggacaugggcuauaaaaugcaugacagucagcacucacaguguggccggcacaacagcauuguaguauuuuugcaauuuccaaaacuauuuuuggaaacacugcagauagaaucucaccaaguucaaggaaauaaauuagcaagaaaaaugaggcuugguggguuuuuauguucuccuccccacccccacugcccaaguauaggugaggacaauggugguugacacagaaacaacaauggauuaacuauacaccugguuuguacccagaaauauaaccaguuugagcuaauuugguuucaguuauuuaucagcuuuguacaaaauguaaauaaaauaaaauggaaucuauucaauaaggaauugccaaggacaaacuuuaaaugaaugaccucucaguguaccaaaagcagcauuucuggaggaaaaaaagaaucugaacuugauaaauuacucaaguuguuaauaaagcuauuuuugugugugcgaaccaguccaaauuacuuuuaaguaauaagaggguaauguugucucugacacacgugguaggauaauuagcagaacaacuuuuuuaaauguuucaaguuuacccauuucucaaggccuccaaauuucuuaguaaaacgauugagaugccuggccaacauagugaaaccccaucucuacuaaaaauacaaaaaauuagccgggcaugguggcaugcgccuauaaucccagcuacuugggaggcaggcugaggcaggagcaucacuugaacccggaaggcggaggcugcagugagccgagaucgcgccauugcacuccagccagggcaacagggcaagacuccaucucaaaaaaagaaaaaacauauaaauaaaaaagacugagaugcaauggcaaauucucaaacacuguugaguuucuacuuuauaugcaggugucaagcucuacaucucaaugucaagaucacacccauauuggugagcugauuguuaaaguguuugagaacagguaguugacgauauaguuaaugugcucacuuaagcaauuacacacuagauuaaggacuucaacaugagggugucuuuuacgcuguauuuuaugguuaaacagagcauuucaggaugacaacaaacuguaauagcauauucauggaguuuuaggaugaaauccauuucuugcaaacacaauuauuguuccauaauucucccaccuguuuaugacucccugugaauuaaauuaaaacacaauuucacauuaauuuaaaaugucauuuucaaaaggagauauuuccuauaaagcuuaugacugauaacaaucuccagaaaucagaguauuauugacaagaagccauaaaucuguauaauagucauuguuuuccuuuuaaaucagauuuaaggugcuauguguuaccuuuacugaucucuauuucuagauuuugacauguccaaaguguacggagaggaguaaguccuucucugguucuucuguaaacacauuuuccagaguuagcaaauaaaaauacacaaucuucauugaaauuugaauuuuacacacacaacaaaucccuuuguuaguauagaauaaaauaauauuuuaguagaaguauaucguaaacauugccaggaugcacacagauacggugaguaaacccaaagacagaaguuuagcucuaccaaaauaaggacuaguugauugauuauauaaaucacauauccaaggaaauuuuuuccuuccagggauuaggccagcuucauaaaggucaaguuauuuucauucaccacaaaacgugaaugucuuuucaauucccuauaucaugacuaauauacuugccuccucccuccuuuccuuccuuccuccuuuccaucccucuuuuuccccuucuucccucucucucuuccuuccuucucucacuacauucaucauucccuuucaauaaaugguaacaacaauaaucacacaauucaaaaguauauuuauccagaguuuacuacuugccaaaugugauacuaaaagcagcuuauuuuagccucacaccaacucuagaucuaggaauuauuuuuuucucucucauuuuauauagagaaaauagaggcucagagaugcaaagaaaguugcccaccaucacacaucuuggaaggagggcacaccuguaucugccugacucucucuauacagguacacacucuauccuggaacuauaacaaaugaagaaggaguuuuuuuuuuuuguuuguuuguuuuuuuuuuuuuuaaguaagauauaucuccuacucuggcuaagcucacacauuaguguggaggaaaagugauguuuucaaaaucaccuuuaugcagugagauucgcaaucacuaugagaauagcaucgugagcuugaauaagagcccgagaagaagcaaacagcgauuugaaugauuuggccacugauaaugaugguguaucuguauuucuaauaacauggaaggauauccuugcacauuauggauauggaaauaauucagaugauacaacaggugaguaaauggagucucagcggaacuuggcaauauggcagagcugagauggaucagagcugggauucgaguccgggucuuucuaaauucuugaccaccuaugucuucuaccuugccuauucugagcucccucagaaugcaaaccaugugcuagccuguaauaccauaguaggccaguuccuccaguucccauuuaucaggaccuugagacaaauccaaauugucauucaaggaucaaaggacucacacuggugccccccccaaaaucaccaacucucugaaggcaaugagagaguuaaaauggaucaaaucuccaagugcggcucagcucagccacaggaaauauaacagaaauaauaauggucuuuacagaaagacucuaaugagaaggagccugagaauugaaccuaucacaagaaacuaaugcuuagcaaaaacaguugguaaaaaugcuauggccggugaauuacaguggucuucuuuucucuucgauaauuugggggcaauugcauccaaauucuaguccacugauuuccacugcaauucaugcccccaugcuggggagaaucagcuggaauaaacauaaguuugccauuggaagacuggugauguauccuaaaagagguccaggcaauucuugucucaaccauuaaaaggagaacuauaacgccacuucacacuacccuccaaacgacucucaguguguuagagaaccugcgcuagcacuccccaagcagucauaacagauuaguggguuaagcucuucaauucaggcccauggcggcaaaaucacuucugguguuuucuagaacuccuucauauuuuuccuucguauuuguaaaagugaacgauaaugccaaugacauuuucaaaagugauagauaauaaauauccugucccuauaaacacacgacuauacacuccuuaauuuuagcacuauguuuuguagguuugaagugcccagccugccugaaaggcucuuuagcuuugaacuauuccuaugacaauuuggaagaagcagauauuuguccuuuaaagaaaaucaaguucaaucucaccguauuuucaagaucacauaaacuuagcaagaaaaacuucuugaguuaaagggauacgguagagaagacuuaucccagccaagagacaugacccuuaauggagggggauuggcaauguuuggagacauuuguguuugugacaagagggggaagggaugcuacuggcaucuaguggguagaggccagggaugcugcuaaacauccuacaaugcacagggcagaucccaacaaaaaauuauccaaccccacauguuggcagugccaaagcuugagaaacccuguacucaaguuaaaugaauaagcuuauaaugccuuugucccaggcaacccucugccccagauacauuuaccuauccuuaaaccacaggacaaggcacaggccucauucacgacacuacucugcacauggguccaagguaacuccuccauguauuacagucauucuucaaagaauguacaaauugucaugagaauucacuuuucuucagggguucuauuuuccucuccaaaguuuaaguguucugggguaaccuccaaugaaaagaaaugcugaauuuuuuuuuuuuuuuuuuuggucuagugacagccuauuacuuagcacuaaagaccaaagaagggaaacuuuaguaaaaagacagggaggugcugauggcugguuuuacaagaugagaauuuaauggggauagugguuuuccuuuuuuuuuacaagcugagcugugcuaagcuauucaaauuaguaauucuaucaauuaaagccuucuauuucauggaaaguacuugcuaaauagaagauuaggcaacagaucagagaaugaaagaauuacugaaauggagcucaaauauuuaugagaaauuuacaucugggagaccuucccucuucuuaucccugcuuccaaagggaaauccauaaagagaagauaaagagcaaagcuuaguccucaacaucuacaagccuaagaagucugacucacuuugaguuuuaggaaagaagaaacuguuugguugcuacauauacuuuguacugccauaaaauaggcugauuccauaggucacauagaaaaauuaaauucacuauucauaauuuauugcccuuggguguuugcucugguuauucauugcucuguaggaaacaaccccaaacauacaccuuuaaaaaauagcaauuguuuauucugcccaugaaucuucaguuuggacagggccuugagguggggaaugggaaguaacuucuuucugauuuucaguaucuagggccucaaaugggaugacuuccaauggauggagguuggccauuucccgcuccacaaggccucuccacauggcuagcugggcuuccuucaacauggcagucucaggguagucaggcauuuuacacggccacucagccacauuccauuggucaagcaaacgaauaagugcagccuagauacaagggaagaugaauucaacucuaucucucaaugagaugaguagaaaagaauugauauucaucuuuaucacaaugugaacucagcaaaauguaauguuaauuagaaaggcuggcuaauuaagcaauauaaaccaaaauaacagaaaacagcaaguguccugguaaucacuguuacuguuugcuuuauucaauuaaaaggugcauaucugaggaggaauguuuuuuucuucuaccuguuuugucucauauggauuauuuaguuuuauauucacuggcuauuauugaacauuuauaccauuuuaggucucugacgaaauauauaaacuccaugggaaagccauuuucagguuguuuuaucagccugauuagucaguggaaaaccauugcacacacaaacucucaaaauacagaaaaucucacuugguauuugcugcaauugcuuuuaauucuagaacuuaaaacacugccuuuuauaacacaauuucuucaguuaauuuucugccucccuuuuaugauuuuucuuuguuuguuuugagacaaaggucauacucuuucauccaggcuggagugcgguggugugaucacaguucacagcagccuccaccuccugggcucaaacaauccucucgccucaccuuccugaguagcuaggacuuacagacacacgacaccacgccuggcuaauuauuuuucauuuuuucauagagacaaggucucacuauguugcccaggaugguccugaacuccuggacucaagggaucuucccaccuugaccgccccaaguguggagauuacaggugugagccacuguaccagacccaucacucuuuuaaaaucuguaauuaguuccagaaauuaauguauuccccugauuaaaucugaaauugcaacacgcgcauuuuggaaagacuucucccuguugucaucuugaaauggaaaucacgccaaaagcauuuuccuccucuaggaugcaacugaacaagcuguacaaaagcuugaaauuccugaaauaucaaguaagaaagauaagaaaccgggauagcugggggauauguuuugcgggccuaacuaaaacaauagcgauuuaaguagcuaucguauagacacuugaugaauccuuuuauuaucucugaaagauuccccguugcagcaugcuuuuguggguaaagagcuauauauugguacaugcagcucauaauuaugucagccuaaccacagccaacauugacagccuaaaacauuaaagaucuuauacagccagugcugaauauagcuucuuuuauuggcucagagagcagguaucaauuauaaugagguaauaaaauuugcaagcacuguucauguccugcucugauuuuuuuuuucccucucuccuugagauaauaacagcagaaaaaggagaaagaaaaauccucuuaguucuaaccacagauucuucgaaagcucucacuuucuauggcugggguacuauaaagcuguuugcuuacuggaguuuucgggcuggcaaacucuuccuaccuaaauagaagcugcaaauuucugaagcacaccuugcaagucagaggcuccaggauuaaugguuuucauuugcauaacuauaaacuuaagguacagcuucccaagccugcauccucuaaauugcacuuacugaugagaugcaaaauccucuaaaagcguuccccaaccuaaaccaauuuguaaaguuguuuuguuauuuaaaacauuaaagaaauuaaagugaucggaauauaauuagauuaauauucauaucuuccaaguugcuuuaauucuaauauuaaaaagauuaaauauccacucagaggauuaagcaaaaagucaagccguagcaacacauuuacauuaccuuacugugcaaauuauaaaccuaauuaaucuaaaguuuccuacaaauugaauuggauauucauuugcagucuaacacaacuuuagguacuuaaaauucacuccaggauuguuucuuuacgugcgcacuaagaagcagggccacguugcugggaugcaggaaucacauuaaaacggcuucauucggguucuaauugguggaaauuaaaucucaaaauaaauuuauguaggggaaaaaagcaaagacuuuguaauuacguaugugugcaauaauaaaacacacccuggccuccccaucuaguuucugucaauaaaauagaaaacgcaauccaguuguuucuuccuaaaagcguugaguucauguuuuaccucuaauauugugaagaacaugaucaaaagauuucauccuuuuugcauggucuuuaacuaagagcaucuaaagggcaucuaauuacuuugcucuguaacccuguucccaccugcuuuugccaccucucugacccuccacccacccccccaucccaacccccaaauacacaaacauacucccaggguccccaugaaucagugagaucaacugugucaauuucagaucgauugcagacauauuaguaauuaucuucuugccauccacuucuuaagcaauaugauuguuagaaaugcuugcuccucagugccauaaagaaauagcacucgaacaggaauuuaauuuccucagcaaggccauuuuuacuuucugcagaaaggguacacucgccagcaguuuugccaugagagaacaccggacaaaggagacaggcucauuuauaaccugacacguguacucuacugcuguguccgguuuccauuggcuggaaagggaccucacauucuguauuuguuccgacuggcuagcaacuuagaacuuuuuaaaagaggcaaaggccacauuuucuuaauccagucuaccacuguuggacauuuggguugguuccaagucuuugcuauugugaauaaugccgcaauaaacauaugugugcaugugucuuuauagcagaaagauuuauaguccuuuggguauacacccaguaacgggauggcuggcacauauacaccauggaauacuaugcagccauaaaaaaggaugaguucauguccuuuguagggacauggaugaaauuggaaaucaucacugucaguaaacuaucgcaagaacaaaacaccaaacaacgcauauucucacucauaggugacaacugaacaaugagaucacauggacacaggaaggggaauaucacacucuggggacuguggugggguggggggaagggggagggauagcauugggagauauaccuaaugcuagaugacgaguuagugggugcagcgcaccagcauggcacauguauacauauguaacuaaccugcacaacgugcacauguacccuaaaacuuaaaguauaauuaaaaaaaaaaaauuaaaauaaaaaaagaaaaaagaggcaaaggcagaggagaacaaaggaaggacgaaguaacuuguggaaugcugagaaagguaaaaacaccuucaaauaaggaagaggaacaggcuaugaccuaaugcuugcuuggaccaguauaagcaugccagggcaaauauuuaggcuaaacugugggagcuaagaacauaaaguacauugauuucuucauuacagcuagcagauauuuaagaauguuagcacaggucuuugaauuaacuuugcuucuaagagaaguuacuauuuauuccuaauuagauggggaggaaauucuuucaagaggaaccucuacuuuuuacacccuuguagagaagugaaacagugcaaaucaaauucaauugcuggcaugaaaggauaacacuaaagaaauuugaggcagcgacugccuggcuguucacuaauguugacgcucccucccacccacccagcacacagcaaacuauauuucccagccucccuugcaggcagccauggucaugugacugaguuguagccaaugacauaaguguuaguggccuggagaauguggcaaccucaaaaggucuucguuggucaaggugaagccacagaauggaaggagccuggguuccugaauuaccacuuggaggacagcggcuugcugaucacagcaccuguuuuggauuuuauguuaaugaaaaacaaacuuacugauuuaaagcauugcacacuuagguuuuaguagggucuccugcgcaugaugcaaaaauuauuggugaguccacuucccaagaaaaaguuuccccuucccacagcaaggcaacacuuuacuccucuaaagacaacuuuuucucccaacaggcuccaacuucaagucacacauauauuaacaacugaucagcaugaaacaacccgaggaguagggcugcagucacaccuguuuauuuuacuguugugauggcagcaaauauaauggcuacagcuuccuugggaauaauccugcuauaagcguuaaugggcgaagagccgugacgugugauuugggucagugucuuguguucacaaggagcacucaaggcugcuaaucugggcuguaauuucucguuucuccucaaccacuuugccuuuuauggggcuuauauugaugaaugcagaggauaacugucagcucaccugguaaagcucagugcaagaaguuuaacaauucaucucguuuccuaaaggcggcagaagagaagcaagcucugggccuucaacagguucgacccacccuauucuccucacuuccucucuuaccuccuucccccaaccuauguagccccauucauuucgccagauugauuuuuucaauuguaacggaagucaugucacuccuguucuuaaaauuccucagcagcuucuuaugcaacucaaauacaagugcagucuugggucaggggcccauucuucacccuccucucuggauccaugccccgggcuuugggacugcaguauccucccucucuaaccgugagcucagccaugugauuuauuuggggcaucagugugugacagaggaauggguaugccaguucugggucuagacuugaaaguccuuauguguuuugaguugcugucuugcauuucugcccuugccauaagaaagucaugucuggucuagcccugcuggucccaggaagaugagagacauguggaggagaaccaccccagcuaaagugccccacccauguccagccuagggcagaaagcccagcugaugcaaagaugcaggagcaaaacaagcugacccacagacacagggggaagccccaccaaaaccagcaggaccaguagggcagggcagccaagcccagccuaguucugcugaaccccacacacacgugagaaguaaauacugauugccgugagccacucaguugccacacgguuacgcagcagcagcaaccaagucacuggccuaugcuucaucuugaagcucuaaugaccuguuuaaacuccucccauuccagaccuccagggugccccauacucugcaaucacacuggccuucccucagguacaagcaugacauguuuuuuucuugcccuggagucuuucccuuaauggaaccacaugcuuuuaccacuccauguccuucugcauggcuggguacugcucacucuucauauuuuaacucagaaguaacuuuuuuuuuuuuuuuuuuugagacagagucucacucugucggccaggcuggugugcggugggaugaucucagcucacugcaaccuccaccucccagguucaagcaauucucugccucagccucccaaguggcugggauuacaggcgccggccaccacgccaggcuaauuuuuguauuuuuaguagagacgggguuucgccaucauggccaggcuggucuugaacuccugaccucgugauccacccaccucggccucccaaagugcugggauuacaagggucagcuacugcgcccugccacucagaugcagucuuaagagaaagccccucaacaaugccaucugggcuuggccuuccugaucauucucuguggagugucccagcugugcugcaaaugggugacagcuguaccagaauaucgaugccccucaagguuuugcguccuacaacugccagcccugagcagccucauccacauuacucaauugugccgaauaaauccccuguguuugccccagugugaaagagcgggcacgugcugcuugcacuauuaugcuuacuuccuugacaaaggcaaaaucuggcccuccucuuguuuuuguaaauaaaguuuaauuggcacacagccacagccacucauuauguaacagccauggcugcuuuugaguuacacuggcagaacugaauaguugugauggugacuguaugggucacaaagucuaaaauauuugcuaucuagcuguuugcagaaacagucugcugaccacugcacuaaaguauaaacugucagaggauagaaaccuugucgcuuuuguaucucggguaucuagcacagugccugucccucagggauucucauugcauauuuguccagggaauagaggaaucaugacuccaguggacaccuguguuuaacucccaucucuguaccaaaggcgggggucccuuacaguucuggaggucacucuggggauggugguagagaugugcuauauugcagcugagcccggaacaucagggcagcuacaaugcuggugaccacuguguggcacuugaauuucucagaaaggugguaacgaggcuccugccuccacuggcagcagccggagugcugggucugcaucugcugcaggcaagacaauuugaaaguuugaagaaauaagaacaacucaaaguuuaauuuacucaaauaagcaauugaugcuuuagaguauaauuaucagagaaaacaaaaaaacacaacacauucuuuagcauacguuauguuaauggcagguuaggauggcccacugugcauaauuuagccaaacaauugauaccaaauuuuuauauauauauaugauuacugcuacagaaacgaagcaccaagacaaagcacaggagagcucauaauagacacacgugaacucugaagcccuaauuacaucacgggggacgguaaucaguugcugcugaaccaagcagaaaauggggguaauuuguaaacagguagaguggcaguccaggugcaccggcauguguguggggcuggagggcuggggccccugggcuuccaucugagcuuugcaaggauggagagguucaggaucacuuuucucagcugaaaacacaaccuccaagcucuacacaggucagcucccuccuggccugcccuucaguucaaaaaauagaaagucgaaggcuagcuuuuugaaggaagcuucuccaugcuccaugaaauagaaaaugauuuuccgugucugugaucugaggcccauugcccuguaucuuccccugauauccuagaagacgugagucccuggcaucuuagggagcagagggaugccagucuauagccaccuugaccacaagggauauuuucaggagaggauauagugaauucuccuuccugcaacuccucugcagacaggagauuuugugcuagguaauugcucggguguauucugguucaaaaugcagagucugugaaucugaaucaaugaguugucagauuucuuucuuuccuucauucaugcaggacuacaaaucugcucacgucaugguccuacugugagccagucaucagaucgcaaccaagagucaccaaguaccuggaauacagcugcccugugacguuaccuuccaucugcaucacccaaaacaaacugacaagcaaaaaaaaaaaaaaaaaaaaaaaaaaaaaucaggacagucucaggagaaagucacccaguucugacauccagaacuguaagggaaucgauuuguguuauuuuaugccacaaaauuuguaguaaucuguuacagcagccacaggacacugauacacaugguggccccuagagggaguucaagacaggaugcagguauuugugcauuaacgacaucauuucuauaugccaggcuuucauaaaccuugguagaccaggcugacauuccucagucgaucaaucaauuaaucaauuaaccaauggaucaaucuucaucuggucuauuucuggccuugucaaauucauuagcaaaaccaccauaagcuuuucagcauugcggcucaagggaaucuaagaaaacacuucagacuauuaagacuugcuucucacacaaguauuuguggccuuuaaauacauggugaauccaugaggguaaggacaauuugugucucuuucccuccccacccucaaugccuugcaugugcuuacuacucaauaaauauuuauugacugaaugaaagaauaaaugaaugaaugaaugaauacauaugugaauggcuggaaggguggcaugcugguugaaaggagaagcaauauuuguggaugccaaggacauauguaaauuaaauggcuuugcaaauuucugauaaaaggucaguugcuuuauuguuuaaaccacggggucagguagcucaggcuggggguuacuuuuacauggaagggagauaaugaguugugaguuguuuaagaauuugaguaaccaaucguauuaggaauaugggaaguacgagaagaagagaaaagaaggacuagaaauggaagaagaguuggacacaaagagacauuuguuguagugcaggccugggggacaaagagagcagggugaaguugcccacacacacccagcccuggauuucuuuuugagagaaagaggugggagcugaauggcugcaggaagaaucuaccagagucgguucaaaaucuccugcugggcugagccaagcuaugcucaccguggaguccuccuggugagacagaaagcuuuguuuuucuguguacuggggaggaacugggagaaacacuccccggugagcucucucacccucuucccaccaugugaagaugcacaagaagggcagacaucuaugaaucaggagcccagccuucaccagacagugaaccuuccacugccuuaaucuuagacuucccagucuccagaaccauguaaaacaauugugguuaaggccauccagucugugauacuuuugucacagcagccugaacugauaaagacaacaggauacaggaaaggaagaaccagagagaaugacuaauuuuucuugaucaucuacuaugugcuggugcuacuauaucccugggcugagagcuuuacaguucaagggaaaaaagggaguuagacaaaugcagagaaaaugaacuaaacacuuggauacauacugacaauaauaauaacaguggcuacuucucuugagcaaugaacaugugcugagcacaguccugcaagggaggauuauuaucccuacaauauagaaaagaaaacuguggccgggugcaguggcuuaugccuguaauucuagcacuuugggagggcaaggcagacagaucaucugaggucaggagcucgaggccagccuggccaacauggugaaagcccgucucuacuaaaaauacaaaaauuagccagccaugguggugugcaccuguagucccagcuacuugggaggcugaggcaggagaaucacuugaacccgggaggcagagguugcagugagcugagauugugccacugcacuccagccugggcaacagagugagacuccaucucaaaaaaaaaaaaaaaaaaaaaaaaaaaaaaaaaaaaaaaggaaaagaaaaaaggaaagacgagcuccagagagauuacaucacuugcccacaguugcacaguuaguaagugcacacacacacacuguguuaacccacaaugcaguuaguaagugauugagccaagaugcaaaacucaggugccucugccuccaagcugguccuuuucauugauagcugaugugcaucagauuguuuugaggcuuuaaauucugccuccguguucuauugggaaaaugagacuaggaauggagaaauuucucauccaaguaagggaaacuaacaacauagucucucuuucuggagaggucagcuggcaacuuugcccauuuccugagaguauccucucacccacgcagaucaugauguacaucucucuggagugggagccaggccacacuccaagcuacaagcuggacaacugggcugauccuugccaauuaaaaugcaacuccagccugcauuuccauguaggucaaaugucccaugagcuaucacugaaucccagaggcugcauauuuaauucuguacccuuagaaagcucuugcugaaaugagguacauccaccacauaagaacuugguucuaaugcauaauuuggggaaaagauuuaauuuaacacuuguaaagguuaaugcgauagaauuuacgaaagaauaaaugaaugaacgaaugccuaaaauuugaggcaaaaucuaacauuuggagagauugacaggagcagagcugaucuuuccagagaacuuagcaucuucuagagcucgcugaugcuaauuuuaacaucuacccuuuauugagcaguuauuauguauguaaaucuuuaugcacauuaucucauugauuauuguagcaacucuaugaaaugagcacuagcauuagccucauucuacacaggggaggaugggggacucaaugaggcugagugacuuuacagggucacagagcuguuaaguggcagcgcugggccuugagguuggacuuuaagauccacacucuucagcauucucugacacugccuucuuuuccauucuucaacaucaguccccucuacaauaauccugcucagagaccauguauuaggccauucuugcauugcuauaaagaauuaccugagacuggguaauuuauaaagaaaagagguuuaauuggcucauaguuccacaggcuguacaggaaacaugauacuggcagcugccuggcuucugggggaagucucaagaagcuuacaaucauggcagaaggagaaggcggagcaggcacgucauguggccagggcaggagcaagagacaggguggggggcugugccacacauuuuuaaaugaccagcucccccaacaacucacucacuaucgugaggacaguaccaagaggauggugguaaaccauucaugagaaauccacccccaugacccaaucaccucccaccaugccccaccuccaacgcugcagauuaccuuuugacaugagcuuugggcagggacaacaucuaagcuguaucagaccgccagcuggaacuucaauacuuucaacgacggauuuugaugguaacuuuccuucucccugaagagcguuuguugaaugccuacacugugggccugaagacuccucccugaacacagugaacauuugcuguuugggauucccaguacguguuccuuuucuuuugcuuauauuucagucucccuuugggagcugcgccucacugugacucucaggccaccgggucugggcagggccgaagccucuuccuggcucuaggagagagcacauaacucaggccuaaucaaugagaguuucauugucccuggccacaaggaccaaaccacagaagacaagugaccagaaagguccgagcagagugaaugagcggcagcccuggacuuuugcuacaacuacuggccuuggaggccagagguacuccacuuccagaguuugcucucuacaucccaucuaagccugucuuagaauaaagcuagcagagaagagaucaaaacugaggaccagagaaagaaaggugucugauaauaucauuucagccuggauccagagauuaauucccugguuaugaaucuuccucugcccagucuauacuggucagccugauccuauuuacaugacaaaaaucaucaugucucaaauuacuuacuuaauaaaauguggguuuguguguuauuagcaaacauuaggguuauaaugcaggauggaaauuuggaacaaauuaacuacacaugcaagcugucggauccuggauccagcuaugccugaacucacgucuaccccuggacuucccacuuacuuaucuaaugcacuugcuuuuccucccugaagcuauuuuaaguugaguucaguucugucucucauccucaauguuggucuuaauuuuauccucagaauccacaaagaacaaaucaaaauuuccugcagaaaaauuuuucauaaaucaaaaaccauuuuuuuaauccuaauuucugcuaccaugccaccaccucuauucaucugguagagguuuaauucacgaaguucauuguaaaguuuccuggcacccucacaggaaacaaguuauacauagauuuuuuuuucauuuaaaaaaacacucauguggccauucaaagcuacaucucucuucucuucagcugcaaguaggcaaagucagcaccucucaccugcccacguguccaggaagcaucuaccacagaggaaauggcagugcccagguaugaugggaacucuugaugacaggagagccugucccauuacaucacugaacagaaaagcucaaagacaagaccaagagugaaucuuagcagacagucaagaaggaugagaaaugagggcauccauaggcauuugcucaucaugaaauucugacgcaucacuuaaaauccagggacacaugaauagaagcaauaaaagcuauuuuaauuaaauuugagcuauaauucuggguuucuuguuuuguuuugguacuugcaugguucaacaguauauuagacaaaugugcauuugagaaauccugaucaaggaggacaaguuagaagaaaaaaaaaaaaaaacccugaguauucaucugucuucccacaaagucuuccugaagcuauucuugcaaaaccuucugcccacuggcacuguaugcguaugauuaacugcacuugagcccaacagcuugcauguauaguuaauuugcuccaaauuuccaugcugcauuauaacccuaauaaucacuaauaauagacaaacccacauuuuauugaguaaguaauuugagacauuaugauuuuuaucaugcgaauaggaucaggcugaccaauuuacacugggcagaggaagauaaauaaccagggaaucaaucucuccagcacagacucugucucuuggcaaaaugauauacauugaucaggcaagaaacccagcuccaggcccugcuaggcaacaaagucaaugaacuuccauguuccaagccaaaaggucagggaaggugcauguuuccacccaugacauaaugcaaaagacagugaggaagccucagcuuuugggaggguguaagagagcgugggcuuuggaguucauggacagaguuuccaaccccagcuagggcacucaaucacugugugcaucugagccuccaccugugaauacuucagagacaggcgggggaacgugggugcagguuaaccaagagcaagcaggugcaggcaccuggaacaugguagcuagagaguuaaucaguuucccuccaaaauuuguggaacauaaagaguaggauagaagguauauacauuuuacauuucgcacccauuuugcagaaccagggugaacuucccauucauuuccacacaagaaaccaccaagacucuuagagaggagaaagcaguucccgggcuccuccaguuucucuaaacacgugugagaaaggacagagcaagcagagguugaauguaaguuauuaucccuucuagguuugucugaauuuugccaggaagcuaaagcaaaagcguauggaaugaaaaaacaaaaguguaaagcauuaaagcucaagcccuggauuccaugaaagguccaguuuugccaguuucaaacugccucaugcccuugccauuugcagugauggcuucugucuuucugaggugggauggcucuugguggccugcuacugaccccagucacuuggaauucugaucccguacucccagaggccaaccagacuuauucacccgucauaggcucagcccuccuuggcccccugcuaagcagcugaugaguucugcggacuuaaugagcaugaucccugcuccaucauccagguuccuaaugagaaacuggaacccacagggcuuaugucugcccaggacaggacaccggcaaggaaccgcaaggggcgugguggguggaauccuuauaucagggaaugggcauuccagcaaggaaggcuuccuagagagggugagcucagagagaaggugacacacagaggcugggggacaagcgggaggggugacagggagaugauuaaccuuaugaaggaagaaagccaagaauuaacagacaucacacgagugcaaagaagauuccucuuuugcauucguuuuuauuuuuauuuaaguuggggcaagaccauggggucaauaucuguauugugucagagacugccaauagguguguuacauuacaugacaacacacguaaugaauuacauguauuaggacauugcauucuggccauguuucugcuuggauaagagacugaagcucagaacggugaaaugcacuugucugaugcacuugucugcuaguaacuagggauuucaggaaccaccucauuguccccccacagcccaaaacccaugcuccauccauggaugcguccugcaacccaggagcaaccucucccuugggcaaauuggcugggcaacagcuagcuaaguuacuuucugugaucggaaaaaaaucccaguacaaccuugcuccuccccgagcucuccggacaaggacaaagcacucagaagaaggucuaagagugucagguucccuggcugacaagucuagggggaucucugugguucuaguuaucccaaugaucugugacucuuuugcaggguagcuggggagggguugaugaugagggugggaacuaaagcaaaacugaucuguuuuacagucaugauuuuccugagaaaagugagaaagaaaugacaaaaauuaucaacucaggccaggcccaguggcugauaccuguaagcccagcacuuuguggggccaagguagguagaucaccugagcucaggaguucgagaccagccugggcaacauagugaaggcuugucucuaccaaagaugcaaaacaauuaucuggccaugguggugcauccuguggucccagcugcucaugaggcugaggcaggaggaucgcuugggccugggaggcagagguggcagugagcugagaucgcaccaccgcacuccagucugggcaacagaaugagaccuugucucaaaaaaaaaaaaaaaaaucaacucagaaagaaugaacugaaauguaccugagaugugggacuuggcucuuugagguucaaagaacuuggaggucauaccaaggaugaacgcuaucauuuuccaagggcucuuuuuaugccaggauccauuccaaguacauuacugaugugagccaaucuucacagcaaccuaugggguaggaaugauuauuauacccaguuuauagauggaaacacugaggcacagcagggugaugcuaauugcccaagggcacacaacugguaguguaacugccaccuuugaugaaauguaccagcaugaucguaugcauuuacaacacacuacaccccuccagauguacucaagagaaccccaggauggcauggagcccagcguaucaguccauggaauguggcuuccuggaagaagcaacuccugacugguagagaugagucagaugaugaauaucagacagacagaagagcacgcaaaaagguucagagaagggagauuucgaggugagaaaacugaagucagagccacugaaacuaagaccccaggcucuccugcuuccaucuagcaucacccugcuccuccucauguuuucuuaagaaagauggcacaaggaacaauggacaggaguuacuuuccgaggugccgggucaagaagccuacgguaggaaggcaaaacccucgccagugcuggcaucuggcaacagugacaauggacaccucgaccauggacacagucaugggcaaaaggauucugcuugggacccaacuguuucuaaucagccuuuacgaugggcaaaugcgucgccucugguucugcacagcugugcccaggaggaagcugcuccuccuguuccagggcuuggcuguucugugacuuccuaugggggaagggggucguuuucggccuggucccacuuaguccucaaugaaacucccuuacagaugaggugacuuggcuucugcuggcaggagaggaggcaauccaagggcgcagagagguuaauggcuuaugcaccaagacagucauuccugcaaagucagaucgguauucugcaaccccugaacaaaacugcaacgcaaaguccuggguucaaaaccguaacaugagcaucaccugcaaaaagaauuccccagcuacaauaaaacagucagaacuuucauuucuuuaauuuuuuuuaaugcaggaaaucaaguucaguuuauccauguuaaauuuaagaaucccaacguagagguuuaacacuaagucauaugaauuauaaccuauuaaaacucccauuuguggcagacauuagcuuugaaaaaaaugauccuaggggcaacucaauagauauauguggucaugaaaugcagauuuguaaguuauccucuauguaugcuuuacaucuuuuuaaaaaauguauuuuucugauuuaaaaguuauuucuaggcugggcacaguggcucaugcuuguaaucccagcacuuugggaggcugaggcaggugggucaccugaaguuaggaauucaagagcagucuggccaauauggugaaacccugucucuacuaaaaacacaaaaauuaguugggugugguggugggugccuguaaucccagcuacuugggagccugaggcaggaaaauugcuugaaucugggaggcagacauugcagugagcugagauugcaccauugcacuccagccugugugacaagagagaaacucugucucaaaaaaaauaaaaaguuaauucuuugucagaaaacucugauaauauauuguuaaaaaucauaauuagaacacucauaaacaauaacaucucaauaaauuuccuuccagucuuuuuuuucugugcaugucuagggcauguuaaaacauaucuuaguaauuuuuuccauaauuagacucacagaauuuuucuuccuucguuuuccaccuaauguuguaucauaagcauuuucuucuuauuuuucauuaaaaucacuguuuauacuuugaaacgcccuuuuauguauuuuaucuucaggagacaauucacuggaucuuucugggaauaaccacgugcaugaggaaagacaaauauuugcaaagggccaacagggugugagcugacaaaaaaaaagugugcagguggccucucacccuguccugggguucacggggggacagauccuuuugaacuggauccugcacucucccaacugcucaucugaauuaauuguugaggagggaagccgagagaaugcuaaagaggaaucuguacaggggaacuggcagauauuggagccugguugccaucauguguuaacgagcuuuuucugguuauguaggggaggaacagaaccagaaaagaaaugcgagugugagugcuuuucucggauggaaagccuguccuuuggcugcagcuggcauuucuacuggcacagucggccacccagagagcaggcaggagcuggauggaaugcugaccucuggcagaaagaucuccugaccuuggggauaaaaaugucuagaugaccuuguaggggauaaaaacaacucaacuucaccagaaaugcaaacaaaaccaaccucuccaaugacauauuuaccuggcuugcgauugugaggccuauuuaauaaccuuucacuaacaacuaagguugcaggagguugggaggguguggcaaccugcccauccugccucagcuucugggagguagcagggugcaguuguagaccuuguaaacacacagauuuaaauguggucucugucacucaucagcagugugacuuugggaaggugacagcugcugaguccuagacuccuaugacaacuuccuuuccacagaccccacaacuugauguaacgaacccccagucuaguacccagcauacagcaucaucgauaaucacauucccccaacacacccucaaucaacugacccuaggaauauccauucuuccucucuacaaaaagacuugagaaucaaaaccauucugguuucacccaugccccagcacuuuccaggcaggguaggaaaagaagcaucccccagagucaggagcaggagcgagagagagagaacgaacaaaugaauuacuguuggcaauuacagggccaagacugcugucacuuuucugauggugcuggcagucaaggcagcuuugugcuccucucccuuccuugagagagauuacaaacugaaaaccauugcuguaaagcccaggccccgcccugagucugaggaagagcccugcauucuuaacagagugccugagaagcaguaacaacaaauacaguuaauacgugagccaugagagacccaucacuauacccauauuccuuuuguguggcuaaauggagccaagauaacacacugagaaauacguaucuucagaaccacuuauugcccaucugaaagaaucccuuuggcacuuccacugaaucugauccucucuucaugugucuaaaauaccugaugcuaacaucucuacagcacaguucaucucuucugaaacaggauacacucagagccaugaugacagauaugcagcaugccuguuuacucuucccaauccuucgcucacugcagacaucacuaaucaaucccagcacucguucaaucaagugcagguacagccucacaguccuuccaaaaacagagcuucagagagccacugugaauugaauggaguugguaagccuuucauagaaggacagaucauucaucucuucucccacauuaagccaagagcuccgauaauucaggcagaggaaagcccugacucuggcacuuccuuaggagcugcucggaggaagcugcaccauaggaggguuugucaaaggccucacaugucaugaaugaugcagcaaaugcagauacuuauauggaggucaacgggcaauaauucuaugaggcaagaaugggacuuaaauuacaaaguugaacauaaaggguacugucuaaugaaugcaggaagagugaugaguuuucgauuuuucagccaaaagaggugccaucugaugggcauuaucuggugggagucagggcaaaaaguaggccccauggcaugguugacagaguggggagaaagcuguaguggguauacuguuugagacgcuacuugaagagggugaaaccugacccaaggaaaucuccaauuccuaaauccaagguauuucauagagagugaaagauagcccaggguguggugaaugagaaauggagagagcaggaaaacagaaagaaaaccacagagagaccacagagguggacugugcugaguaugcuggaaggaggaacggaaaagauagauucuuaagccaagcaaaaagccaagggaugcugguggcaauguaggcauggccuucuaagaucuugagacagucugaggcagcuccuuuaagaagcugaauucuuggcuggguguaguggcucacgccuguaaucccaucacuuugggaggcagaggcaggaucccuguucacagcaccaacuuggccaccgucuaaugggguuggccuuuuguucuuggaacaccugagaucaggaguuugacaccagccuggccaacauggcgaaaccccgucccuacuaaaaauacaaacauuagccaggcaugguggugcacacuuguacucccagcuacuugggaggcugaggcaggagaaucacuugaacccgggagacgagguugcagugagccaagaucccaccuaccacacuccagccuggaugauagagugagacuccaucucaaaaaauuaauaaauaaauaaaauaagcugacucuuucccccagacacaccucuacugcuaaucauaaaauauuaaaggagcagccggaguacaccuuccacuuauggguaaaucacaaaccauuagcccuguucacagcaccaacuuuaguucaccucccuuggccacugucuaaugggguuggccuuuuguucuugguacaauauucuagacagucuagaacuccccuggauuugccucccauuggaaaucaaagggauuagagauggacuggguuuccaggaguagagccagggccaaugauucuggaagguacguggucuuguuuucuacgucuuauugugggccacuagcuaguguugccuagggaaauuaaaguggcacaugcaaaaaugaaaauacugacggucaaaugaugagaucacagauauuuauuuuuucuugaaaaaaguguauuuauuuguuuguuuguuucacuuuacuggauauuagaguacaauguugaauguaggaaauguugacaaguuaaaagagucagcaauauuauuaaccauuaaugaauuagaggacaaugauuuugcuucugauuuauacuugccuuuacugucuuucaauaauccuacuagaagaucauuugcaaaauguauuuaaugcuauaauuccauuaucuuuuauuuuuaaaguaauaauuuaaaagaccauacuuagccuaauacacuacucgggagacuggaagguauguuucgugauacaaugaauaauuccuucauguaauuuauggcauuccaaguaagcaagugcuuugagcacggcagguaugcucugaucagagaaguauuuuuguuuuuaaauaauuaagugcuuugaaaaaaaaaaagaaaggaaaaugacacagaagcauucaagauguuggauaccaaaaagauuaaugccuuugagacaauccaggaacagauaaucacuccacaacagaauaaauaucugggaauuaagcccagggcauuggggaagccagucuccugaucauucggugagggggcaaaauacuaaagacaguagcaugucuuaacagagcccccaaaagaugcagcuguuuaagaaaauugagggccagaguacaaggcccaggcaguguauacaccuuggagaaaacaccuuuugcauucugaugcuuugcauacaauuucauuauuuauguaauccuaucaaaacauauacaaugcccaaauggaugucaggaaaguuauugacauuacuaauaauggugcuuuucauuuauagagagugccuuuuucugagacagugaacuauuuuuacauugggcaugaggcuuuuuaggagaauuaaugcuuaaaauaucccuucaguguagcaugugggaaauguuauagauggagaagaaaacagauuaauauaaaaaaugucaagagugcauaauaaaaggcaucccauucaguucccuggcccauuaccaccagcccacacagaccacgugggcacagccacagccgugagccauagccugugcuuccugacauaacuacuuuccccaggaaugaaucaggaguccccugcgugaccccuuggcugggccagucagugccacccaguuccaacaucccugugacauggucuagccagccagcuaugccuguuugauggugcgacagacaguccuaacucccaugaugcugagaauccaguaucauaaauaagucagccacaaaagaacacaucacacacugugugauuccacuuauaugagguaccaagaguagucgaauucauagacaaaguaggggagaauggugguugccaggggcugggcuuggggaggugaugaggagccaguguucuguggguacagcguuucaguuuugcacgaugaaaaucauucuggagauggauggucaugauguuagcacaacaauaugaaugcccuuaaagccacucaacuguccacuuuaaaauaguuaacaugauguugauaaagggguggcuacgcaugugguagugagggccaggggaaaucuggaaaaucccuguaccuuccacucgauuuugcugugagccuaaaaccaguauaaaaaauaguuuauucuggauaaagaaaaugugguacaucuacaccauggaauacuaugcagccuuaaaaaauaauuauuagagucuauauuauagagucuauuauauauuauguauauauuauguauauguaauauauauaauagacucucuauacauacauauauacauauguguguauauauauauaaauauuuggugggggcaauaacaaaggaaaacaguuuuuauagacuuuguuuuacccuaacaaauauauauauacacauauuuauauauaaauuaucuauacauaauauauauuuuauauauauauuauauauauauuacaucuacaccguggaauacuaugcagccuuaaaaaauaaugagaucauguccuuugcaggaacauggauggagcuggaggccauuauccuuagcaaauuaauucaauaacagaaaaugcaaauaccauauguucucacuuauaagugggaacuaaaugaugagagcacauagacacaaagaggggaacaaaagacacuggggccuaccaaaggguggaggguggcaggagggagaagagcaggaaaaauaacuaaugggcacuaggcuuaauaccugggugaugaaaucaucuguacaacaaacccccaucacgccaguuuaccuauauaacaaaccugcacauggaccccugaacuuaaaauaaaauauaaauuuuuuaaaaaaagaagaacccugguacuaggcaaucuaaggcugguucaggaguucaagaaaguugaaauguguguguguguguguauauauauauauauacauauguaaauaauauacacgcucuauuacauauauuauaugaauuauauaauuauauucauuauauauauguuuuugccccccaaauuauauauguauguauggaaaguauauuacauguauaauauauacuagacuauuguguauauauauuagcuguauauguguauagucuauuauguauauuauauauggguuuauuauaauauauagaaacccauauauaauauauacacucucaacauaauauguaacauauucccuacauauuaauauauauuacauagaauauauuauauauuacauagaauauauuauauauuacauacauuauaauauaauauauagacuacauauuagagucuacauuauagagucuauuauauauuauguauauauuauguauauguaauauauauaauagacucucuauacauacauauauacauauguguauauacauauauauaaauauuuggugggggcaaugacaaaggaaaacaguuuuuauagacuuuguuuuacccuaacaaauauauauauacacauauuuauauauaaauuaucuauacauaauauauauuuuauauauauauaauauauauauuacauacagaaggaggcaggagcuguguagaaugucccaggagagucuaccuaauaacagcccaaaauaaaaagcaucccguucaguucccucucuuucuauauauauauacagauaucuguauacagauaucuauauauauagauaucuauauauauagauaucuguauacagauaucuguauauagauaucuaucuauauauauaauauauaauaagauauauauaucauauauagauuauauauauuauauagauaucuauauauagauuauauaucuuucuauauauuauauauauauauagaaagaaagagacagagagagagccuauuaagcaaaacaaaaaaacuagaaaaaauacauccacuauuuaaccauucaaaaaagaugguauuaaaugauaaauuuuaaauuaaguaaauuuaccucaauuuuaaaaauaaauaaagacaaaacaaagguaaaaauuccacauaugcccagaucaaucaaguuuagcauacacauccacagggggguguagcuuuucccuuccuucuaggcuuuaaugaccacuuuaucucaaauucauaagaauuacauuaacauggacccacaaaaauugagucccuuucuucagcccacuugaagaugucuaaugcguuucacuuugcaaaccaacucgagauaauccugaagaaaagaaggaggcaggagcuguguagacugucccaggacugcagugccaggaugggacagugaucaguaccaaacagugcuccccagggagucacccaccacguaccucucagcaccccacacgugggcucugcagggaugggaaacccagaugggacacucaucuaaucccuaaacacccucaagaagggggcgaaggcuuccgcauaucauaagaguuggccuugacauuuuaaagcaacccuaguguuuauauaguuuccuacuggauuuuuuuuuuuuuuuuugagacagggucucacucuguuguccaggcuggagugcagugacucgaucucggcucacugcggccucaaccuccccagccucgggugauucucccaucacagccucucgagugggugggacuacaggcaugugccaccauacccagccaauuuauuuuauuuuuuacuuuuuguagagacaggggucucacuauguucccuaagcuggucuuaagcuccugggcucaagcgauccuccugccucagccucccaaagugcuagaauuacaggaaugaggcaccaugcccagcccuuccuggauucuucagaauaucagucugcauuuacaccuaguuggcaugguguuuguuugauaauggccacaaacaaccggaggguagaagauacugguacaagcagcggugagcccaagauuucaagacccaagugcaugaugcuucaaagccaaacaaagguugaacgaaaacaagggugucuaaucuuuggagaagccaaaccuuaaaugagacggaccaagacagcccucauaugagucgguacagcaagcuguuagggaucacgccuggucuggugucagugccucuguggcagaguuucugugggaaccuuaagccaucacugcuaaugggauugcccgugcagaucaaaaggcauccuggagaacacuuugggaaaaaagggccaugaaaaguaucugaagugcuggguagucuugaaagcaauuuagaaaaaugcagcaacuaaauuugucagauuccuuuucagaagaucugcguacgcacuggaggagagaaacccuaaugaagaagucauaaaguaauuauuaaaaaaauuaaaagaguagaaucauaaaaguuuuccuaaguaauacaaaauaauuacaauguccuaacagacaugcauuuuuaaccaauggcuaugauaacggaaaauuagacuucauuacuuauucauaaaauucuggugaacaauaagcuccauuuguaacaguuuuauaaauagcaucuuuugggcagaugcuauuuuuuuuggucauacaaugucagaaaccauucuuuauuuggacuaugggguaaaccagagcucaucagaguucauagcgguuggcuuaccuaccaccaggaucaucaagaaauuauaaaacacaacggcucuuggccccuauuauaccaguaaagugaccauaugcguuuaugcuuccuuucgauuuucuauuugauaguuaaaacacuguugaaguuugaagacaguaaacaauguuugaugaaucuacagucuuuauacuagcgggagaguccaaagaccaauaaauccaggguacaauuaauaauugagauuccuggaagcucuaaaaggaaauauuaaaaaugcaaaaucuuguugaaaagcauaauuaagcgcaucaaugccuaaaguuuaaaggacaagcaauuucucauuaaaguuaaaaaugucaauuuuauauaagaauauauuacccuaacuuucuuugugggguaggaggaggauauagaaaaacaguuuuuauagacuucauuuuacccuaacuuaaaggagcauccuguuccauuuccaaaguccucacugccccaagauccuaaaauaguauaacuucagaugaguaauagcuaaauaaauuuaucacacaucagaacccuuuacuggugcacacauguuuugacaauggugcugauggacaugauggguuuacuguguauguggaggaaauuaacaggcauguagacugcauaccuuuuucuuaauggcugaugugcgucucuuccccaugccugcagcugaggauguaagaaacauccaguuuccgcgugaaaacucaaagacguggaacugaguaggcccagccgugacgggguggggcaaaggucuccugugcaucuguacccaaagucccagccuggggccuccagagguaggcucccuccuucaucaaucgauucugcuuauccuguugcuauccugagauaccucagcuggccuguuugcccaaauggaccauugagaaaacauguuuccaggauaaucaacccuuuggcaggucauccucaaauauaauuuguauugugcuuauuuuucaaagacauggagaguguucuccacauagcauagguacuagauaugcucuuuucuccaacuucaaugucagcggcuauaaauuuaugaacauuuuuuuuucuagugguucaggaaacugugaagugaucucuucccaguuuucagaaugcuuuugugauauagguugguuugaagauuggaaaaccauucgccuccaucuauguaagcaaaccaaauguaauuauccagauaauguaaagaaaauaaauuauaaaccuacucuuguggaaagaaguuuagagaguaaauuuauucaauuugcuuuccaugggggcuuauguguaaugucgaaagaaacacgcacugaagcguuuuuuccccccaaaacauacccuaauucaggaaaaaaguaucagaaaauuuuaguuaagcuggaaagggagggaaggaaggagagaggagggaagaaagcaagaaaggaugggagggagggagaggaagaaggaggaaagaaaaaugauagauuugcagccuacaauuugugcuuuuuuaucaacucuucaguaaaauguccuaaucaaaugccacagauaagcgcuguacacugccucauguuucugugaaaacauagguagaaugucuggacugaauuuagcuauauuuugaacaugccuaacgauacacucauagugucacccaacuacauccaggggaacuuuccauuugccagacacugggccagguauuaggaacacaaaggaaaauaaagcagucgggcgugguggcucacgccuguaaucccagcacuuugggaggccaaggcagguggaucaugaggucaggagaucgagaccauccuggguaacacggugaaaccccgucucugcugaaaauacaaaaauuagccaggcgucguggcaggugccuguagucucagcuacucgggaggcagagcaggagaauggcgugaacccaggaggcagagcuggcagugagcugagauugcaccacugcacuccagccuaggcgacagagcgacacuccgucucaaaaacaaacaaacaacaacaaaaaagaaaaacaaaggaaaauaaagcaaacucccuaauucuacucaaacacugagacauuaucucauuccaagccuaagacacgugcuguuucuaugcuauguucaggggucuuuagaagacacuaggcaaccacaaaaaccaucccgagaaaugcuucuauaucaagagacaucuauaucaaaaaaagacaucuaaaucaaaaaagagacauucuguauaaaaggaugagucauuacuuggguagaguaaggaggagauaaguaucuccaagguguuccaccuuugcaaagcuuggcuuauaacaaugaccgaauucacgauaggaaaggaagagauuuuucagauucauauaauucaggucagagguccaaaugacaggcugauguuauaaucaaaggcucuccagaacggggaauuggacauuccaaaaugauggcaggcagaagucauuaguucuuauucaguuggaggcucuucuuaguaucaauaaacaggguguaaaaugggaggcagggaggcccaggauagcuuacacaaaauggccuugcuccuugaaguaauuauaauaacaaugaagaauuuucauuuugcaaugaaaaguucugcagagcuauauuaucuaccaaaugucaccacuccaccaucucuaccuuuuuuuuuuuuuuugagauggagucuuucucugucacccaggcugaagugcaguggcaugaucacagcccacugcagccucaaccuccccagcucagcugauuaucccacuucagccuccugaguagcugggacuacaggcauguaccaccaugcccagcuaauuauuuuauuuuuuguagagauggggucucaccauguugccaaggcuggucuugaacugcugggcucacgugauccuccugccuugaccucccaaagugcugggauuacaggcaugagccacuguaccuggacuccacuguguuaacuuuucuuuauuuacucaguauucagcaaaaauucauuaagagucuaccacgugccgcccaggcgugguggcucacaccuguaaucccagcacuuugggaggcugaggugggcagaucacaaggucaggagauugagaccauccuggcuaacauggugaaaccccgucucuauuaaaaauaccaaaaaaaaaaaaaaaaauuagccgggcgugguggcagucgccuguacucccagcuacuugggacgcugaggcaggaaaauggugugaacccgggaggcggagguugcagugagcugagaucgcgccacugcacugcagccuaggcgacagagggagacuccaucucaaaaaaaaaaaaaaaaaaaaagagucuaccacaugccaggcucuguguucucuccccuagaggcaggagagugcagaaaagcaggcaugauucuuucuagauagagaucauugucuggagcagaaaauggacccugaucaaugaucacaugaacaaguacagaacugcaagcugaugugagaaggaaggggacacaguucccagagaguccacagcaaaggaagugaccguggccaggggagucuggaagguaucucagaagaugugaugugugagcugagaucugauaaccuaaugaaggugaagggagagccuccccggcagaggaugugcaaaggcccuguggcaggcaggaguuaggaguugaccgaggguagggugacuaaagcacagagaagggaagugucaacagggcugaaaagggccucuagggcauaugaggguuuggguuguucaccuaaaaggagugaggaaacuuaaagaagcgaguggaagguuaacaugaugcacuuaguguuuugaaaagggcaacaggggcugggcauggggacucaugccuguaaucccagcauuuugggaggccaagacaggcagaucgccugggaccaggaauuugagaccagccugcacaacauggcuaaaacccaucucuacuaaaaauccaaaaacauuagcucggcguggugauaggcaccuauuaucccagcuacucgggagggugaggcaggagaaucacuugaacccaggaggcggaggcugcagugaaccaagauugugccguugcacuccagccuaggcgacaagagcaaaacuccgucucaaaaaaaaaaagcaagcaagcaaagcaaagcaaagaaaacggcaacaggggagaugaaggaugaaaggauuaucagaaaggccauggagaaaaucauuaaaggguauauuaguuuccugcaucugugugguagcuuaaaacaauagaaauuuauuuucuuaguauucuggaggccagaagucuaaagucuaggugugagaaggcuuaguuccuucugggggcucugaggagaaccuauuugugccccucuccugguaucugggggugccagcagcccucagugcucccuggcuugugggggaaucacuccgaucucagucucuaccuucacaccgccuucucuucugugccuucuucacuucugucucugcugaaaacaccugucauuggauuuaggguccacccaagaugaccucguuuugagauccucaacugaacuuaucugcaaagacccuuuuucucaaaugucuagguuccagugaacauaucuuuuggggagccaccacuaaaucgaacccaaagggcuacugucuuaacucaggccuuuauggacagcuccuucccagauaacugcaagagccucucagcuaaucucccugccccagccucagugacauugucuuucugaaacaaguccgacacaggggaaccgcauucccuugcucaacaagcaaaacaaaacaaaacaaaacaaaacaagcccaccuuccugacucuucacugcucuugggaguggaauggggagggagggacucucacucuccagcaggaacacaagguccuccccaacugggccuggcggugcuucauuuacaucagcucagguccuaggauugaacuccuguuguguaggccucacaucacucuguguccccauccucaucccacacucacguguuucuucaccagccugacucccauuccucuuuagaaauguauuuccagcggccaggugugguggcucacgccuguaaucccagcacuuucugaggcagaggagaggauugcuugaggccaggauuuugagaucagcuuggaaaacaaggugagacccugucuccaugaaaaauuuaaaaaucagggccaggcaugguggcucaugccuguaaucccagcacuuugggaggccgaggugggcagaucacgaggucaggagaugaagaccauccuggcuaacauggugaaaccccgucucuacuaaaaaaauacaaaaaauuagccaggcaugguggugggugccuguagucccagcuacucgggaggcugaggcaggagaauggcgugaaccugggaggcggagcuugcagugagcugagauagcaccacugcacuccagccugggcaacagagcaaaacuccgucucaaaacaaagaaaaaaaaauuuaaaaaucagcugggcacgguagcacgcaccuguagucucagcuacugaggaggcuaaggugggagggucucuucaccuuaggaguuugaggcugcagugagcugugacugugccacugcaccacaaccuacgcagcagcguaaggcccugucccuaaaagaauaaauaaauaagacauaaaauaaaauucacccacuuaaaguguacaguucagugguuuuuaguauauuuacaagguuguacaaccaucaacacgaucuaauucuagaccauuuaaccaaccccaaaagaaaccuugaaugcuuuagcagucauucucuaguccccucuuucccagcccccugcaaucacuagcuugcuuucugucucuuuggaggugccuauucuagguacuuuguauacacagauucacauguuaggucaucuuuugcaucugguuucuuucacuuaauauaauguuuuuuuuguuuguuuuuugagauggagucuugcugucauccaggcuggagugcaguggcacaaucuugucucacugcaaccucugccuccugacuuuaagugauucuccugccucagccucccgaguagcugggauuacaggccugcaccaccaugucuggcuaauuuuuuuuuuuuuuguauuuuuaguagagaugggguaucaccauauuuuaguagagaugggguaucaccaccagccaggcuggucucgaacuucugagaccucaggugaucuaccugccucagccucccaaagugcugggauuacagguguaagccaccacguccagcguaauguuugagguucaucccaguuguagcacagaccaaaacgucauuccuuuuuaacacacacauguuugccugugguggauggucacuguccucuucagaccuuaaaggacgccccacuaugaaugccuagucuccuggccaguaaucagccuggauguaaccugaacacuuugugaugaacauccccagucucagucagccccauccuuuuguccucacaacuccaggguaacaccaaguaaaucacucaagggaauuaggcacauuccucaucucccccuagaacucauaccaagaggaugcuggaagcugaucagaggucuauaaagcacucugaauucaacagagacaugcaaugcauaaaugcaaagggagaacaguaauucuuuuauuacacagcuugacagccuuccaacaagauggacuguuuucccauccaauugcuuucaagcuuuccauuaggucaagugugugcauauaucuaaugacagagcccccgggucacauucccccuccuuaaaccaaauacagacuugaacaugauugcuguugcuauauugugguuauuguagguauuauuuuuguuuuuucaauaagccaacagcagugagugcuggcuauauacacaguaccacgcuaaacucuauuuacauuaucuuauuuaauccuccccaaacccuaugccauagguauuauuagcagaugcauuuuucagcugaguaaacugaugcucaggggagagaaguaaccugcagaaaggucacaaagccagaaagugcaaagcacagacucuaucugcagaagcugagcccuuucgguugccuuuuccaucaucccugggugcuucugagcaaagccgcugacaugugccaccucaguuccgggcuugguggggggccacugccucuucuuggccuccccucccucuugggcuccagccccuuacaucagugcauaucauuuggcauaaaucagcccccaauuacaugaaugccacaaccaggaacacuuguaauuaaaacugggacugacauccuaaaaguauguucccuuccccauuccucuuuguccugcaaagauauuauuggaaagagaaugagcaaucaucgggaacauaugcuuucggaauauaaugggacucagcuccuccgagaaaaggcuguaaaagggcacagagacaaaauguaaaguagacagcuuuauuuacuagcgacuggggcauguccaagaaauaacagauaagccaguaggcuugauaacaagcgggacuuuuuuuuuuuuuuuuuuuuuugccacagauugcuggagaguccucuugcccccaaaaucuguccccacacaggcaucagagcgagcuuuucgcagcugccaaugugccccaagcacuugucaucccagcccauugggcgcugaucccagccuaaagcuccauccccagucuuugcaacucuaccuuuuauaccuccuucaccagcaaaagcaaauugcuuggugcuuucuggccuguuucaggccuacgugccucugcacucaugguuuccucugcccagaggguacuuggcauccccaucucucuuugucuuugccuaacccucuccuauucaugugucaaagcuggucaauaucaaucccuaucauuuauccagcacuuacuaugugccugcagagagaacgucacaugggugauuuuaacucucagugaacugggugauacaguugcugguguuggucccagcucauccuggcuccagaaaaccuccugcuccuuuauaacuggcacuuuuuguguguaugugugauugaacaagcuacaagcuagugcagacuccuuaaucugagggucuguggcuggaacccuagaaagaggggguguacacagauggccaaaauguuacaucuuuauuuuucacuaacaucugacuggaguuuagcauuacugucauuuaggcaaugcacugcgaucgugugagaagcaucuguguguuugucgcaaucgaaaucacagauauuuuccuaucacgcgagagucgcagcuauuuccaaacaucguuuucacccacuguuuugauaauuaguaguuaauggaccgaccaugagcuguguucuuuaauggguuaagaaggaagaacauuuguuacuagaucccaugaguuaauauuuugacaacuguauuuuaauaugauugguuuccucugugaucccgugcguuuuauguauucaaaaccauuauucugcaaagggcaccaaaugcccaagggguccgugacacaaaaacaggugaugauucccaaagaaagcgaguuucuugagaguagagacaauaucucgcuaaucuugcauccugcgugccuuacccuagcaccuuguagagcccaaauauuccaagaaugucaaacaaaugaaggcaaagugacugaaaaacuauuuuacugcauguagauuugcagaauggcguuuccuugucuuuauaaacauauucacgaauucauucauucaacaaauauauaauggccuuguacuggccaagcacuggacuagcauuaaagauuccauuuugaaugagguaaaugaacaucucuugcucucccugaaaacuuuuugaagcuuguguauccucuuggucuuccacccaugcugaauaacuuggggugaccuauuuagcuacccacaauuugaugucaagaauccccuuagcucccugacaaucuaagcucauuaacauacucccucacuuaaaaaaaaaucuauaaacagcaggcugccugcuuuuuauacuuuugugguagaauuaaaccaucaaaccucaaagugaccacuuauuuucagggagauuccguaauggagagcacagaaaagaauccacacgacgugugggaagcugcaugcguguugacaucaacacccuuccccuugcaucuguacagagcuuuauccuacucaccacacucucccuucuuuugucuguugauuuuauuaucacauuggccugaaauguccccuuccccaucgccaucuuucuacccagcaaacuuguaccaugauauacuaauaaaaaggaugacaauaauagcaaacauuuauagauuguguuguaugugcuagccugucuuuucauacugugguuggauuacuguugcauuuaauccuccuaacuccccugggacagagacuaucaugauccccauuuuauauaugaagaaacugagccacaaagagguuaaguuaucgcucauggugauacagcuauuauagcaaguggcagagccggaauucauaaccacugguuggacuuaagacuccauaguuuugaucacaaaaccccuuaaaaagucaccucccuaagaagucuuccaugacugccccaggcacuguccucuccauccagcacugcgccuugcagcauccuuaugucucucaauggguuaaguugcuuuauuauaauuguucugccucucuuuucuuccuuccuccuuugacuguuucaaagacaagcacucuccccagggagagaucuagcauguaguaguuguucaucaauuguccagugacuauccacugcaaccaugcagaugacauaagaaaggcagaaguuauugccacaugucagauaaggcauguuaaugaugagcucuuccccacaguggggauuaguagagaagugagaggcuaacugaucacggcugugugcuugguauggaugcagucacccagugaauuaaguauauuuacccccauuagagggaaaagaacauugaggauccgagggguugcuuaacuagccugaaaucaccagcuagguugaaaugaccagcuagaaaagauuagcuggguuuugagucugaugcagaaauuaaacucaagccuucuaccuuugcucucuucccucucuggaccacuaaccaagacccagaggucugccccucagugugccugcaacaauuacacccuuagagagcccgggguuggagucucccuugcuuauccaguaugcacaugcagcugcuuccugagcucacagauacgcaggauaccagcuugcuugcuuucugcuuuuguuuuuuccccuaaaagagacgauagucaugggcuacaugacaacuuucagucaaugacagacugcauauaugauggcugucccaaagauuauaauaucauauuuuuacuguacuauuucuauguuuagauauguugagauauacacauaccacuguuacaacugccuacaguacgcagcccaaucacacguugcauagcuuuguaggcuaagaccaagaggcuagaccauacagccuaaguguguguguaguagacggcaccaucuagguuuguguacgugcacuccaugauguuccacaaugaugaaaccaccuaaccaugcauuucucagaauugcauccccacugcuaagugacacauuuugagucugaugucauuccaacuuuuuuuuuucuuuuuuuuuuuuuuuuuuuuuuuuuuuugagacaaggucgcacucugcugcccaggcuagaaggcaguggugugaucuugccucacagcaaccucugccuccuagguucaagcgauccuccuuaccucagcuuccggaauagcugaaacuacaggcaugagccaccaugccugcccggcuaaauuuuuaaaauuuuuuguagagaugggguuuugccauguugcccaggcuugucuccaacuccugagcucaagcgauccgcccaccuuauccucccaaaguguugggauuacaugggugagccaccacgcccagcccuaacauucaauuuguauauuucuauccccauuauuugcauaaugaaucaucauccuugggucuauggggaacaaaaauuucaaagcacuguauuuagcacagaaccacuugccgaaaauaggaaagacccugguuuauggcucugcagaaucaaucacuuucugguugauuucauguggaggaggcggcccacauugauuggggugagcaugauauguuugaaacaaucucuuuggcuuugaaaugguggugucuuauagacaugaccucgauucugacaauuaucuauuuaauuggaucaauacagacagcccacucccccaaaccacugauucaauuaaucagaccauugucaaaucccuucuccucuugggucuguguagacacagaccaaguggcaauuucucccaagaugggcacagaggucaauaauccgcuuuuggauaaaguaucugauugcucacaaauuauacaaaucacauugauuacugacaaaucauaauguuuacagagcacuauuuggcuuuggcuccaaagcaugaguagguauuuaauuaacaacugucagauauaauuuacaccauuacaaugaccagaaaauggcugauugcugauuuuacauacuagaacaaauacucugcaacuagccuugguaaaggcaaaauaacuagggacucaacgauagacaauaaaaucaaauuucaguaccguguuuaaccggaagauucuugaaggccaugauaccucugccuccgauuagaaauggaaauccuuuugcucauagguccgagaaacucuguaacuaguuuuguuucccuuuuuugccuugacuaccaggaaacuccaagccaaaucuuuagccccaguacauaaccuuuuuggauacuguggugugcaaauguguauuuuauucuauuucgccugcuuuuuacuuuuacauguguuuuacuacuucauuguauauuaaggaucuagccuggaugucagcaaacuacaguccacaggacaaauccagcccaccagccuguuuauguacagcccaccuguucuggauaaucuguaauuuguuaugcaaauaauggggguggaaauauucauaucaaaacgugccaugacaaaauaacccauggcuuuuuuagacugguuuuaugaaaaaaaaaaucaaaaaaauauaauuucaugacauauggaauucaaauuucagugucuauaaauaaacuuuuaucagaacacggccaugcacauuaauuuaugaauuguccauggcuguuuuugcaguagaaaggcagaagugaauugugacagacgucauagggccugcaaagccugaaauauauacucucugguccuuuauaaaaacaguuugcucauccgugcucuagccuaccuguaauuucuuucuuucuuuuuuuuuuuuuuuuuuuuuuuuuuuuuuuuugagauggauucucgcucuguugcccaggcuggagugcagugaagcgaucacgguucacugcaagcuccgccucccggguucacgcuauucuccugcuucagccucccgaguagcugggacuacaggugcccaccaccaugccuggcuaauuuuuuguauuuuuaggagauaugggguuucacuguguuagccaggauggucuccaacuucugaccucgugauccgcccgccuuggccucccaaagugcugugauuacaggcgugagccacugcgcccggcagccuaccuguaacuucuguggacaaggcaagagauggauggauagauaacuagcuagagaacacagagggacauaauauacccgaccuggaguuacacucagugcucauauuauucuuccuaauuaagcuuugaaggugauaccaucuagggcaggggcaguggcucacauccauaaugccagcacuucucgaggucgagguggucggaucaccugaggucaggaguucgaccccagguccuauuuuggaaaacauaauaagacgaugagaaaauacacagaggggcguuaucgaaacucaguuaacacgacgucagucuucuuuaaaaagcaguaguugaggucaucaucuucuaagaaggacugggugggccaggcggggccugcagacuugggaagaggauaaaaacagaaacaggaguuccuagccaggcgcgauggcucaugcauguaaucccagcacuuugggaagccgaugcagguggaucaccugaugucaggaguuugagaccagccugagcaacauggcaaaaccccaucucuacuaaaaacacaaaaauuaggugggcaugguggcgugcgccuauaauaccagcuacucaggagucugaggcaugagaaucgcuugaacccaggaggcagagguugcagugagcugagauugcaccacugcacucuagcccaggcgacggagcgagacucugucucaaaagaaaagaaaaagaaaaggaaaaaaacaagaaacaggaguugcugcucgugggcaaguggggaagagagugaacaugcaaugggaagaagacugcaggaggagcaaccacccaacugugacagcaucaccgcaucucaucagugggagaaaaguuaagcagcaguuucauuccaaaggagaggaaagaaccccuaaugauuucauuguacucauugggguacaagguauuacagaagccuucagaagcugccaguagauccuuucuuucugaaacauucagggccuuuuggagguaaucgauagcuuaaauagaggauuacaaagacagguuggaauuugagaacauauagagauacaaagagagguaaccguaacuaagucaggaucaggccaggcguggugacuuacgucuguaaucccagcgcucugggaggcugaggcgggcagaucacgaggucaagaaaucaagaucauccuggccaacauggcgaaauccugucucuacuaaaaauacuaaaauuagcugugagugguggcacaugccuuaguaccagcuacucgggagucugaggcaggacaaucacaugaacccgggaggcggggguugcagugagccaagaucacaccgcugcacuccaccuuggcgacagagcgacagucugucucagaaaaauaaauuauuuaauuaaaauaaaaauaaaucaggaucagagacgaaacagcccauuuuggaaaagauaaacuaauaagagaaggagaaaauauacggagacagggacuagggacaugacuaaucccacaguggugugcuuccaacucugguugcagauaugaauauggaacccaaccagugacccuccucaugaguugaaccaggacuguuccuggagguggcuucccuccaggaagugacuucucauuggaaggaaaagaaauaaagacguuauaguuuauugagcaccuacuaugcagcagacacucagguuaacucuuaaauccucaccaucacuuggaaggaaaauauuguuacuauuuugcaaacaaaggaaaagugaguucaagaaaaaucaaaaagcauguggaaggucacacggcuggaaaucaugguggcacuggaauucuguucaucucaacuucaucuguucagcugagcuuccucugaccccauugucucgcuuuuuccccuuagcuaggcccaggaaaucaggcaccuucuguguuuccuacacugucuuauuccagggccuaagaccauaccuagaacacugcagaaacucaggagaaguacuccaacccaauggcaaaucacaggcaaaugcacaguaguguccuguggcccccgacacauccaaauuugaaagacagagguucaggaugacagcaggagaaaggccccuuucaugucacacguaguccuuggauuucugccuuuccaucuuugaucccucgcagguaccuuugcccaguggauacauccuucuccuacauaucacagagcauuccuaguccuuccugggugccaccacagguaucaguaaauaaaugcucauugaaacagcugaugcucacuaagugcuuguaaaagagaaucagauaaucagauaaauauaaguugaacaaaaguaggaaaccaaaaauagcauaguaaguagccuuggaauagagcaaaacuaacucgaauccacuuacuaguuguguacacuccagaaagugacucaauuucuaugccuugguucuuucaucucugaaaucagggccgaaauguccccuuugcugcagugacacaugauuaauaaacuauucaaagucuuaggcacugaguagcugcucaaaaagcaguggcuaggaguuggguuguuuuugccaaaucuggggaaucuuccaggugaaaacaucucuggaauugaaaaaucuuagaaggaucuggagcaacggcuggauuucccugaacugaauguagcaacauuuacauuuuucauaccacggaaaauugagggacgauccaggaaaacauagacagcuugagaaaauuuaaagguuccacaguguuuuuccauucggggacaauagaaaacaggaaaacauuaauaacaugucacugcccgacugccagcagaaccaccccaggaaagcaucuuuugguauaaaucaccgggugggcaugguauucucccgucccaugcgucauaaccacccuaaccacuacucccaugaccaccaucucgggaagauguugaaaaccuuucaaacuugacaaaauccagggccuuccuuaaauaggaccaucccuucccagaaaaagaucuuggucucugccagcucaaagacccagcucgggcuaaagcgacgaaaugcagacgauugcucaguuccccagcggcucucaggaauugacagucucuaaauuacugccugagaagcauaucgcaugccaacugacaaaaggaggagagcaaaaaauccuuacaggcggcggagcauccucucuuccucucuggggaggagguguuucugguguucuugucgcuggacccggaaaccaaaugaaaaauaugugauuacaaacaccugggagggcggcagagcgagaaugaaaaguagaauaaagaggaccccaaccuuccccauguaggaggcaauugggcuaaaaaaauaagaagaaaugagacaauaaaaguaacaaaugaaccugcaauugcuuugcuuccgggagcucccaucugauuucagauugguucuccaagucaacuuggguagauuaguguauccacgugaugcaaaccgaccuccgaggagacccgggacccaggcagcacaggaccuaacccuuggugagugggcugucccgguggaagacaguacacugagcagugucucuggccaucauugugugugcuuuugcugucccuguugcacacgccugagcuuugagugacuucauggggggacaugcguuuuacucuuagaagagcacacagaaaaagagaaacaaagaagggaaaaaaauaacuccagggaagauaaaagaguuaccagaacugagcagagacaagauagggaucggggcaguucuccuggggucagacacaucccuguacuacucaccacuccccagcacagccugcuggcagaucagagcgcaugaggacaggcguaugcauuuuauuuuuaaaggcaaggcauucacucucgacccugugggaggaugcacagaggaaggccucuuccugcacagugagcuaaagcccuggggcugugcggugggcggcaaguggcagcuuucagaccagggcagggagauacccucaacagggcaauucuggaggaccaccaacuuccugcucacugguagcauuuccuuuuuuugugaaacggagucuugcucuguugcucaggcugacaugcaguggcacgaucucagcucacugcaaccuccaaucucccagguucuuccugaccucaggcgauccacccgccucggccucccaaagggcugggaauacaggcaugagccaccacacccagccugcugguggcauuuucuuugugaugccuuucuucagccaggcuuacaaacagcagcccagucugccacgggccauguugguggggcaggagucaaaggaucuggaagaaaacagaaggcugcaccgaauaccugcuguguuucaggggcuggcuggccaccaggggaggaaaaaagggcacguauacguccugcuuuguggaacuuccagcccuuuccauagacuauucauucugccuggauauuuguucccucauucauugguuaaucacagccaucucucugccuuggagcugcaccacucauuagaguagcccucagccauauguggaucuucaaauugaucacaaugauaucaaauuaaaaauucauauguccgucugcgcaguggcucuugucuguaaucccaguacuuuaggaggcuaaggugggcaaaucacuuuugaggucaggaguucgagaccagccuggccaauguggugaaaccccaucucuacuaaaaaugcaaaaauuagcugggcgugguggcagacaccuguaaucucagcuacucgggaggcugagguaggagaauuacuugaauccaggaaguguagguugcagugagucgagauugcaccacugcacucuagccuaggugacagagcgaggcuccaucucaaaaagaaaaauuaagaugucauacuaguugcaugccaagugccacacagccagauguggcuuguggcuuuuauacuggacagggcagagauagaagacauccaucacugcagaaaguucuauuggacagcgcgggccgagagcacugcaaaagccuccuacccaguguccacgcuuccacuguuggcuuugacacuuuauucucaacacaguagccagagggaucccugaacuauucagaagugagggacaaaacaauagaggaaaaagauaguucuagauaaggaaguugacagaggccaggcacaguggcucaugccugaaauuccagugacucaggaggcugaggcgggaggaucacuggaggccaugaguucaagacuagccugaagaacauagugagaccccauuucuaaaacacaaaagaguuuuuuguuuuuuuguuuuuuaaaaaagggggccgggcaugguggcucaugccuguaaucccagcacuuugggaggccaaagcaggugaauagcuugagcccaggaguuugagaccagccucggcaacacggcaaaaacucaucucuaaaaaaugcaaaaaaaauagcuggcuaugguggcacaucacaguagucccaguuacuugggaggcugaagugggaggaucgacugagcccagggaggcugaggcuguggugagccaucaccaugucacugcacuccagccugggggacagauuaagacccugucucaaaaaauaaauaaauaaauaaauaaauaaauaaauaaauaaauaaauaaaauaaaaaauaaaaaaaggaagacuaugggggaugaaaaccaaaugcaagggaauucucagauuccagaucgaacaccaacagaaguuccaaagggggcaggauuggagacaugaaaauuugaauguagagggcauauuagauaauacuacguaauaguguuaauuuucuuaguguggaugugaaaugguugcauagaagaauguccuuauucucagaagaugccugcuaaggaauuucagggugagccgugaugaugucugcaacuuuucaaugguuccaaaaaaguguguguguguguguguguguguguguguguguguguggaugugugagugaguagauauguaaccauacauaucauauguaaagauacaugucacauauauaaagguauacuuaucauauauuuauauacagaaguaaagauggugagauguuagaaaucaucguaagccagaucgugcuacuccucuacucagagccugcccaaaccucccuauuucucuccaaguagaaaccaaagccauggcaggaccuccgaggucccacacaacaugaccccgucugcccucucgcucucuguucccaucucccgcacuccucaccacacaggccaccagacugucacugaacccccacccccgccccagugugcucugcccuuagggccaugguuuccccucugcuggcagcaucggguccaugucccuggaagguucccaucucuaccccuugguacccauggccaaaccuccucugccuggaagccuuccuugaccacccagagaaacaauccacugucuucuccaacuucuccgucuccuccuucccugauuuguuucauaccacucccugccuucucauauguuauuuaucauauauuuauuucaugaauugucuguuucuuugccacaccucacagggcaggggcuuuaaucuggcuuauucccugggggauccccagggccuggagcugucccgccaucaccuguggauuggucagggaugcccugcccaguggcagguccuccguguucacuugauuagcaaacauagguccuuugaguccugggguuccagaucugucucugaagcugccacugaguuaaaggcccuggucccaucugucgccugaggcaccuucccucagcacacgccacucucuaaugugagugucucccucgucugcuccucucugaguccccagcuccucacucuugucuggcacacagcagaugcucgguaagcauuugugaaagccuccuggggaagccagccuuguaaauaaacacuuguuucauggguggauuauuuuuaaaaagcaagaagucuaggcaugaguaagguggagugggaacagagggacauggugggugagcagcuggccaaggccuuugcaagcauagcagcuugcucaauucuaggcauacucaagacccauuauucuuccuuucgcuucugaaguccuaggauacugagguucagagaaggucaaugacuugcccaaggucacacguuaauagacaaauuaucaaauuucucucucaacuugauaaguuccaaagcucaggucaggacucacucucuccaaccaccuucccagaugaggucgaagcccccaugauagguacagucuugugugucccccuccuccuucccauguaccaugguugcaccauuccauuucuuccuuugaaaauuugaugggugccaggagcgguggcucacaccuguaaucccagcacuuugggaagcugagguggguggaucaccugaggucaggaguucaagacaaggcuggccaacauggggaaaccuugucuuuaccaaaaauacaaacauuagucaggugugguggcaugugccuaugggcugaggcaggagaaucgcuugaacccaggaggcagagguuacugugagccgagaucgcaccacuacacuccagccuaggugacacagcgaaaguccaucuaaaaaaaaaaaagaaaauuugaugaugggccucuaaagucacagaagccccagugucuccuuuugcccacuccucucuucccaaccguagcacaguuccuugcccccaguuagagcuccauaagcauuugugaaaaagagccacagcagugcagagcagcagccccagccacaaagauuccagaaagcgccccuucauucaucugcaaagagcaggagaaacuuuaaggcuauagugcccaaaccguuuguaacacucaagugaacuggcauucacaucaucuuccugcuuucauuaaacaguuccacaucacucaccuagugaaugggccuuuuuagcagggaagaugaucauccauuaagccuggaagggcaggaggccugcggacaccucugcccccucugccagcuccguggaucccucuaaauaauacaaggcuuguuugcaaucaaguuagaacauguuuaauggugaauaaaucugaugcugaaucgggauaauugcacuggcgucacagagcugacucaauaccuggccaaggcaucccauauuuagaaggguggagacauuuuuagcucgccuuugugugugugcgcugcucauuauacacacguggcuccaauuaaaggcccugccaccugaucggggcccccuggucuccggcugcaggugcacguuuguggggcuggaagacaaggccugggacaggugcugugaucucccuuuguuugcugaaaccaacaaacagcaaggucagcaccuucaggugaaggccaggugcuggagggagugaagggaguagggagagugacaucaguaugaccuggugucgggagcaugcccaagcucuguccuuccauggccuuuggcauggugcauaaugcuucuaagucucaguuucaacaucugugaaauggggauuucacagacuaugguagucaggauucaagauggcccccaagacuuccauuuccuauagaauccccucucuugagugugggcggcaacugugaauaugaugggauaauuugccccccugagugaguuaggcuaccaagcaaagggggaggaauuucgcagaugucauggaggccugaacgcaguugguuuugcauuaaucaaaagggauucaauccuaagugggacugaucuaaucgcuaggcccuuaaaaggggcugggcccucacugaagagagugacucagagcaugggggagccuccuucagucuugaagaagccaacagucauguugugaggucaucuguggauagggccugagagccugagaauagccucuaggggcugcaaggggcccucagucaacagccagcaagaaaacaagcaccucaguccuacaguuacaagaaaaugaauucuguuaauaaccaagggccucugauaagaccccaucccuggcugacgcuuugauuucagccucaugagacccugagcagaagucccagccugaaccaggacuuuuaaccuauggagcuaugagauaacaaauauacuaaauuugugguaauuucuuacacagcaagagauagcuaacacaaugaaaguaacuaccucccaagguuguuaugaggaaucauuugcaugcacagugcuuuguaaagggcuugugacaccaugagugacuaauaaagggcagagguuaugaugauuacuuucucuaccauuauuagucaaugauaaauauuaaauagcuuugguauccgagaaagagcucuccauucacauccugguuuugccgcuaagcagcuauaugauaccgggugagucacuugaugaaaucuacuucuucaucugauaacagugcuuuccuuauaacucugcagugagguuuaaggagauaauaauuuuaaagugcuuagcuucugcaaauucccuuuugccauauaaaguagcaugccuauguaguggggauucgguuauggauauuuugggugcucuuauccagcuugcccuacaaggccuucaucaucuuucucccggauccuugcaacaguuacuaacaauccccuggccucaucuucuccaauacauccuuucgaaggcagccugagugauuucucugagugucucagggccacuguguuugccauuccuuuugccuggaacaccuuuccaguucuucacaucaugagcccuuuccucauguuuuagaguuucucaggggcccuccccugauuacucuauuuauguaagucccucccuuuguuauucuccagcaaagaaccuuuuuuauuucacccacacaacuuacacuuacuguaaaaacuugacuuucucguugacuucuucaacgcccuucacccucacuggaacauaaguuuuggaagugcaaggaucuugucugugucauuugcuauugugaccucucugcuuggcauagcgccuggccugugacaaagugccuguggaaggcuggauaaugguccccuagagauacccccaucccacucaccagaaccugugaauauguuagguuacgcgacaaagggaaaugaagauuguggguggaacugacguugcuaaucagcugaucuuaaaagaggaagaugauucugggucauccagugggugcaaaacuaucacaaagguccuuaaagcggaagagggaaucugaagagagagccagaaggaugccagcaugagaaagacucagccaggugcuguuggcuuugaagauggaggaaagggacccugaguccaugaagaugggcaaccucuaagaaacggaagacgcaaggguacaagcugcccucuagggccuccagaaaaagcccagccccaccuacaccuggaucuuagccgagugagaccuguguuggacuccugccuuaugggacugucagauaauacauuuagguuuuuaagacgguacauuuguaaucauugguuacagcagcaauugaaaacaaauacagugccucacaaaugucuguuggauggaaaauggaaggaaaaaaaaaaagcguaacucagaucaggggcuaaaagcauucaagaaauuuuuguuaucuacagcuuagaaaccgaaacucuaaccuggcaccugaugcccuuguuaggcuaaccccaugccccuccccagcccugucuucauccucugccggugccaugcagacacucuaaccugcugaggcccccgggucucugcacggcugugugucccuggacuucccgcgcuucacaucuucuccuccauucccaggacaggucuccucuuugugcaacucaucaaaugccacuuauccuuaaagacugggaagucuuuccugccgcaggccaaacuugucaccccaucuucugcuuucuguaguucaaucucagcgcucauugucuuuguugccagccacugccacccucaccccacuggaccagggacuucccuagcgcagugaccaugccuuguugauauggguucacucagcgcugagcaccaggccuagcacauaagaggugaccgcaaaugguugcagagaggggacuaaacaccugccgccuguccccaggaauggccaguggguaaccagaguauggauggguuucucccagggaccagggcugccuucuguucucaugcaacuucaccaagguugaguuucucucuuggccugagcuauguucuacuggucacucuggaauccauauaugguggccugaaagggucccuaaaaugcauguccacccagggccucagaaugugaccuuauuuggaaauagggucuuugcagauggacuuagguaagaugugauuacagugaauuagggugggcucuaaauccaaggacugguguccuuauaagaagaacauugaagacauagagagacauggacaaggaagaugguggugagaagacagaggcagagauggcaaugaggugacaacaugccccaaacaccaaagguugccaggaaauaccuacaggccgggaagaggcaaagaggacgcccccauagaguuuucagagagaggauggccuugccgaaaccucgacuugcaaauuugagccuccaaaacugugggaaaauacaguucugcugacugaagccaccuaguacguggcacgccuaagaaacgaaugugcuaugccaucauccuuggcuacagcuaccucauuucugugacugugcuuagccuggggaguaaaugauucuaggaaacuguguguugcaucuccucccaggggucaucaaggaaccuuggacuuuggcuggagaucggcucuugggaaacuuagcuguagguggguggagauggccuuacaaauccugagguccacaggcaaacaucaggccugcauucaaagcacaaggcaagcaaaagagaaaggccagacagaaagccacauggagacucaguuuccucuuuccugggguacacugaggacugacugcauccaugugcccaguacaggggcugauccaaaaacaagcacauuugugcuuuuuccucuuccuucccucucccuuccccuuuuucauuuauuaaacucaagugaaaagaaaacaacaacuccuccuuucugaaacacaagaggggagcucuaaaugcauaaaggccagaauuaagcugugaaauuaacccccccaaaauuacaaauaauaaaaucucacauaggugcacggccccagcaagcugagggaaaacccaagugccugcugugccuuuuuauuacuugagguauauggagucucuaauuuaaggcuaaauauaaaauaaagcauacacagcuggacuuucaaguauuuucaaaacacauuuaauaccuucccgugaaacgcccagaaucugagcaggcaucacuucgcaccaguauaaacaggaguuggcguggaccgaacguacgggcuucaaaagcauauuuaagaggguugaacaggaaccugcaagccagaggccugaagggaucgcaaugcugaccugagcucacagucacacaguguccuuugccacaccagggcuauaauagaaaccagcaaagcugguugacacggccaacaccaacagggucugccucugaccgcagcuuugccugccccccacguacuuuucggcucuguuccuccacuccagggccaauggaaaaugagaaauauccaaguccuccuggcagccaugaauggauucucuguuaucccaggaauucucuuuggaggaaguagcauucacggguacuggcucgccaugcgguacugccaagcguuuuuauucauuccagaauuccccgugcagcgccuucuauugcuagaugugguucugaaggugcacagggacucaacagggacuagaucaaacaaaaccaguggucuucucucuuggaauugccugauguggguagacggaugauaaagagauaacagacaaguaugcaaacaagaugauggucuacaguaugcagacaguaacaccagagacugggaaggcaugguguguuggccaagugacacuugcaguagaccugaaggaugagaaguacucagcauugcagaguacagggaacuuucuuggcaaagggaagggcaaagagcaaaggccccaggacagugauaaaaucugcccaucaauucgcuucuccucucaucgagagguggagucugugucccuuccccuuaaucccagugagcucaggacuauacaguggugacugccuuccccaaagaugcaguggaagugacacccucugccuucugagacuaagucagaaaaggccgugccacuucugcuguguagcugaaacagcugcccuacaagaauccaaucacccugagaccacggugcuggagcagccacgagcugagaccagcugagcccucccugcccugcuaaccugacaaagcccuggacaugugacaaaagccauccuagacucuccaaggccagcucuccugccaacuggauuccacuaaaugaccuccaucaacagccacugcaagaggagacucaaccagccaaacccuauccagaguccugacccagaaaaucaugagauguaauaaaacuguugucguuuuacgccaguaaauugagggguacaccuuguuacucagcaauagauaagcggaagaggccucacggugauaaugggaggaugaaaugaaaccauauauguucuguucccgguauacagcaggaucucagcaaauguuagaucacguccccguuccucccauuccuugugacaauagacuuugauugccuuucaguuucauugccuauuuuuauacuaugcugcauuaaaucauaaauuacaagcagcuuauccaugucugauucucacuaagcacuuaguuuuauugggcucucaaaguuagagaaugacaaacauguaaauuggagaggcuuaucucugcucacugcaaaagaggguucuggaaggagguuuuucagggggaagaguggggucugaauugucuugcuccugaaaugugcugugaggcccuguggcuggcaugcauuggcgagcugggugcauucaccaggaaguuuuuaaaugauuuucugagcgauaucauuuuucuuuccuaaacagcauagauuuuugagcucuaaugcauuucugcauuacggaguacaggcagucucccuugacauguuucaucauggaguuauuuuccaaaucagcaucucgaagagguaguauaacuuagugauuaugagcauggguuuuggauccagacaggccuuggugugaacccugucuuuuccccuuauagacagggagaacccgggugaaaacuaagugucaguuuucaccucugugaaaugggaauaggcacagucccucugucccaguuugcuugugaagauuaaaucagaucacacaagugaagcacuuaauaaagggccucaugcaaagucagagcucaaaauaacugaucugcuguaaucaucaucaucacuuuaguucugcuauggcaagggucaucagguuuagcaaaauaaaaaggcaggggccgggugcgguggcucacaccuguaaucccagcacuuugggaggccaaggcagguggaucaccugaggucaggaguucgagagcagccuggcaacaugucaaaacccugucucuacuaaaaauacaaaaacuagccgggcaugguggugugcaccuguuaucccagcuacucaggaggcugaggcaggagaaucacuugaacuuggaagguggaggcugcagugagcugagaucacgccauugcacuccagccugggcaagaagagugaaacuccaucucaaaaaaaaaaaaaaaaaaaaaaaaaaaggcaggacacccaaggaaaucuaaauuucagauaacaaauaauguguuaggaguacagcacgucgauacacuugcauuaaaacucauucaucguccagcugagauucagguuucacugccugcccuguuuucauccccagauuauuauuaguguaauuuaccauuacaauaaauuccaguugcccagauuugugguuaccccagaccccuaaucacacccucuguccucugccccugauuuucuucuauuuaauaaaagcuuacaucuuuuuuucuucccuccagucucacuauggacugcugguaauuaagauaagccaagagguugcucuagaaagacaagcucuguaacuuuuucuaaagcgacaccacugcaguuauuacauaagcaccucucuaaagcagucaugagguucacugcagagaggcuuucauuuguacuuucuccaacuucccacugcacaaacgcccccuuccuccacauuucccccucucuccccucccuucaugccugaggucuagcucaauuugaaaucucucccccugccaccagcuccuuuuuuuuuucccacauaauauagaguaguuuauuacauaagugauuuauugcaugcaccuuaauguauaaggggcaaaacuuguuuaaaauaaauccaacugagaggauaaucucuaugggcaaaauguacuucgacuuaauuucucuacuggguauuacacacuauauaauugccuuaaacagaagcugcacgcacaaauuuagcuuggcaccaauaucuggcuucacagaacacucgaguuacaugcuggguuuugcuacaaauccuucgcuccaccagaagaaacucaacagcaucccuuaaagaaauaugcauccugacucuccugcugagaauagggggagggagagcagcugauugugugcuggauuuaggggggcggggaggccuuugucuugggagaggaggcaaagcugccagccugucucuaaccggccuccguuccucgagacugcaucuucuaggcccuuuauucaaaagugcauucagcagcaaauuaaaucgcagcucccugacuggcaccuggaugugggauauguguuuaauuaaaguucauaguaccuugcccuucuuucuccugcagauuaauuaauuaauguauuuauugacuccuuccugcauucacucacucugcaaauacucgcugagcucuucuuggaccccaggcggugguaggcccuaggaaucucauaguugaaccacacacuauuccugcccacguccaguggggcagaugaguauuaauuaaaucaucacacaaauaagugcaacaugacaaaccauggcaaugccauggaagagagguccaggguccucugagagucaauggggaaggcuggagaacuucccaagaaaggggcuuuuagaggguauauuauagggugccuuagcuuccucuggcugcuguaacaaauuacccccaaauuaguggcuuaaaacaaauuuauuuucugaaggucagaaggccacaauggguaucacugugcuaaaaucaaaggucagcagggcuucgugccuuucuggaaguucugggagagaaucucuuuccuugccucuucuggcuucuagacgcugccugaauuccuuggcuccuggacgcuuccucccucuuuaaagcugguaacaucaggccaaguccucuuuacucagccaccucucugauuaugacccaucugccucucuuuuccccaucucugauucgacugggccuacccagauaauccaggaugaucuuucaaucugaagaugagugaauagcaaccuuaacuccaucugcaaccuuaauuccccaucugccauguaaccucccauauuuauagguuccauggaauuaggaguagggccuggacaucuucggggcucauuacucugucuaccagagaugggaucuaaaggaaggaggagaauuugccaggcaaagcuggaaccuucugagaugagcugccaaugacgugccgugugaacgcagcuucggagcccagugaaggggugcagggagaugguguuaaaugugucuggacaaaggagcagcagucaaauggugggaagccugcucagacacaugaaggauccugguuuuuaucccaggagccugaagagacccuuucgcuauuucagcuggggaagaagauacugcguuuuacuaaaucuaagaucauagaugccauuauuuuucauuuccccuaaggaaaaaaaaaugcucccggugaaaauauggcacaaugcuuucucaugacguagaauuuucauuuuauaaucauuacaguaacucuuuuuaauuuuuuauaaaguuuuauguauuucaaggguacaagugccaauuucuuacacgcauauauggcguaguggugaagucugcacuuuuaguguauccaucaucugaauagugaacauggcaccuaacaggcaauuuuccaacccucaucccccucccacuuucacaagaacucucuuagacuuaaguaggccuccauuuuuaucaccaaucacucuggugcauacaauaaauacuauaaaauguaagugaaaaaauaauuaaaguauuccuaaaauuucuucacaugaagggucucucuccccugaauaacauuuugacucugaaucgcugaugucuagauuuccuccaugcagaucauuuucuguaccaucaagagcauaagugaugcagcuauuccuucuuucuugagaaggaguuucgcuccugcugcccaggcuggagugcaauggugcaaucucggcucaccgcaacuuccgccuucuggguugaagcgauucuccugccucagccucucgaguagcugggauuacaggcaugugccacuacgccuggcuaauuuuguauuuuuaguagagacgggguuucuccauguuggucaggcuggucucgaacucccgaccucagaugauccgccugcauuggccucccaaagugcugggauuacagguaugacccgcugccccuggcugaugcagccauccuuagaagaauccauuaaaaaaaaaaaaaaagaagaagcaucagccacuggcgcuggguucuugagcuggcucugcaguuguguugcgcaaaccuacuuuugauuuccacguccggaauauuucuagcucugccugucucuccacuucacagccauuugguuccuagaagguggaauauuccgcuguuacaucugggacuuuccuggaaucugucaacacccauccugcaaguuugguugcuggcauuugggacauuuauacaugcauaggcaauaacaaagucggacaccgccccugccaggcauaagggaacuuugagauguguucagauuucagagacccugacaugaaagaauuuagagaugcaccugaaggucaaggaucagacuggcacuuucaagaagucauucaauagaagcaacgcuuguuuccaccuuucaauguauaaguuaaaaacaucaguuaauaacgauaaugaaagaguccuucaugcaugcugagcacugugcuagccgcuuaccuacacacaucaaagucaucuaauuuuuacuauuacaccuauuguauauacuaagaaauugagucuuaacuacaucgauuaacuccucuaacagcucccagaucauaggugguagagccaagauuugaacacagaaugacuucagguguggccaauccccucuguuucuauuucucuuagucccucagugaaaaaaucuuuaaaacugacugucuuccaaguuccuucuacaaacacauguggagcaucuucugugaaggcaguaggcucugcucugggcccgaguacaaagcgugaaaacccacagacccuucacucaagaagcucagagcccaguggagaagggagaagagcagccaacaccuuagaucagagagaaugaacugaugugcaguccaacauguccugggucccagcagaagagaaaaacguccccauuuuacucauggugcaguuuucuuaaagaauguuggaggcuaggccgggcgcgauggcucaugccuguaaucccagcacuuugggaggccgaggcgggcgggaucaccugaggucaggaguucaagaccacccugaacaacagggagaaacccugucuuuacuaaaaacacaaaauuagcuagguaugguggcgcaugccuguaaucccagcuacucgggaggcugaggcaggagaaucgcuugaacccaggaggcagagauugcugugagcugagaucgcgccauuguacuccagccuaggcaauaagggugaaacucugucuaaaaaaaaaagaaagaauguuggaagcuaaacauuaggcugcaaaacauucagaaauucccgggaaggcagcgugaaaucugcagagaaaaucuauuccgguccccaucccauacuugguugaccuuacaauugcuauccucucuaaagccagcuugaauauuuccuucuaggggaauaauacaaagaaagagggguaggagggaaaggaagggaggggaggagaggggagagacagggagggaggaaauaaauacuagugcaaauucaccauacauuagguuucuuggcaugaucagugacacgagcgucaauuuuauagguacuguuguauauacaugcuauuguuuaggugaaagccagaaagagcaaagggcaaugaaaguguaaaaauaaaauaaaaaucuggaguagaaagcccagagaaaagggaggucaggcccauacagauauacagaaauaacaacaaaccuauuuuuuaaaaaauucuuuugcgugucaccgugguaagaauagaaacagacccaagccacgaaucuucuagauuuuccaugcaguuaagagguacguuauuuccaaagcugauauagguaugguuuuaaggaaaggaccuuauauuauaacaugucuugcugggacugcuuauuuuggcaucacuuaaaauuuuauuucaguuugcuuugaggacucuuggaguuaagcauccucuccuccuccucuucccccggaaaauagcaccccccucaccaggcacacacacgaaccacucgaacauaugucuacauugaagagcagaagauuggaaaagcagaugguaugaugccuuuggaaucugacagccgcucuguggcagcacuaucaacuaucagcagacaggacuugccagagacgcacauuugagcgagggacugccaaggcgaaaagauccgcaccucgcccucccaggcgcgggagaggaugcuuguguuugaaaacaagcaaaaugcucuucuccggagcagggacuguggacgcagcucugcagcauuuauggcacaugugucggaggccggggagauguucugcaagcgauggcucuauaaacagugccuacuuuggguguuuuccauacgaggcaggugggaagcgggaagggaacaguugggagaauugcagagcaaccuguuuucaugggcuguuuacuuucugucacuguaccuggccauauuugccauauuguccccacauuuuggggggauguagagcacacuagagucucccugaauggacauaaucuuaauucucaucuaaauacuguuguaaacugaccaccaucucucacuguaauuuucucuucucucccacauuaguuaggaggaauggaaagguguggagagagagggaaagggagagaaugaagcugaucauuaugaaugcauacccauggguccggcccagugcugagcacuuugaauaugccuccauucuuugcaaacuuugagcaaaucauuuuacagguggggaagcuggggggcgggggugggugcagaauucacucacacucuuucuauuucauccuuucuaucuucugucacgguagaaaaacauccacaaggcaagauccaucuuccagggagcacccagcugaaaaggggucuggcucagcucugcccuuuucaagguuacuucuucuauccacaagucuucaaaaauuucuaaauggagauuuuauuuaaagaagaugugaguuucguuaaaaaaaaaauuaaaaaaaagaacauucuacgccugagcugacuuucauggaaggggccacguucugauuucauuuugccaaaauaacuuuuuggaucuggauuuggaaucaccaguuucccucuucuuucagugaaaugaaaauguauuucauucaaagccacccuuuaacuccaagcuggccucuacuucccugcaacuuacagcaaucucauuaauaaauuaaucgaacugucacagagguauaaacgcaaaaucguuuggaaaugaucccauuuaagaucacacaaucuccaaaaccuacugcaacauuuuacacuuccuucaggccaccucgggucuccuuuacacuugcaaugaugccccuuucaauuugcauauaaaagacaguaaauugcaggguucauaaacauuuuuauagugauuuauugaagacuagaaugucacugcuguucuucacacuuuaccaguccugagaaucaaaugcuggcuauauauguaaucuugcuguccccaucaaccacauaagaacaagccaguuugcgguuuugcaguuuuuucucuuucucucuuucuuuuucuuuuucuuuuuuuuuuauaaagacaguggcaaccauauuuaucuucaguuagaagaaugcucuccaaguuccagcuuggguuccauaauuuacaaagaacuugguuuuaccaaucggcacugugaagaaaccauucuuucuuacggcugaggacagaaaaaggaaggcuuucuuuucaucuucccauuccauguccuaccccaaagaacgcaguccacaggcacacuucucagggaugaccuguaggcaggagaggggagggaauugggcaaggggcagacuggccgcgaugcauccagaugccucuguucaccuuuccugcuaaaagcuucagugcaaggauugggcaugggcuuuggaaucacguauuuggaaagaaugcaagcagagagaagcugagcuuggaagauacuuuugcuacuucccagccagcuaagucacaaaaaggagugaucagagccaagacaaacuguuauuaucuaagggcacagugaacuccucggcauccuccagacuuuuuaccagggggacugggaauccuuucucagcgcauugugcauaaugggaaaggagagaggcugggaggaaaaacaaaaaaaaaaaaaaaaaaagaagaagaagaagaagaaaagaaagaaaaaaaaaaggcuugcaccucauuugcccuuccaguguccagaagggaguauuucuuuccaccuuuuucacauuauaauaauggcuucacagcuccugaaaagagcccuagugcaacggcaaauggugcaugacacggcgaaacccugcucuuugucguaccagcuccgcuccaaagaaaguccuucucugccuucguuucccugccauuaacugagaugaaaugaguuuuuucccccuuuugauuccaccccccacugucuauuacagugugacgcgauugggcuuccuggcccauuauuucauagagaauucuuuuauucugguuugggaguuugcgccugcaagguuaucugugcacaaagcaacgccucggucuucacauucauuucugaaaucugaucucauugauaagaacaagaccauucgcauugcauuugucagauaaguaccucggugccggagucauaauuuuugugacuucagucagggcucccuguuaaaauacgugaaccgauaaaaaugcaaguauuauaaaaauaaccuuuguaucaaaagugucguccuaucuccuucuucuuucuuuaaagcacauuacguccuuuuucacaugaggcacuuccucauauucagacgucuauguccugauguucauuucuuaaaaauuauucuuuaaaugguacuccaaugccacccuucagcacgcuaggggaaaaaaaacacacacagagaacacaaaacaagaaggccuauaaggagagaaucgaugugaugcaguuugucugaaggggguuuugauuaauuucccucggaugguuuauccaauguugacagguaacguuucuugaucauaauaagcaaaugaaucaaaugcaaacauccucaguggcuaagcagagucaaagaacauuuaggacagggguccaggguacccucgucguagcuccaggguucucuaggacagggcugagcuguuggcuugcccagggaacaaugccacacuguucccacgggggaagcggucacauacacuggaaauaaugccugcacccaacggacacgaaaggaacaggagugaccgaccagcgggcuccgccguggagaacaggcgucuuggcuucuugcagguuccgaugccauccaagcugcaccacgaaaagccacccccggacucaggccauggagucuggcgaguguguuauauaaauauuagcaccaggcagauugcuggagccccuguguguuuccuguccccccguggcagccacauaaagccgccggugacaaaacuaagagacagccaugggcucacucuggagcagcaugccaagccgcacagcgcaagguccuguccccaucccuguuccgggcuccguacacccaggcccgcagcugauaacacuguaauaguccuccuuugaggacugaggcuccugcgugcugauuagucauuuaucacaccuggcagcccugcuuaacuauaauuacucuucucuuauccagccgcacugucauguccgagaggagaggcgaggcagaguccccaguuaaugacacauuacccucuugacaagcacuuaaagguuuuauuguaaauauucaagauauaaaacaucugagauucccuuuuuaauuauaaaaagcaauuucagggccucccuuccccaaccuccccccacccccaaauaguaaaguuucggcgccguuauccucggcuuacugcaaacaaacugauuucccuuugucacagaaacucauugcuacaaguuaacucaguaucucucugcaauuaucagacauauugccuaugaaauugguaauuuaaacacacaucacauuuccacaaaaguuaaauuuccuccccgaaagaaggggaaaaugugcauuuauaugaaaaauuauauaugaaaaaaagccuaaaaugcagcauaaauaguccaguuuuccucauuggaaagagagggaggaagucacugaauaauuuuuuuuuuaaagaugagacucuaauggaggcaaaaauuauacguagauauauuuuuucauaaacuaaaaaauuggaaauuugcgggucguuaaauccugacugccuacuuagaagguuuggggagaaagccaacuuagcauucagugacuuuugaggcuauuuaugucccucaaggagggcucagaggacacuuuccuccgggagucagggacccuggcaggcgauuuccucuugcuaccuuccagcuaaugcauaugaagugaucuuucuuguugguuaggcuugaggcuucugugggccaacuuccacaacagacauuaagaugggaucaugggaagggauggggagcugguacgaaucaaaccuuucauucugagagagaaaaauaaaaaccuacgcagacgcucacauccauacaacacuugcauacugguacauacaacguaaaaugagcucacuggagccaaauuguuuuuguuuuguuuuguuuuuuugagauagagugucacucuuuugcccaggcuggagugcagaggcgcaaucuggguucacugcaaccucugccucccggauucaagcaauucuccugccucagccuccagaguagcugggauugcaggcacccaccaccacaccuggcuaauuuuuuuuuguauuuuuaguagagaccgggauucgcagaacacuguacaggcagauaagggaguuggucuuacagaaggggugaccaaagguccacaaagccuagaagaauagugacaucguuggagcucacggcccaaugucccaagcaggcuucuuuaccugugaaugccucaaggacaggauuaccuuucacucauugcuacaucuuuaguaacuagcacaucacagguguguagauuccaagaaugaacgaauuaaugcaugcaugugaaaggagagccugaaaguggggagagggagaagauccuucaggugaguuucccaacccccugaguuucauuucgccccugcauccacuaaugaauauguguugagaauuauuuuguggcugguauuguguuaggcgggaacaaaggaacauuuauggaggugaucgcaagaccacagggccccacauggacaggagucugaagcagugaugaugguaaugaacaccgagaugaaaacuaccaagaucuccugaaagcuuaugggaacacggaaauguguuaagccccucaccuuccuguuucaucuuaacaucaccacgaggagggguuaaccuuauggcuugcguuguauaggaaaggaaacugagguucugagggagugaaaacaaguuacccaaggggccccaccacugguagguggagaaucuggcuuuuuuuuuuuuuuugagacaaggucuugcugugucucccagucuggagugcaguggugcaaucauggcucacuauagccucaaauucccaggcucaagccaucuucccaucucagccuccugaguagcugggacuacaggugugcaccaccacacccagcuaauuuuuaauuuuuuuauuauuuauagagaugaagucuccuuguguugaccaggcuggccucaaacuccugggcucaagugauccucccaucucagccucccaaaaugcuggaauuacaggcgugagccacugugccuggcugggaccuggauuuaacauggacuccaaauuccaagcuugcugucucauugccaaaagugggagggugguaauuucauccaagaaauaguucagggugacuccuaagcacaguggugagaauuucuccaaauuucuucuuugacuuugacaagggcugaaugugccaucaaugacuuaguaagguacuuuccuucacuuuuccuucuccacaacucuucuuugggaagcugaaggcugccaugcuuugacuuguccccagaguguccugcucuguucaaaggcacuuuauaaaucuaacaaaaugaccaagauccaaacaggcuguccuugccaggguuuuggucugaagacaagcuccccuggaggucgguucuucuuucucagcaugacaccucucucuuaagggaaaaaucacucaugcuguguucaucaccuguuuugucuccuuuuaaaaaaugccaagugaacacagagacaaauucaguccagaaagacugaggcaaagcuugauuaagacagcagagggauccuggcaggucugacugugcccucuugccagacuuccuuccuucccugucucccucccucccuccuuccuccuuccuucuuccuucuuuccucuaugugcuucucccucucucuuuuuccuuccuccuuuuucuucuuucauuuuacuuuaucacauucuggccuguucgcucuaccaucuuacaacuuggguggugauggaauuacccuggggcuuugggggcuccccgguguaaacaaagagcuguugucagugugaugugcauuuuggcauugauagaaugcaggccacagaguuugcaguaacacagcuguugaccuuuaguagcuccggacucuggaaauccacugaagcuagacagccauucccuagcccagaacuaggucgugcagagaacaguugaggcuccucaggcugcggacagggcccuucucaaggcacaaggaggaucuugcagagcccaugacuuagaaccaaugcacagucaggcuucauggaaaacaggcagcaauuacaaagcauggggggaauggaggcccuuaaucugagaugcugaucaguugagcucaaccucucucucuuuuuuuuuuuuuuuuggugagacaaggucucccucugucacccaggcuggugugcaguggcaaggucauggcucacugcagccuagacuuccugggcucuaaagauccucccacuucagccucccgaguagcugagacuacaagcgucugucaccaagcccagcuaauuuuuguauuuuuuguagagaugagggcuuugccguguugcccaggcuagccucgaacucgugaguucaagcaauuugcucgccccggccucccaaagugcuagaauuacagacaugagccacuguaccuggaaucccccgccucucuuucccuccaucugucucucucucucucaaucacacacacacacacacacacacacacacacacacgcucacacaccaccucugucucacuuugcuuccucucacuuccuccugggccagccccauuacucucagcaucucaccgcccucuuugcacaccugcuccauucucucuccugcucugcuucuggcuuacucaugcucucugcucccuaacacccuucuugcaaagggucccaacuggaugcccaauuccugaauccacaagacugcucagucucaguauuuauccccaaacacaagucuuuuucugugucuuucaguucacauuuuugagagcugaaccacacaggaguccacugcuggccccacuaccuuugacuggugguggagccaugggcgcuauggacagggauccccagccugcaagccagcaugggcaggaugccuggaugcaauauuuguggugcuguuaagauucugcagggugguuugacugcaucagggccauucuaucuuggggauccaaggaagcaaagaugaguucaucagacauauauauaagcuaauguauuuagcucuugauauugaacuaaucaaacuaaaaagaaggccuucuaauugaauuagaauucuuagaaccacccgaagaggaaagaugguuaguggaugggggcauccaagauggaacacuauucccaauuacucacuaacccuggggagauacaauaaggguucagcaucuucagaacucuaaauaugcugauaauuuuaguaauuaaggacuccaaaaagggaucauuguuagucccaaagcucuacaaguuaaauggcuuacucugaaucaucgaacucaggaugauuacuuccuccuuguuuuaacagagaacucagguuguacaggaacucaggaauucuccugccuaguuccugaagcaaaaugaaaccuuccaacaaagcugaaaagaagcacguguaucugcuuugccugacugcccaccagagcucguuucuccacugaucgauuggggcucgcagcaacaugcuggccccagggaugcacacaagccacggcugagaaaggacaggcugggaguggggcacagacuacagccaccggucuuucucucugggaagaaacuaacuugacagcuaugcaggaaucucccauuucccuacccaaaugcacuuuccauccuucuguacuggucuucgugccugaaaaaguugaccaauaugaacacaucaguaacuuccuuuugccaucugguuucuagcagggcuugaacaauggcaaagaguugaaggggcggggauguuuauuccgcugggaccucuccuggggagagggaguauuaccagugguaggcugaauuccucaaccaaagguuacagcuccuuccaaggagucuucuccauccuggcaccuucaacugucuccaguaucugcucccucuccuuggccaaggauggugacagccaccccuauuacuaccucugagaaauuaauuuucuuucuuuuuuuuuuuuuuuuauuuuuuuugagacagaguuuugcucuuguugccugggcuggagugcaauagcgugaucuuggcucacugcaaccucugccucccggguucaagugauucuccagccucagccucccgaggagcugagauuacagaugccugucaccaugcccagcuaaguuuuuguauuuuuaguagagacgggguuucaccauguuggccagacuggucucaaacuccugaccucaggugauccaccagccucggccucccaaacugcugguauuacaggcgugacccacagcaccagaccagaaauucgcucucuuuuauguuucccuacaccuugaccacccccccuuuauaaaauagccccuuuguuauuaaaauuucuugaaauuacucaauuuggguuuguuaccucuuucccacugggacuaccauggauacagaagggacaugacgagaccugugguuucaccggaaucauguuguaagcagcaaagcccacagggcugauucacuguuuaaacagcaaggugggaaaguccugcuggaaauuuuuggagagcacauuuuuuaaaaguugacaaguucaucagcccaagaagaaaaggacacagagaguuugggccgacauaucgcaacucucauuagcgcgaaaugaauucacguuacucugccucugaacauggagggcccuguacagaaacaaagacauaugcaccaucaugcaaaaaagccacuugaaacaugagggagcauagaggaaaguccuugaagaggucuuuuccaauuuuucucaacccacauauuuuauaggaaagcuuuaaacucucacuaaaacaauggauuaaaaaaugagaaacccuccuuccaguuucacaauccauuugucucauccucucgagaguugcuagaaaaaagaaaaaaggacaaaauacguggcaggagcuccagcaugaacaaacuugaaaaauccugccuuugcuaggaaaauauucuuaaauuuucaaacacauuccaaccuacccgauacaagguacaaaaagaucauugucaaaacaaagcaaaaccacucacaugccaaagaucauggaaccuaaagcaaucaauaaagccaggacugaguuaauaagcacagccuacuuauaaacugacucgucuuuugguuugugaugcagggagacauuaaauuucaaagaccucccgugugcuucugaaaauuacaaaugagaaauauuggaguccuauacugcuaucaaaguggcaaguuaguucuccuuaaaagcuguacuuaaauaaccauggcgcuguguccuuuaagaaagcccuaggaucauuuccccagccagccuccucugaucccucucugcuccguguggguaagugcacuguaccuccugaccaugcucuuggugggacuuuuuguagcaugaccuugaaauacuuuguuuuacugaguccuugcagucaaaaggagucucuugcgcauccugaaacucccaagucaagcauaauguguauuaucaaaaagaugcccaaaaaucucuguggaauuaaucuuugaaagcuaacaacaucaaaauaauaguacuuuaaaaucucuucugaagcuaucaagaaauggcaaagauguuucaacaugugcaucaacccuggucaauugguaacagccucccagaacacucuauuaaagagaauucaagagucagauccauucuugggagaaaaacagaguacugaugaaugagugauguccgccagugaccuggaauuaaggaaugaugucaaguagccuaucgguuugucauucuuguucuuauuuauccucacucucugcacagguuacuuacaugaaauccuaaaaagaaaauccacuaaaauccaaagagugguacaaucagcacagccccaaccuacuuagaauacugugggccuggagucuaaaaauggaaaccaguucauguccaaaccaauuguucuucguggagcacagggaggauauuaggaauaugccuucauaaagcucugagucagacugguauccucuaggugacuuucaaaacuauaggucuggaagcaccucuaccuauggcaucuuuguaaaacugauuaacuauuuucaauaaguuuuucuaucauccccaguggaaaauugcaagcgcgcugcauauguaaaaauauaaaugugugacucaucucgccuagggaaaugcugacagaaccaggaauguaugugugcuccugacuccauaaaugucucccggagccccgguucaucuugacauucccacacgcucccaugccaucguggacaagcuugcauugcauaaaauucugacccugggaugccccuccucaaggaaaauuggaggucagcacagugcauuguuggcucugagccaugaacuuuugacacagcaucugcauuucucggccagucaagguguuuguaugagagggauccuggcugacgggacugcagaaggcagccauuuggaaugcaggcaugagcugcaacuucuacacuccuuccggaguggucagcauugcaaugugaggauccagguaaauugucugugccuauucuuuuuuucuuuuucagauggagucucacucuuuugcccaggcuggagugcaguggcacgaccuuggcucacugcaaccuccaucucuuggauucaagcaauucuccugccucagccuccugaguagcugggacuacaggcaugcaccacuaugcacagcuaauuuuuguauuuuuaguagagacuggguuucaccauguuugucaggcuggucugaaacuccugacuucaagugauccucccaccuuggccucccaacguucugggauuacagcgugagccaccgcgccuggccccuauucugaauguagugcaggcgacuuccacuagugacagggagagaucuguacuagccagagaugugaagugauucauggcacggggacccugacacugcuauuagcccugugguguugacaaggcacauuggagacaacacaacacccugcgugccgguggcacagauuuacgggcugaacugcuuccucuauucugacauaaugcacugugacagagugacagaagacagcguuugugccuguaaaacccucaugaucaacaggaaauggagcucucuccagaguuaaguccuggaagaaaucgcaugccgaugucauggcagccucugcugcuggggcuaaagccaucugcaauucagauggaaucugauccguucggaaacaguuacaaaguccaaaaacugggcggccagagcuuggcuccugacagagcgggguggagggggcaagggacucagcaacacuuggagcugggcaaggauccaauauuuuuuuuuuccuuuugcccaguaucuguccauauccucuuaacauggcaaaugaaaucagacuucaacaccagaaccuugaugagccgauuaacugaaaaaagaaucaguucuuccccugcacgcuccaugcacccuucuuccucgucuuucuccuuucuguuacauccccugcacacguuccuuaccugagcugccgguaucgauccacagacaccacagaggaaaucacgaaaagaggacgaagaaagucugaccacuucuaacuaaacgguauuacaaaaguaugaagauucacaggauauuuuugguagaagguuccuaagggucaguuuguauguuguuccaaucaaccaguugagacagaaacauugacuuacuugaguagaaguaugucaguaucucuccgaacaaaguugaugccagaacucucugcucaugugagucaucccacagggcuaauucuggccugcugccuguuuuuguaaauaaaguuuuauuggcacacggccacacccauccauucacuuacugucuacagcugcuuuugcacuacaacagcagaguuggguaauugaaacagagacuauaugacccacaaaguauaaaauauuaauuuuacgggccucuauagaaaacauuugcugauucuugaccuagagagugcuuucuuggaggugggggacuugcaauuaccugauaaagcuccuaagaauuccaagcucugccauauagcagucuuggcaaacauguacagggguaugugccacaugguuauaccggacucaaagcaaauaaaagacaaagaauagcccucuggccgggcgcgauggcucaugccuguaaugccagcacuuugggaggccaaggcgggcagaucacgaggucaggagaucgagaccauccuggcuaagacagugaaacccugucucuacuaaaaauacaaaaaaaauagccgggcaugguggcaggcgccuguagucccagcuacucgggaggcugaggcaggagaauagcgugaaccugggaugcagagcuugcagucagcugagacugcgccacugcacuccagccuggguaacagagcaagacuccaucucacaaaaaaaaaaaaaaaaaaaaaaagaauagcucucauaacagauggacugcuucaccaguccuaucguucugcauuaguuaagcuaacuccaccugcuguaggagauaugucucaaagucacagggguuuaacacaauagaaguuuaucucucacuccugaaaugccuuauugaccagaaggagaugugcuccacgcagucauucagggaucaagacuaguuucauccugcagccgauuccauuggcuggaagucacaaggccaaaucuaacaccaggagagucuagaaaauauaaucuagugguguggcaaggagaaaagggagacaggcugaacauuuagccccacaacucauucugagaucuuaacguaccccauuucuucuccccuuccucucuuuucauagcaugauggucuuuccuauuagaaaaggcacacauaacaccuguucaguuuuauggauaaauacaucauguaucauccuucccaggaaaauauccauccuauccaaggagaaugcaaugcucaacuuaagaaagaacaccacggaagaagcgugagaccagauacgaggaggcccugguuccugauucuacucucccgccagcuucuuggccagacacuuccuuucuucagcuuagguuuucccauucauuucaggauaaacaauuugaguguccguggucuauguuucagcucuuucugauucuuugauucuaugaaggaauuccuaacgauggaguuugaugccuuggugggaaaaagauguuuggaugcuauucucagugucagucuacaaaagcaaaacacaagcccacuuccacaagaaacucagacuacaggagacccacaauaaauacuucacaaaagaaacaaaggaauauauuacacugcagccaaaggaaaccacagccccaaagacugcuucucccauugcaaacaguuuuauaugcaaucugcucaggguaauuuuauuauuucaggcacuguucacaacaucaccacacagaaaucaaaauuugaugaaauuaguuuagccaucacaggaaggauaaagaggggcucagaaggguauucauuugauaaauaaaauauauuuuagaagagaauauucugguaaucacuauuuauuaaugcaaacuucucgaggguuugcaggauucaaaugcacauuuucuccucacuaaauaagcauacauguuugaggagcccggucuaaaauauuaacaguccuccugcaccagaaauauuaguccuucccuccuucucugccugcuccugucaagaagccauagagcauacaauagcagcgccuagcuaaccauguaauugauaacucccuacucuacucacugugggaaucugucaguuaaagucuaaagauacauacacaccacuaugaaaaugaacuaacacaagucugucugcagaccaggaagggccugaaugcagucgacauuucacuauuuaauugguuggggccagcuuaccagcacacacguguauucuggcaauggcacgcuguacuaugacucuuuuugacagacuuauuuagugaagaggagguauuuuuuuccccagaugauugcucaaaaucacgcuuucaaagucaaagugauucaaacuugccugucuguauuuuggaaacacaccaguuggaaggaaugcaaauucauguuccuauuucuuaggcgugugugcacgaaagaggcuguuuggggucguuucuuuuuauuuuuuuucuucuuuuccucugagcaaugaaggagaaggaauacaaaccccacggaguuuagcccauccccagugaggcucagaugggccaaauccuacagacaacacguuucacccagcauagguccagagcccuuagagacagauguugaaacugagauucugccagucaaaacacuggagccuucaauguucugggagggucucuccagcaggacauacaguuguagcauccaaaucuucaggaugcuugaaggagucuucuugcuuuucggggggcaccuggcaaaguggacacaggaaggacuuugaaauuagaccaucuucaguguaacucagggaaaugaccucacucuguugcuccucguccuuggaaacggagcugguuguaucuaccgugcagggauguagagggcuuaaauuaagaugcuccaagcugggcacaaugucucacaccuguaaucccagcacuuugugaggccaaggccgguggaucacucgaagucagcaguucaagaccagccuggccaccccaucucuaacaaaaauacaaaaauuagcugggcaugguggcaugugccuuuacucccagcuacuugggaggcugaggcaggagaaucaccugaacccggaaaguggagguugcagugagcccagauugugccacugcaugccagccuggaugacagagcaagacuccaccuaaaaaaaaaaaaaaaugaugcuucauauaaacaucauccuggaugugauacgugcugcauggacagcugcccacauuguccgugucccucccuacucugcccuaaagagaucugcuggcguuuuccccccccacccagcauuuuugguuauucccguaaagaucauuagauggcucaggcaucagccagcgcagagaaauccuaauaagagggcagaguugggagaugugggcaaagccauuucugaugcuaacacagccaggacaucauggagaccacaugcagaguuuaggaaagugcugcaguacaacgguccucccagcuaggacacugguucaacaccaaggcaugggacuccacaggaagaacucgaaugaggcucccaggggucugcaaaguaugacugcaugacauacaaaaaugccccaugaugacgcaacacagcgcuucuuagcacagauuucuacauaagccaagaacuaaacuguggggccaacccugugacuuuauaucacucgaucucaacauuucugaagacaauaaaaacggagauaccaucaccucuacauuuacccacugaguccaguccuacaggauuacagaaccauaaucccuuccaagagaggacuuucaagauaacccuaucuauuccuccuuuccagaugaugaaaauaagcccugcaaaauacuuauucaaaaaguaagaaagguaguagcuaaagucuccuugggagaauggagcugauccggguccccuuucaaggucaaaguucugauugugauuugaaaugccaugugggguuccugcaacuauggaauaaucagucaugguauuaucauucuuaccaucaggauaccuacauaggauccugagagaugguaaaagaaaacgcuucguaaaagacaaaauaaauaaauaaacuauuaguauuuuaauugagacuggauugccaggcagucaauuuaauuaacugcggcacaauuaauugugaaaauugagguuugacugugauguugucaauucaagugguaucguguagacuugguuacagccaagagaacuaaaaccauuccaaggacauuguuggaauaaaauuagcagugcaaguguuuacucaaaauaaagacauggaaauccugaaggcaaagagccaucuuuggcaaacuaccuuaguuuuuccaucugucaaauggagcucacacagccaacuucacagcaaagauuuaaaaacuagaugcuuauaaaggugaaggauagguaugauucagcaaggauuuggggugggaguuggaggaaaagggggcacacauugacugguugauugauuugagauggagucucgcucuguugccaaggcugcagugcaguggugcaaucucagcuuacuacaaccuuggccuucugaguucaagugauucuccugccucagcuucccaagcagcuggaaguacaggugcccaccaacacacccagcuaauuuuuuguauuuuuaguagagaugggguuucaccauguuagccaggauggucucaaucuccugaccuugugauccacccaccuuggccucccaaaguaaugggauuauagacgugagccacugcacccagccacguugauuuauucuauaucacuacccacacuuaccaaucacacccuuuggauaaaugcagugcaguuuuccugcugcuuuccaagcugagaaggaaaaaccuggaccacuggggaccuuuaucuucagcaucucaugccucaagcauggacggcuacacaggcucugagagauggguacugaucauugucuuagagacaucugaguaacaagauccuuucaagagcaucgguagaaacucccauuugacucuccucucuggguggaaccucuguagaaaccgucacaggagccuuagccaucgcuagcugauuccagggagugagggccuuucaccugccucuaauucaguccugagcaaaaucaugcaguggccaccauaucugagcaccucgaugggggagccugucacguacguauuccgagacagacauaaacuucucucuucuuguugcugcugcugauguuaauaacagaagcaguuuucacuuggagccaaaccaaugccuaacuaauaugauagaaaaaaaacuauaaagguuagaaggagaugaacuaaaacacaggcguuaucucugggaggugggaauggggauggcuuguuuuacuucuguauguuuuccaaauguucucuaauaaugugaauucuuuuuguaacgggggaagccacaugcauguagcauaaaacaagauaagacccaagugauauucgagaggaaaauauauacuuccugugucuguauagggaaaaaaaaaaaaaaagacugaaauucugagcagggaggacgaaggagaccuggccguaaaggagagcagaugcugaugaaggucgaugcugguccucauagccuaaaaugauugcaccugcuucaagguguaggggagaguaaaguggggagggacaucaaaauguaccugaagaaauaacaagcgcuggugauaagguuuggaucuguguccccgccgaaaucucauguugaauuguaauccccaguguuggagguggggccuggugggaggugacugagucaugaggaugaacccuucauaaaugauuuagcaguaucuccuugguguugucccagugagagaguucucaugcgauucggugguugaaaaguguguagcgccuccccagucgcucucuguugcuccugcucuggcgauguaagaugugccugcuuccccuuuaccuucugccaugauuauaaguuuccugaggcgcccccaguagcagaagcuucuaugcuuccugugcagccugcagaaucaugagccaauuaaaccucuuuucuucagccauuacccagucucaggcauuucuuuauagcagugccagaauagacugacagaguuggugacagugugagaaacuggaaccccugcacuucgcuggugggaaugcaacauggugcagccacuguggaaaacgguuugauauuuccccaaaaaguuaaaaagaauuacugcgugacccagcacuuccacuccuagguauauacccaacauaauuaaaaacaggaacccaaauacucauaugcaauuauucacagcagcauggauucacaagagcaaaaagguggaaauaacccaaaugcccauggauggaugaaugggucaaccaacugugguaucaauauacaguggaauacuauucagugauaaaagggaaugaaguacugauacaugccacaaugugggucaaccuugaacacaugaugcuauuguaugaucccacuuaaauaaaauaucccaaauaagcaaaccuacugagacagaagguagaaugguagggaagaggaauggguaguagcugcuuaauugguacagacuuuuauuguggggagauacaaauauuuuggaaauagaugcgguauuuacacaccauugugaauguacugcuauugaacugucuacuuugaaaugguuaaucuuauauuaugugaauuucaccucaauuuuuuaaaaguaggggaaaacaaaaagcguccuugaaguuuccuugcuuuuaugugugucugcugcuucccagaugggagcuuggugugaggcugggaugggagugcauguuugggauccuaggaaggggguccuucaggacggucacagacuugcaggcacccccugcacccccugccccugcugaugauccgagcccucugucagaaccuccuuuccuuuaagcacuucuuucgaggcugagcuuucacuguuuuccuucuucuaucuccucuccccuuucauuuuuguaacaacaaaaauuuuauagccccucaaagaaaaaggaaauuaagcgacucccccagacaaggacacaugcagagagggcgucuauggugggauucuaauagggaaaauaaaguaaaggacaggccuacugagcucaucuccuuauagcuucuggugugugcuuugcuuguggggcgaggacagaauaaagagugccaccccacaaacuucuauggucauaacgaauaaggcaaaugaacaggaucuggaggaucucaggccucuggaggauccaaaaggacuucugcuucccugugggaggccauuuaaauuuaagagcucgaaccucucugacaaacaccaucaggcccagccuuugaagagcucucagggcucuccugucugaagaagucuugccaaaauaagugguucaaaacaaacacuugagugaaugauauauaggguaccagagauaccacauaugggaguaaagaggaagauauuagagcuuguaggaaauugccuggaggcaucaaaaagguuccuguguugacgugugcgugagccucaguugaaaccugauugucccaggccaggggaaagcucucugaugagcuuauacaugcuagauucaaaaacauaaaacgaacaaaaaaagaggugucaaaucuaagccaguuacuuccuuucugauggcccugagaaaaagaaaagggcaugggagguggagugcggcgugcauacuuuggaugcuaucaaaccucugcccuccauguuugcaacugaaccaggcauuaaagacacugacacugucagcacuaagaucugccucauggaaaaaguauuuuaaacgguaguugcaguaaaaagaccuagaguggggaagauagaaguaguaucuggugagcuccuggugggucucaggcauuuucucuuuggauuauuuuauuucagcgucacauuaauccaagagauggucuuaucuucgcggguguggauguucaggcuuggaaacgcaacgccaugcuuuucgcagcugcaagaucccaggcugagaccuagaucaagcuaugauggcaaagugcaugcaacuacaucaccccucacguucuugcuuaagcagaaauuacuugcucagucagccucccaggcugccaccauugcgugccauguggcuguuagucacaggcccacgcacaucacaugcuccgaaucugagacucugaccacacagcccugagugcugggagugagcgaggaccugagguaccaugagcaaaagcagcuucaucgguucucauuucaaaacuacguaagaaauaaagaucagaaagaaguaggaguguuucacaagaugcugguaagauuaaagugugcagggagauuugcaaggaaaaaaacuuucauucauucauucauuuguucauucuuucauccaagaaauaauuauccagugccuacucugugccaggaacggugcaggauauucgaggauggacaacaaagacgugagcuugaaauugucauucggauggaauaacaaugcccuaauguugcuggagcccagagcggggcgcuggcuaaacgcaccauugaaaggacauggcaucuccauaaaaagacuuugcaaagguuuccaagcaccggcaacuaaaaggcaggaggguaucaggggauggaggguggcagggcaaaggguggaagagggggugacauguggcugcugagaaagcuggaagagguuugguccuaauggcaaggguccuuacgguucuaggagccagaggucuugccuguuuccucccacccuccaagggccuggcagaauugucugaaaggcugaauuccaucaugaccuccgcuugcccaaaggccucaauuggcucuguguugccuauggacaaaacccuucucugagcgguguauucccaacaggggugacaauacauccagggguguuaacauugguuuugagggacgacaguuggggaauaaacacuguucacccuuucauuuacgaggcauauaccauguguauaugguacaugaacaggcauucagcacaucugugguauucagauuucaugggcaaagaccauuaggaaagucguaucucaaaaggcuccugggggagggggccauaaugaaaaaaaaaaaaagguuggggaacccucuaggccaagguuucuuaccuccaguguuauuuucauccaggaccacguaagauuuuguugcaagggucugcccuguucauguaggauguuaaccacuauccccggccucuacccccagaaaucaggagcacacuauuaccucauccuaaguuaugacaaucaaaaaugucucuagacauugccacaccuucccugggugcaaaaguggucccaucugagaacccuugaaccagaugaggcuaauucguauagguguucacuaagucauaacuaaguaaaacauaacaauguugacuuuuuaaggacuggaguaucuuuuauugguggcaaucaauucugguccagaguuaaaaugcagaguaacaaggcaaaagcaggggcccagccuugacaauagugaaggccuuuucacauccaacaacggucucaccaggagagaagaggggcuggggagucccuuccacaagccuagaaauguccaucucccuuuggguccggagaggccucauuaaauuccgaggcugcaucgguggacccugacuugcagcugagcauuucaaggucuccccgggccuccaguggacaggaagcugggguaauaaauugccucugcuucccggcuuagguugugggucucagaagauuacgcccuaaacaucccauucugaaggguggagagcuggcggacccaacaccagagaccaagugugggucuugggguuuggcaaaguggcaacucuguaaacaccauuagguagccacagaauaaucuguccuccucuucaggacagacaguugcaucgggugacauuugcuacguguaauauuuagguuugugcuaaauaaaaaacaaaacugaaauaauucccugcacauugcacaauauuuaaggaaauaauacaugguuuauuaaaguugauaaccuuaacagagacggauucaucacaucauaacuaggccagguucuagaaaacagaaucccauuuuguuguggaacuugaggcugaacaauuuaccaagacucuuuccaaggcuaguguauagcaaggcagguacuagggaagaacccacguacuguucaauuaagauguuuauugaugugacacacaaaauuccccugcuuuauuaucuguacuggaaggcgguuauucauuuaacugcuuugcuuugugcugugcggucauuagagacaguuuuucucuaacacaaauccaaaagaauccguucucugaagaguacgcuugccuucuuuucccuccaaaaguauuaacgagauugaauuuuccugauauuguuugauuugugaaaucacacugcacuuucaagcgcagaaaugaggagaguccuuuacacuuuuugaaugcaagauuuuuucagaaaggugaaaccauuuagaaaagaauuuuaaacauucaacauaaauguugcaugaguuuugugcuagggaaaagaaagcugacuaguaauaaaaucaccuugaaauaaucguaggauagguaauguuaaauuaaauaaacacgccgaagaaaaaaccaaaauucuacacaugcaaauuuuucccuaguuggagauagaaauuuccguuuuccaagggaagcaggggcucucggcucaugagcccuggugcccccacucccgaaccccugcccgcauaucagcacagaaacuugugucauuaaaaauacccagaaauacuuuucauuuacuuuuucucugggaacaaauuacucaaauugaacucaagcuuuaaacuuucauuuguuaaaagagcacuuugaaaaaccagacaaggcaaagcaaagcaaacaaaauaaaacccugaaguugguccuccuacaguuugagagacugagacagaaagaaaaacugugcccccugcccccaaaaaaagaaagcaaaaagaaaauaaauaaauaaagggaggcuucguauucaucagacauguuguuagagauguuugaagaaaucagcagauacuuuaagaacauaugagaauucauacuugguuggcuaauuauugaguagcucuguucucuguauugugcuguuaaaaguggagaucguucuagaacaguucuauuuuucucccuuuuaucaccuuccccagucuacccggcugucuccacuagggaacauaaguacccaaacgccaggaugacagcccggacuucugcaaagcggcuuaauuacucauuacgagauuccaucaacacaagcuccggucugugguuuuguaauaagggccuuuaucuuucuuaggauuucacuccuucauaaaggcggacguggcagagauuuccgcaaccccaccuuauacgggaagggaaugagaggauuuuaaugcaugaauuugaugucauuaacaaugcugacagcuguuuaaucccaggggaaacaacagcugagucccaacugcaggaaaaauaauuaacucuucaaugcgaucggaggaagggaucuuaugaaucaauuacgggccucuugccuuaccugcaguuuuugucaauuacucagcccuucggucgggaggcuccagcgcuaauaaaaugacaggcagcccuuacaaggcggggagacguguuaaguucagaggacagauuuauuaaaugggucuguucuaaguuugccauuaauuaaaauuaaaaaccauuuuuuauguuuccacugaaucacagagaauaaugaacuaaaaguaaaaggaaauaauaaagugggagucuugggugaccugaggucagggaggagaaggcagcugagcuggaagggaaagaaaaauaggcucugcaguugaaacagaaacagagggugggaugugcagcgguauguacuuuaugacaugugccauucaauguaaauggaacauuuacacaccugcugaugacgguaaauuugcuacucuucacccucccucccccagagauggucagugagccucucuuggcggcuucagguucuuuuauuuuuuuuuuuuuucaccccugcuugcugacuuccuuccagugacuauuucuacugcuuuuaauuuguaaaauauuauagauauaaauaaugucugauuaagauccugcuuugaaauacacggcgcucacuucacggcucccauccaauaaagcccuccuggauccuuuccauucauuuauaaugcgagacucugagcagaugucuuaaguauucaauguuacaaacagcaacauuacaugaauuuaaauuuggcucuuugucugaacgccccuccaagcacggcagcugauggccagggagcccaguuucaucuggaaaugaaguugcucugccaccugccccaagcuuccuccuccaaugcaggacgacagccugcucuuuccugagaggucugggcugcuggguauacggggagaccuuccggcagaucagggucuucuaaagugacagguggagcaagaaguuucggaguaaacagcagguggacaaacuccuaccucggccugggaagagcuccaaugcuccccgagugugcgccugaggcucccgauggauccucauaaagagccugcaaggucugcacuaauaucccgauucugcugaugaggaaacugaggucccaggaagaaaaaugaacuagcuuucucuuguuaguguucucuuuaaauggcauuuaacagaugugcaugugaaaauccucagguaaaguuuggaacccaacagcacaaaaagaaggccagggcggcagaggguggggaucggggugggggggcgauuuaucagagacaugacucaaugcuuuaacuugaaaaaaaggaacccuaaggaauauaagggauauuguaacaauagauuugguccacccaguacccuuccuuuuucuuaugcucuucugggaagcacacuuugcuccauuugacccgucagggauccauuagagugcuccauucucuuuccauggcuguagauacaugaccuacgacaccuguuaaacagccuaucucucucuuuuuuuuuuuuuuuuuuuuuuuuuugacacagagucugucacccagacuggagagcaguggcgugaccuuggcucacugcaaccuccgccucccggacucaacagauucucccgccucagccuucugaguagcugggauuacaagugccugccaccuaauuuuuguauuuuuaguagagaugggauuucaccauguuggccaggcuggucucgaacuccugaccucaacaagugaucuucccgccucagccucucaaagugcugggauuacagguguaggccaccgugcccggcccuaaaaagucuaucucuugaccacagcgauugcucaggaauaaagcauauggcucacacuggacuagaaucuuaccugauauauauauugauauacauauacauauguauacauauauauauacacccugggaaacagagugaggagcucuccugcuguuaugaagcuagcaugagaaugggaaucuggauuuucuggcagcuguuucucccaccagguagagaaaaucugcugcagaaguaagcaaaacagagaccaccauagcaaaagacagaagcaaacaaaucaucugauuauauuuuugagccccuggauccagccgugccugaagccaucacuccaagacuuccugguacaugaaccaacauacucccuuuugccaaaagcuggguuuaguugccccccaagaaucacgacuaauaaggaagaaggaggggagguacacacuguucugugaaaguucuacacauggcuccuccuaucuuuuuaaauuauggccucaaaugaauucucagcaaauuucucaugauucuggcauuacacuauaaucuuuguuagcucucugacuuuccucauacuguuccuucuaccuugaaugucuuacucuuccacuuccauacuuggugagggucuauacauuguucaaagccuagcucaaacacaaugccuugggucgagucuccccugguuuuauuagguaguaccagguuccccaaauaaacugugaucgcucaagagcaagaguugcaccuuugucacugcugugcucucaacaauaaggacgaugcugggcaugagguuaugcuaauugauguuauucaaaaaccauucacagugaacuagagaaaguccaaauggaguuuacacuguaguggggaagggcagagaaucaaagaaaaugauucgggcagggauaaaucugagucucuaacugagagccaacaccgugcugugguuaucaaaagagcuaauggcuuucaaagggggcauuaacagcaggaggaugugugggguagaggugacaggcccauuccacgaugugcuacucaggccacaucuggguuccugucgugguccagacuuaaaugagggcacuugggaaauuugagcguuagacuacuugaaucccaucacaguuuucauacaauuuuuuaacagcuuuguugagauaugauucauauaccauacaauucacccauuuaaaguguucaaaguuuuaguacaaucaaagaguugugaaagaauuuccacaaucaacuuuacaacauuuuuauugcuuuagaaggaauccugcuaucuuuagcuguuaaucccaaaugccuccauccacgccccauccccagccccuggcaaccacucuacuuucuguuucugcagauuugccucuuugggguauuucauguaaaugaaaucauauaacauaggguccuuugugacuggcuuuuuugauuaguacaauguuuucaacaugcgaauuuuccuuucuuucuuuucuuuucucuucuuuauuaaagcugcaggaaacucccuuguucauaaacagcaccuugcaugaaauacaaaaauaugcaacaaagaagagaggaacuguucuaguugaaagagaguggcugggugugguggcucacaccugucaucccagcacuuugggaggcugaggcgguuggaucacuugaggucaggaguuugagaccagccuggccaacacggugaaacccugucuguacuagaaauacaaaauuagcugggcaugguggcaugugccccuguaaucccagcuacucgggaggcugaggcacgagaaucccuugaaccagggagauggagggugcagugggccaagauagcaccauuguauuccagccaggugacagagagagacccuuccucaaaaagaaaaaaaaaaaaagagagagagagagagagcaggguggcaauccuaguguuauuuucuugacuuuguccccugagguagcaaaggagcaugcuaggguuugugacugaauucagugcccagacccauaagaccagacacagaaacagccagggaguccccugacugcuccacuggcuucucccucccacaauuauacgccaggucucuaauggaggaaauaacaagacaagggccacuggagccugguagcugagccacuccccggguuccaggcaguccaucuggaaauauaaaguucuauuuuguuauacauuugaaaguggaaaaaagcugugcuauuucaaguugucuuuuuuuuuuuucuuuaagaaacugccuucuccaugaagaaguauuaugugacaaacauuccaagucccuucuuaugguaauacugcacuuugcaaauggcucggauccaauccaauugaacauaauaaaaugaaacaaucugugcuaucuccaauagcuuuaaucuucaccaugcuaaugauuccuaaaaccaaugagcaugguuucaaaaagaagaagaagaagaggaagaagaaagaaaagacacauucugccucucccgauaucagccuccuuggcagcuggggcuugugcuuuuugucaccaucaugaaccucucaacaggguccuugggaaaagccugccccauugcucugaggucaaaguuuacaugugaaaccaacuuauaacagucaucauaaugucccguugcuugugaugguuaacaaugaaacauaauugcauccacgaugaagacugccaucucauuuugcaagguuggugagaacucccuagggaacaguuuggcuaccaccaggaccuggucucuggcaauuagcaaugacaauuuaucuccaucuacacaaaauggccagggcucagagcacaugguuccugccucgggucgguggugacaguucccuguuggauuccuacggguaggacuauggggcacaguuucuggauagucuggaaaucgcccauucacucauucacuugcauguaugaaucauguccaugugcugugccaugcagaccacgcacugugccacgcagaccacgcgcugugccacgcggaccacgcgcugugccacacggaccacgcgcugugccacgcggaccacgcgcugugccaugcggaccaugcacugugccauacagaccacacacugugccaugcagaccaugcacugugccacaaggaaugguagauuaaacacauacacuuauacaucuucuuuuaauauagugggguaugggcuaaaugagaaguauaaacacagaacugggggugaggaaaggaagaaaggcucccugucucccuguucccuccuccuccugcagcuacugauguggccccggaggcugcaacagaguugauuuauguggcaucacucccauccucucccauccugccucuccuacucuuacacaccccaaagauuuggaacucugugccauccucugcagucuccagcuucugaguccuccuaagucagguccugaccguucauggugauccuucauccugugggaaccuaacacccacuagacucucccaagcuaaaucugaaugacaccagucuuggcuguuuccuguauuucuuuaaaagucuacauaggggguauugggcauaguggcucacaccuguaaucccagcacucugggaggccaagauggguggaucaccuggacucaggaguuugaaaccagccuggagaacauggugaaauccccaucucagcaggaaaaaaaaaaaaaaaaaaaaaaccacaaaaauuaaccaggcauguuggugcauacuuguggucccagcaacucaggaggcugagguggguggaaagcuugagcccgggaggcugcagugagccaugaucaugccacugcacuccagccugggugacagagugagucucaaaaaaaaaaaaaaaaaaaaaaaaaaaggccucggcaggcaggaguaguugccucccaguuguuuggggcuagauucauccacuugcaacaugauuugaaucacgcauuuuccucuuuccuuccagguaucucucagggcugaugggcuucucagagaggcagguaaacuugggaaaacaggcugaaacacauaucagauaacccagggacagaugcaugacuauggggaaaguucuagaagagaaaagaaaggacaacaauggaccaaaggaagcauuugaauagucugcauauucuacaggcucuucuuccaguggagacaauaauaaauguuaauaagaaauaacucaguauuuacgaaccccuuaccauguaccagacacaacgcagacgcuuuuuaucuacaaacucauucaaucuccacugcaacucuaugaggugggaacuauuauuuuucccauuucacaaauuuaguacccgaggcccaaagcaguagguaauucugccaaaguagaacaguuggcacaugugauuugaauccagaccuccauuuucagugauaucagcagaccaugaaaagaguuuugcaauauauuuaagcuccuuuaaacagugugcacccuuugacucagugaucuuacuucugaaaauguaaucuuaagaaauagcucaauauuauuaauacauacuauauuuauugauucaaaacauucacauguuacuuuuuagccuuacuuauaguaaggaaaauuuagaaacaaucuaaauuuucacuauuaggggaagaguuaaaaaaaaaacuacagucauagccacuaaguggaauuuauagccaucuuaaaaacgauguacaugaaaagccuauaauauuguggaaggguauuuuaguguuaaggucaaaagcagaaccaaaacuucuauagacaguaugauuacaaauauguuuagaugccaggauaggggguguacaguaaacggaaagaagcacuguuuuccauuugguuccaucugaaacagcuaucaggaaaugauuuguuucugagcaugucuguuaucuccucuuaaccuauagccucuuaaaccagugccuuuagaaaacucaaccugacuuuuuuguuccugagauauuucacacggaaaaauaaauuauaucaugggauuuaauaucuaaguuggauaaguaaagcuagguucuuuagcugauagguaagaagccacgcaaaaaagcuuggaauccucagagcuggucacacaguguauccaaaauugaugaggcacacagauagcaccuggagauaacuuuuuccauucuuguucucaggugcagaaccaaaucacagcaucuccuuccuccaacucuacuuuggagcaaauugaguccaaauuagaucacccauuucguccaauuguauaaaccacggcaauacugcuugggaaaaucuaauaguguuaaucuaagaacugcuccugugcccacaauagaaucaaacaaauaaucaauaagccucuagauauuauaacaucacugagugaaggacagagaaaagauugugugugcagagguugcugcuuaaaugggaucaagucacaaugcgggaagggcaaagccaacacaaaaaaaugacgacgacagaacuggguugaguaacauaguuuaugccagagaugcuaacagugccagaaucuucuaguggaaagcauuagacuguguaucugaauaaggcgggcauuuuuuuuuuuuuuuaagauggaguuuugcucguuacccaggcuggagugcaauggugccaucucggcucacugcaaccgcuacuuuccggguucaagugauucuccugccucagccucccaaguagcugggauuacaagugccugccaccaugcccagcuaauuuuuuguauuuacaguacagaugggguuucaccauguugaccaggcuagucucgaacuccuaaccucaggugcuccacccaccucagccucccaacgugcuaggauuauaggcaugagccaccgugucuggccaaauuuuacuagugauuuaaacaucuuguucaaccaucaauacuaucucuguggaauuguuacuauuguucccauguuacugauggaaacauaugagguuuaaagagcuuaguucacuuucccucuucucacagauccacugggcagugccccaguauggacucugccuggaggcuccagcccuacauuucccuucagcacugcccuagcagagguucuccaugagggcuccacccaugcagcaaacuuuugcuggggcauccagguguuuccauauauuuucugaaaacuaggcagagguucccaaaccccaauucuugacuucugugcccccacacacucaacaccacauggaggcugccaaggcuuggggcuuccacccucugaagccacagccugagcuauaccuuggccccuuucagccaugacuggaguggcugggacacagggcaccaagucccuaggcuacacacagcacagggacccagggcugggcccaugaaaucauuuuuuccuccugggacuucaggccucugauaggaggggcugcugugaaagucucugacauggccuggagacauuuuccucauggucuucgagauuaacauuagguuccuugccacuuacacaaauuucugcagccagcuugaauuucuccccagaaaauggguuuuucuuuucuaucgcacaaucagacugcaaauuuuccaaaccuugaugcucugcuucuuuuauaaaacugaaugccuuuaacagcacccaagucaccucuugaauguuuugcugaugagaaauuucuucggccagauacccuaaaucaucuuucucaaguucaaaguuccacaaaucucuagcgcaggggcaaaaugcugccagucucuuuguuaaaacauaacaagagucaccugugcuccaauucccaacgagcuccucaucuccaucugagaccaccucagccuggacauuauuguccauauugcuaucagcauuuugggcaaagccauucaacaagucucuaggaagcuccaaacuuucccacauuuuccugucuucuucugagaccucccaacgguucuaacuucuuccuguuacccaguuccaaagucacuuccacauuuucagauaucuuuucagcaaugccccacucuacugguaccaauucacuguauuaguccauuuucacacugcugauaaagacauaaccugagaccgggaagaaaaagagguuuaaucaggcuuacaguucuacauggcuggggaggucucagaaucaugguggaggugaaaggcacuucuuacauggugguggcaagagaaaaacugcagaaaccccugauaaauucauuggaucuuaugaaacuuauucacuuucauaagaauaacaugggaaacaccagcccccaugauucaauuaccucucccugggucccucccacaacacgugggaauucugggagauacgauucaaguuaagauuuggguggggacacagccaaagcauaucagcaagucaguagcaccuuuaaggcccacuuucuguaucuuaaaauggaaaaaacaauaugugucuguguguuaagugcauagugcaaugucuggcagaaaguccauacucaaugcauguuggcucuuaauagccuuaucaugacaucaccuuaauuauuuuuaaaaagcauaccacuaacauaacuagcauaagcaaauacugaacucuaauucaguaauucaaggaugacacaccugcuuaaguguuuaggagugaagcgacugcugucugcaacuuauuuagcuuuuuguuuguuuauuuguuuuuguuucugagacgggguauuacucugucgcccaaguugagugcagcaguguagucacaguucacugcagcuucaaucuccuguacuccagcaauucuccugccucagcugcccaaguagcugggaccacaggcauacaccaccaugggcagcuaauuuuuuuuauuuuugaagagauaaggccucacuauguugcccagacuggucuucaacucccggacucaaggaauccucucaccucugccucucaaaaugcugguauuacaggugugagccacugcaccugaccuacaacuuauuuugaaaugaaucaagauagacugauggauagacaagaggaaugguaaauggauagagaugcaaauagagggaaauguuaauuguagaaucuagguggugcauaucagaguacuuacaguacaauucuuucaacuuuuguguacgucugcaauuuuucauaauacaaacuguugguaggauggcaguggcagagaaagaagaaugacaauaaagaaugaaauaucgugggcaaaucccacaaccuaaugaggaguaaaagaagcaagacagcaaagaaugcguacugggugacuauuuauaugaauucaggaacagaaaacuaugcugauagaaaucagaauagugguuaccucuuaaugcugaugguacuucuugcuuagaaaggggaacagaugagccuucugagguguuagaaauguucucugucuugaucugagugguguuuacacaguuguauaaauaaguaugaguucauugaacuguacauuuaaugugugugcaccuuaccguaggaaugauacaucucaaguuagauucugaugcaagcagcucacauuuucugaaugcccuccucuuccugugccaggcauucuuucugggcacuuucugaugcauucacuuggaaaaccauuucagagaauugucugacagaauacauuauuuaagccuuuaaaugcaaugugaagcaaucucacuuucuuagaaaaugacugucaucccugagaguaagcuuggccuacaaggaaauuaugaauguguaaaacuccucagccuccuagcccuuguccagagccuuugggccuuuucuugcuuccuucacaaucacauuccuucuuuuuuuuuuuuuuuaaaaaaaaaaaaaaaaaaaaaaaaggaugccuugcugacuccaaaucucuuccuucuggcacagaauucagcuaaugggauagagaaaaaagaagccaccuccacauaacaucacacagaaagucauccacaggguggcuguccucauuaaagccuaggcuucucuucucuccucugggagagauuccuguucagauggcaagccucucccucuuuuucacccuaagacugucccuuuccaaagcuccuuuauggcccaacccacuggaucauagguagaagucacauccagacuugcucaggagcagccuggaaggagguccugacaagagacaagggaucuguuuaaggcaacaaagacuuggcugcuggguccaucccuaauaccugccaaauugugcuugauguaaaucugaaggcaauaggucuuggaugcagucaauguggaaccacagaaugauuucugcaaaaucaacuucauggaagauguagcagaaauagagaugcauuaagauucaggacagcaagacuacuaugauaaccugagguacuuguuuaaaagauaaaguuccccaaguuccuccucagacuuacugaaccagaaaaucaggaagugauacccagaauaugcuuauuuuaacaagcucaccuuggggauucucuugcacgugaagcuggaagaucaaagacucuuuguaaagagucccuucagaagaacaagccuuucauuuauccccccuuacucacccauccaugcacccaccaacccacccauccauacauccaucuauguacccaccuaccacccaccauuccacacacccacgcauccauccaucuaccuauccauccauccauccauccauccacccauccauccauccauccauguaucccauagcuauauaucugcugaguguuaucuuugugccaugccacaaacugcaaccuccuugauggucaaagaccaaguuuccuuacaccaacuaguuuuacagagaacuacaucaauuuaggcauguucaauuauauaaucaucaguucauauauaacuaucauguuuuaaaaaccuuacaguaauuucccucauuuuuccucguuaaucugcauagaccuuuuaacuucugaugucaccaucccugcauaaaggaccccuggcuuuuaggagacuaugaucuggaacauaaccauugaaugcuuggcuugagucuuucuuucaggggaacuugcaccaugagcugagaacaccugagucucaagggccugagggucaucaugcccagauguauggagcugauuacuuuuacagacaucucaucacaagugaguaaagauacuccauggagaauacauuauagauucuucucuuuccagaaagcuaagauaauuugggacccaaagcaagccccguagguucugaacuucuuuacuuuugacaucaagucuucaaaagagcuauguauguauacaguaaauaaagcaacugaggcagagauucaguaaaacaggaugcuaguuuaacaagaagacaaaaaaaauaaggugacuaaauagagaacucccaaagcuacauaggcuccuuuuggaacaagugcuguguaccucuacuggaaagucauacaucccaguagcugauggcacagggaccuauugucccugauggcucucuguucccuccagacugugagaaccuugaagguagagacaauuuccuuauuucugaccaauggaucuguuccaugccugacagucauaacucaauaaauaccugcucucuuguggagauauuuccuucugggguaagaaggugacaaaaugaggcaguuguaaucuccaguagauuuaagcuaaagcaaauaaaugauuuucaugaagugacagucuccuuucauaugaaguauugaggaugguagagagcaagucuagauggcugaaggacagguaguaucagcccagucacucagcagcaacaaacacggacuuaguuuugaauauaccacaagccaaacguuacgcuagaaaauaugaagccuaguccuaucauuuucugucuuucauagcuggagguggggaggucuuuguccuaugacccaaauuaaggucauuuuuggugucagacauuacaagucagguacuaucuuuuacaccacaacauggcuuucuggaauuagcuguucuuccucagucuacucugccucugagccacagcacaaccccuuaucccucacucuuugacaaugacccugaccuguagccauuuagucugucccaccaugcaccaauacccacuaacugguagaccuaaagcacaaaugucauugguauuuccuuuaguuaaccagaagucucucaccuuauacacacccuuuauucucaaccuugguugcaaaugagaauuacuuaggucaucuagaaacucuugaugcccaggcuguauccuuauccaauuaaaucagacucuccagaagaaaaccaggcaucaggaucuuuuauaguuccccguaugauuuccacaggguucagaacaccgacagaggacaucuuucccucacuugucucggauucaucaauaugggcauuuggucauggaaaggcuccuaggccuuuugaugugguaguugcaggggggucucaucagugucugagccugcagucuauccgacaaauuuugaugagcucuuugaucuuucaccaagacacuggccuuccuaucacacugagagucaauacuacggguucucacaaccuagaaguagauggauggauagauggaugaauggacagaugaauggaugaacagguggaugaaugcaugagugaauagauggauggacagauagauggauggcuaacccugugaagguuuuuauuaucauaccugaauuagcuuguuaguguuaucuuuucaaauguuuauguccccuaauggacgucaaguuccaaaacauggacaucucuaucucucuuugcuuucucagggccaagcacagcacuuggcuggcagcagauauagcaacagguaaaaaauacaugccuuuugaaaaauaaaugaauuaaguucaaugcccuuauuucuaagucuguacaauauuauuccaggaacauaauuucucaguaaugagaagaacgagaaccuugacguagagauggcccauugauauuuuacuuucauacucuacaaggaaauaccuagcgguaaguucggauaaacauucuaauuggaagauggucuuacuaaucucaagaaaaaguggguagacaagcauuuuuaaaaacauuacauuauuuuaauauuaaaugucuugcuguuauagaacucccuuuuuucacagaugggaaacuaaggccuagcaaauaauuuaccucagaucuugaacccagaacucuuauuuuuuaguccaaaucucuccccacuaagcuaugcucacccuauggaguugaaugcaacaaacauguuuuuuucuuuugaaucaaaggaagaauuuuaaaauuacauaaccuuccuuccccugugcccacuaccccaaccauguccuauuuucagauuaaacuauccaaaguggcauugacgacuugguauauuucaucaaacuaauugcauccuggugauaccugcacauaccauguaauuuauauuucaguugucugagaauaccaaaagaaaaccagagaaaccuuuguuguaccacacuugguaaaaggauggacucgcauuucuagugggagagaggggcagcacuguuaaaaaacacuguucagcuuacuuuggaaacugcaaggcaccauaacuucccaaauuggcaaaacuaccugcuauggauuguaguaaaguguguuuuuaaauuauuucagaaccauaaaaccucuccauagagaguacuuugaaagugcaaauuaaauauagaacauccaugaacucuauccauuuuuacaguaaguauauauuuccauggggguuuguaccaucuuuuuugucuaguuacacuaguuaauaaugcagugaauuuucaguaauagaguaaauguuauuuugaugacacuauuugauuaaauuaaagaugacauuaaaaggaccauuucaauaaagaaccgaaauauucagaaguagcuggagcugaguguuuaagucagcuagucuggcggucuuaaaaggaccaaauggaauuuccuucgccgugugaaugaugagcaaguuaaggaacaauaggaccaaauaauauaucggagaauaugaaggcucagauuccaagacccaggcaauguuaguuauuugaggcaggcauaccacgcgccagaaaacagcucauguggccuugggaaaauguagaaacgcauuaaauaaaacgaaagugagagggcacugagauuugcagcaaaugugcugauguggugacagugaauugaguuguugcacaaacaaaagaaagggcggauuagucauguguccccccacgcccagccucuucucugcaaauucacaaaggcacaagugggccagccgcaccagcgcagggacagcuuugagauuaaaacaggacaagagaguccuaauucuuuuguuaaggucuccguuccuaugguguuugccaaagaaaaguucuucuccuaacggagagguucacauacauaaaucaaacaacugcuugaaaaucccuugacuuaaguuuuuagagauagaaucuguaguuuuuagagauagaaucuauccgaagagacauaccucaguaacgugacugaguuaugaaucacggguauuucaccagaaagaagacccgagauuaaaggugugcagcaguagacauucucaguucccacagaacaccuguucuggugucucagccccaaacacaggcgacaucccuaugucuacaaugagccacuggcuguugacaaguucaggccugaagcauucacauuuguggguguuuuuacaacuaaagagagacagggggaaaagaacaauucagcucaagcuaauauaauucuuucuugugaucucaaaacagcaucauuagaugcuaaguuuucucagauaauuaucuggucgucacgcaugucgguaucucaaaauaauuauuucgucacacaaaaggacggcggugugguuugcuggaaaagucgugugcccugcauuucaguaaauauugcuucuuuaagggcagauaccucagauugcaacacucaugguguuuucaaccuucugcauauaaagugggagcguuuacuaucuucccagugcaaaucacuuagacacaaaggaugauauagaaagucacaugaggcaagucuauuaaauaaagcaugugaauaacacacggaguccucaagcugccaggaaauuuguucucaccgaagauacccacguacugggagggacugcaacuacucagaagugacaguagcaaacuuucuuuacaaaacauccuauuucccagaauuuugaguggcucaagccuacauguuugagacacucuccuucacaauuuccaaaagugggcacagcaugccuucgugaccuccuguugcccucuuuguuuccccuacaggucugaggcugggcucagcagaucccaaauuucuuguuuguggcacacuuuugaaacucaaaaacacaaaaggaauuuuugaugugugcacaaagagauuaaaaagugaaaacagagguauuuuagggcaaugaaauuauucgguaugauaugauaugauaugacaugauaugauaugauacaauauaugauguaugauagauacaugucauuccaugucugugaaaacccacagaauauauaucaccaacugugaaccuaaugaaccuauagacuuuaggugaugaugaugugucauuguagauuaaucaauuaaaacaaauacaggccuagagugguggcucaugccuguaaucccagcacuuggggaggccgagaugggcggaucacuugaggucaggaguuagagaccagccuggccaacauggugaaacuccgccuucacuaaaaauauauauuaaaaaaaaaugagcuggguaugguggcaugugccuauaaucccagcuacucaggaggcugaggcagcagaauugcuugagcccucgaggucaaggcuacagugagcugagguggugccacugcacuccagccugggugacagagcaagacuccaucucaaaacaacaacaaacccccaaaaccuaaacaaauacauggaucuaguggggauguagauagugagccagggcucugccggagguauacgggaacucucuguacuuucugcucaauuuuggcuccccaacuaaaacaguucuaaaaaaaaaaguuuuuuuuguguuuuuuuuuguuuuuuguuuuuuguuuuuuucuaaagugaaaagaaggccagaggccaggcaugguggcucaugcauguaaucucagcacuuugggaggcugaggggggaugggagaucgcuugaggccaggaauuagagaccagccugggaaacauagugagaccucaucuuuacaaaaaauaaauuagccagagguggugauguacaaccguagucccagcuacucgggaggcugaggcaggagaacugcuugaguuuaggaggcugaggcugccaugauugggccacugcacuccauccagccugggcaauagagcaagacccugucucaaaacaaaaaaaacaaaaauaaauuuuaaaaauaaaaagaaacaagaaaauaaaaaaaauauaaaaaauaaaguuaaaagagguuucauaaaguaaauaugaaugauuugcugguuuuaaaaagugcaguuauuaucccugcagccuggugugcuuacacgaggugaacuucgcgccauccuaguugugauccacccucacaugcuccaguaaaaauagaaucucuuuuggcccaagcucucugggacucugaauaacucacaccucucacuugccucaagucugaccugagugcugcggcacaccugacucaucuccucaaugcuccucucaacggauuucacugacguuguuguaugugcagcuguggagaauaucuauuuuagggcaugagggacauguggagguccaucugugaagaugcacugaacaucauuugagcacccacauugcagcucuagcauauggcccugaucucugaccccugcagucucuccuccaggugacccuaacagcaaaguuuccuuuuccugugggccaaaauucaauauagucuucaacugucacuuucucucugcggaguuuccugaucaggaaagaauacauucccaauacuuugugggggacaaugcagaaggaucacuugaagccaggaguuugagauaagccugggcaacacagugaggcccugucccuacaaaaaauuuaaaaauuagacuggcauggugucccgugccuguggucucagcuacucaggaaacugaggcaggaggaucucuugaguccaggagcucaagacuggagugagcuacaaucaugccaccgcacuccagccugagugacagaacgagacucugucucaaaaaacauaauaauaacaaauaaauaaauagaacaaauuggucauguagcuuugcuuccccauagcacuuuauauaauuuuuauuauggcacccaccaccccucacccuagacucccauuacaggaauuuauuuaugugccuaugcuucuauaucaaaaaaucauugaggucaggucuguaucuuauuuguucuuauuuaugugucuguuuccagccccuggcacuggcuuggccuucgcugcugcuccacaaguauauaaaggaaauggggcauuugggcagcucccuuauuuuuagcaagccacuaggcuaucaaugcagauuuuuaguaaaauauaaaaguuucaccauucaucuauccaugcaucauuuauccauccauccaacuacucauucauccaugcauccauucaucuguucauccacccaaacauccaugcauccauccaauuauccaaccauccaaccauccaucccuccauccauccaccuucuauccacucagccaugcauccauucauccuuccaccuauccauccacccacucacucaaccaucauccauccaaucauccaaccauacauccacccaaccauccaaccauccauccauccauccacccauccaucuaaagaauaugcaaucaugccuacucugacagacauuuuuauggcagaucuuaacaauuuaaaaaagaaaaagcaaaagaaagaaaagaugacuaggaacugaauaagauaugguccuugccuugacauguguugcuauggaagaggagaaauaaccuaugaaagcaaagaccacguguuguucaucuuuuugucuccugcagcaucuugcacagggacuuggauucagcagcauuuuguaaaugacuacugaaguaauuaauaaaaauaaacgcaauauaaggcagcaagugaaaagugucaaauaaacucaaagcccaaaaaugcuacaggagaguggagaguggcucgaucaugcccagcugcgaaccucaggguagguagaaucugagcugagacagaacgucuggcucgacuuugaaaccaggugaugagagcaggcauuccaggaaagaguuuauccauucaugcaugcacucucuucugucacugccuaccgaaaugcuuggcacagagguggaccucaauaagagguuuugaaguacgguacccacugggcugagcugggcauugaggcaacaguggaggggacacacucucugccgucaaugaguccccuggggcaaugacucugaaggaagccaacaguaaacuggggguuaggaagacauuauguagccauaaaucagcaauuuaaacugcauacauagaguggggcagagguccuaaagggacuguugaugaacagguuucaaauuugacuagguuugaauuuuguguuugcaauuagcagcauccauuugcauacaauuagugugcaaagcccuuaaaaagaguuuguucucuaaaguagguuaaacaugccccccaccccccacuauaauugugccugagcuauugguuuguuuuagaaaucuauuauccuauauagaccaaggagaaucuuuggcucagucuagguccaaaggggaacacuuagauaguuauccugccuggucagaaccacggcugaacuucccaggggcucuaacuuaggaggucagauuaucaggaguggucacugaugauugaauuuaacagucaauuugguugguauauggucagauuguccaccaccaccaugaacaacaacaacuggaaaaaaaaaaaauccagggaagcaauaaccacaaaucagagaaaugcgugauuuuucaugagcauugugugguuuugcugaagccuuugcuggcccauccaucuucugagccagcuucagguuucccuuugauuccuguuucucucuguagaauuauuccacaagccugagcaagugccucuaaagcgcagauuuauucacguacucauucacuuacucauucaauaaacacuuguuaacagcuaagccuucugcugggcaguagggauacguuggggaaccgaaacaaacacaugcccuacggagcguacugucaggugggaaaaauaggaauuaauaaacaaacacaaaaacaggccaggugugguggcucauaccuguaaacccagcacuuugggaagcagagguggacagaucacuugaggccaagaguucaagaccaggcuggccaacauggcagaaaccccgucucuacuaaaaauacaaaaauuagccaggugugcugguacaugccuguaaucccagcuacucaggaggcagaggcaggagaaucgccugaaccugggagguggagguugcagugagcuaagaucgugccacuguacuccagcgugggggacagagcgagacuuuugucucaaaaaaaaaaaaaaacucaaaaaacaaaaaaacaaaaauguaaaacugcagcucagugcauugcugccaagaggaaaugcacagaacuaugaaaacuuauagaaggauuuaaugcagucauggaaggcuuccuagagacagugaccacugaguugaaauauaaagacugaguagaggcaaaguaagggagaaaccagcaugugcaaaagcccugcugcaggagggcaacugcaggaagccaaaagagaggguagaggguuacaaugauaacagugagaaaugagacagggaagguacacgggggcuaggucacugggucgagggauuguagguuaugauuaggggucugucuuuacccuacagacaguauaaaaucauugcugugguuuaucugagggugggaagauuagaauggcauacucacauuugggucucaaaaagaucacuuugcuacaguuuaaaaauauuauggaaggaaacaauggccccugcuggauuccacuguccucucacccacauccauugaagaguguugcuaucugccuuuggcaugcuggugccaggaacugccucuuacucugcucagaccuuuccugcaagccaccauccuggcuggcccccuucacaacuguaaguauguggcucucucucaccccuuccaugggcccaggccucuuaacccccucaccugguuccccgguacuggguagaaccgcaguccugaauuccacuggcaaugauccuaaaacaagauugacaucaagacugccacugucuccugggauggguauugauggagcaguauagcugcugugaugaagcccuguuguuuuugucuuuuuaauacccauguccccuuuuccagcaauaacaugacuucuuuacugugagguacuucauaccucacagucuauaugguguggaucaaggggaucccgcucccaugcucuaagguggucuuuauuccagguccagacagaaagacggugauuggcucaaugauuuacaugugacccacugagggccaaugagagucagccgugggacucuugcuugaagcuauaggaaaggagcuuucucucccaccaauauucccugagcauuaaggcuaugggcgcaugcuggccaugucugcaaaugaaguuuacagagauggaaguacagcugagagaugcagagaaauagaauuaugaccgcgccauuuaaucacuuagauccagccacgccagauccacccuuaggcuucccaguugccaaucaauccccaucuuuggucuaagcaaguuagggcuguguuuguuacuggcaauggaaaauaaaaauucuguccucaucuggccucuucucauuguccuacaauugcugccaccuacaaugucuggccugagaugaagcuaacaggguggugaauuaagagaggcgguugagcggggcuggaaagaaccggauguuuauggcuccaaagacugaaaaucuggacaauguuauccuugggccuucagcuaccacaccucugccaaacaccuugcacuauaauaagaagagacaaucagagccccugcuucaaaagucugguuuuccccaaaggugccaaccuucaaguuuuccaaaguccuaggcaugaugccaguagaucauuccagauuucauuugaaaacucccaauuuuaucaccgugagugucuaagagaaaccauuacuuagaagcuugcagaaaguacugacccaaggaaaaaggauuccaccucaaaauucuuacccuauuuaauggaagucauuuuuaaguucaaucuuuuuuauuauguuagaaaucuccauuuccuaauaccagaaacguguguguguguguguguguguguguguguguauguguguguguguguuccuuuaauagccaggguuugcuuugucuuuccucaaauucaaguucaccugcuguaacuuagcuuuccaacccaacaucuuuuucaucaggagcugacaaggcaaaaaagccccuuccucucagaacaauggcaugccaccaugcuuuuguaguaacaaacacugaaaaguacucaacuucuccuuuccuuucuccucaaggaaauaaccaucgacugacuaauaccgccccacuccaaaggcacacacaucaugucaugcauuugagcuaaagaccguaauucaacugaaagauuaggagggaauauuggaaaaggauggauuagacauggaaucuacaaccuaucaagaagggaaaagugagaucauacucucuuuuugaaccaaaauacaaaaacaaaaacaugugcaguauaucauaguugagaacuuggucucugguaucaucgcccaaauucaaauggcagacuagaccuagagcugcacagccuuggaaagucuacaagccucaguccucucaucugucaaaugggaguauuauagcuagguuaaauaaugcaugaaaagugcuucacauauccuuuaccuggaauacaauaaacaguagauaaauacugcugcuacuauuaagaaaguagggcugagagccauaaaaaguuacaaagauguggagugacaugucagaaucuacaacggagauuucucccacuagacaauguaggaugcacgcauugaggcguucaauccuucaagaggaaaaccuuuuacuuguuguguuugccccgcaagguagaucagggacagcuauggcacgaugcucaaaagaagccacacguauaccucaaggcuuuguccagauggaguuaacacgagccuuggagagguggauuaaaagaacagaaauguguucaucugugaaauuaaaaguaguacagcaugacauacagcauuauguguugggguuggucaaaagcaauaauuaggcugaguaugacucugaacacacucaucaucccacaaaagcaauucuauugaaugcagggagcugagugucacgggaggggacaacaggaaaaaguccagguuguaggaggaaacaugcuagaugagcugagggcugguugagccccacccuguggaaggccccaugacaguguaucagauuuucuauugcugccacagcaaauuaucauccccuuaaaaaaacguaucuagucacgacggcacaguugcuguggguuggaagucccaggcaaagaguggcucagguggguuuccuguuucaggucucacaaggccacucacaaggugucagccagccugggcucuucuuuggaggcuccaggaaagaaucugcugccaaaccuauucagguuauuggcagaauucagcuccaugcaguugcagaacugagguccccguuuuccaugcuauuguagguggaaggucccuauuuccuucuggcugucagaaagagcuaguucuuagcuucugagggccgcccauauuucuagccaugugcccccuccaucuucaaagccaguggcaguacgugaaauccuucccugcuugcaaucucucugccuacccucugccacaucucuccgauucucuuguccaccuuccccuucugcuuugaagggcuccugugagaacucugauccaugcuaaucacccaggauaaccuuccuauucuaaagucagcugauuaguuaccuuaauuacaucugcaaggucccuuuugucauguuacguaacaccaccauaggaguaaugccaacagaggagaugucgagggccaaaguucugccuaccaccagccccaaaaguggcuccccugacauaggggcuggaacugcuggaaccucuuuucgagugggaacccccaaguuuaugcucuucagacaagcaggaccacaaggcauccagagggaugaggaggcagcaggcaugaagcagagcugucaugggcaccuaccaaucaggcagcagagcugucuuggggucuggugccuuucaggaaacgggagguucucaaaagcagaaaugccgcaagagacagaccucuggcucacucacaagaaaauggauuuuucagucuagccacccagaaaagauacaaguucugagaucuguuaggugugagugcucuaugcaacaucaggaagacgcucuggaaacuucuaaaagggagacaagaaguucuuuggugagacagcaacaggggucccaaacagugacaacaaauaaauaauagcuaguggugccacugucuguggaccaaccuaccaccugagauccaggucuugagcaagucugcauuucuaaauguccugacaaaccacggaggcagguguuaccugucucauucugagcaacuuaagguucacagaggcugaguaaggcaagaugcuagcagcugcacggauggaguugaacucucucugacggcacaggcugccuucuuuccucuccaccagcccuucaggccuccaucgucccacccuuccucccucugccuuugacuuccucuagaauguccuuggaccucacaucuaagaaauaaugauuuaauuacugguguuuuuuucaaugacauaauuaaauauccacagcaagguaaaucaaccugaaccuguuggaaggaugcuuacaagccacucugggauauuuuauuuuggagcuucuccuauacauauuuuggcuuuuaugcaucuaaaauuagguuuccaauuuagccccuggaggcaagaggugaaaaugguuauaaauagcaucuagguggcacauucuuuuuggcuuuucugaaggggcuaagugaggggacaaagcaauugcuuuauugaacaaugcaagcgauuauccuccggcuuauuacgaucggggguuaucugaccacaguguggcguggacagacaccccugccuuaucaagggccaucccugaaaaucuguaacagacagcucaucagaggaagagcuuuccagccgaaaggcucccagccgacucugcauucacugaauuugccagcccuccccugcaagaagaagagagcguuuccucacuccuuucaucucaguuagcacucaaaagcaagaugcaccugcgcuguaauaaaugcagggauacagcuaagggggggaagagaaaaauaacaaaugcagcuaggggcuuaaaaaaugguguuugaagcuaaugacagcguuccugccuuuauugcuucaggcagaaacagggaguuaaaaaucuaaguggcuugagaaaauauaacauuuagcaaacucauuugcaggccuccaguuggauuauccuaauuuauuucauuguuaugggguuuucucuuuuggguacuuuuuugaucuauuuuuaauggaagacuaaugugcauuccuuuuucccccucuuuuuuuuuuuuccacagggauuuauugagcaguaaggcuuuuuuuuaaaaaaagaaacuuucuuuuuuaacuuacuccuuuacggaggcagagacaagacugagggggaacaaagucccucuucacaauccauuuaaugccugcgugcgauaccaacuccuaaagcuuuauuucaucucaaucuuccaggaagggaaacuauccuacugacucugagaaggucaucgugugauguccucuuguccuugccacggccauucuuacaccgugacgcccucuuguccuugcuaccgcaguucuuacgccagaaucuugucuugcacugagcucccccgggggcucacugccaauucuguggaccacugcauccauauggcccgcaugacucucaacgcucugaaaaacagacgcaccacacaguuuuccaggccugcaacaugucugcagaguggagacaugccaucacugcaucucuccugugcccuaggaugaagacagaaagaaacucugucuuccagggugaacucugauguuucuucauuguguaaauaagcggaaagacugguuuggucauuuugugugcaucuagaaacuucuugacuauuucuuugaaacagaaagaggccaggcacgguggcucacaccuuuaauccuagcacucugggaggccgacgugagcagaucaacucaggucaggaguucaagaccagccuggccaacauggugaaaccccgucucuacuaaaaauacaaaaaauuagcugggcaugguggcgcaucccuguaaucccagcuacuugggagacugagacaggagaaucacuggagccgggaguuggaggcugcagugagccgagauugcacugcuguacuccauccugggcgacagagcaagacucagucucgaaaacaaaaacaaaagaaacaacaaacacagaaagagaaaauaggcagaggugucucggcauucuuguagggggaauuaaaguaaaauuaacuggaggaauuuccugaacaaccaccuuauuuaagaaaguccaguagaucgugguauguuucuagagcacagcuucauugcgaagugcuaugcagaucagcggcucuuuuggguugcccggcaagccugugaggaaggcaggacaggugauuauuagccugaagagacggaugagaaaaugacuacguggugagaugaacugacauguucaaggucacaagggcaguuaaaggaagagccaggacuggcuccuuauccagugacuacgagaugaaguucccuccaugcucaacccauacgaacuaaagacagcuucugucuaccaagaacauaauacacauaccagaugagcccuaaauaaaaacaauuugcaggaaccuggaaagaaaugaaugaagcaagacaaugcaggggagaaaggggggcauacaaggaaagucaaagaaaaaaagaugccaacuuaaaaaaaaauccuuagaaauaaaaccaguagucagaucaagcagcgaacauaagccaacaaaccaaaagagagaaaaaaccaaaagacuaaaaggccagcauauuuuggcagaaguggccggguauauaaacaguaacagaagagauuuacaaaaauuggucaaaacaaaacaaaccccaaaacuuuuuuaguuacaguacagacuuucaaaccugauuuugaucuuuuugauacagagacuuuagaugcauuaaaacuaaggguggauuucacaauuauaaagacaaguagccuucuuauuguaaaguuugagauuauacauuuaagaagaucaaucaaaucaaauugcucaacucaaaucgugcuugauauuccauggaaacugaaagaagaacuggugccacuguuauuugguuuucauuuguucuacauauacaggcaaagcuuuuucuuucuuuuucuuuuucuuuuuuugacacagggugucacucugucacccaggguggacuccagaggugcggucucggcucacuguagccuugauaucccaggcuccagcaauccccuuaccucagccucccaaguaccugcgacuacagguguacgccaccaugcccagcuaauguucuauauuuuuuguagagaugggguuucaccauguugcucaggcuggucuugaacuccugaucucaagugaucucccugccucggccucugaaagugcugggauuacaggugugagccacugugccuggccuuuaggaaaaguuuuucaauuagaaucucccuucuguguucuggacccaggugaauuaccagggaagcagcuaugugggaaugucaaggaaccucuccaauuucacuuacagggccaugcucacuuacuuagaugggcuaaggaucagugucauaagcagcagugcaguccuaggaggucucaaguuggcuuuugcaggauauugugacuugcauuccccacaugcucgaaucuccgcaaaagcaauuggaugggugacccgccauucauuccaaagaucccaguaugaucuuugggaaagagucacucaauucagagugcuuacauagauguguacgaaacucaagaccacagcuugauucgauacagcaagacaaaucaaauauaaauguuguuguaucuugaggaccaguuuuugucagagaagauguucagaguaucauauugugauauuugcccccaucaccuguuuauaauuugacuccauucaacugaugcaacaaacgugucuugagcaccuugaagauaagacagcuccuaucuucaaggaguucacagcaugguacauaaaacagacauauaauuccaauucaaugugguagaggcugaaagauguagaugcugauaaaguaggggagaguuacaauuaugagagucaacuuuuaucuggaaagggaggguagaagagauuauccagaaggaugggauguguugugcugagucuugaaagacaaaaaucaaucaacaacaaucuuaucauaggcucagacaauaccacagcaaaaaacccccaaacaaacaaacaaacaaaacccaggaggaauucucagaaaucaauacguccuugauuuuguguuuuuguuuauuuguuuuucuucaaacguccuuuccuugaugagcuucuaaaauaucuggugaaggaccugaaaaugaacucuucugacaacagaaaaccaggcaauggaggccuuggguagcaggaaugauggguuccuguggcugcugcuucaucucagggaccacauaccacacuuccagaagcugugcucuuucgggacaucggggagccauuuaguccaccaaacagugaugugcggugggaaagauuuccccuucaaauugugggauccagaaggaguugcaggaagcuuaauggucuuggcagggcuaccuuuuacugcuggucccaucccugcaaucgcacacccugcuacuuuuccaguguccuacacucuucuggauuuuuucagcugcguccaggccauugacggggccacacagaguggagccaucgcccucuauuuuguuuguuucccaggacugaucaauggugaugugucagaaacugcaagagcaaggcugcucugauaaagcucgauaaccccauggcuuggaagaucugauaacucagcugcucugcaaguuuaugugccuggguccucccuguuucucccucuaggaguucuccaggucuggauggguuaucuggccugggggaguggcgaugcagucggaggagaugaacaguuagugaauaagaguguaaucuugaaugccaaaggguuuggaucucggguugcuuuuuacucguuuagcguaccucauucuccuuauccaggaaaugggcacaauaacgccugccucccgggaucuuuuuuaagauuaaacagaaaaaggaagagguuauuuguaaagugcaaaaugaaauguacaucauauagaaagcacucaaaugacaacuauuauuuaagaacccaccauguguugccaccuugauucgcugucuagcuaaaacuuuauagcaauuuaaaauaguugccgucauugcccuuauuuaacaaaacaggaagcagaagcaggagagauaagcaaaaauaaacgcagaaaggcaggcuuucauucaaaguugaucugauacaaauccaagacugcugcauuauuuacuugcaaaugaauaucuuauuuccuugagagagaggaggggaugggcagucagcaaagaagcaaagaacaucucuuucuaaagagcugucuuugaccuaggaccugagccacgggauuuggaauucaucccuuccgggaaaccagagagaagugcaugaacggauuucucaauuucuugcucauguuugccugcacaaugaugucucaaaauauuucuccccuaugucuugcgaugaccaucaaguucaguuaguuaaguucaagguccucauuagugcucauuccauuccauuuucucuucaugccacgugugaaaaguaugucucaaacuuucugagaugaaguaccuuuaaaauguaacgcucuccuugauugucugaaauaauguauucugguggguuuuuauuaauuccuugcuuuacccccaucccacugcccagagagcuacgggaaucaauuuuucuucugucuucuucuuaugauuauuuggggcaacagacuuaucuucaaacugcugucauacauuuuuacaguguguccucaaaacugcucccgagagugcaaaagagaguaucaaauaugcaagggguaggcugcgcuagagguucuugacuuuucaaucagcuugaugacuuuuaaccccuuacaaaugaagaaaaauucuucaagauggcuuggcagcacgaggaacaacuagaauuauuuaagaagccuacuacuuuaaagggaauugacuauaccaaacucuuuaacuaugucaagaacacacaaagacgcacccacucugcuucuccauaccaaucacauccaagcuacuagaaaaggagggcgcuuccguguuagaaucacagucauacguaauuugaacuugggcauacuaaagaguaacuaccuaucagcggcuagaccaggcgagguagagagugggaaagaaaugcucgccaauacuuccacccacuuuauuucccaaugacccacauucaucuacauuuuccuacggaauacagcacaauguuuacaguaaaaaauaaaaccaaagaacuuaaucagcgccguaauuaaauuaaggccuaaauaagugggcaaaaagaaccaccaugauuacaaaaaaagaaaaaauaguaguaaaagcacaauccuugacuuacaugaaguacuucuuuuauuugauuaugauaccuuuuuuaaaaauauaauuucauuguaaggcgauuaacugccuuuucaaaccugggaaaggaaaccugagaauuucuucuuuccugugaguaggggggaugcaaauacaauguacugcaggaauaacaaaugcucuauuuucugagcacucuccuaugauuuaugaaagguguaccucacugugggaagauaaugccauuugaaaugguccauuucauaacucuauccccccguccccagcuucauacaggacuacuaugaacuccugaauccaauaauguuuucacccucuacugacaaaaaaaaaaaaaggacuuuguucggaggaagguaaugaugcgcuuacgaggagcaacggcuaacgcucugucuccagggcuuucuuuggcaauggccacggagcuuccaaggcggggaaacuuggauaaacaaaaugaagaaauaaucaacaugcgcgacaucccuaauguccuuuuacugcuaguggcauuaauuauagcacgggcccaauccuccaagcgaccgcagaaccaaauguuuugccugaacacgcucuccacuacaugauagauuuauccuuugcaacugggauauuuccuauucauucaugcaccaguucaguauaucugcuuguuaaucuaacugcaagaacgcuuucuagaagaggauucuuugcaagaugugaggcaaucagggaccaaucauaaacuucagugaaauucauggcugugagucuuucuggucauaacaagggaaaagugauauauacaucccaacaccaugcagguuccagaagacccuuaugaaauaugagugggauggggugggggggcagaagaaaauuccuugggauccaagcaaauggacagcauagacaugaagagugacugaaaauacaugaucgauacaacuuauuagaaugaagcuguacauuacaccgggaucaaccucuucucuugaaagacucuaaggaccaggauaagaggacaauaagauaacaaacagggacuugacgucaugaauacugaaagggaaaaaaaaaguaaccccgcuggguagauaugcuuuguggucauucaaaaggaaaaaaaaaaaaaaaguuaaccuaagaaaagaaagaaagacauaugugcacaugccuguuuagggauauuuuaacuucuguggagauuagagcauuugagaaaaccuauauacccccacucagguacuaauggauuaagaagcagauggaacacgggaugucgauggaaaugauguaaaaaugugacuucgaaagaacuccuaacaccggauacuccuccugauucuggaauuugcauauuuugacuuguaucuaaaaagcaauuucaaggucagcuuugguagagaaacacugagcuaagaugggaaguaaccccauuaaaaaucuaccacuguuuugcauauuuauuuuucuucuucuauagcgagcaaugacgacucauaaaucaaaaaaucaggguaaacaaauaccacagagguuauuuaauacaaaauauauacuccguauucuauuucuacacacaaacauuucuguuacucgaauuuauaauguguguaauacagcauucaugcuuuaagaaucugcauacauuugccuaaaguagaaaaaauauauuauugucccaagucucggaagacccuggcccaaauaaaaugaugaccaccucaaaugcauuuuuguauaaugggaugaaaguaacguuuauuuuuagaagcuucaggccugcaguuuuuguaugcauauaaaaauagauuuaaaauuuccaguuauguaguuuauggucuaaccaugaauauucuaucugggugggggcagucgaauuggguaaacuugggccuucaacuugagcaaaagcauguacaaaugucaaaaacaacguccacacgucuaugccaaaaagaucgccagaccuaugucaccuugaugaaggaugacggaagggaggcaggcuaaaaggggaaguggaauuuggagaacugaaguugucauuaaaaggggcuggguuacccagaaauggggauuuuucccaguagacuuggguaccuacaaagcccaaacacuuucauguuucagggaacuuccuuuugauaauuuuuaauaauucgauauuugaucauugaauaauuugaccaugugauaaaauggcauucuaagccauuucaguagccauauacaaaaaucagcccucuuuauuugccacuuuugccaaaaauaaaucuccugcuuuauucaucagacuagacuugaaacaaacuuuuggccauuucucaaaaaauuaaguccacccuuaaaggauacauauuugccacuggugagcuaaugccaaagaaagaaccaagaaucaaaaguaaugcacaaaaagaaaauucuaaaaaguaucccagcaauuguagagucauugggcaucaucuguaagggacacacauuacugaggauggcaaacacaccauccagguagcagccucucuagaccagguacugccuuucauccaucuuuaaagcccaacacccaauucugugucuagcagacagaagaugcuccaugaauauacguugaugauuauauaaacuguucugggaggcaucuguaauagcaacauggacgugacuucgagcccaagucaaugggcagaaaauccagcggggccacuguccugucuaaagcccuccuguggcuacccacuccauuuagaaauuccauuucuuuuucaaaccuugggcugaaaggccacaaaaccuuuccauccacaucagauuucaaucuaaaccaugucauuacacuucauauucuaccuuuguauuuuucaguugugcuaagccagcauucccccugacugggccucccacucuccaguacccacguggcuggcccuggcagcucagccuucaguuuccuuaaagacuuuucugacuuuccugaaauuagacugcucuccucgccagccccucucuaucacuuuaucugguauaaugggccauaccucacuucucuccuguaucuugcucacucauucauucacugacuauauggcugcacuagaacaaagacacuuagucugccuucauugcuaucuccccauuaguuaguacacaguaaaugcauaauaaaucccuguggaauaaaugaacaaaugaaugaauaaacuaaaaugcccagagacgacucuuaauauuugccguauuuaacaaaaacccacuguugccaguugcuaauaccgacgggacaggucaacucaaacaggcccaccgagacagcagcaggagauagaaaacucaugaaacagagcccuugccuuugaggguuucacugucucacacaaagguccucaagcucucugugucugggccucugcacuugauaaauaucaccaucccaggaaacacugucagugguauacacggguuccaacuuggaggccaagcucugaaggaugguccacacccuaguuggaaaagguagggucugggcaacacugaucuacuuccugucuuuccccaccucaccucuaguucacguccagguguguggaaguccugccuucauguauuucacacuccucucaaaacagccauccugugucuuucccagaggccaggaagguccugacauucagcgccagaugugaggagaugaaaaauaaaaucacagggucugaguggugaucuuagcccugcugcuggcugcccagacuugggaaagugaccuaucuccccauaggacggugaggacagcaauaccuuaggcaaggacuuugagaacuaagucagaugaggaauaagaaaacacugaacacagaccuuggcacauuaaaaaguucuauagccacacaugguggcacacaccuguaaucccaacacuuugggagagagaagcagguagauugcuugaccucaggaguuccagaccagccuggccaacauaguaaaaacagaccucuauuuaaaaagaaacaaaaguuagccaggcaugguggcaugugccuguagucccagcuacucaggaggcugaggcaggagaaucgcuucaacccaggaggcggagguugcaguaagccgaggucaugccacuacacuccagccugggagacagagugagaccuugucucauaaauaaauaaauaaauaaauaaauaaauaaauaaauaaagcucuauagcugggcacgguggcagaugccuguaaucgcagcacuuugggaagccaagcaaggcagaucacuugaacucaggaguuugagaccagccugggcaacacagugaaaccccaucgcuauuaaaaaaaaaaaaaaaaaaaaaaaaaaguuaauacaaauacaaaguucucuaaagguauguuuagcaccuccauaauuuacauaaccauagaaaacacauacucaaagaaaaaggaugucuuuguuaaugcauaaucugacaccuguaucaaauuagcauaauuaaagaugcagguguauuggagaaucaggguaaacaguugcuuguauuauuugggucacuuucagguaaauuugaaauacuauuaaaaguugaaaguuuucucuucugcucugcuccccucuccaaaaauccauauguauguuccucuugauggaaauuugauauaucaacauuuuuuuaaaucuaggaauuggaaugauugcugagaaggaauuacugagaagcuauuuugaaguuccaguaguuuaaaccuauauuuccacuuaauuuuccaggaccagguuuaguacauauuguaccaaacaguauaugaccguauucccaaauccaaauggauuacuaauggauuaauaugcuuuaaaaagcaucuuuacaagauuuaaccaugaaaaacuccuugcuucucuuggcuuccauuuagcaggugacacccuguaauacuucaaguuaaagaguuacagaagccuggaauuuuaugugagccugacagcgauggauuaaaaccauacucuagacauacuucaaacgguagcacugacuuuuuuuuuacuuaacucauaguugauccacuggagccauuuucuggaaacugugauugcugagcuguugucagaaaucucuccuuaccuaggguacguugcuuuccaaaccaagaggaaaaaguacaaucaagacauguuccaaaacccauccagccuguggaccuugcccaggguguaccagccagaaauuugagacguccuggaauucugaaauucuuaccagaaagcagcuuaacuuuaccacuggcaugaguuuuaauagguugccucagcugcuugcuagcaagcacuuauguaccuauuuauucacugaguagcuaagccuacagagaaaagagcucuagagaguaagaagucuuacccauccuggggagaucaugcaaagcuuggguuaguuuuggggucuucaaaagguucagagucauuccagauaaguccagggaaaacucgcuugggauggaccacuugggacgcagccaucuuaagcucuguccaaggguugaaggcccaggucaaagguacagagggcauacacagcaaauaccaaaagucaaccauuaaacucacugccuuugccuauugcaucuucucaucuugccuucucuauuucuguccauggaccaccauucuccgguucccagaccaaaacucaucauuaccuccuucuuuccuuucaaucacaaccaauuacuuacccucccaacuuauggccagucuccacucuuucacuccuacucuccaaacccacuguguuggcagaacuucagcauccagcaacuaaaaucccaucacacccuuccaacuuuuuuuuuggaaccuagcugcugcugcugcugcuuauuuuauuuuauuuuauuuugagacagggucucacucugucacccaggccgaagugcaguggugugaugugagcucacugcagccucuaccaccugagcugaagugauccucccacuucagccucccaaguagcugggguacaggcaggugccaucacgcccagcuaauuuuuuuuuuuauacuuuaaguucuaggguacaugugcacaaugugcagcuuuguuacauaaguauacaugugccaugucggugugcugcacccauuaacucgucauuuacauuagauauaucuccuaaugcuauccuucuccccuccccccagcccacgacaggccccggugugugauguuccccuuccuguguccaaguguucucauuguucaauucccaccuauuagugagaacaugcaguguuugguuuuuuuguccuugugauaguuugcugagaaugaugguuuccagcuucauccaugucccuacaagagacaugaacucauccuuuuuuuauggcuguguaguauuccaugguguauaugugccacauuuucuuaauccagucuaucauugaugaacaucugaguugguuccaagucuuugcuauugugaauagugccgcaauaaacauacaugugcaugugucuuuauagcagcaugauauauaauccuuuggguauauacccaguaaugggauggcugggucaaaugguauuucuaguucuagauccuugaggaaucgccacaaugucuuccacaaugguugaacugguuuacagucccaccaacaguguaaaaguguuccuauuucucuacauccucuccaggaccuguuuuuuccugacuuuuuaaugaucaccauucuaacuggugugagaugguaucucauugugguuuugauuugcaugucucugagggccagugaugaugagcauuuuuucaugugucuguuggcugcauaaaugucuucuuuugaaaagugucuaauguuuguauucuuuguagagaugggguuucaccauguugcucaggcuggucucaaacuccugggcucaagugaugcacccgccuuggccucccaaagugcugcgauuauagaugcgagccaccaugcccagucugcuucuucucuuuuaacaucugcucucuauaggccugcauuuaaaucucucaggaacacauuuuuuaucaugucauuguccuuuuaaaucugcuguggccccacugucaaauaagaguuuaaaugcuggguucuggcacugaagauccugaagauccuccacaaagaccccacauuagcaaggccugcgugguggugggucauaggggaagaggguaggguaaaaacagaugcuagcuucuaaucauguucucuguaaguuucuugguuugguaaguuguguuucuuuuuuuuuuuuuuuuuuuuuuugauacaggguuucgcacuguugcccaggcugcagugcaguggcgugaucacaguucacugcagccuugaccuccuggacucaagugauccuccugcuuuagccuuccaaguagcuaggacuacagguaugcaccaccacaccuggcuaaguuucuucuuuuuuuuuuuuuugagacggagacuugcucugucgcccaggcuagagugcaguggugcgaucucggcucacugcaagauccgccuccuggguucacgccauucuccugccucagccucccgaguagcugggauuacagggaugugccaccaugucaggcuaauuucuuuuucuauuuuuaguagagacgggguuucaccacguuagccaggauggucuccaucuccugaccuugugaucugcccaccuaggccuccgaaagugcugggauuaccagcaugagccaccgugcccggccccggcuaaguuucuuuaaauuuuuuugagagacggugucucuauguguugccucggcuagccccaaacuccuggccucaaguaauucucccaccuuggccucccaaagcacugggauuacaggugcgagccacuucacccagcuauaguuauguuuugauaugguuuagcuguguccccacccaaaucucauguugaauugcaacuuguaacucccacaauucccaaaugucgugggaggaagcuggugggagguaauugaauuacgggugcaggauuuucccaugcuguucucgugauagugaauaagucucacgagaucagauaguuuuaaaaaacaggaguuucccuacacaagcucuccucucuugucugcccccguaauugugaggccuccccagccacauggaacuguaaguccaauaaacuucuuucuuuuguaaauugcccagucucggguaugucuuuaucagcagcaugaaaaugggcuaauucaugucuuaaaggagcaguucacacuggcuccuccgacguauccuaaccuaaccuauuccaccaccuuggucuucagaacuguuaugucaacaucuugacuuuuuuuguuuguuuguuucuugagacggagucucccucuguugcccaggccagaguacaguggcacaaucuuggcucaacauaaccucagccuccuggguucgagcaguucuccugccucagccuccugaguagcugggacuacaugcaugugacaccaugcucagcuaauuuuuguauuuuuaguagacacuggguuuugccaaguuggucaggcuggucucgaacuccugaccuuaggugauccacccgccuuggccugccaaagugcugggauuacaggcgugagccaccacgccaggccaacaucuugccuuuuaaaaaaguguucaaagagucuccuaugggagauggugcucagggguagcaacugaugcuuucgauuugcaagccuugcucccccaguccagcccucugucucauagaaacucuuaacucagagucugggugagucuaauucccaagguauggacaggacguggucuauugauucaacacugauguuucaaccagagggcaggcagcaagguucaaccuggacuauguucuccuccuaagugacuuuauggaacuuaaaucugucuuccagacaagggugcugggccagaugaccuccaaaugccuccuugcuccucaccuugucuguuuguucuacaggaggggcuugggaccagccugagucaucucucuucugggaaggucccucccuaccacuucccaggcccugagcaaugggccagcucucugugauguggauauagucuguuuuaacuccaccagguccucccauggggggaauucaccccagaggccgcagcugcaggcuucucuuucagggaggucagcaauuccagcgcuuggucggcaccucuugaaaacggugccaggaacauuucgaggacagcauuuuccuuggcaggugugccugccggcagggcccacuucaagguuugcaagagcaggaaaaagacaucugggaucuaucuguggcugucggugugcacauuuugaggggcaaagugaaaaagaacucucugacgcagcauguucuuauccaggcauaggcugucuauacaaagaaaaacaccaggguggaaaaacggccugaggggcaccuggaauugucucaaggacugcguuaggucacugccuggucaguacaagaagcacuucucuguuugcggacaggaccagauaccuucaucccuucugaagaauuggauacaauacuuuaugaggagcuuagaaaaagagcuaccccuccauguucgaaggacugggagucaagccccucagacguaccagcaauucaagugguguauuaguuuguucucaugcugcuaauaaagacauaccugagacugaguaauuuauaaaggaaagagguuuaacggacucacaguuccacauggcugggaaagucucacaaucacggcagaaggccaauguggagcaaacacaugucuuaaauggcagcaggcaagagaguuugugcaggggaacugcccuuuauaaaaccaucagaucucaugggacuuauucacuaucauaacaacagcaugggaaagacccacccccaugauccaauuaccucccacgauucaaaucccucccauguggcguggggauuaugggagcuaaaguucaagaugagacuuggguggagacacagcuaaaccauaucaaguggguacugcuaaccuggaauugccuucaaacuucugcccaagugucuuguccucugugaacaguuggaaaauacuaaacacuugucccucuguauuccaggcagaucuguagaugacuccaugacugcauauucugcacuauauuuuaccuaauuacuuuuauaugugccuccucuauuagacuauagguuucucaaggucaaggaucauguacucauugccuuuguauccucaccuuucuccuucaagcacaugcccagcaauccuugcugagcugaacuggcccagcccagcaaaaucugcugacuaugcagaguuguauauuucauuuccagcucaaacuuuuaugugcugaggacuucccauucucccuccaucauucuuccguccuguucauuuccuuagcagggcagguacccucucagccuuucagucuccaaagagaagaagaccuucuuugacuaccguucagauugggaguuucucuuaccauuccuagagcaugcugaccugcguucccauuaucccuccccacacagcaucuccagggucuugucaguuuuccacuauuccugagugugguaacugucuacggaugugcguauagcucuguuuucguaagcuccuuaaggacaaugauaggaccuuuuauuuugcuuucacuaaaaucuauuaaauucuuauuuaccauaugcucaucacuaaguaaaacauuucaugugcauuucucaugugauacucacaucagguguaggagauagauauugcuauccccaucuuauggaugaggaaacugaggcugcuagugacauguccagguucauaaggguacuaguuagugauaggaccugggaacgaacccagaacuaauugaccacaaagcccauguuacauuuaacugucauucuccuugucuuugucaccucagugccuugcauagcgacugaccuaugaacagcggguacucagcaaauaugugugauggaagcaucacaggugccguggaaccuugccaggacuuuucagugaguucuucugcucaacuuuacucacucauuuuuucauucugcucuuuguccuugauacauuuacucaauaggauuaacugcaauuaacaggaaacccaaauaauggugccuucaaacugagugaaguuuguuuaaaaaaaaaaaaaaaaguccuugccuggugcagcagccuaugccugugaucccagcacuuugggaggcugaggcuggcggaucacuugaggcuaggaguucaagaccagccugggcaacauggugaaaccccgucucuacagaaaaaaaaaaaaaaaaaaaaauuagcuagcugggugugguggugcacaccuguagucccagcuacucaggaggcuaaggugugaggaucgccugagcccaggagguugaggcugcagugagccaugaaugugccacugcacuccagucuggguguggaggagacccugucugaaaaaaaaaauaaaaaaagaaagagagaaaggaaggaaggaaggaaggaaggaaggaaggaaggaaggaaggaagaaagguccugaaauaauccaccccaggcucugggguaugguguaauuuucaggacccaaguuccucccauuuccauucacaauauuguuucucugccagaccccacaucccagacggcaggaagggaaggaggagugugaagaaggcaagaagcuaugcuuccccuaaggacacgcccaagaaguccaugugggacuucccugccaccccauucgcuagaacugggucacauggucacacggucacagagagcuagcugcaagggcaguuagcacagggaauuuuuauccugaacuaccguguaccucuuagaaaauucugcuucuaagaaagaaggaugggcuagauacuggguaaaaaggcaaggguccgugcacaaucgcauuuccugcaccugaaacccagucuuucuuggauuuauggcauugccccaggucagauucuggucaccuuggacugacccucugcaaccucaucuuuccauuuucuuuucaaagcugccuuccuaaacgcucuuccugaaaucuuuccugagcuggcugcagcaugcaguccacgcgggucuuuagucgccaucccaaccccagaaauagaagcagggccuggcaaucuuaucccgcccuccuuguccaccaggcucaauaaauauuuggggaggagaaugacugaagguauggccaucucacucggaucccagaucccacucggauacggugccaguauuuuuuuuuccucuccuuagcauuggaaauagauuuuuaagcaguguuauauagcaguuccucuucaaaauccuucuuuccuauucuuuaguaaugucuuuauaaaucacuguuauaaaaauaaggcaagcaggagaaaaaauaugcacuauauagaaacugaaaauucaaguauuugcuuuuuauuggacacuugaggcucuuaaaaaagagaacugcuaggaaacuuaaauacaaaaaaaaaaaucacuguaugauaacauaaaagcccaacagaacugaagaguuuaugaaaauaauucgaauauuuacacuucaauuuacggucugaaaaucacccccaaaccguguucuuauucuuaaauggauuucuugagagagcguuaaauacauuuugauuauuuugacaugaugucuacuuggauguucugugcaaugauuugaaggcaaaaaggaaauucuuuaaaaaucuaauguaacuauaugugaacguauauuauauauacagaaauguacauuuauaugcaugcauacauguaaaguuuaacaagcaucucaacuuaaaggggcacuucugguuguuguuauuguuaggggaaaauacuguaaauuuaacucgaaggaagccuacagucaaaacacauuauaauucucuugacagagaagcuuggguucaaguucauaucuuuuuaucuucuaaaacugaggcuugcacgaucacugaaacuguguuuuauacacaucacagaaacacagcaaugcagguccauaaaaguguugaugaaagagagccaaauauaccaacugaucacauuuucuuuccuauuauuuuuuuuuccaguaagucaaagaaaccccuucucagaauuucuuucauuucaucuauuuagaaaguguauuuacaacuauuuuaacaggcccccaaagcaucaaauaucuguaacgaaaaaucaguauucacuucagaaggggaaaaaauauucacaacaagaaaaguggggccgggcgcgguggcucacgccuguaaucccagcacuuugggaggccgaggcgggcagaucacgaggucaggagaucgagaccauccuggcuaacacggugaaaccccgucucuacuaaaaauacaaaaaauuagccgggcgugguagcgggcgccuguagucccagcuacucgggaggcugaggcaggagaauggcgugaacccgggaggcggagcuugcagugagccgagaucgcgccacugcacuccagccugggcgacagagcgagacuccgucucaaaaaaaaaaaaaaaaagaaaagugguagggaaaagcauaguuccaaacacuuuauuauuaaacucauggguuuaaugaaaaccaaacauggagaauacauuauguaaauacauacggacaaaaggcuuuugaaguccaggcgaccacaguauccaggaucugagaguaugauauuuuuuuuguuuguuuaugcauucuagcaagacuucauauaacacgcacacacacauacacacacacacaaaaacccugagauuguuuauucaguuuuaagcacaaaucucugcaaacuuaagcaaaaggaauggcuaggaauauguaagugucuggguaaaagaauaauucauugaacuucaguuagaaacaaaaauaaacaguaagagaaaucccuacuuaaucugccuuccaaagaaagacauuuauucaaggauacacaggcaaauucccccacgcuggagcaaugaaacgaaacuaaaaaucagaaacaaaagauacaagcccaggcaccaaguaagcucaauaaauaagugcuugauuaagucugauaauuaugccuuaauuaccuuccuucucuccaauuuagauuuaaaggaaaauacaacugcaaauaguuaugugaacuacauaggguuguagugcugguaccuacgcaacuucagaaaucaaaugacuaacauccauuuaucaaauaucuauugagugccuaccugcagucuggcucugggcuccgugcugaggcaaggggaugaaaagagaacuuuuacccacagagaauuuacaaacaaacauguagacagacacaugguaauaacagacauaagaacaguuauugauggucugcuccaucaauacuuacaccaaaacucaaggaaauuaaaugacuugccuaaggucaccaggauaaacaguggaccaagagcaggcucugcuggaggccggugucauguucuuucccugaagcucggacuaaauggauaaguaacaaccagccaggcauugaaaauccugcucacgaguaccacauaccucauucucuccucaaaacaagguccauuuuauacaggagaaaacucaggcuggagaaaccaucacagugacuuucucgcagucaagaauggugccugggcagggcaugguggcucaugccuauaauuccagcaauuugggaggccaaggcggguggauggcuugagcucaagaguuuaaaaccagccugggaaacaugccaaaaccccaucucuacagaaaauacaaaauuaggcaggugucauugcuggugccugugcucccagcuacuuaggaagcugaggugggaggaucacuugagcccaggaaguagaggcugcaguaagccuucaucgcaccaauguacuccagccugggugacagagugagaccccuucucaaaaaacgaaaacaaaaacaaaaaaacaaacuggcacucagcucucaauacucacacccauggucuuucuagaaauguagaaagacuuuucuccaucaagucuuucaaaagcaaacaacuuucuccacaacaccugaacaaaugauaaaggucauaccaguguaugcugcccaaagaucagcacuuguugaaugaaagaacugacaaaccacucccgcaucacagaccaacagcaaagaaguguacgucugcuuucugcaaaaugacugaaaacaaguuuuuaaauggcugcgacuucgccauccugcuccuccucaaagacaaggauggagaaaccauagacacaaacucagaauuucaguaaccaagagaaauuauagacaguuacauucaaauugcaugggccaggcuuuauuuucuuaggaacuuuuuuuuuuuuuuuuugagauagggucucacugucacccacgcugaaaugcaauggcacgagcauggcucacugcaaucuccaccuccugggcucaggauauccucccacuuuagccucccagguagcugaaaccacaagugggcaccaccaugccuggcuaagcuuguaaauuuuugagagguaagguuuugccauguuacccaggcuggucucaaacuccugggcucaaaugauccacccauuuuggguccauccacucccaaagugcuguauuuucuuaggguucuacaauuggcuguaaaccucuaccaagagcagcaguuucuccuuaccuguccugucugucuccagaauuguucauagacucuacaauuuacacuuagcucuccccacaucccuucccuucucccugcccucuugguucacagucuuucugcccaaucgcauucauggucugaaacagucccacauucuaccuucauucugaagggaggcaagggugggaucaaaugaaaaaccaagaaaugaccaaauccugguaggcuagaacuagggcuucagcgaggcucuuuaccucugagcacugcuuucuuauuggccaaagccucacccugcaagaacaaacagcaucuucacccuuagagagaaacaaaauaugaccaaagcucuggaagguggagacuucccuucucaaaucuuggcaaaagauacaugcaaaaaccugguucucauugaggaaaagaguucuguacaguuugacgaagcagaaauauauuuuaaaaugugcaucuccucccuguaauacuaccccuucuguuuuacagcaauagcucccuaguggaaagaagcagaaaacaacacacauaagcgaguuccugguuaagacgcugggaacuuaaagcaggacauguuugaaaugugagggcauuuuuuaacaccaaggaagguaauuauuccauggaacuucguggacauauuuugccugagagcuguccuuucaaacaauaacugagaaggguggaucucccuuuguugccauuuuagaacucuguguuuaucauccgggcaguugagggguuauuuuccucaaucccaguaugcugccacccaguggcagcaaugaucagccuuggucauguggcuucuaccaggcuuagccaaugagcacguuuucuuuuuguuuuuguuuuaagucaggguuuuacguucucaugcagucuggagugcaguggcaauaucauugcucacugcagccucgaccucccaggcucaaccaaucaucccaucucagccuccccaguaacugggacuacaggcacacaccaccaugccuggcuaacuuuuuuauuuuuuguagagacaggguuuugccauguugcccaggcuggucuugaacgccugagcucaacugauccucccgccuuggccccccaaagugcuggaauuacaagcaugaaccuccaggccuggccaaguauguuuauuugaaaagacaaacauugagagcacacugugugcuagagccuaauaaaggauauaugcauuuucacacauauguugacaccaacaaucacuaguagucuaaaagagaugucuauaagguauuacagaaauacuuaaacagaagacaucauauaggaagcucuacagaaugaccagauuauaaacuuauucaagguauuaaugguuacucucccacacagaagccaacuaauaaauguugaauggauaaucguggaguaaauuaacacuuucuaaacagucaaaaggacucugauauauguuuuuaccaauacuggcuuucuuauccuccuaacaacaguggaaggauuuuacagauaaggaaacugggcugaagagaaucuugaguaaauuacucaaguacaaccaaguagccugcagcgaagacaaguuuuaagugagauauuuuaacuccaaagcugggauucuuuccauucugccauuagucugacuuuuaaauaaauauuuguggauagacaaguuccauuuuugaugaugauaugauggcagcaagcuccauuuuucaaacaaaguuuaaaagcaaccccacccccuaaaaaagccuuccuaauccuaaaaucuuauaaaacuugucuaaccacauuauaaaguucuuuuccaagacgucuaugaauucacagcuucaagaccaagcuucagagaccucccagcuaccuuccccggucuacccagccuucuuucugcuucucuaaccagagccuugucuauggauuaauaguuccuagcagccgggcacagcggcucaugucuguaaucccagcacuuugggaggccaagguggguggaaucacgaaaucaggauaucaaaaccauccuuggcuaacacggugaaaccccgucucuacuaaaaaaaacaaaacaaaauaaaacaaaaaauuagccaggcgugguggcgggcaccuguacucccagcugcucgggaggcugaggcaggagaauggcaugaacccaggaggcggagguugcagugaaccgagaucgcgccacugcacuccagccugggcaacagagcaagacuccgucugaaaaaaaaaaaaaaaaaaaaaaacuaacuaaaaacaguuccuagcaaucaacccagaucaucacuugugaaacuugugaauccuuuugacauuuccaaggcagauaaaaacuacuuuuucuugaagaauaaaguucacacgacuaauuuuuuccaauaggaaaaagccauauauuauuugauucauagaagagugaaauauccccccacccgccaagagauuuguagaaaaagcugcuaacacacuaugaauggaaaauuuauauauauuauguauguagaauuuccaaagcucuuuucugaaaaaguugauauucugacucccaaucccaagaaagaacaaaacaaaauauaaacuagauauuaggaaagguaggcucaaaaaauagcaggcuggaccugggacuuauauagaagaaaaugacugcucuauuuuuagaaugaucugaacuagaaauaaugauguugauaaugaugauauucuggugaaauuaagccauggugggcaagguagaaggagaggaagaaaaagaaagauggccgggcacaguggcucaagccuguaaucccagugcuuugggaggccgaguuacgcagaucaccugagguugggaguuugagaccagccugaccaacauggagaaaccccgucucuacuaaaaauacaaaauuagccuggcaugguggcacaucccuguaaucccagcuacucgcaaggcugaggcaggagaaucacuugaacccaagaggcagagguugagguggaccaacauugcgccauugcacuccagccugggcaauaagagcaaaacucugucucaaaaaaaaaaaaaagaaaagagaaagaauuaugccuccugaauauggaauauuuuuaucuaaagauguuagauuucuaggcaaauaaaaauuuaguuuuaaguucuuauuuuuaguaugauuaauaagcccuuauugaaaauaggccacauuacuuagcaauggugcccaggacugggacccccaagcuccaguuccuuuaguuacuccugagcuuuaugguuugagugaaaccugugagccucagcuuccuucucuguaaaugggaaaguuggaauccuuucuuauaaaauccuuuccaaauuaaaaaacauucacugaggcugguggucguggcucacgccuguaaucccagcacuuugggaggccaaggugaggggaucaccuaaggucaggagcucgagagcagccugggcaacauggugaaacccugucucuacuaaaaauacaaaaauuagcuggguguuguugugcaugccuguaaucccagugacucaggaggcugaggcacgagaaucgcuugaacccgggagguagaaauugcagugagccaaggucacgccacugcacuccagccugagcgacagaaugagagacugucucaaaaaaaaaaaaaaaaucacugaaauauaugcagaauauauuccugaaaaaaagagucuuuguuugcuugggcaccucugaucauacucuggagacucuuaaugugauuuaggauggggccuaacuacacccauguaaccuuagguugcagaugaaccauucuuaaaggaccaacaauauugcuuaggguagggacacuguaccacaguuaucaguugacuuggaggcugagaucaaauaugugggcaaucacccaaucacaccuacgcaacgaagacccaauaaauacucugaacacagaggcucaggugaguuucucugucugacaauauuccaugcauacugccacacauagauaguagaaaaguauucuguccugaugucauggguagaggacaauagaagcuucacaucugguacuugucuuggacuuugccccauuugucucuuccccgaucuaauuuuaaccuguauccuuucccuguaauaaacuguaacuguaaauacaauagcuucugcuaagugccacaaguccuucuagcaaauaucagccaugaggauggguuugaggaccaccucaaacuugcagugggugucagaguaaggacaaucuugggcaucaugccuucuaacuugcaguuaccccuuacuccucacaguagcccaugagaaguuuagacacacacucugcuuacuuuaacaguuaguacucagaaggaguugccaggaacccauuccucucuuaccuccaugaccuguaggucauccagaauccauguaaccucccugagcuccaguuuccucaucagugaaaugagaaugugaguaagcugcucagucccaaugacaucuuuauuaugagacuugauuaagagaaugacugugaaaggucuuugaaaauggcaaucucuuuuucaauuauaggauauuaagagcuguuguuacuaugauuuugcagcucaaaugcuucaggauucuaucuacucuccuaauuuuacuguacuccccaugaccagugaguccaccuuuccaucagcaggugcugaaauuaugucagcuagaacuuucauuagcaaaugguuuuagucagugaaaaguaauggcaaaauaaaugcggcauuuugacguagcuguaucuauucuggcacagugcgguuucgaggcuaaugucuuuucaaacagcucuguuuugccugcagacuugaauacccucauuacaguguuugaaaaaaaaaguucccuuauguuuuuuuaaagagcgccauucuucaaaaagaugucaagaagcucuuuuuuucccccuugcuacaagguguaauguagagauaagcacaaaaucugguuggaaaugugaccuauauuggacuggcaaagcuuaauaucaagcaaacagccagugugggagcugguuuuguccuaccuugcugcugguauuugcagaaaaguaccacauauuauguguggacagugagagcaguuugaaagucaauuacaguuuuuaaaaauuggaaucauuugcucaucgagcucaucagaguuuugaacaagucccuggccuuccucacaacagccaaagccaggucuuuuggaaaacauuuuauuuucaugcucagcguaauaagaagagaaaagucguguuuugcagaugaaauggugcugauaauaaaaaguaggucacacuuucucucucugucuccaucacucuuuacuuucucugaaagacaaaggaguguuuccaagacaugaaucaagcaggucagguaccugaccuggauguucuuugcacucugaguaaaauuaggaacauuuucacucaaagcugacauuuaacaagggcagggaacuuggaaacaauaacugcuuucuacgugacugacaaggagggcuggguuggggaugcaggcagcaguuccuccagucauucggggucagcgaaaaucacagguccaaagaaccauagguggcugggaccuuaggacuugggacagcaagacagaaaacagucacaaggaggaaagcaucacaucugcacccaugggagacaauguuauugugcauuauuauuuacuucuccagcuauggggagauuacacaucccugccccagagugaccaggucacuguguuuggccagugaaaugucaggugucacguccuggaagaaacuuuaagaacuugucuuuucucuuuccccuggaguccuagagagaagcugugcuuuuacucuggauccuggcauggagaagaccaagagcaagcagagccagcucuugacggcccuacaguguagacaagaacucagucuuuguuuuugcaagcuauggcaugguggggucguuuguuacugcggcaaaccuagucuacgcugacugauacaaugacccucagugcuucccuuccaaaagcaugagaaggaggcaaaccguaaauaagcuuacguguuugguagucuauuauucuagaucauuuuuuagcucagaaguggucauuaauauaucuauaaucaacuguacagacuggucugcagacgcuuuggcacacacugugucuccaggauccccacauaagaaaauaaagccacuuagucaggugcaguggcucaugccuguaaucccagcacucugggaggccaaggcgaguggaucaugaggucacgaguucgagaccagcugggccaauaugguaaaaccccucucuccuaaaaauacaaaaauuagccaggugugguggugugugccuguaaucccagcuauucgggagcaugaggcaggagaaucgcuugaucccgggaggcggagguuguagugagcugagaucgcgccauugugcuccaucuggcagacagagcaagacucccucaaaaaaaaaaaaaacaaaacaaaaagauaaaagaaaaaaaagagaagaaagccacuuaaggggacugauugcuguuagaagguagugauggcauucuaagugaugaucuaccaauggugauccugugcuagaccauggagcaaaauacacaaagacaauucuagacucaacugccuggaugcaaauucuagaaucuaccacuugcccucugcuugauccugggugaguugucugacuucucugagccucugcuuagccaucuauaaaagugggcuaagagugggggggugucucugccagaaagaacuguuaagggaauuaaauaaaugaauacacauaagagaauagcacagagcccaugcauguaauaguuacucaaaguauguugguuauugcggucauuguuccguguguuguuuaguaggaucucaagugaguuauuaauuucaauuggaaaugaggaacaggaacagccccccuuggcagcggcugcuaugacugaacuuaacgaaguuacacacuaccugacaccacgacuguauuuccaccugaaaguucuuuuuucugcccuggguccaaucagaaagguacucuucuuaccacaaguaaccacaauaacaacuccucuguguucuuggaauagguagcucagaaaagacaagagaaagugcucauauuuggaacgacggaucaugugagaccccgcaaaggaaagagagaagccaauuuaaguucuguaauauagagcuuagacaaguaacuugacuccuccgagcauuaauucuggaauuucugaaauggguauagugagagaaaauuccuccagggccugagacuagaauaagauaauggaugcagugcuuucaggauggagcugauuucaacauuaacuguuauuaucauuaguaauaaaacuaagaauacaaauccugccaggaauacacaaaauaguaacaagcauuuugcagccugucucggaaagaagaaaaaguuuucuuaacagccagcuucucugugcagagaccucugaacacauucauuacagagacaaaagacguggguccugaaaccgagaacaaccaagugacaguccagcccugccagaaaauaaagggauaggacacgaccuagguaagaagccagccuggaaaggagagagguuucauggccacaaaucaacaaggacuccuuaggaaaaggaagagagaaacaggaaauguauagaagaugccucuuagaaguacaaauaucauguauccauuuauuuuuuucuuauguuuuauuuuuuaaaauuuugauagggcuuucuuucuuucuuuuaucuuugagacaaggucucacuuugucacccaggcuggugcaaucacagcucacugcagccucaaccuccugggcucaagugauccucccaccucagccuccuauccucccaccucagccuccugaguagcugggacuacaagcaugcaccaccacgccuggcuaauuuuaaaauauuuuguagagguggggucucacuguguugcccagucugguuucaaacuccuggccucaaguggcccuccugccucaacuucccaaagugcuaagauuaugugugugagccaccacgcccagccuauaugacaauuucuuaaacuuuuuuuuguuuuaaaaaacaagaucucacuuaggauaucaguauuucugaucuagauguauuccuugucaguaucauuuucauuccacaauacggguuuuucucaaacuuuaaaaacuagcagauauuuauuaauagaccuuaugacauaugguguuugguucuggaggcacuaccaaaaacaggagauacagucccugcccacgaguagucacagccauguaggaaagcaagagauauuaaauggcaaguuauaagggcaaugagugggaaaguucaaguagaagggcugcagcugcaaaagaaugaaaauauguuugauuguggcagugacagugguuggggguuaggaauaauuuccaacagaccauuuuguugacuucaugaagucuugaauuaaauuuaaggaaaaaaaaaucagccagcucucgggguagguagcuaccgagacuagaugaaccuugcucaguuccuacacgaaugcaggucaguggcucccacugacuaaggcugcaacaggaauuauaagcaucuagagguauuuaaaggauguuuauuugagugugggacaccacagaaccaucccucucuucuuuugauaacgaaauucugauuugaguuaggggaaccacgccuccugacucucaguucgugagcuuugggaggucugcaguaacagcuguaagguagaucaugugacccaagacuugccagacuuccaaaucuccauggcuacaaaaauugguugagagugggcauguugucccagccacgucagacuaaauuccaggaaaagagcaagucuggucuucuccuacuauauugaaucuggaaagaugugguuuagaagagucaacauuugucauaagacccaaggagugagcuugucacaaaauggugccaaugcugagaaaaauaaaaccaagggaugaaaagaggggaaccagguccuuaaaguuuagccccugggucaagcuuuaccugauccccuuaccacaccuauaucuuucaguuaauuaagccuguuugaaugaacauuucuucuacuugcuaucgaaaggguuuaacacuggcaacuucauacagcagaaaauugaaaacaguuuuccugacccuggguuguaacaauuggauaaacuuucccagaauuuaucagacacuuaguuuagaguuuauccuagaaagaaucacuuuuauuuuguuucaagucugagauauugugccugggauggaauuuuacuaacagacagaaugaccauucaucuuugcucgucuaggccaaucccaauuuaugucuguugucuugguauaauuauuaucaguaucucauuucucucucagaaguauucaaaauccauuggaugguaaauuauaaggucacucuacugguaauucuccuuuacaaagcuuuucccuuuagagcagaaucuccccaaauucucuuuagcgauaauuguggcuaauuauacccagugaauaaucucaucuugccagucuucccauguuugacuuuugggggauuaaucauagcuuuacagcugucgaacgagcuucuugaaagcaugguauuauuguuuuaucuaaaggaaaccccucugaaacagggucuccauccaucauacccccugcaguagaaagcgcugauuaaaacuuccuggccggcaaacuuguuuguuaacaugucgcuuccucccuacugucagcauaaggucuuccuugugcagcguguuuaggauucggcugagagcauuguuuuaucaagaugggacgguuaucugugcgggaguacacugugcugggaaucugaccaccucuguaaacacaaugauagcaucgugucugcacacucagagaagacaaugguuccaaauucccuuucccuaauuagaguucaaaacaauaggugggaaaucugaggccccacuaucaucuauuggccuucauuucugggcauugauugagcuugggguguuuugugugugaagaaauagcaaauuaaaauucaggcuucuucuauuuuucuucuuugagcguucuuccuguuauaaagcuguggugaucaagauuaaaaauuggaagaagaagauuugagaguuauaaacacaugugaacgauaccaaguuccuuuucgaagugauuccaauaagcaaauguuugaucaaggcagaugacgggaugagaacuggugcaauuuuuuuuuuaaauggcuuuggagaggaauagacaagcacuuuccccaaacgguaagaaacuaucuucugagucaaugacugauaacacugucuguuauuuugcuaauaggaaccagcaaugucacagugcaauuuuucauuuuuuuaaaucuucaaaugcccaguccccugcuaacauuuggcucauugaucugcaugcgacauucuguguaggcucauuggccagcgucauuagagggacagucauuacuaacaaucaagucauauuaagucgauuuacauuuaugauugcccuguagaguaacaauuaagcuauuuagauggaaaaaucucccagccucccgugaaaggggucuuuugaaucgcagacacacagcauuuacuucuuauggaauuggaccagccaagauaaaggacaggugaccagauucucuguuucaugacuggaauggucauguaaagggaacccucuuaaucgguacaacccaaaugaaucaugaucugauuuggggugaguggugguggagugaauggggaggcacaugaagaaaacuggagaguaauuuuuuaauugcagcaggaguccaagcugccacuugaucuccauuuaaccagccaagaggucuuccaucuccugcucagagcccuuuccugaacuuguggaucaggcuaagugaucauuuucuauguuuuuggugugaaccacuaucuuaccaccuaauacaugacccuggaauuaacugauucucugucucuccaccaggccagaccacagccugcucaagggcagggccaucugguuccuuuuuuuuuuuuuuuuuuuuuuucugaggcggagucucgcucugucacccgggcgggagugcaguggcgcgauccuggcucacugcaagcuccgccuccuggguucacgccauucuccugccucagccuccagaguagcugggacuacaggcgccugccagcaugcccaguuaauuuuuuguauuuuuaguagagacgggguuucaccguguuagccaggauagucuggaucuccugaccucgugaucugcccgccuccgccucccaaagugcugggauuacaggugugagccgcugcucccggccugguuucccucuuauacucacagugccuaaaaguucuugaucccacacucuguacucaauccauuucauuccacaaagcaucaauucccauucaguuaaucacauaagaaaucuucugcauuaaaaagaaauuucaugaaucuggaacuguuucaaaguacagcguucaagcugcaaaucccucauucauucacucccucauucacucaccugcaaauauuucugaagcucauccuauaugccagguacuguucuaagugcugaagacaugaguggacaggacagaugaggucccugcucucuggcagcuaauaguucaugggaaggcaauacuaauaaauuagcaaugaaugaaugaauagacggauggauagacagaaaauaucagauagugauaagugcuagacagagaaauaaaauagaguuaugggauagagaaauugugaguagugacuuuggacaggauagccaggaaagacuccugugaggugauauccucccuacaucagaaugauacugucauacuccauuuccaaaugcaguugucaaaucucauuuucaucucugaugauccucagauggaccaauaauaucagugaauuuccugguacaauuucuugucuggaauagcaguaugggccacgugcaguggaucaugucuauaauccaagcacuuugggaggccaaggcaggaggaucacuugaggccaggacuuugagaccagccuggacaacauagcaagaccccguaucuacaaaaaauacaaaaguuagcugggcauuguggugcacacuuuagucccagcuauucaggaggcuacggugggaggauggcuucagccuaggaguuggaggcugcagugagcuaugauggcaccauugcacccaagucugggcaacauagcaagacccagucacuaaaaagaaaaaaaaaaaacuguagcaguaugagcacagguauugguugggguaaugcuugcuacuaugauacaguaaaagauuucucacaucaaguccaaaacuaguucuguauuucugaucgacaagugacuuugcucuggguggugaacucagggacccuggcucuauccagcuuguguauggcuuccaacaucaucaugcuuguucacaucaagacugcaggggaaagagccgugaggguuuugcaagacagguuuuuacaggucagguugagaaggggccaacgucucgucuuccaacaguccauuggccaagacucaggcacauggcugcaccuaacaggcagaggcucaaaaaugcagucuaaccaugaaccaggaagaggcaaaaaacgggcuugcugaugucuuggggccucugcuuaugugaagcacuaggcaaacuuguaacgagaauuaucucaagcccacucccugcaaggaugaggucucggaucuccucauauuaccucagcgacagcaacugccaugaucgaaaucaaaaucuuuucuggcaggagguagggcaggaugucagaugugggaagcaaaagcuagggcugaaauccaaaggguuaauucauuaaagaaaaaaacacucagaccuguugugcucugagacaacucgagagauggaaggcuaaucauccuucugggaugccgaguucuuuguggagcccucagaauggaccguucgacccuucgagguuucucuugcucugaucucuugcuaauggauaguguuuuccaagcugaugguguuuuaaagauacggcaucuaaccaaugauaauacgucugaccucuugagggagaaccuuguauaucuuccucucucagccucccuuauuggcuaauuacauaacuugacuagaaguugguuuuagagaaucaauuuuaccauugccuaaucacaaguaaagaccauaaaguuuuaugagagcugaagggacugccuuuuacagaggggaacuuaaaugagaauuaaaggggacauuaaaugauaagaaaugaaauucuacaagguguuuuccccugacugccacacuaaauuacagugcuggggauauaacccugcugguuuugucuccaacaaggcacucagggaagagcggaggagcuggcauuucuugaucaccagcaaugcaauugacagaucccguguuaguggcuuugggugaagacgcaggcaaaaaccccuugagcugccaucuacuaauugugugacccugggcaaguucucugacccucagauuugucaugugcaaaaugcagaugacagucaucaccucccagagcuggaaggaugaaauaaaauaacacacauaaggugcauagcauagugccuggcacacagugagacuucaaugaauauauccugauuaccuguguuaaugauaggacaugcuucaaaacaacuggggcuuuguucaguuccuauaaauaagagcuaguauuaauuaugugccauaaagcagcaaccuguaauggcaucaucuccacuuuauacaugaggaaguugaggcucagagacacuggaaaaccuguccaaagaaacaagacucaugaaggccauaauuggacucagaaccuagguagcuuugcccuggaggccaauauacuggacuacuguguauuuuucuggguaagguucacagaccagucugccuguucauaauuuaucuuccuuuauaacaagcagcauccaugagucuugcacacacuaagcuugagaaugauagaagcugggguguuucguugaguuuuucuuuuugagauggaguccugcucugucacccaggcuggaaugcaucagcgugaucucagcucccugcaaccuccgcuucccggguucaagugauucuccugccucagccuccugaguagcugagauuacagguacgcaccaucacgucuggcuaauuuuuguacuuuuaguagagaugggguuuaaccauguuggccaggcuggucucaaacuccugacuucaagugaucugccugucucagcuucccaaaguguugggauuacaggugugagccacugugcccggccugguguuucuuacaacauugccacuggggagaauuuuccuaagagucuuauuucauucaauuaccaaaagaauuguccauuucucuccuuauaucuccuucaacuucugaaucuuucaccauuaucauuucuagcacuuuaaugucuccacaaaagucaggaucuggucaacccaggccaucaagaaaaagaaaagacugcuucuccaugccuaauaaaacagcaggaggguacaguuuacaaauaugugauuuaugguaaaggucaaguaugcacugaaaugggaacaugucccauaggcaagcaagguaguuaugacaaaaaacagauuugaauggaaaucaccaaaauugcucuggaaauauuaaaucaaagauccuuuuugauaacuggaaagugggcuggugugguggagggccaccuuccacucugacaagggccuaggaagacaagcagacuccugucugaggucugcaacuggggagaacaagaagggaggcccuggggagagccacacauggggauggaagucgacaggcugugggaaagccauuuuuuaauuuuuuuaauuuauuuuuaauugacaaaaauugcacauauauauugugcacaacacauuauuuugaaauauguaaacaugauggaaaggcuaaauugagcugaucaacauaugcauaacuuugcaucugauaugguuuggcuguguccccacccaaaucucaucuugaauuauagcucccauaauucccacgucaugggagggacccggugagagguaacugaaucauggggaugggucuuugccauguuguuucugugauagugaguaagucccacgagaucugaugguuuuauaaaggggaguuccccugcacaaguucucuugccugccaccauguaagaugugacuuugcuccuuguuugccuucugccauaauggugacaccuccaccgccauguggaauugugaguccauuaaaccucuuuccuuuauaaauuacucagucuuggguaugucuuucucaguaguaugagaaaagacucauacagcauccuuaauuuaaaaaaaaaaaaaaacaaaagauccugauacacucugcuaacaugaaacaccacacuguucuaauacggaugaacaagguucuccugcagugaggaacaacccccauaacacggugacuugauacagaaaaagcuuaauucuugcacauacuacaaguccagaaaaggcugucagggcccuuguuagucucaaucagagaugcuggaagauggaggauccauuuugucaugugaguccaugaucaugaugucaggagaaagcagggaauccaccugcacuggcuuguaaaucucccccuugaagugacaguucaugcuucuuuggcuaaagcaagucaccuaucuaugccugaccaaaaagggagaaaaagcaucauccccagaaggacagacgaggaauauuuaacaaagcacaaacgaucaccacaucuacacaugaaaaaugauaauaauaacauaaauauaugacaucuggguugcaugggcaauuacaucaaauguaauuauacuuugcaaaaauuugaucuuaaaucaaaauauagguggaauugcauucuuuuauguaccagggagagaagaugaaaccccagaaauaucauuacaauuagcuugacaucuuauuuugcuaaacggaugccuaaggaauaagcaugcaaugugccauuugccaagcaguauuuauggauucccagacaguaacuggcccuuuucucauaucacuguuuuccugacccucuacauuuggacuaaguugacgcauggaacaaccucccuguuccauuuaaaauacgaugcauaugguuuugcuuaaagaacaaacuauguacuccugguaagaaauauauuagugggauggacacagaggucagggaaugaaagauuucugaaagggaacuuucaucuaagaggagcaucauuuccagaaagccucugugucaaaugauggguuucacucacaggccaaagagaggcugaggguuaaaaccauccagaaggcacgugggaccuagaggaggccaaccgugcacacuuuucaggacaugaaauacagcuccuguuuugacacuuguguaauagcaugguuguucaaccuccuuguuucugugggguuuaugguccauaaaguuuaauaacaaucuuaacagcugaacagagaauacaugaggcucgaaggccacucuuaccaaagcggaucuggauucuaaaauucuuucccccuuggcaucucaacauuuacaagugccugucucuuaauguugacuguacaaaauaaucacguggcacaaggaaacaugaacgacuggcuguuauuaaaacagccuuugcaaaaauuauaacggagaaaauuaugaaggugauggagaucugauguaacugacucuaucuugcuucuaaccuccaggcugucuuguucaaaguugauuugguuguaggacuaacuaacuuugagaggaacuuaguuuacgguuuaacuuugaaacaaaagaugauaacagcccuuucccaaaauaaacaaccuuccugccuggggacuagacugccuuugcaggacuaacaaauuagccacaagauuagaaauuaggguuuaggagucaugcugccggaggcugcaagauucugaaccuccccaaauugcuccaggggauaaugucacuaugguaaaaccgaacaucaguacuuuagauacuuugcagacccugcaauugauggaucagcuggcaccacccaggucaauaaauugacucauauggucuuguggcucccacccaggaacugacucagugcaagaggccagcuucaacucccugauuccaucucaaaccugaccaaucaauacuccccauucccugacccucuucucacuaaauucuccuuaaaaaucucuaucccugaguuuugggggagacuuauuugaguaauaauaaaacucuggucucccacacagccagcucugcaugaauuaaacucuuuuuuuuuuuuccgagacagaguuucagucugucgcccaggcuggagugcaguggugugaucucgacucacugcagccucugccucccagguucaagcaguucuccugccucugccucccgacuagcuaggauuacaggcgccuaccacuacgccuggcuaauauuaguaucuuuaguagggaugggguuucaccaccuuggccaggauggucucaaacuccugaccucaguugaaccacccuccuuggccucccaaaaugcugggauuacaggcaugagccaccgugccuggaccuaaacucuuucuuuauggcaaucccccugucuugauaaaucggcuuugcuuaggcagcgggcaaggagaacccguugggcaauuacacuggcucuuaaguugugacacugccacacacuuggccauagaauccugguguaaaacuuugaggaaaugaagauuacagagccuuguuauccugcaauuugggaacuauaaacuuucauacgguuaguaugccagggcuucauccaaauaccuggacaaaugagauaaacucgaaauuccuucccaaagccugcaaagcugugcacugaucccagccuccuccccuuucucaucuguucacuggggucaccaaagccccuugcaguuggugaauucaucgacccuugacaugccacgggcuuuggaacuugcugcucccucgucuuugcggggcuggugaggauuccugguaguccuguuucccuaggacuggcuccauuacauuucuagaucuguugaaaugggaucuccucagagaaacccuccuggccccaucuaagguaauacucccucuaguaacuuacccaacugucuuugcuaaauagcaguuauuaaaacugccuuugcaaaaauuguaagaguaagaaaauuaugaccgugaaagagaucugaucuaaccuagccccaucuugccuuuaaccuucagaccgcccuuagucauuccugggcuugggccaagcuaacuuuggggggauauuuaguacuuaauuuaaaugauaauggcccuacccccaaacuaaacugccuuuguaaagcuagcaaaagaccaccaaguuaggaggaggacaggagccugaauucugcuaaagaguggacauaaacgauuagcagccauuauuccagagguuacaagauuugcaauuuccccaauuauuccugcagauaacaucacuuuguagaaccuaagguuggccuucugaaaugucuuuuccggcuuuugcauuuuugaggacugguagccccauccccauucaacugguccugugcccugccccccacccagaagcggauucagggcacaaggguuuuacacaccccuaugauugcauccacagcccaucagcaguacccauucucuuguccacaaaacuauccuuaaaaaaaccccagucucugaauuuucaggaaagcugauuugaguaacaauaaagcuccagucucccguuuagcuggcucuaccaacauuaaacucuuucccuauugcaauuccccugucuagauaaaucggcuuuaucugggcaucaggcagaaugaacccauugggcgguuacguuaucaccaccugccaauagcuuauuugcguaauuauuuccguguuuauucacagacacacacacacaacaaugagagcaccauggaguuaggaagcuugacauauuauuccuaacuucaccuacugcugguuuagagcaaaugaauaaaacacugugggugauaaagggucagaagaccuugucacaugaucaaaaacaauuucaaguuaaaggaacuuucagagcuuaaacugggcacauccauagagcugacaggauaagguccuucccacaccacaacaaaaugcaaacuuucauccaacaguaaccuuuaucaucacugaagcugacuggcaugguuuugcucuccugacuucuccagguucucccucuuccccugaaagauguauauuuaugcaguucucuuuggaagccguggacuacccugcaaucguggccugauuuugcacagcacaagugaagagauggggacaaagacagaaaacucccugcugaugacagggcuccugggaagagaauuuuagcuugggggaggguuggggagggaaaguaggaaggagaggaaauccuuaucaggcuauauuugcauaucaaagagcacuuccagccgggcuuucuuugcccaguaacaaagucaucuuauucaaggccaagaggcuuuccucucaagcugccuugggcuaugccuccuacuucuuccuuguggagacaaaacagcauggcuaucucaaggcccagggagauaacucaccacaccaguggcucucugcugccccagaugucccuagauggcugagguuucgcugaggauuuuggguuuacagacuuccauggcauuccccucagacuccucaguuuacucaaggucccuaaccaagaagacaaaauacuguagccuauguuauucauucauucauucauucauccaucauugcauucaucccaaaaauacuuaucaaaauauuacuaaguggcaagcaugcagcuacuucucccuuuuagcucuuggguccuuuaauuaaucaacauaggugggaaggagccaaggauggcugggugcuccgacacuaaugacuuugggccacguuuugaggggguggaaacguguuugaugcaacuagcauuugaaauccagauucccccuuagcucaugguucuaagaaguugguuuuaaacuacauuguauaaauaggauacuauucugcucacauuugaucggcucauaucauaaaagggaguucaugguccauccuuuuauuaauggaaggauucuggcugggccagguggcucaugcaucuaaucccagcacuuuggaaggggccacagcuggagauucacgugcaucucggaguuugaguccggccuggucaauauggugagaccccauuucuacaaaaaauaaaaaauuaacuaggugugguggaacaugccuauggucuccacuacacaggaggcugaggugggaggauuacuugcacccaggagguugagucugcaguaagccaugauugggccacuugcacuccagccuggcugacagagugaaagccuguccaaaaaaauaaauaaauaagaauucuuccaagcguccaucaacagucacuugauuuacauuucuuucuuuaaagcagaauuuuucuuagauuugcuucauauuggaaguaaauaugugugggcucaauauacaacugaaauuagcacgcaauuuucuucuccgccuccuccucuuccuccuccucuccugagauuggccaucaaccucaugcucaggccagcagcuugguguccagggguauaaccccucauagagggucaguuccaaaucagagucauugaaggccucauuaugcaauauguuuuaagugaccccaagaauacaagucucagagacucacauuucuagcugaaagcaugaaguggaaggaaugaaaauauauuuucuguaguuauaauaacacuauaggaugagguacucuauugggagguaggauaaggaugggaagacaauuuggaaaaccaacaggggcaccaacugggaaaaggaauguaauaccaauaaaagaaaggugugugugcuucuuuaaaaggagaaaaaaugguuauuuucuuuccugcacuuaauuaagaaauauucaguaacauagaacuaaguguugauaaaaagaaggugcaaaggcccgagaauuuuagaaaguacuaagugugacagaucauagauagggugaccagauaucuugacauacgccuauugucccagcauaauuaccugcuccccaaccucucucaaaaaggugccaguguggaugauaaauuauguggucacuguaaucauagcaccaacaccugggaggcaggcugaccuggggaagggaggguuuacauuuccagugaccaugccccacccagaaaagacauuuauggccaggccgguggcucaugccuguaaucccagcacuuugggaggcuggggcaggcagaucacaaggucaagagaagaagaccauccuggccaacaugcugaaaccccaucucuacuaaaaauacaaaaauuagcugggcgcaguggugugcuccucuugucccagcuacucaggacgcugaggcaggagaauugcuugaacccgggaggcagagguugcagugagccgagaucaugccagugcacuccagccuggcgacagagugagacuccgacuaaaaaaaaaaaaaaaaaaaaaaaaggcauuuauaagaucaucuaagugaugacaucacaagcaccuguaacugcuaacuucugcuuuaaagaaaaacucuaacaguuggacuuuacaucuguugcuaguuuaauaacugcaaaagcucugcaguuuucuucagaaagguggacccugaucccuuuuguacgugguguucccuaauuucagacacguuaauaacaggguaaagguguugaugauauaugauuauagcuuauagggcugcagccauuuacuacacacaaggagucuccauucauucgcuguguggcuggcccggagaaaaugacuuauccacucuguaccuucagacccaccucuguaaaggaggaauaacaacaguccccugccacagaguucugagaacuaaauagaauguuccuuuaugaauuauguuauaaauggacuggacucucagcaugauugagcuagaaaggaacccacgggugacuuuucugagcuccuguacuaugcauaauggauggcagcuugaagaagacacgugccuagagcgaaguguccaggugcuucucaaagugaggcuggggaauagaaucugcaggcagggaaucuaaagccauuucacucugacuucuuagaaccaaacugaaaggaaacccuuaacuuuccacgccuaaguaacaaaaggaggaggggcuacucuuuugcaaccccuuaccuuuucugcagggcagaugggaaauugaaaguaccucugagugguuuugcuuuuugcaaccaaucagacguuugcauaggaguguaacuuuguaacuucacuucagccucugauggguugcugcccacaaccaaucauacugacuggaggcggagucuucguuugcauaaaagagcaacucuguaauuucacuuuagccucugauugguugcuuuccaaaaccaaucagauguuugcauaggagugugauauuuguaacuucacuucagccucugauugguugcuuucugcaaccaauaagacugauugcaggccaccacuucauuuauaagggguguaccccaaguggccaaugggaaacaucuagggaguauuuagacuccagaagauucucuauccagggccccugaguggcugcuugggccguucccacucuauggaguguaguuuugcuuucaauaaaccucagcuuuuguugcuucauucuucucuugcuuuguuugugcauuuuguccaacuauuucuucaaaaugccaagaacccggacacccuccgcugguaacaaaaggacucauccaggaauguggauccucgacucagccgcgacucccuugcagcuuuacaagacacuaggaggaaguguccuguccuugcugucuuuucccuuguauuuuagaugggaagcuaaaacuggaggggggcaaaaaccaggcccacuaaggcuaagccugaggacagggcagaggaaagcacaacagauuuacuuucauucuuagaagacaguggauggaaaaguggauuuccaccaacaaaagaccuggccuuuuucccugagcaggaaauacugagcugcuguggucuugcccucccugcagagccggccuaaugguuuacccaugguaaaagcguugcagccaaagagagcagaagagaaaacugggaagcuggugucagauuuucuacucgggcauaucuuuggccuaggcccccgcagcagucacgggggaaggccuggaaagccgcagucuaacaagaugccugacauugugaaaugccuuaacccuagccuuucauccaccucuuagccuugccucucccgcccgccccgcguggcgcugcuggauacaagagaaaaagucaccguccccuuguccuugagguaauuaaucagcggugacucuuuacccugggaauaauaugccucagaacacuuuucauuccuguaauaucaauuaugcugcagagaugcaguucugaaaaagauacaaaggcauuuggugggguuugguggcaaaguaaccaggcuaaguuguugacacuacagcacacaggaugguuucagacaccaccggaucagcugcaggcugcccgauucuccagaagaaaaauguuucccuugcuuccugcagagguggauguagaugcugucugccagcucugaaaucugcaccauuuccuucuccaagacgauuuugccagcucucaacucccgccaacccaguaauuuguguuggucacuauuucauccccuucuuccauuuccuaaggcaaaucugccacuuagaaauacacacauaauggagugggaaugggauugaucagcccaacagugaggugcggagggacgccccucacuugauguacacucagauuuguaggagaggcccgugugaauucacgucaucccuccucuauccugggcagcgacagacuuggauuguacaccaguguuuagaacacugacuaccucgcuaggcgcaguggcucacgccuguaaucccagcacuuugggagaccauggcagguggaucgcuuaagcacaggaguucaagaccagccugggcaacaugaaaaaaccguguuacuacaaaaaaauacaaaaacuaacccagcgugguggcccaugccugugguccuaguuacucaggaggcugaggugggaggaugacuugagucugggaagcacaggcugcagugaaccaagauccuaccaauguacucgagccugggcaacagagggagauccugucucacaggaagaaaaagagaacacugacuaccagcuacuuaugaaaagaaggagcaaaacagaaaaugaaacagaagugguuguggggagagggaaaagaacaggaaaaaaagagaaagaauuaaagccaaaauuccauccgaaauauuuccgugaaaauauucuauaauguguuggauauucuaaagcuuucaugacauagucuuauuuucacaaacacauacuuugugaucuuuuguccucccacaaaccuuuggaugauugccagacuauugcuuucaaagucuaugucuucauuccuuuaucuccuucagcaccuacucucauggauaggaaggaacccgaacucugcauuuugcccuaugaaaauggacucugaaucccagcuugaaggagaaagguaaugacugggagaaccggaacuucuagaugugugcaaacucugauacaaggguugggucugaaaagagagcagugguccauucuguagaacauguucuuggaaacuucaaaauaugaacgcucauggaaacugugguacccuucuagagagauuaauuagugcucuucuugggaauagaacauuaaagagaauaugggaugaaucuguauuguagccaucucccacaauaucaacuaucuuuuucuuuuuuuuuuuuuucaaaaaaaggcucugauuaaaaguacaauuuuauuuaauauccuucaaauaaaaaagagagguuauuacguuagcaugaccacuaugaauauucuugaaagugguacuaguagaauuguuuuuuaugauuccauugauucaaaaugaaaaguggcauuugccaaacauaugaucugaugaguaauagauuuacaaagcaaccaaagaggaaagacaggcuggaaagaaaaucuaucugauuaugacuuugugguuuguguacugguuacaaauaaccugaaggccacgaaauauccaaauuggaaccucugcuuagaaaauucuuaugugaauagggaccucuguggguuucuugaaaguugugaggcaggaucuucacuguuucaugaaucacuuuccuaacagaaagucucauuuuuaaggaaaaauaaaaaacaaauuauuugggugcccagcaaauuacaugcacaguuuuuaauaauaugagcgugcauacuugagugacagcucauuugggcuuaaggcauagauuucaacauguucaguguauggagaaaccaggcuggaaacuuuccccuucagugucugagcugacacaaaacaggaggagaaaagacuuuaaucucgucauaaacaaauguacaggucugcaugaagguuuacacccuacucuggcaaaaugaugaacgguuuguuacugacuccuucauuuaaaaaaacaguaauaaagaaauaaaauagagaaggagcagcaacgcucucugcaggaaaaaaaaaaaaaaaaaaaaaagucaggagggcuuguauauugcacaucuccguuuugguagcccaaggagggaauauaagcuuaaaguccugaauuuaacaaaccuaauuaucaaggcuuaauuaguaccaaggguacagcuucauggaacaccugcagacuuaauuuauguccugacagagaggaacaaguguuaaugggcuguauuuauguuaauaccugaaccuuaggagccaguggaacaaaacagaccacgcgcuaguuuuccaagcuacaacacaaauauaaaagauuuucgucuuaaugcugcuuugcacacaauucuucagggaucacagagaucuccuuaaacuuuuaaaacuaaaaaguggaauaugaagaaguagagccguucuggguaucuguaaaagucuuacaagaucaacucaccaacuagucaucauaucuuuuauuuaaaauugacaauggcggauguggccaauguucccguuguucaggaugaguguuucucaggacgcugaaauauaaacccacuguuuccacagaugcuguaauauuaaaauaauaacuaacauuuauggagaacucacuguguaucagucauuguauuaagcucuucguacacauuuuccaguuacagauaaaggaaagugacauacgggguaaauaaacaggccagguuucuaggaaguucaaagauuuggaguuagguuuccggaacaaauccuuuuaaccaaugagcuaaacucccucuaauaugcagauaguaagaauaagaaaaauauaaaacauauauauaugaacacauuuauaaaagaacucucagcaaacuagaaauaaauucaaacuccuuaaucuaaugaaguauagguacagaaaacauacaacuagcaucacauauaauagagaaguccugaauaaagcaaugaugucugucucaaaaccucuguucaacacuguccuacaggcuauagccagugcauuaaaacaagaaaaagaaacaaaagccauaaaaauuggagaagaaguaaaacuauauucagagauguagagaauucuacagaaucuauuuaacaaaaaggaaaaggugaauaaauaaauuuuaagaucacaggauaugagagcaguuugcuagaaucaacuguauuucuauauauuagaaacaaacaguuggaaaaaagaaauuuuauaaugccauuuacaauagcauaaaaaaaucaaauguguaagaguuaauuuaacaaaaaaguauaagaccuccacauucaaaaucaucaaauaucacugaaauguuuauaaauaaagaagccuuaaauaaauggagagaugcaugcucauggaugguaacgcuuaacacuuucaggauuuugauccuccucaaauugaucaagagauucaauaccaaagcaaauaaacucccagcaaggcuuuuuaaaagaaauggagaagcugaucaggaaauauauauguaaaaggaaaguaucuaaacuaacccaaacaaucuugaaauaaagaacaaaguuugaauccuuauuauuaccuagcuuccaggcaaucgagcaguaaguauaagaaaaaaaauuagaucaauggaguacaacagucuagaaauacacccacacauauauagucaacugauuuuugacaaagaugccaaggaaauugaauagcgcgaggauuagucuuugaacaaauagugcuagaacaauuggagagucuuauggagagaaaaauaaaccucuaccauuaccucacaccauauacaaaaauuaauuugagauggaacauagaucugaauguaaagauugaaguuauggagugucuagaagaaaacauaggaaaauauuuuugugaccuggugauugguaaagguucuuagaacaagaaagcacuacacaaaugaaaaagauaaauuggacacuaucaguauuuauaacuucugcuuuucaaaagacaccauuaaggaauaaauagacaagacaaaggagaaaauucacaguacauaugaaaaaaaaagaauguauccaaaauauauauagaauuccuauaauucaauauuaaaaagacuaucuaauuuuuagaaaauggccaauacauaaacaagcaguucacagaaagaaaauauaugaacggccaaugaguucauaaaaagaggcauuagucacuaggaaaaugcaaaauaaaacuagcaagagauagcguuucucacccacaaaaaggcuauaauuaaaaagacugaaauuacaaagugcugaugaggaugugaagcaacauaaacucuuacacacuucuagcgggggguuaaaaugauacaauuacuuuagacaacuguuuggcagcauucuuacaaguuaaacacuaagagucaauaauuucacaccuagguauuuaucaaaaauacauaaaaacauaagggcauaaaaacauguauacaggauuuaugaauauucgugguagcuuuauucauaauagccaacaaauauaaacaacccaaugcucaucaacaggugcacagauaagcgaauugugguguauuuucaccacaggauacuauccagcauugaaaaagagaaccccuaauacacccaucaacauggaugaaucacaaaaacauuaugugaaucauuaagcagaagacgacacauacaaagcaguagguaugauuucuauuaaaugaaguucuagaacagguaaaacaaaguuacaaugauugaaacaagaaugcuuguuucugggaauaaaaggauuuauuggaaaggagaaugagauacuuaccgacgugaugggaauguucuuguuuuuguuuuuuugguuuuuuuuuuuuuuuuuuuuuuuuuuaaagacagucucacugucacccaggcuagagugcagcagugccaucuuggcucacugcaaccucugccucccaggcgauacucaagccucagccaccagaguagcuacgguuacaggcauaugucacaauggccagcuauuuuuuucuuuuuuuuuuucuuuuuuuuguauuuuuaguggaggcgggguuucacccuguugcccagacugaucucaaacuccuggccucaagugguccacccuccucagccucccaacaugcugcgauuacaagcaugauccacugaaccuggcccuggaauguucuauaucuuaacuggggugguggauccaugauuauguacacguauacauuuuucaaaauccagagaacuguauauuuaaaauaugcuaauuuuauagaacauaaauuauguaaauuaugucucaauaauauauguauauguaugcauauacauuuucucucucucucacacacacacacacuucugugaagagaauuauuccacaggcccaauuuuauauuaguaaaacagaccuuacuuuugagugcuacaauccaaucgacaaaaaugcuugaaaagguuaagauuauuuaugaaaauguuuacuaauuacuaucugaguacaucaagcuuuguggaaagagaguaggcuucagugucauaugucccaggucauuaugaugcguuugcuucucauuagcuaugugaccuuaugcaaguuaaugaucagccucagacgguuuuugacggaagggguaggggaagcaacgcuggccucacaaguuugcgguguggcuucagugugcuaacggauguagaauacacgauucagggccccagguuuuguuauuaccaucaguggucccagcccguuuuugauaacuuuguaaacaccaagugguuuugggaagccagucauucuacaauccuuuucccaaauuuuugucucugaaaaugacuaagcaaauuuacaaaaacaauuggaaacaacuuggugacuuuuuuuuuuuuucaaauggguaagugcauuccggauauaauuauguuuaaaacaugauucagcacacuuuauuucuucugaaguauuucuauuuccuucuuuuauaaaaccuacuauuucuaucuuauuuuuaaagaucaauugccugcauguuuucagagcccuuucagaaauaucuuugguuauuacucaucugugaaaaggaaauuuaaacaaaguuugagaacuguucauuucucaaaaaagacaguggaauugaguaucuguuuccugggauguuaagucagcgucaagaccaaauucaugagauuguuuuccaaagagaagacaggaguaauacgaaagaaugacugagguuucaugaacuguaucagcuuccuggcaugagagcacucgacuuuauauagucggauacugugagucaguugacauuguucuuaagaaaacuuguuuuuguuagcaucucagaauuugccagagccauauuacauuuaagucuugcguuccucaaucaauuugaccaaugaacuuuuugaagaucaaugggcaagauaauaguaguagaaggaaaacaccaaugauaguuauuucucauuuggggucagcauugccaagcugcucaggguuuccauggcaucauuuccaaacccuccuauuaaauucuaaaggagaauagaucuuugccuguggacaguguaaauuugacaacaaauacaggguugauagacugguggaauagaaaaacacaagaagcuacgggauggaagcuaggccaucgucaccacugccauggggcagaacagaaagaagcaugauguuuugaccccacagaggagacaacacucaaauccucuucagugaacggcuguguuucuaggguacugggaaugagaaaggaagauguuguaugcacagaaacuuaaguuauuuucuuaaugcauaauuaagaaaagaaaagaaacccacagaaaagugaggcaaacccacugauaaacaggcagguucuauuucuguuaacuggguaagcccagauucuuuaaaagugauuuuaaagccguugaugcuaucaacuuugaaaugugguuugaaaaagcggauauuacacuuuagcauaugccuaauaacugcccucaccauggaaacauugaaggcagaaaccauuguguuuguuuuccuaaucguacuaccaagauaagacauagaguucucguaaaccggugcccggcggcaugaugggaucuccagcuucuguacaccuaguuguggagguggauccuggguggauccauuggaacuaucguaauaagaauuagucccgucaucagauaauuucugauugaaaauuccgagaacugaguuaugcacagugcucaguuagucacuguuuuucucauaauagccgcauuguggaaaacugaagccggucuuggggucucaaggucaacuucauaugauaaacaucuucaaggcaugauuuuagucccgucuucuuucccaaucuuguuuaauugcaacguggccuuccaugcuauucucucuauuguuuccacagccucucuccaccuugagacacacacaagcaggcuggguagguauaaguaccaccuugcucccucgacacauuaaucaauuuguuucauggaauaaaaaagaagacaaccaucuccaguugaaaauuagaaucaggcuggauuacagcugcagcaaugaacuagguagagcagaaagccaaacucaagccuguguuuccaaccaguagagaggcugacuacaaacaauaauuuagacaaaaaauagucuaggacuuuaugaucuacaugcuuaagcaucacugaacauuacuaacuuugaaguucaauauuauacuuggagguguauccuuugcugugcuggagagaagcaaagaaccaggcuugagucuaaaauauucccauuaacccaauaacacaacaauuagauguguguguauguguuguauaacucuuuaaaacuaaacgaucaaggcuaacuauggaaauaaaagugaacauuaacaauugccacaguacacuugccuguagcuccagcuauucaggaggcugaggugggaggauugcuugagcccaggaggucaaggcugcagugagccaugacuacacuauugcacuccuuccugggcaagaaagcaagacccugucucaaaauauaauaauaauaauaauaauaauaauaauaaaagccucaauaaaagacauuacucuaugguaaucagggauaccugguacucaaauacaucacagacacaauaucugcucagcugguaacaaaucugucaaggaaaauauugcauaucaacucaaaagaugcaucuagaaaaucuuguguucuagcuugcuagaaaacaaaagauacugugugagugugauuuccucuuaccucugugaagcaaaagugugaucgaugaaggugagaggggcagggaaagacagagaaaggcacguaauguaugacagacauuuucuggaacaaggggaagcuaaugaguucacagaagugcuagaagggccccuggaaaauaccagggaaccucagacaaaagagucucccaggcaaggaagaaaacaacaauacaugaaauauuggcugcaacauuuaagcaaaaauuaaaauggcagccaugugggcagaaguggaaggagcugagucugagagaggaguggguggaggaggaagugucuuaggcagugaccucacccuucucuauuucaggcacuuguucuagccuggagaugguuuccuaaguagcaacagaaaaauaaaagaaaagagaagucaauccaaacuauuuaaacauaaagaaaauauacugaaugggggagccugguaugacagccucuuggauucaaaccaugugagaggggacaggcgaaaggacugguauuuuucgaggccugacucugugcuuacuguggcacugggagguuggcagauaaaaaagaagaaugucuucccuuauuucaggcauaagauggucaagaggggcauccccacuuuuuuuuuuuucuagcuauagucauuccaucucauagucgugugucuuugugacccugucagccuggagagccuccuuuucuguguggguaacuacaguuuacucagcaggguggagauggaaacuccugacuccagugcuccucugaccucacggucugcuuugaggaccccugcucugcuaccagagaagcugggcuuccugcugucgcucuugaaggaaggaauccaaggcauuacuguuaagcuaccugugagugcuuaaggacagaaaagacccuucauugcccuuuguaaccaagccuaggacuuggcguaggagauaccaaugaaugaagccaacaugcucaaacagcagaguuccuuaauccaauuggaucagcagcccuuggccuaacugcagguugguccaaaucguggcuaacaaaacucuacaacagagguuagaaaguugugggaugccaucaacaggacaccggcuccuauaguaucacaaucaccugcccaaaagacaauggauccucaccuagcccaaugcuggccuaauuguuuugcuuuuggcaggugaccuuguguuucacacacgcagaaucucaguagauaacacagguaaaaguggagcugcuuuggauaaaauguggaggaagaacgcucugaacaagaauguugucguccagcucccacuucuugacauguguucuggacagcgggggugaccuguccaugaccaccguuccaacuagagguagaaccaggccuagaacgucucuugcaccaacaugaaaggauguuucccucauuagaguauuaauuucucgaaggcaucucaucagccauccugugaccccagaguccaggaacgcacacaggugcagaagccauuugauuuuagcaugugguucauuuuuuuuuauuuuagcaugugguucaucgaguaccucuugccucuugagauuaaagaggagcuaggguugcuaaugguugacuuccucuucuucuuuccaauccuugaauuucguaugcaauuucuuagauuccgcuggucucacugccaguagaaaauuaguaugaaacagaaaacaugguuuggcaagugacaauguuuagcgagaaacagaagacauucacuaagcaaggaaaaaaacccauuuuaucagacacacuuuuuacuuuauuauaggccuggaguuuuaaaacacuauuacugacagcuuaaauauccuagguuaugauuucucaagcuagggaagaccuccccgaccuacacugaccauaucaaagaacugaagcaaacuccggaaaaccaacucugcuccuucauuuguuagaguugaugaaguauaacuggucauuauuuaaaguuuaauuuuuuuuuccuuugccuucauauaugaaauuucucacugggacauuucagugcucuuagaagaauacccagcaguggauucgaaaucauuugucaucuuucaagaucugagacucuuucuugaccaauuuagaaaagaaggauguuagagcaaacagacagcuuagcugcuaaugacgggcaauaguucaauauuuuaugccaccuugaaaaaguugcaguaacugaagguguucucacauuaauucuuugcaucaauuaucgacagagaauuuaauuuaaaggcaacuagucaguaaccuagggguaguguuuuaaauaauuuauaauugcugcauggguguaaucauauugcuauugauuaccauccagucacuucuacagguccagcaggucuuaugcuaauuacuuuuagugagaucaccuuuuuaacucuguauucccugguaacaggaacucauuauaaaaauaacuuaaugaagcgcaaucguuuagaguccuuacagaaaggagggaagggaggagggugaacuuaggagaaagccaggaguugaaagcacuaggcugagauuuacagaucaacaauccuaaaccugaaauuacauauuguuauucaaauaucagaugggacugagacaaaagaggugaaaaacaggguauaugaaagaaggggcaggcagaaaaaagagaacuaaaggaagauuuaaacaauuucaguuuugagaaaaauuaucugaauuucacuuuauucauucauccaggaucacuuuuuauucacuaugaaacagacuagccaucauauugagggauuuaggaaaggcaaccugugauuuacuaaaaauuugucagaaugaggcccacuguaugcuuccuuuuauauccucaaacagugugagccaaagacagguuuguucccccugaugaaaggagauugauucaguuauuaaguggugcaggaauguaccuaaagucuuuauaauaauagcuaugaacgcauuuuacuaaauauugacaaaacaugcucgaaacccaugauuuccuguauacuguuaccuugaacaaggcuaaggcuggcauuuagauaaaaaacagaaagugaaugaggaagucaucaguaaauaauaguauagguggcccauagacaaggcacgcucagaugcuggucuagggaaagacuggcuguggaaaauacuggcugagugagcagaccacauguagacacuaucacucuucucucucuuaauuuguuccccuggcaaaaagagagcaacuacaaagguugccaagguggcaggaagugaagacaucagcaccauuucagggaagccaggaggcuugcccaguucagacagcaacuuguggacaagcccuccugacuggggcugggggaacagucucagaaggcccagauagggugggagggauguccauuaagaacaugaggauuaagaaugauggaggucaaauuuaagaaugauggaggucaaauuuaagaaugauggaggucaaauuuaagaaugauggagaggcaagaggucaaauaagaauaugaaaauggggcuuuuauuuauugauguuucuuuuuauuuauuuucagaacuuccauuuuuaagcaauugcauuucaagaauagaugugccucauuuacaaaaucuaugugucaguguguauaugugcuucaaaacuguuaugacauugauguuguuuaggaaaaaauguguguauguguauguguguacauguguguguauguguauuucccuaggagcaauuauguaauaaaugcaauguuuuugugccacuugguuucaaacuucagaaaauuccuaacauuuaggagaaagagaaaaaaaaacagagauucauuuucugaaagaagagacauaagaugguacacaucuaauuuaauaccaacaauuugggugacuuauaaacagugggaguuuacauuaauagaaaauucaucauaaacuauggacuuucuccagauacagcaaacguaacccuuguucugaagaugaggacaacaguaucuuuaaaccucggguggcagcuguugugaucgaggcggaacaaaacaaaauagggaacuauaucgcacaaguuaaaauggggggaaaauaccugcagaaauugucaccugcccacacugagaguuugcucacaaauauucucacuuaaaccuagugaaaaggaaacaacaaauuucuagcuuauuccauuuccccugggcacgcuuaguacuuucaagcuuggcucgguuuucuccuaguggagaccaguggacacaggccaauacuuauggcugucguauagcacuaaaauacauuauauuugaagcugcaacagucuagcaucaaccgccaagggcaagaaugaucacucugagacacaucaagucggcucgcguuucauugcagacucuuagaugggggacccaguuugcaggguuuaggcugcugauccauaguauaaaucggggcggggggugggggagggacaaagaucuucuuaaaaagccagauagaaagcauuugacuaugcaccauugcagugugaaaauaauuagauaugaacaauauauaaaugaaugaguggagcuguauuuuaauaaaauuuuacuuaaggaaacagaaaaugacugucauuugccaaucccugguacgaauccuuaucaucuuauuauuaagccguauuccugaagggugggacacagagucgacuccacagggcaggcagugaagcugaccucugaguugaauucaaagagagacaucuucuuguaaaagggaagaagucagccgggaugggauaaauggucaguuucuagggggagcuggagguggugaggaggacugaccagggaagcuuucuaagggcaucagggggagauuauggggcuuggggaaaaaggagaagcuugaaauugccacugugaggaauggaagagaaauuagaucgaguaaacagaaauacugcugggcagucuugagacauaguugagacuaugaauuaaaaagaaaaaaaaaaucaauauccucuuagaacuguaccaacagugacaaaggucauagaacuaacccugggcuauuuuaggggaauguauuucguugucuagucugugucuagagaugagcaaagggauucuacauccagccacaagagcaucucagaagacuccuaguggcaacauaaaaauaaguucuggcucggucagcagggacacauuuaaguccucauuagaaugacagcugucuccauccucaaaacuaacaaacaaaagccgucuuugaguucuggaagacagggaagcugggauccugagaaaggcuuucugccuagagcugucaguuagcaccagcuaauagcaccuaguggaccucaggaugugagaaacuaaaucccuagacaacuacaaaaagaauaggaguaacaccuggaacaacagggacccaagggccaagggagcugccucugggcagguaccugggauuucaguucugagaaggaaacaacaaaucaaggaaagcuuucuccucacuguaaucacacuagcccaaaguggguucucaagucacuuucagaagggagaagcaaagcacaaagcccccaguugcccaacaccuuggguaggguuaaacauuuuaugcaggaaucagcaucuuuaaggagcucaccuuuuaaaaggagccagcuuuuuguuguaaauggcacugacacuacaacaagaaaguugauuucacaaagaugauucauuaagaaauaaaauauucauggcugacagcuugaaggaucgccauacaguuauauucuaaugcaccuguccucucugacaaguccaaugugggaugucaugucgccaaaguuuuauuuagaaauuguuugucagagugagcuuucuaaugugaaugaaaaauucauccccucauuaagaagauuuuacaugaaaugucuaggauuuucaaugaacaccaggacaugaaccaauuacuguuaaacacuuaaagagacagaguccuaagcucacucagcaaaacucuuaauugcacaaauguggagaaaauucaacaucccgaaaggcaaaugggaauuuugauuuggaaaucuucuuuuguuuugucacaucuggaaaaccacuaucuuuaaaagaccugggggaauucaaaugcacuauuuuauggaauccacauauaucuuaucugacccuuuuguacuuacacauuggcugauggauuuuggcauuuucagccacuuguucaacucccgaagaaaaugauucaaguguuuuggaaggguguugaggugucuguagucauuucuuguguguguguguguguguguguguguguguguguguguguguguguguguuuuauauacuuuguugccuucauugccuucccaccuuacuuucauaauuuguguaaauaucaaacaggugccuuggaagcgaaugcacugaauaauuccaaaacguggggaguugggagagaggggaaagaaaagcuacaacagauuaaaauagaguugggcugcauagagagucaggagaaauccacaggggaauugcugguauaaugaaauagcauuuuacagucaugacaauggauuaaguugacauugagacucuuuuuugacauacagucuaguucaguuuaacuuacgggagaaaauaguucccaaaccuagcccuagacuagguauacacacacacacacacacacacacacacacacacacacacacacacacacacacacaccacacacacacacauauagccagacugucacuucaucacuuccaauuucagaaaagguuugagacugacaauaugaaaacucaaauuucuccuccuuaaacccagcagacccuauaaacuuuaagaauuuuauauucacuuucauaggauagaagcuuuggugaacuaguucgaggaaaaaguagccuugccccuguaucugugcaucacaaucccauaagacucuaacaaagcuuuccaagaaggaaggacucugaauaagcuuuuuaccauacagcuguugcagguggaaccagaauuucauagccuuuccuugugcuuuaauuauagcugccucugcaguuucuuuuagacauauucuuucucuauauguuuuucuuuucauuuacauuuauuucucccuucauauauauauuuuacauauauauauauauauauguuuuucuuuguaauauuuuauauaguuucuggaaagcaauuggacaauacauaucaauguguaccaagugucuuaaaacaguuuagaugugagaugaaauucuagacaucuaucuuaaaacuucucugaagaucagauacggaauuuuguacagagauguucaaugauguguuauuuaaaauugggagcaaauguccaaaagaagaggaaauguucuuuugugaagccaccauucaaaauuacauuuaggauuuauuucucauauaauuaauauugaguaaauaaaguagaauacagaaugcacaaaauguacucagagauucaugaggcaaaaaguaaaugcuuuuuuuuuuuaaagaaaaaauaccaaauguguacaauggguauggguauacuuuaaaaaaaaaaaaguacagucaggcgcagugguucaugccuguaauccgagcacuuugggaggccgaggaggguggaucacuuaaggucaggacuucaagaccugccuggccaacauggugacaccccgucucuacuaaauauacaaaaauuagccuggugugguggcgagcaccuguaaucccagcuacucaggaugcugaggugggagaauugcuugaacuugggaggcagagguugcagcaagccaagauggugcuacugcacuccagccugggcaacagagcaaaacucugucucaaaaaaaaaaaaaaaaaauuccauccccaucccuguacguggaugugauuaaaacucaacucuaaacugagucaaauucuacacacugcauauuuauacagcagguaagccagcuguucuuuaauauauagacuuaaguaagaagggggaagaauccgauccuucuauuagguaaaucaaacuaucaguuaaaaaaaaaacuuucccccuucaucuucugccauucgugagauauuaauguauugaguuaucccuauggaaacugcaaaaacuauuuacauaaauucuccagucuaccaaauugcaacuugcucaaauaaaucagagacugaggcucuaguuucucugaauuuugguuagcagaacucuauguuggaaaucacauccaacacauuucucacaaucugcccauaauuaguuucacugggaaaacugugaagaacuauuuugcugcuuuuaaauucauaauuuugguucaagagcccagaauaagauguuuagacagagugaaaacuauuuucuaacaaaucaauauuaauuuaucugacuguuguggucucaggagccaaaaaguguucuuguacugagcugacaggaaagauuuuauacugaccaaauguuauucaaauauuuauaagacuggauaauuuaguaaagaaaauacagauggaagaaggcaagaguauuuuuuuuuucaguguuccuucugcauuuacaaaugacaagaccuauuaaaaaaaaaaaaaaaaaguagagagugauugguagucccccgcaaccaugagggagcucguagaagggcuggccauuuagcccacuccacaaacuaacagagauguuauuucagaaguugccagugacacucucaccacugaaccuggggugccauguugguuaagaacgaaacacugcacaguggaagaaacaacugcccagugacacagcugagggcuagauggcuugguggggucucagaggguaugcauuaaugacuggguaacaugaauugaugggaaaagcagaagaauaaauggaaugcauugauugugcuuuauauuauuauuauuuccuuuaauucucucaacaacugucagauaugauuuuguauuuguccaugaacuuuuuguuagaguaaaauauacaugcaaaaaaauucacaaaacauacaugugucauuaaaugaauuuucauaaacugaacacacccaguagcuugaacaagcaacagaacauuagcaacaugacggaggacacuucaugcucccauccauccucuacccugacuucuaauaggaauaguuugcuuuuuagucaacucauuguaacuauaaucacauaggauacauuccucuguaucuuccuccuuucucucaacaucaucucuguaagauaaauccacauuguugaauuuaguucuaagucauucauucuuguuggugaguagucuccucuuguguggauuuauuacaacuuauuuauccauuccaccacugauagauaucugggugguuuaccagaugucuugaguaaucaugaauaaugauucaguguguuauaaugaauaaugcugcuaaacacacucuuguacuugucuuuuggcaaauguaugagcacauuuugaccagucauagucuuaaaaauggucuuuuguuuuuuuuuuuuuuuuuuuuggagacagggucucacucugucacccaagcuggagugcagggaccuaaucacagcucacuguagccuugaccucccugggcucaggugauccuccugcuucagccucccgaguaacuaggacuacaggcauacgccacuaugccugacuaauauuuuuguagagacaggguuucaccauguuggcccagcuggucuugaacucccgggcucaagcaaucugccugccucggccucccaaagugcuggaauuacaggcaugagccaccacgccuggccagaagugaaauuucuaggggaucagauauacuuauauuugauccuauguaaaucaagucuuccaaaaugguuauaccaacugauguuacuaucauaaagagguuuucuuucccuuuaaauuaucuuuuuaguuuagaauauuaguauuacaggaaacuuacaaacagaguacacagaguuccuccacgcuguuuauugucuuuccccuaaugucaacaucucacaugaccaugguacgcuuauugcauuacuuuuuuuuucuuuuuuuuuuuugagacagagucuugcucuguugcccaggcuggaguacaguagcaugaucucaacucacugcaaccuccaucuccuggauucaagcaauucuccugcuucagccuccugaguagcugggauuacaggugggcaccaccacacucagguaauuuuuguauuuuuaguagagaugggguuuugccauguucgccaggcuggucucgaacuccugaccucaagugaucagcuugccucagccucccgcaaugcugggauuucgggcauaagccaccaugcccagcccaugguaugcuuaugaaaaugguauguuacuauuaaguaaaugacagacuguauuuaggauuucacgaguuucccacuacaguccuuuuucugauucagggucuaauccaggaugucaccggauggcauuuaggguuucaucucuacguuacugcguuacugaugagagagaggguccagauggguucaggagcuugcugaaguucacaaagcuuaagaggggaggcuacuuuaauuuccacaacaaccacaaucacaacuuuuaucacuguuuucugaguuauuuugugccuaggcaugugugguggcauccaaaaggugaucaauucuuccugaauaucuacccuuuucuggacccugggcccacucaaaugaaaggcgaaccgcuaaggugcuuccuguccucaagccuucaauuuaguugcaguuccuugugucgggagcagccaaagaaacaugucacucacaguucuguggcuucucccucagccuacgacaucgcuggugccgguuccuggaagacaggcuaugcucuguuccaguuugugucacucgaccaagcagacacucaggaagucuuugcuaaaugcauuaaugcccuuuuuuuuuuuuuuaaaugguggcauuguaaaaacuuuauauuuaagauguauaaccgggugcgguggcucaugccuguaaucccagaauuuuaagaggcugaagcggguggaucacuugaggucagaaauacaaggccagccuggccagcaaggugaaaccccugucucuacuaaaaauacaaaaguuagcugggcacgguagcacauaccuguaaucccagcuacucgggaggcuacucgggaggcgaggagagaggaucacuugaaccugggagaaggagggugcagugagcugagaucccaccaaugcacgccagccugggugacagagugagaccccaucucaauuaaaaaaaaaaaaaaagauguaugguguguuaacagaaccuucuccagcuguaguggagcuuaggaugauuuaaugggaggcacagguaauaaaauagaggauggaagauaauccuggcucugucagauugcugugcuauuuugggcaagucgcuuaacuucucugaaccuguuuuccaggaacaaugaaaugaugauacaaauacuguccuggcucccuagguauaauugucaaagacuuugaaaacuauaacauacuauacacauguuagaaaguauuggcuuuaugacacuuauucuuaauaauuaaaaauaagucacaaaacggagaaaacuauuuauugucaguucuuuguuuuuguuuuguaaauggacucuugcucugucacccaggcuggaauguaguggugugaucucggcucgcugcaaccuccgucucccgggcucaagcaauuauccugccucagccuucagaguagcugggauuacaggcaugcgccaccacacccaccuaauuuuuguauuuuuaguaguaaagaugagguuucaccauguuggccaggauuaucucaaacuccugaccucaagugauccaccuaccucggccuaccaaagugcugggauuacaggcaugagccaccgugccuggacugucaguucuucuaauucgagaagaaaaugccuauauccauaaaaucacuauagaaaccaacugagcagaagaaccauuuuggcguagacaagccagaaagaaaaucauugaucauucuauuacuucuuaagugauuaauggugagccaaccuaucauguacaaauauugucuaucuguauuuaacacaauggagcuaagaagaauguaauacaaagcaacacagauaccuuacaucaagucacaauuacucuugaucuuaaagcuagacagcaauugccuugagguuagagacuauuccagcaaggauccuggcaaauaguuggcccuccgaaauuguuuguugaauauuuaauuuucuagucuaaaugcauuggaaacuuuuauucucugauuuuccuugaaaauauauuuuggagaaaaccuguauauuaguuuccuagaaguucuggucugcaagaaaaacuuaacuaaauuagacuaacauuuuucagauuuugccugggcagcaguaacuauguagacaaaauuuuaccagggccaggcacaguggcucaugccuguaacccuagcacuuugggaggcugaggcacgugaaucgcuugagcccaggaguuuugagaccagccugggcaacauggcaaaaucccaucuguaccaaaaaauacaacaacaacaaaaauugggcaggcaugguggugugccccuguggucccagcucccuugggaggcugagguaggaggaucacuugcgcccaggaggcaaagguugcagugagccgugauccugccaccacacuccagccuggcaacagggcgagacuuugucucaaaaaaaaaaaaaaaaaagaaaaaaaauuaccagaagcuuuaggggaccgaaagauagacucauaaugaaaaaaaaaagugcuuggaaaacaggagucagggucuuauaccuacgucugaccugaucugauaucauagacaagaaggcagagcauuucucugaaucgugaacugaucccaacuuagaaacauacucccauguugggaaaacacauugucuuuccauuugauacaguuaguucuuugaaaccaucuucucccaaagguaguguugucaaaaaauagucacucacacuuaugugaacucucagauggaccgccagcaagaguacaucagcaaguucggcaagugaauucccucaccaauaauaaauaaggagcaaagggaaugaagaugggcauuuuggcuggauuccaaaugcaaaaaccugccuaucuaccuucaaaaugaugcaagauugcaguuuguuuaauguucaucuuaugugcuuaauuaccgauagugcuugacuaauuauuucuuguuuuguagacuauuuaaacagagaaggaaagcagcuauauacuuucguauaccgaaugaggauuuguaacucauuuuuguaaucgcauaauucccggagggcuucauuacaaacacgaaagaaaacaggaugcuaaaagcaggugacagucuaauuuccacagguacgggugaaagcauuagagugaaguaauggaaaauaaaauaaaaaauagccuuuagauguuuccaucuauguaagguguuuucauguuaauaagagagaaaacugcaaauacagcaaagauaucuucguuugguacuguugucuuuucugaugucugauuugauccaacaucucugaaauaaaccaccaaauagaccccaguuuucuuauucacaaauguaaguguuugacaaguugcauacgguaucaucaacucguaucaugucucuguuuucacucuuuuacuuuaucuacuuuugacuauaaauucuuggucaucuaacgccauuacaccagauuucaaaauguuuagaaaaaugugaggcuuaaacuaaaggauaauaccagagacccuagagauuccagacuguuaggaauuacuucuucuucuucuuuuuuuuuuuugagacagaguuuugcuguuguugcccaggcuggaguacaaugacaugaucucagcucacggcaaccucugccucccaaguucaagcgacucuccugccucagccucccaaguagcugggauuacaggcaugugccaccaugccuggcuaauuuuguauuuuuaguaacgacaggguuucuccauguugaucagacuggucucgaacucccgaccuuaggugauccgccugccucggccucccaaagcgcugggauuacaggcgugaaccaucaugcccagccaggaauuccuucuaagcacaaacaauguugccucuuggauggaaaucagauuugguggucacgaggccaaaggccaaauuuuuuuuuuuuuuugagaguggacuugaagaccagggugguauuacauguuuggggaagugagagcagauccugaaaaaguaugagauguggauuuugcccuuauggcaugaagaaacuaauugggaauuugaaauaagacauuugaaacaacagcaaacaccaucuuugacaucauguugucaacaucagaggguccaccauuuaucaagcucuuacggugucucauacugagaugcaaucuucacuugcucuuacauugucacaaaagccugcccggcaugcccaaccagcucuuuuuccagauguugcaacugaggucuaugaccgugaaagaugagcuccuugcccucaacuucgauuuucuuaucugcguuuuucugccuuaacaaguacuuaggauuacagaaguuaauuuguuucuaguaaauuccuccuucccucccuuccuccuuuccucccuuccuuccagauccagggugaaguguagugacacaaugauagcucacugcaaccucaaauuccugggcucaagcgauccucccaccucagccuccugaauagcuaagacuauaggcauguaccacuaugacaggcuuuuuuuuuuuuuuuuuuucauuuuuuuguagagauaguauuuugcuaucuugcccaggcuggucucaaacuccuggacucaagagaccauagggauucuccugccucagcuucuugaguuucugggauuacagccauaagccuggccugguaaauuucaagcaagcaacuucacuaacauugucaggauagaagccagacuacuggguguugcagggaaaggggucuauaaaggaaauuaaggaauaaaauggguaacauuuacagaacccucacaugcaccaaacagugugcuagguucuucauacauauuaucucaugauauccucauagcaacccuguaaaauagguguuaauauaauuauaguuaacauuuauuaagugccaaugugcuucagagauuaaaccaagccuuuuauauguguuauuucauuugaugcucccccaagcccuauaaaauaguuuugauuaucaaucauccucauuuagcugaagaauaaacugaggcuuagagaggucaauuuguuccaaaguuaugauaauuacuuuacucaaugacaggggcaggaauugaacccaggggccugccugcaaagucuguacuucccaaugucaugcuaggccaucauucagcaugguauuuuuauuuauuguaacucagacaagcucagucaucugcccaaugucaugaggcuaaggaguuguggcucaggauuuccauccauggucuguccuccugaauagcaugcagcaccaccucggaagcaggcauggcugcucaagaggcagggcaguuguauuccgaaccccaguggauacuuacugagccaguacuaguuaugcuaaaaacuacagggaaugcuuugucuuaggggaucuuccucucuggugacgcaaagagaagggaccugcuagagccuauaaaaacaaaaucaucugaccuguaaaaggcacaagaggggauuugcaauugaacagaccugguuuccaauccccucucauccaggaguaucugugggcgcugaagucauuuagcuuuuugggcugcugggcuuagcuauaaaauguauauaaaacuaccuauguugcugugugguagagugaguuggacauuauacauccaaggauauuucuagauucauuccuccaauaaauauugucuuccacgugcuaagccuuccucuaggcccugaaguacaauagugagcaaaagagacaaaaaucucaguacuuacaaacuuacauucuucuagagaauaggagaauaaacacaaaacucauguaugucuaugucucuaucuauguccacaucuaugucuguaucuaugugauauaauaagugccacaaggaauacaaagcaggaaaaggaagagagggugcaaggcucagagaggcaggcugccauuuuauagugaguggugagaaacagcuucacugagaaagugucaguugagcaaagccuuuuggagaagaacagcucauggugcuacguggaagaauacuccaggcagaaggagcagcaaaggcaaagcgucugagacaggaacacaccuggcaugucugaggaacagcugaagaagaacaagaggccaguagguggaaaaagcucacaggggggaggcaggcgggucagagggggggaggcaggcagggcauacagaggguuugguguccuacugugacgauuuugccuuuuaaucagccugaaaugggauauaaagucuuagauggaugaaauaggaauaacuuuucucguuuccuuccucgucugacuaaauuaacagaugaaggaauugucaaaauacaaaaccuucuuccuuacugaacccacugaccuggcagggcuuguaaggaaaagaauuuguuucuagaagagcuauuuaaauguccuggaccucuucgaaccagcagaaauaggaaccaguuaacuuaacaggcaaaguaauaagacuauacagaggaaacacauuuuccuacuuuaugccuuaauuuuaaguagaguuacaagauuuccuguaggaauucagaguguuaucuuauuuuaugccccaaacuagaaagagcguuccacuggguuugccaagcuguuaagaugaaaauaucuguuugagcacagcauaauagaugagguguuuaaggcauuuuccuuuagauuuuugguuaaucuucuuuuaguuaauuuucugagauaaaauccaguuauaaauaaccugaggguacccuaacugggcuguucugagaauggcaaaucuuuaauagccagaacuucugccuuuuagagaucucuagagaaagcaguacuuugaaaauuauccaaagcaaaauaagucgaaagcauuaacaaauuaaagacacugggagagagaagaaaggggcgaaugagaaacuucuuugacauucacaagacagcagaucuuacccuugaaacuccuuuaaaaaaaaaaaaaaagaagagucaagcauucacaaucuauuuguugauuaacaacagagaacuggugaguuucugucauaacagagucuuggaaaauucauccuuuuucacaaaaggaaaggagagaaaauuccagacaaaacacccaaagugcagaagaaagggcauggccauaagcagccaucacuuagacuaaaguacaauggguacaauauuaaaauaagaaguuuuagaacugcuuuuaaagauagcuggcggaagaauuaaaaaaaaaaagaaaggaaaaaaaccuuaaguguuuuccguuguuaaaacguaaagcaaaauuuauaaaaggauuauaagguagcguagguaagaaagucauguaaacuaguugaaauaucuagaguuccucagcacaaaaagagcagguuggcagcuguccaucugcaguguauauaguaccauggagccuguuuauaaaaauaagagagggugggagaccuaaaguggguauaacucaaaacaaaacaaaucuguaggacuagauaagggagggugauuauucccagguacuaauaggcuaaaugguaucaggagaaagaauuagaacaaguuucuacuaagcaauaaaaguguggaagaaacauucuuuuaaaaaacgaaugagaugcccuagaaaccuguaagucaauaaccgugucaccaauuguaggauuauccaggacaugcagagccuacacugacaggccaguugaaaggguagacacaguuguaaucgacuaggaaauugccacuguggcuuagaaaaaccaagucuuguuuauggguuugccuccaucuuucuaagcuucuauaaaagguggcuggugaaauguaccgggauucugacgauacucaccuugagauaagggauaugaagagucgggaagagaggcaaagugaauuccauauagccaagaacagacagaaggaaaaacagauuaaauagcaaucaaaacacuguccuccacuuaaugaaguggacugucaaacugauuugcuauuuuuuuguuuuaaucauucuagccaggcagaucagacacucgagaauuagagaaauacuaauuuggacuagacacuggaaaugucuuauauacugggagcaucauaaagcuagagaaggcuuacaaagcaagauggcugccacugagaucagcacacugggguuuuuaacagaaaccuauuacuugauuuacugggagugguagaacccuaaagaagcggugaacauccaacacugaaauuugagcuggcucuuccucagaaagguuucagcggcuuaaucucaugcaaucuugcaacauuccugaauucaaacccaugaaguagagagucagcccgagacccucuucagaauccaccgagucugcugggcaggaagagcuagcuuguugaguuguccugcugcaaaugaaauaguaacuuucucagaagcauaggauauugaaagauuccuuuaagaggccaaguccucaaaggcauguaugcaacgugaagucaugggggcaggccuuccugguuccaaugcauguuuucacaggguugugucucuaugcuugaaggggagcucuugggccuaucugagggaucauuuaccacuugcuguaggaaaguccaguggaaaucacuucuaguggugagucuuggccaaauauacuccuauguagaaggccuguguaggagguuaugcuuggaacaguugaguagauguucuggcaaccugugauggccuuacuaagucaugacagucagccaaaaaaaaaaaaaaaaaaaaaaagaaaaaaaucuucuggucacagacacaguugaagguguuucaauuuuuguccacuacccauugccaacaugucuuuaagucacuugccaucagaaucuguaguggagaccauccagacaucuuuugccaugaauaacaucaaguucuuccuguauaccaggcgcugcagugagcccuggccaggcaccacaucaggcucagacaaguccauaauuuuuugaaaucgacccaguuggagguagcagaaccaggacugcauuccaagggagcgggacuugacagcuuuagcaacugcgucugcuuucccuccgcuccuagccucucacucacccaagaucaugucuguucaggaugcagcucucuauucaacuccccaacucagggccuccuuuccuggcggcucaaauggaagcuuuuuuuuuuuuuuuugagacagagucucgcucugucgcccaugcuagagugcagcggcgccaucucagcucacugcaaccuucaccuccuggguucaagcgauucuccugccucagccacucgaguagcugggauuacagacgugugccaccaugcccagcuauuuuuuuuuuaaauaauuuuaguagagacaggguuggucaggcugguuucaaacuccugaccuugugauccgcccaccccggccucccaaagugcugggauuacaggcaugagccaccgugcucagccagaaccuuucuuuaacuugauuacuguggguaguuacacauuuucaauggccacuagaaugaagucuucagagacacuaggaccugaccugugauugccccucgcuauacucccagggacuaagcacauggccuggcaaaaaaacauagccuuccaaauaucucguuuuauuuuacuauuuuauuuacuuuuugaggcagggucucucuguugcccaggcuggaguacagugguacaauaacagcucucugcagccuugaacuuccggccucaagcaaucguccuccucagucucccaaguagcugggaugacaggcaugcaacaucaugcccagcugaguuuuaaaaaauauuuuauagagaugaggugucaguauguuccccaggcuagccuccaacuccuagccccaauuaauccucccaccucagccuccaaaagugcugggauuacaagguauaagccacugugccuggcccuccaaguauuuaaaaugaauggauaucucccaaagacuaagcuguaaauggcugaacaacuuacauucuuaccacaucugcuagaugguaaauauuugugcugcuauuuaaaagaaaaaaaaaaucagcauaaggagauagucaacuugaagggugaugaccagaucucugauaauaggagcuagucccuucuuaauuccaauuaggagcuacacguugguaauuagugacauucaaaccucuaucuaaaacaaauuuuuaaacuuuuuuuaucaagcauaauuacaugcagaaaagcacauacauaauaagugcacgacucaaauuuuucacaaacugaauacgcauggaaccaagacccagauggaggaagagaaaaaggacuagcauuuaaagaaggccucugggcuggguguggugacuuacacccguaaucucaguacuucaggaggccaaagcaggaggacugcuugaggccaggagcuccagaccagccugggcagcauagcaagaccucaucuuuacagaaacacaaagauuagccaggcauggugaaauauaccuguggucccagauacaaaggaggucaacaugggaggacugcuugagcccuggaggccaagccugcacugagcugagaucacaccacuacacuccagccugagcaagagagcgagacccugucucaaaaaaauuaaaaauaaauaaauaaaaggggccucugcaugugaaguaaguguugaugcuucaaaaaccaccaagauggcagcuucggaaggcaaagaaagagaaacgcagggagugguuggggacacugccugucuaugguuuugagcacuggcugcaagcaaaugugagguaagcaaaaggaugagaaagacagugagcauuuacugaauuccuaccaugugcccuaagguauuuuaguuaauuauuuuuaaaacaaagaaauugaggcuuagagugauuaaugcacuuguucaaggccacagaugccaggccugugugacaccacagccccuuuaucccccacuguaauucacugucucaucucucagccuggcauuucuuuccuuuaacucccuucuuuaaaaaaagauggcuauuuucauaauaaugacguuaguaauagcuuuaauuauaacuuuguugaguccucagucugcaacaaguguuuucccuacauuauuuccuuaugcccaucuuucuuaugagaaaacugagacuuggagaaauuaaguaaacuuuucugagcucucauagagaucucaguaauagcagagcugggauuugaauccaggcagccugguucuauggguugcacuguuagacaucgucucuaaaaguaccugcaauuauaaccagaauuccuuuauaaauccguuccucuaauuccucauuagaaguggaaaugaacgucuuacguacuucaaacacugguuagaaggguugacagaaauuuugugcccuagacuagagauuucucuccaguuggcccuuguugaguggcaucugagagggucugcaaggccacagccaagcucucccuagggcauggcuggaagaaaacagguugaggggccagaaaggaggggcccaggguagggccugggggcucacaccuguaaucccagcgcuuugggaggccaaggugggcggaucacuugaggccaggaguuugagaccagccuggccaauauggugaaaccccucucuacuaaaaaagauacaaaaaauuagguggguaugguggugccugccuguagucccagcugcuuggaaggcugaggcaggagaauugcuugaacccagaaggcagagguugcagugagcugaaauugcacuacugcacuccagccugagcaaccugguaauagccauuucucuagagccuguuaccuagugcauuuccuaguaagccucaauuuaggauuuagauugucaccacagcuccagagucauccaagcgugaacugcuuccuuggagaucuugucaccugugucucacaggacucauuucugaccacccaggugcagaagcacuggaaacugugguggacacaagcuucaucgaagccugugccaaccauucaguuaucacccuggugcuuugcaaacaucauuacaaggcuuuaauccaggcaucgaggcucaaguucacccagucccucuccugccacugugacaugguuauucagcagguucagcagugcauacagguuauaagaauaaggacgaagccauggggggaaaaauccccccucuuucugucuuaggacagcagcggggguuuuuaccccugauugccucauuaaaaaaaaaaaaaaaacaaccuucacgaaaguugggaauuacuauauucaauguagaaugccauuuguucauucauuugauauucaacaaguauuuacugaauugcuucuaugagcuauaggggauaauuuaaaaacuuguuuuaccucgagaaauuaauuuccccagaagaauuaaccauaagcagagucuaugagacccuggcuauugggacacuuaagacucuggugguugugguaaaccagaaucaggcagacaguuucagauuuaaaggaacugauuagauuaggccgggcaugguggcucaugccuauaauccuagcacuuugggaagcugaggugggcagacugccuaagcucaggaguucgagacaacccugggcaacacggugaaaacccgucucuacuaaaauacaaaaauuuagcugggcaugguggcaugcaccuguaaucccagcuacuugggagacugaggcaggagaauugcuugaacccaggaggcagagguugccgugaggcaagaucgcaccaccgcacuccagccugggcaacagagugagauuccgucuccaaaaaagaaaaaaagaacugauuacauugguaggggugagaagagagacaaggggagaagaggaggaagaauuacauauuuaaaagaucaguaaggguuuuuuguuuuuuuuuuaaucugacacagaaaaaaugagcucugaaucuugaaucaagacauuguaucaauuccgguuauccccaugauggcaggucauucaagcuuggaccuuagucuucccaucuacaaaaugggaaggucaggggagauguccuuuaauggaccuugugauucuaaaguuugaaaaacuuaugauucuuagaaugaaaagaaguaaugugugucuauacauuuauuuagucaaagaaacugggucauugucaucaagcaaaacagaaaccagaguccugaauguguaucaacagaaucuugaggaagcagauuaccugccauccaggaucuuaggguuaggagacggaaagcaauuucccccuuccuguuugaggauugagucaugcccugucagagcacuuaggccuggccuuacacauggacaggugacagaccaauacuuugaucaaugauuuguaguugauggaagaaguccccuggaggacuggaagacagaucaguggagagacuuugaucugugucauucagcuuccaaaaccuuuaagcucacauaaacauagacucccaaggcacugacgucaaugauaaaucccauguucuccaaaugugcuggccccucaguuauuugggaaaaaagagcccaugaguaaaagggagauaaacauacacacacaaacuuacuccaaagcaaaugcugagucuucucucugcuggcuuuuggcucugcuaagaggcuaucugcgagcaagacuuauuguuguuuagaaacuagaaaucuacaacucagcagcucuugcucaucuaaaucagagugggcgaugcacuguaaguaggccaccacuccccacguccacaaaaauaccgcagaaucaguaacccaucaugacacccuuucccaacgagcccaugcgcagugucaaaauccuuuucaacacagcacuucaaucggcuguuucaauugaccagacuugggucaugaaaugaauccuauuuuacauccuucaucuaaauuguuaccggaugagcugggagggagggcugugugcacuucuugcguauaaacuuguguuggugacuguaguccaggcaauugccaaauaagaauagaauccauaaaaaccauuuugaguaggaaaaacagguugcagucuggaugcuuggaaaaguaggcacuuucugacugaagauaaucacaaccaacucucggacuuuccuugauccccuucuaaccccuaaguguuucauuuccagcagggugacaggauagagaucugcuucagggaggcuuggaccccacccaccacagaguccacagaacaugaauaagucagcugaugguugacuaaaacguauauacaauuuuaauuacauauacuaguguauuuaaaauuucauucuaaacuaauguaaucaaaacuaauguaaauaaacauacagugguuaucucugaaugauaggacuacaggugauuuuuauuuucuuccuuuaaaacuuuggccuuugugacuuuuuacagaucgcaugcaugugugugugugucuguguguacauggguguguauggacguuugcacgcagguguguuuuaauggaaaaaggggggaaaagugcaaauuucuaagggaugcaaagacauauuaaaaauccaugagacaaugagauagcauaaggacuagaagagcugcaggucuuuccucuccugccagauuauuaauggucauuaucugaggguuaggggcaugugaauuuuagacauauauagugagccagagccuaugaauggcucaucagcauugguuccaacguucccuuccucucuucaaucucagagugacucuugcuaaacuguuggacagauaguaacagaauuugucuaauuauacagaaugggugaaaaucuuucuauguuccuguaacuauuggcucagucaccugauuuaaugguccuggaauucauuuuuuaugacuuuauuaaugugaaauucacauaccauaugauuuaaccauuguaaauauacaguuugauguuaguauauuuauccaguugugcagccaucaccacagucuuguccuagaacauuuucuugaccccccaaaauugccccacccuuuccagguaauccccuccacucacucccagccccaggcaaccaucauucuguuugcugucuauagaguuucaucuuuucuagaaauuucauauaaaugucaucauauacuauguggucuuuuaugaccggcuuccuucacuuagcguaauguuuuugaaguucaucuauguuauuaaagguauccagaguuaguuccuuuucauugcugaguaguauuccauugugucgauagacuacauuuguuucuccauuccccagcuaauggacauuuggguauuuccggcguuuggcuaucauggaugaugcugcuaugaacauucaugaacaagacuuuguauaagcauuuauuuucuuuccaguagguucuuaggaagggaacugcugagccacauauguguguguuuaacuuuuuaaggcacuggacaacuguuuccaaauucauuguaccauuuuacauucccaccagcagugaaugacaguucuaguucuuccacauuuucacaacucuugggauaauaaaucuuucugguuagagcuaagcuaguaggcaugucauggucuggggcuagaauucauuuuacaguggcagcgaugaggucagaaaaggccucagauuggcaguauaaaaauuaguuccacaauuuacagcucacagcucaccaguuguaggacuuuaagaaacucacuuaauuagccaggcaugguggcaggcaccugaaaucccagcuacucgugaggcugaggugggagacucucuugaaccugggauguuguaguugcagugaacugagauugcaccaaggcacuccagccugggugaaagagcaaagcuccgucuuaaaaaaaaacaaaaacacacacacaaaaaaacaaaacacacacacauacacacacacacacacacacacacacaaaaucauuuaacuucucugagucucagauuccccaucugucaauuggaaacuauaauagcucuagauuaugaagagucaccaguugagguaagauguguaaaagauugugccuaaguucccauuuauuucuggaacaaaaaguauauugauaaauauguacauaaaauagaaagggauaugaaaauagacggcguugguauucuuuucuucuguuaaccaagccaagauguucacuccauuguccuuugcaccuaaacuucuugcacucccccacucaccagugugccaugaagaugaguugcaguuuugucugucucaucuucuccacuuuucuugucauugacccaccccuucucaucauuaaccacuuuuagugagcuaagaacauaacagaaggcgcccuucuccaauugugaauacuuccucaagccuucuccuuccacaaagucaagaaggacuagacccagccugcaauaggagcguuuaugacaaaucacaaauuugaaacccuuuggcuaucauauuuaugcagcugguggcaaggguucauauuugaagcuucagaccaaagaaagaguuugcuccucagcccugaugcugcaggcuuggcuucugaguguggucaccuacugacccuacuauuuuaagaaaaacuggaaaggccaguaauuuggauaugguccuagcucaagauacauuacagacuguccccaauucccuggauagcccguggcuggaaacagugcauuccugguuuauugccaauguccuugauuugcgugcucugccauuuacuuagaacaaucaggcuacguugcaagccagggcaacaaaaacaccgccaggagccaaauaggcucacaggggaugcaccagugccuugguggcccugaacacuuaagugauuuuguuccccuuccaauuucgugugguacauuagcuuuuaucgauagcucauagcuucagcaacuguucuucguuuuacuaaccugaaggacagaggaacaagagguacccacacagcugauaugcaagaaaaaaaaaauagcacgggaugucuugaucagucucaaugauuucuucccuugcuacagcucuccuuuaaugagggagucacaauuauugcaaguuaaucaugucucagucccccagagggagaaagagugaaaugaccacuugaaaucugaccguggcucccuccaagaaaauccugguggcacagcgaggcauucaugaaacugcgggcucugauuuauaucacugcuauggagacuggcagaaggauucuucgguguuuucauaauacaacuacuaaacaaaaguuagcccaggagcuagaugggaaaucuauguuauggaagagaaagagaucaauuuuuucauugcucuaaaaaacuuaacauuuccaacuagaaucugcaccuuggagcaaugcagugagucuaugacucacggaugcugugaaugcuguaacugcuucccuuucugcguaguaugugaucaccuacgguuuuuaaaaaccauuauuguuaaaaccaaaacaaucacagauaugauuuguugaguaacuaucacaaaggccagacacaauucuuguuuauuuuuugagacggaguuucacucaucgcccaggcuggagugcgguggugcaaucuggcucacugcaaacucugccuuccgaguucaagugauucuccugccuccgucuccugaguagcugggauuacaggcacuugccaccaagcauggcuaauuuuuguauuuuuaguagagaugggguuucaccauguuggccaggcuggugucgaacuccugaccucaggugauccacccaccucagccucccaaagugcugggauuacaggcuugagccacacugcaccuggccggccacacacaauuccuugcacuuuaccuaccuugccucaauucauucucacagcaaucuaaggaauuauaaauuuguauugcuauuuuguggcaaaggaaacugagguucagggagcauuugaaauugucaaaagccucagcaaggaagagaaggagccaugaugugaaucaaaguccacuggaguguaaagauuuaucuaugguguugaccucuaucugcccuucaccugacguacuucuuuuaaggaaaucagucauuuaauaagucuugcaaguugucuuacauuauuuaugagauuggcaaggaauaacagagaaagugaagaagggaaaaaaauaaaggaagagaguaagucaaggaaaaaaaacugaucgcauccuaaaucauucucuuaaacauauccaucgcacaaacauacaaccuuuagcacuuuaaaauguacggaauuuauuuuacauauuaacauauguaauauguuaauaaggguguuuaacauauuaaagcacuaacuuuaaaaaauggaauuugaaagccaggcgcgguggcucacgccuguaaucacagcacuuugggaggccaagauggguggaucacuugaggucaggaguucaagaccagccuggccaacaugguaaaaccccaacucuacuaaaaauacaaaaauuagccaggugugguggugcacgccuguggucccagcuacucggggggcugaagcaggagaaucgcuugaacccgggagguggauguugcagugagccgaguucacaccacugcacuccagccugggcaauagagugagacugucucaaaaaaaaaaaaaaaaaaaaaaaaaaaaggaguuggagaaaaauagccacacagcucuguuuuuaauuaccaaagauccauuguucaucugugaugugucagacccugugcuaacagggaaucucagagcugggcccaaugggaccucaacagacacagccagaaucacaucauggagguuaugugcagcccuguuucaaaaagccaaauccagggcugggugcaguggcucaugccuauaaucccagcauuuugggaggccaaggcaggcggaucuccugaucccaggaguguaagaucagccuuggcaacauggagaaaccuugccucuacaaaaaaauacaaaacuuagcugggugugguggcaugcgccuguggucccaucuacucaggaggcugaggugggaggauggcuugagccccaggagaucgaggcugcagugaaccaugacugcaccacugcacuccagccugggcaacagagcaagauucucucucaaaaaaaaaaaaaaucuguaaaguaaaaaagggcuccauucuguauuaucuucagauauccaacaucaaaaauuuauaaaauaauuccugaugaauuaaccauagauuuacuguaugaccccguaauuccacucccagguaggugguuagguagguaguuuggcuugauauaaauacauaucccuaagaacuggaaauagguguuccaacaaaaacuuacacagaaauguucagagcagcuuuauuugcaauagucaaaggguaaaaacaacacaaaugcccaucaacagaugaaaggagaaaaauauuugguauauccauacaaugcaaugauauucagccacacaaagagagauggacaugcuacaacuguggcugaaccucaaaaacacgaugcuaaguggaggaggccaaucacaaaagaccauauauuguacaauagcauuuauaggauguggacauaguuuuuugagagccaucauuccaacucacuaugccugugauaguuuguuuaugaagcaauagaaaacuaguacagugaccacccauuaauuuauucauuuguuuguuuugccgguucaacagauacccacugagcacuugcugugugcgaggcacuaugcugggcuccagaaacacugaguaaauaagagacuucgugccugccugaauacagcuuaugguugggagauucacucuuaggcccuucucacaaagggagccacaaugccgaaagaucacgaggacuacugaugguuuugagcugugacacuaaaucagcagggaccagugguccauuggugacucucugaugaaagacaaguacccucuucccagguacaaauggaauauaaugcugcauauuauuucagaagauucuaagauacucaggguccauucaucaagguccauaguuaagaacacuuggccuagagauuuuugagaugacucugaaaaagaaauauacuaaguagagaauguacugcgagugucugcucauuguuuccaaguuaaaacuuacuuggcuggcugggagugguggcucacgccuguaauccuagcacuuugggaggccaaggcggguggaucaccugaggucaggaguuugagaccagucuggccaacauggugaaaccccaucucuauuaaaaauacaaaaauuagccaggcuuggugguggcgccuguaaucccaccuacuugggaggcugaggcaggagaaucgcuugaaccugggaggcagagguuguggugagccaagguugcaccacugcacuccacccuggcaacagagcaagacuccaucucaaaaaaaaaaaaaaaaaacuuggcauaaccaccaugaugucuaauuguauguguccacuugacugggccacaggauacccagauauuauguuaaacauuaucucuaguguguccaugaaggcguuucuggaggacauuaacguuucgauuaguacuaugaguaaagcagacugcccuucccaguguggguggcuucauacaaucuguugaaggccugaauaaaauaaaaggcugagugagaaagaauugccucucuaugccugacuucaagcugagacaucagcuucuccugcccuuggacucagacuuggauauggaauggaacugaugccuuuuuaucuccugcuucucagcugcucagacucagacaugaacuguaccauugguuguccuggguuucgaugucucagucucuguaauuucaugagucaauuccuuauuuaaaaaucuuuauauauaucuuuauacauauauacagaaaaauguguguguguaugcacuuguguguuuauagaucuauauugaauacuauauauauacauuauacacuguauuaguacacaguguauaguacauacacuauaguguguauauguauacucuauauacuauaguguuuauauauauuauuuaguacauauaauguauagauauagaaagacacacccauagguguguauagauacagaaagacacacccauagguguguauagguacagacagacacacccauagguguguauagauacagacagacacacccauagguguguaaagauacagacagacacacccaucgguguguauagauacagacagacacacccauagguguguauagauauagauagacacacccauagguguguguauagauacagacacacccguagguguguauagauaugcauauaucucucucuauauauauaauagauacauguguguaucuauaucuauacauagauacacacacacauauaguauuaguucaauuucuccagagacuccuacuacaaccaucaguaucaccaacaaccaaaucuuucucaaauguuuaucaccagaaagcaauuuuagccuugcacuggauauuacaaccuugaauagaaaacauuagaggccuggaaacaugguguauuuaauuucuuuugugcuuuaccuauuucaacaauuucuggacuuuuuaagacagaaacuauucaaccaacuuuugaaaaaucaaaagaaggaaaugaguuaaagguuuuuaccuggaauucaaacaaacuaaugaaagaugacauuuauaauauuuagagaaugauuggaaaaaugggccuucacuucaugauauuaaauaauuugugauguuuuugggugugaugaugauacuguaauuaucauuuuuuaaagagaccuuacuuuuaguuacucaaaaugucuaugaauaacaauauauaaugucuugcauuuacuuugguaaauuuucaggcaugggggaaguggguggagagagauaaaacaacaauggccacauguaauaauuacugaaucuggaugguagacucaugggauuuaauuauacucucugucaacuucuguaaaucauuuuacauuuuaaaauaauaagcuggagccaaaaauaauuuuaaagccagugugaauaaguuaauagguggauagguggauggauggaugcauggacugggagaagacuuacgucccagcuugaagucaggcagagggagucaauucuuucuuacucagucuuuuauuuuauucaggccuucaacagagaaggaaaaaaggaaagaagcaaagagaggaagaaagagagagagggaggaaaggcaggcaggcagacaggaccucugaggcugugcacaguggcucacaccuauaaucccaacacuuugggaggccaaggcaagcacauugcuugagcccaggaguucgagacaagccuaggaaacauggcaaaaccccaucucuacaaaaaaaaauacaaaaaauuaguugcgaguuacggcaugcgccuguagucccagcuacucagggggcugaagugggaggaucaccugggccugggagguugaggccacugcacucuagccugggugacagagugagacccuaucucaaaaacaaaacaaaacaaacaccugggagagaaauccucccuauagccugagcuaagcuggaucauuuuaacucccuaauuuuagcuaguucccagacauacucaagaacauccacacauuuugcagugcagcagagcacuaaagcggauguuggcacugcuaacaggaagaacacuucuuuuucacgcauuaucauuaccugaacuuauaugaaguauuuauuuuguguuuguugccuuaccuucuccacgauaaucuaagauccaccaggauagggacuuuucuuuuucacaguaucuuucccucuuagaacaaugucuggcacaugauaagagguccauuuuuuccuucuuuuuucuuugaaugucaggcaauuugcauaaaugaauaaaucaaagucuagccaauucauugugaucuucauugacugccuacuauauacuaggucuuaugugaggcaucaagauagugaaugggaggugcucagaacagacguuauauccaaagggggccaagugugggaauucuucaauuaccuucacagaaguaggccacuauucauucauccauccauuuacugauucacaaauauuuauuaagcaucuacuauaguggaauugacaaauaguauaaauaauagcacaguauaaguaaauauuugguaaaauuucucaacuaauacaaucuacauuuuaggauaugggcgauggaauaaggaugggagcuacuucauauuccacaauuccagccaaaaguuuauguguuugugcauaaugcuaauaugcggcuagaaaauuguuacaauuuuucuuuugagaacuaaaaaguuuacucgugaaaaugcuauuuaucuaaggcauuauagcuauuugcuauagcuaucuggauaugucaccaaaucacaaaguucauuaugcuuucucauucaagcaagcaaaaaauaugucuacuuggaaaccaccuguuuauaaguaagugaaaauaggagaugcaaauaaugucuuuaaaaaaaaaaucacuguuaaaucacauuaaauuuccucuucauuuucuuccuuaaaacuuaacuaucgauguccauccuuugaaaauaaccaucaauagcuauuaguguucuguuugccagcuguuauauccucuaacccagaaggcuauggagaaauuuuugaguacauuacucgcccugcucuuaaaccaagagaaucacagaagaucaugaguuuuagggacugacacauaaaaugcugaacaugaagguauuuucccuaaaaccaaauccauaaugacaggaaaaaucugaaguuuuacuaacagcaacaugcccucuggaaugggugcuaaugauaaaaaucgagcuauaacacauuccauuuuuaauuaauuuuuaacacuguaaaaaaagcuuuuccuuugcaauaguagacccaguucuuccugguaagauucccaaaaguacugcaagguaccucugcucuuuucuggaaggcagagcucuucuaauuuauuagaaauugcaggaagggaguagggagaaggggaauucagcaggggggaaaaaucaauuccauuccugccuucuccacuucccuuucaggcagcucagcccaagcuuuaugcugggaaacaaaguugaaaucaguugaacucauuuuaggccccuucauccugcuucucugcaaagguggaggguucuccccagugucucagauuaccccgagaacaucaaggagccacuucaucgauuauaguugugcaacugaaaucguuuguccuuuuuuucauauauauauauauauauauauacauauauauauauauauauauauuuuuuuuuuuuuuuuuuuuuuuuuuuaaauuucaaaacuaguagauauuggccagccgugguggcucacaccuguaaucccagcacuuugggaggcugaggugggaggguaacuugagcccaggaguucaagaccagccugggcaacauggugagaccccaacuacaaaaaaguucaaaaaauuagccagauguggugacacaugccaguggucccagcaacugaggaggcugagaugggagaaucacuuaagccuagaaguuugaggcugcagugagcugugauugugcccugcacuacagaaugggugaugaaguaagacacuaucucaaaaaaauaaaaaggacauguugauggaacacaauucaaacaugacagguaaagaaaaaagaaagaaaauucccuccucaaagccuucucagcuccuaagccacacuccgugcuggugauagaaguuaucuaccacuauuuauaauuacuguuuaucaccucaaccccaaaucauuuuaugaaaauacacacaaaaacauucagcuauguguauaguuuuuuuuuaaagacaugauaauacauguauuauucuucaauuugcuuuuuccaacucaaaauuauaucauggacagccauuauacauauacagauacauacauauauauacauacacacacauauauauacauacacacacacacacacauauauauauaugacuacauauuggguacagcauaugcugcucagauggguacacugaaaucugauaaaucgccacuaaagaacuucuccauguaaucaaaaaccacuuuaccccuaaaacgauugaaauaaaaacuuauaucaugcacagccaauuuauacacacacacacacacacacacacacaaacacacaauguauguauauagagguaucuuuuuaauuucuuucauuuuuccuuuuuuugcuauagaguauuuaaaacuuuggaaaaacuguaacucaaauaccucuuuauuaauaucaauuuagaauguaauaggucaaauaacuaaauaaauauguaugcacacaaaauaacgcuaaaaaagcauucauucuucuaauuggguguccuggcacauucauucaaauauuucuguauuuucugguacagaauggaauugcuugaucaaaaggcauguguuuaauuucggucaaaaaugccaacuuguucuucaaaauaaccaaaaacaauuuaugcuccuauaaacagcagauguucuuuucuccuguaaaggaaaacuuuuuggaaaaucgaguuaugagcaugagucaaaguuuuauuauaauguuacuacuagggaaaaggccucuagugaucaauucaaagauucagccuugguggaggcauuuuauaggaaaaugaaaugacaagauagucaauguuaggcuagauacaaaaggaaaauaacauuugguuuaaggucacuagacucuugaccgacagucagcuuggguagaugggugacugauuucucagaacaagucuuaaucgcauuaaaguuuaucagaaaauugcuuaagcaauuuaucaggaaugaggcugugaauuacaucaugcaucauggaaaaaaagguucuauuccagaccagauucaggacaacucuucuuuuuuauaccuuuuuauacuuacaugcucaccaacauggaaguuaucugccuucuuaacuuuugccaaugucauggugaaaaacaguaucucauuguucaauuuccauuuuuaugauuaaaaauaaaguugagaauuuuuucauguuugccaauucuuuucaaugaauuucuuguucauuaucuuugcccauuuuucuauuaggagguucacauuuuucuuuucccuuagccaaaacucuuugcauaugugagauaaauuauuuaagcacuaucacacacugcauaaugacauuuugaucaacaaugaaccacauaugcaauggugaucccagaagauuguaauaccauauuuuaacuguaccuuuucuauguuuguauaugcaaauacuuagcauuguauuaaaauugccuacaguauucaggacagaaacaugcuguacauguuugcugccagggagcaauaugcucuaccuagccuaggaguauggcagguuauaccaucuaggauuguauagguauacucuaugaugguggcacaaugacaaaauggccuaacgaagcauuucucagaacacaaccuccucucuaagcaaugaugacuguauauguaaauguguauguucgugaauauguguguuaaaucuauguacauguauauuucuauuucauaagauaguacauuuuuuuaaaguacugaauuauaugccccuucccauuguacugaaagagaucuauuccauuucuuuccucuuucugagacagagucuugcucugucacccacgcuggagugcaguggcaugaucugggcucacugcaaucucugccuccuggguucaagggauucuccugccucagacuccugaguagcugcuauuacagggguguaccaccacaaccagcugauuuuuguauuuuuagcagaaaugagguuuugugauguuggccaggcuggucucgaacucuugaccucaagcuauccacccgccucagccaaccaaagugcugcgauuacaggcgugagccacugugccaggcuagaucuauucaacuucuacuucgauaaaagucacuacaagccuguuacucccugcuuuaaagcuuucggugccccuacuugccuacaaacaacguccaggccuguugcaaggcccuuuccaacgcagucccugccuaaauccuuaucauuuuccucugucauucuguucuggcccuuuaugcaccaaaaaaauuauuucuagggaccagacugacucuuuucaacccugaacuccuuuccuaugcugaucccucugccagaaacauccucccuggauacucauauuugucuuccccugucugaaggaaacuuucccuaauuauuugccuugcccugcaaguaaaguuagauaaaguuagucaccuccuucuuggguaccuugugcgugcaccgacuuuuuccguacaaaacucauuuugauugauuuguucccaagucugucuucuguaaaagacuucgaguuacaugagaguaaggacugggccucaauuuucccuggauccccugggcuucacacagaaucugacagacccaagguggaagucaggaaauaagugaugaaugaacaggcuaucuuuucugauccacacagcaugagggaagcaaacacagaaguuaggagagguggugcgucucucuccaccccaaccaauaaacaaaaacaaccuuaaaccuugaaaaugauuaagucuauacaggcuggaaacugggagaagacagguugucuucccucuucgguuagcucuagaaucugaugggcuacagcucugagcaggaaguauuaacacaaacaucaucaaagugcuuggggaaauuuuauugucugccacauuuacaaauuggaaucgaucuucauucagccaguuucgccaaaguuucugcaaagugaacauagcaaaagauagguggugccuuucagaucaccugugauuaaacucacugcauuugucuucaaacaaaaguguuuuuuuuuccuccccgcaacauacaauuuuagucagcuaacacuaaauuagacacccacucagauuuauuaugauaagaacauucaguaagcuaauuucaagaagaugacuccuauaaauucuuauaauuuauuauuuaguacuuugguuuuuaaucauuaaguacgugaagacuuuguaggucaaaccuguauuaaugaagacaguaaucuauuuuucaaacucuucuccucacccaccuuucaaauuguaaauuaacagaaagagauuuaaacacacuuguaaaaacaaagguaauaauuggggggugguccccacuuuccuaaucuuucuagguagacugucaaucauaguccugacuuauuuaugaugaaucauacugauuuuuuuaaauaaaauaauggaguguaaauuugagaagccauuacuucacuaagaaaauaaaacacauaacccauuuuaaaguuuuguuaaaaaaaaaaaaaaaaagcugcuguucaaaaaucagcaaauagagcuggcgcgguggcucaggccucuaaucccagcacuuugggaggccgaggagggcagaucaccugaggucggggguucaacaccagccuggccaaaaguggugaaaccccaucuuuacuaaaaauacaaaaaguagcugggagugguggcaugugccuguaaucccaacuacuugggaggcugaggcaggagaaucacuugaacccgggaggcggagguugcagucagcugagaucgcgccacugcacuccagucugggugacaaagcaacaugcugcuucaaagaaaaaaaagaaacaaauuagcaaauacagguaucguuagguguuaaucucaauagaggaauuuuuauguuccagggguguuacaauuugagggaugcauaggcagaaguaaaauauuaacuggcuacauauuuuagaaagcuauugauguuaacuaaaggacagucuucaucuccugaacucacugccaaauuagaauguguuucaugauaauuucaaacauuuggugcuaaaagacuuaaagguuucauuuugcugaaccaaggaauucuauuugauaaacugcaugcaaauaauaaauaaaguuaccugcauaguaacaucuuuucauuuuaucuaaaauaaaaugaaguuuuauuauaauacaagcucauuauaagcaaccugaguaguuagaguagaaagaacaauguucacaauuauuauuuuaauugagaaaaaauaucaagaugcgaaaugaaauaacuguucggcaaagucacuacuauguaaaaacaaucguguaaaugcugagaaaaauauagaaagaaauauagcaaaaugauaguagugguuaucuucagguggugguacaacagacaauuuuauuuuucauuuccucuguucauuuuuuaaucgaacauucuggaaauuccuucagaaauaaaaaggcauauguuuguauccaugauacuacaaguauuuuaaauuacaucaaugucugaaucuucauaugacagacagacagucagcauccauuuuaccugaagaucuauugcugagggcuucgcuauuaaauuauuacaacaaggacugcuuauggcaucucuugguucagugaaaaccucccugggauguagauacaugcuuacaagcuggguuucauaacaggaagcccacuacacccccaccacgcaggagagugcauacuacauuacuuuagaaguauuuauccgccccucuucuccacccagggaaaggcgaaguacuacagguuuuucagauaaaauccuugaugagaagaaaauacaaagauucugccucauggucaagaagauucaugaguaauggagagcagugaggggguuuuagcacaccggguuauggaauguuugcugaaacuggauuucuggauuuugaugaucaauaacuaaauaaauaaugauaaccacaauaaugaaaacaauaccagccugguuaacguggcaaaacccugucucuacuaaaaauacaaaaaucagucgggcuucguggcaugcgccuguaaucccagcaggcugaggcagaagaauugcuugaacccaggagacagagguugcagugagccgagaucacgccacugcacuccagccuggaugacagaucaagacugucucagaaaaaacaaaaaagaaaaaaauaauaauaauuauaccugcuauuuacuaugcauuugccauggcuauacauggcaacauauuaacauauuguuauaacguauaguacaacauauuguuaugcaacaaauuaaacaccuuacagacauuaaacucccacacuaaccccaucagguauucucauuuugcagauaagaaaacugagauaagacauuacuaauuaucuguaugaccccgggcaaaucaacacugggugggggcaagauauaaauugcaguucaucugacugaucuccaguaugucauuuaaugaugagaagaaagaagccugucaccaaacuacuuuuugagaaagugcuauaugcagagggaacaaagaauuuauuacuguauaaaaguuucugcccacaaauguguacauuuuuaaccucaagaaacagguggaaccauugaggaacuccuacauuuucuuccauuuuaauuguuauuaagcuauuacauuauuuauccuguaggcagcgcauaugggcucuguauuaauauugguguguagcaaauuacuccaaaaugaagcaucuuaaaaauuaauaaauauuuacucccucacauagauuuucugggucaagaauucaggagcagcuuagcuagcugauuugacuugggugucuccuaagucaagauggucauuucaucuguggucauccaaaaguuuaaaggggguuggaggaacugcuuccaacaaggcucgcucauguuggcuggcaaucuggucugacuguuggaagccugauuccuugcuaugcggaucuccccauggugcuguuugaguauccucgcaacauggugucuagcuucugccacaaggagugauccaagagaagcaaagcagaaguccaaauguauuuugucaccuagcuucagaggucaugcgcuaucacuucccccuguagguuacacaggacaauccuguucagaguagaagagaaauauacugcaauguaaaacccaggaagugagggucacuagaggccaucuugaccucuggcuaccacagaagcucaucucccuuucucuagacagugccaugcucuuaaguauuuaagguugaacucuaacauuucaacaacaaaaugaccucaaaaugaaugagaugagagaaugaaaagucaucuugaagaaauacaaacaugucccaguucaagucacucuugauuguggggccaguauuauacaaggaucccaaaagugcuguguuucaaacagcugaggaaugaaugaagauuacagguacagaaaccaagaggcuuuagcaaugaugcugaagaugggcaugaaggguuuaaaugaaauuauuucauaaauguaaggauauauaaaaacuccagucuuuuaaaauaaauacauuacuugugaaaaugcauuagcaagugaaauccuacaauaaaacuuuugaacaguucaucuacagccccuaaaguuuauaaacugggcacaaaauuuaggggagguccacuucauuugaaaauaaaaaauuguuuuauauuuggagucaccuuguauuuugaaacguauugccucagccaagauuuauugagcaucucuaugugucugacacuguccuagguuggacaaaguggugaaugagacagauaaagucccucaccgucuagugggaaagauggaaaauaaacaaacacaaacgugcaauacagcuucacugugaaaguaucaggcucauuaucuucugaggcaaccaagcauuugagucauauaggcaaugaccuuugcuuuaaucauuugccaauuaaauaacuuacaaugucacuuggcucaguacccguacuucugccuauaaguaaacucuuuuucuguaguuccaccuauaagaaaauucucauccucucuuccuacucagauuaacaagagcauuucaaacuaugugauaauuauagcuccuguugaaaauuauuguuuaugacccuggguuuacacaucaguuucugugaauuugguuauuguagagucuguaccuaacagaaagaccuacucuuagugggcucacaaagucuaauuucugaaugagcaaguuugagggugaaagccauauuguuaaugaacucaucaagguaaauaccacaggcaagcuucuggaaauuaagucaccuggccucacuguccacaccuacccucuuucaaauaacucacauguaauacauuaaaaaauuuaucucuaggagcugcaaaagaaacacuacaugcagagagacccagaauacugagagagguguuggcacacucccgacugccaucccgauuccuuauucaugacugaucaauaagugaucacagaaaucuuccauguugagccaauauggcaccaaguucuacucaaucaccaaaaauagacacuaagaacucauuagugugaaaagacaguggggcucaaagaccagggguaucaauaucuguuugucccaauaagauuggguucuuuuuugaauugagcccugaguccacacaccccugguucacaggcagugacuggcacagagacacaaguagguccuggaugaggcucgucauuacauaaagcuucaacaauggugaacaaggauggugaugguaaauaugaaguagcaguggaacuccaaggaaucguaaacaaugggggagaggggacuaaacagcauuauauacaaacguuucauugcaacauuauucuuagcaguaaaaaaacuauaaacgguauaaauucccaguuauugaagaguucaugagcuauaaggacuuucuaucacuugacagcuuuuaucuagcugauauuugacauuaauaaucacuauguuacaacaggggaagacacuugugcuauaauguuaagugaaacacucgggauguaguaucaauguauuauaacuaauauuauggaggcgaaaaaacucauucauaggggaaaaucugaauggguuaaccaaauacugaccauggcuguugucuggagugaugacacauuggcuaguuauuauuauuuucucuauuuuuuuauuguuuucucuuugguauuuuacacacacacacucacacacacucacacacacagaaacugguagugaaaacuucuguagacuaaaagccaaauucucacucuaucacucuauuuuuuuuuuuuaagaaggaauuucgcucuuguugcccaggcuggagugcaauggcauugucucggcucaccacaaccuccaucucccagguucaagcuauucuccugccucagccucccaaguagcugggauuacaggccugugccaucacacccggcuaauuuuguauuuuaaguagagacaggguuucugcauguuggucaggcuggucgcgaacucccaaccuuaggugaucugaccaccucggccucccaaagugcugggauuacaggcaugagccaccacgcccagcccagccuaucacucuauuuuuuauggguccuuuggcucagguaagaacaauauaaaccucgcccuuugcucacugcaucaagauuagaaaucuagucuagggagggaaacaaccauacuguguuuuguccucaaauacagaaacgaaaucaaaguuugccaaggaaggccuaucucaaaaugugguuguaguuguuuucuuuuuuuuuuuuuuuuuuugagagggauucaggcucugucacccaggccggagugcagugucacgaucuccgcucacugcaagcuccgccucccggguucacgccauucuccugccucagccuccccaguagcugggacuacaggcgcccgccaccaggccuggcuaauuuuuuuuuguauuuuuaauagagaugggguuucaccguguuagccaggauagucucgaucucccgaccucgugaucccccccgccucggccucccaaagugcugggauuacaggcaugagccaccgcgcccggccugucguuguguuuuuugacaacuucgugacuucgcaauuucuaggaaugagugacucuguagcaacaugcccaaaggugagugcucccagagacuuacauugacucuuguauguuugggcagaacaguggccaaacuaggagggguacacaguuaauguugaguuacuguauagacuguccuccgugggacaccaaguagacccuggggagcuguggcaagauugucaacagugaucaugcccauggcagucugguggccacccauccuacugcugcucaugguaacuaugucuuugcgagucaucgcagcaaaugauuuucagcaccuuuaccccuaaauagaaauaugaucacaaccagcagaaaaagaagcguacuaacuuaucugcaaggauaaaaacugggcuaaauagauuuuucgggucauuaaggaaauacagaaucucagaggagguuaaaaaaaaucucagaggagguuaaaaaaaaaaaaggucucuguguaacucccgucuauuuugggaaucucauguauggcauugagaacuggugguucaaccucaucauuacccuguugguaggaggagagcagacugaucuaggcuuugcuuucugcuucagggucagcccuaggcaaaucuguuaauuaggcuaaauuuggccacuuagauacuccugcccuucccacucugcacccuguuuccucccaacaccaggccagguuccccguacccuuaggcaacaccacauaaaggacuuuccauuccccagcauucacagugcucacuccaccucaugcccagucgcuccugagcucucucuuccuuggugugagcugauaaacacucagagccuuacauuuuaacagugguucuuucucgaggugcuggucuaguccaaaagccaaguuccaacaguuagcaaauacagugcauuuaguuagacugucugggaaggucugugggggcaaauaugacuugaagauuuuuucaacauuaacaacaacaucaacaacgaaaagcagcacugauugggagcccacgguguacaaaguuacucuuacuuguuuuccguaugucaacucuaauucauuggcauuugcuggauauuaaaccccugcaaaacccagugaguaacaacagugaccauuuuucuuauauuuaguuucugaguccgcgaaugggcugugcucuuucucuggugugucuggggucaggugguagcuuggcuaguagcuagaugacucuagagggaccucacucauaugccaggcaccgacaggcuaucagcuggggcaaccacucucccuuuauguggccaccaugcuccagcaggucagcucaggguuguucgugcaguggucacaggguuguaagcaacgaaacagaaagucccaguaucugaccgcuugucaugccucugcugcuaagauuccacugggcaaugccagucauacaggacagguguugaugcggugagggaaauacuguuuuccuuuuucuucuucuuuuuuuuuuuaaacaagcuaccauuuuuacaauuuaccauaccuuccccaaauccuagccuuuaguuguuauuauuuccaucuuauagaagaagaaacugagaguuaaauaacaucccaaagaaagcucagaauaaugaacucaguuguggcuagaugcaguggcucaagucuguaaucccaacacuuagggaagcugaggcgggagaaucgcuugagcccaggacuuugagacugagcugggcaacauagcaagacccugcucuccacaaaaagaaaaaaacaaagaaacaaguuugaaaaaacccaguuguuguguuggauuggaauuagguacaaacacacauuaaaguguacauauauauaauuuauaauagauacugauauguuauaaauauaugaacaaauaauggaauguguccagaaagaaauauaaauauacuaaaauuauaauauacacagagauacaggaauaaauggagauagguguaugugcauggguuuguauaauacacauauuucuaaacucuguugagaaguucuagaagcaaugacacuccagcaguaaugagcgcaacuagcaccuagaucuuaguucuaaauaugauucuauaauaaaacgaaccaagccuccauggagaaugaguuaauuccaagacugaggcagggaaguccaagaugacaguguaaagccucuuacagugccaaaaaauaagaaagugcucaaaaaagaacggggcaugucaaaagggugcaggaaccugcccgaaagaccuccuaugggccaaagccggaacaauuugagcaccaaaauauaucacaauacugucguauuaugaccuacagaauaaacuaaauauucacguauccauaccaauauaaauggagaagaagaaacagccuuccauguagaagaauucccaccaaaaaauagaaggcaugacagaaagacaauaucagucaugagaauaccacaguauuaaucauugcaggcaagauccccagagggaugcuaaaauuaauggaugaaaauuugagaaguagucccaaaguaccucccccaauauauuuauuaauuacaaaggaaaaaaaugauccuuuacaguggagaaaucuggcagauaccacguuaaccgagaggucaaggcuaacaucacuaguaauaagauauuuucacauuacacauccucugacuugauggccgaagaauggcacaucacuuauguauauuccucccaaaaaugcaccacgucauucuaaucaagagaacacaucagacaaacccaaauuacgggcauucuacaaaauaacugaccggaacucuucaaaaauuucaaggccauuaaaaaaaauaaugcaugagaaacugucccagaccagaggggacuggagagauaugauaauaaaugccaggugguaucugguuguaaaagaaggaagaggacacaccgucaaauccaaauaaagucuguuggucaguuauagucugaguguaguuaauagcaucauaacaagguuaacuucucagugcugaaaaauguaucauguuaguauuaggggaagcugagugaagaguacaugggaaaucuuugcaguauuuuuuauggcuuuucuguaagccaacauuuauuucaaaauuuaaaaacuggaacaaaccaaccaaccaaccuuucccaaggucccacagcuccugaugacuaagucugaauucaaauccacuugugccagauuccaaacuccaugcuuuccauccugugcagugccucccgcauccacgcuaccaucuuagaauugguucagacuggauuaggccaccccuuccaaaugaauuauuuuaugggaaaaacugguggcacaauuaggcauaaacccaucuaccuuaaauggggaaaaugaggcacaaggucauuaaaauggacgugcagaauauucacucucauauucacucucagcuccaugucuuaagugcccacauaagccagcuuauaaugucauuucuugauuccauuaaauuaguacaggauuaguacauaucucaaccuucaaccauuuugucacuuaaaaugagugucuggaaggccauucuuccggaaauauuaguuaccuuguccauuacuuacuuaaucauagcuuggaguuauuuuuugccuuguggaggcugacuauaaauuauggacuauuacgcagcaaagccacacuuaguaaauuauauggcauuggaaaacccuugcuuuugggggaaaauuacacuuucuuuaaaaauauguuuuauaaaauauuaugcuaagccuguaaaagagaauccaugagcauacuuuguggccauaaggacauauuugacaguugacuccaguuuccaggccgcuccuaaaaaggguuuggaauggaaaacuucucauuugauauucaugucagaauggccguggucugugaauuucuacaugcagacagauaggaggaaaggcuggaaaccuuguuggucuucacccaugaugcaguaaauaaauuagccauguagucuuaaguuucauuuugagccacaauagcagacuaauaggcaguauuuuuucacaguuaugaauggauucuuuuuuuuuuuuaagaccaguccauagaaguacuuugguauuugauuaaaaaaaaaaaaaaagacagcaagauaaaaaaagugcaugaaugcagggcuauuaaauaggaggagacaacgacccuuuggaaugaagguuuuccauuugucuguagcuuuuccaaccgcuucacugcgcuguguccgcaugguuggagacagccuuucaggcuggccaaggaaguuaagacuuccugccucaauaggccagucuuuguuguucucucagggccaaagauccugagagucagcaaccacuagcucuggccacuuugguguaugcucagucccuggugagcuagagcaaggucacugggucagcuuacacggugacacuguuagacugugccccagccaacucuggccggggauacauaaauauacaagacuaaaaaaggaggauggcacugggguuuccagacgcaucuuguaaggcagacaguugcccagcuuaaaagucugcaaaaucuuucuuuaaaaagguauguuuuaauuugaggauauuaauugcacggaaauuauuugacuguaugauuuauaacccugccagaauucugcggucuuucccuccacaugugcuguugccauuuucccuuuuguacaccuaucauuucccauuguuuaucuucccugauugauguucgggcucgggauguuuuccauuaugagauucauaauuaucacugguaauagagaaggcuucccuauuaucuucagugagacugcccaaauuauucaucguaacccacugguaccacacggcaggaaaauaagaauuuauuucccaucccaggcauaugguagauaagaggauguauuuauuucuccauguuucaaaaggauuaagcuuugaaaaaauaaauaucacuuaggcugucaguaagcagaacuuuaugguucuggguuuagagggccucucuugggcuaagaauagcacaacuaaacucugguuuccaaaagaggggaagguauggagguggggaaucacuuacaguuuuacuuggcuaaauaaacaaauacgauagauuucaaccacaguaucggucuacaaggcacccagcgucaccuuagaccuccacguuaaauaacgcaccagcuuauuuauaaaaauguuaccaaauuccagcagucuuuaaccccuggcuauucucagagcauguugaauacaucaucuggguuuugccuaauuacacauaauuaggaaauguaauuacgcuuuucgguguugcucugccauuaggaaccgaguggacagcugaaacgcuaccaaggaugcagcgcuucagagaaaacaaauuaaaaauaugagccaaccucuaaaaauagggauugugcugaagguuaguaaaucaaacuuauuuuaaaaaacauaauaaauugcuuuuggcucuggcuaaauauuugaugcaacaguuaugcuggcugucuuuguuuuguggacuuacuuaaugauacauuauuugcauccaugcugagccacggagagggaaugaauuauuuugcuccucgaugagugugauuugcucacuuccucauucauuuaugcuuuuuuauuuuuauuuccuccuuuacaccggaccccugcucuggccaaggaagugauuuccaaccauucugugucaaagagucaaaacaugucauuuguggguuuguugcauauggagggugcuaaugcccaaagcuuaggcaaagcugacaguaaucucauccccugagcugggcauucgcaucuuagcagcauaggaaugggcgauuggcuuuguuaagucaacaaaacaggcaccacaauaaucguuuuccagauuggguuggacauggcacugaccuagguggcuuuaccagcccaaaaaguaagaauuuugcagguggagaaauagaaaaaucgcauucuuuagagguacaagcucaugaaggaucuggaauuggaagcuuucaacguucuaaucuuugcuuuuguguuuauugaauuuuccucuccuaggacaguggcugacaguaauaaaguaacacacuccauugaaugcacuauuuauggaaacauuucuauggugccaaaaaaaaauuaacaagagaagugauugccaaaagcaaagacccaaacauuagugcaauguuugcagcacuuaaaguaaaauagccagcccuguuaacaaacauccucuccaccugccaguccugugaagcgugccugugggugcgugcauuuuucuaaauuagauuucuuuccauauuucuuucuuuuuucuagagagcguauuuuaagucuaucuuuauccccccuuguauucuauuuuuauuuuuauuugagauagggucucacucugucacccccggcuggugugcaguggcgugaucuugguugacugcaaccuccgccuccugggcucaaaugaaucuacugccucagccuccugaguagcugcggcuacaggugugaguugauuuuuuuuacuucuuguagaaauggggucacacuauguuucccuggauguucucaaacuccugagcuccagcaauccauccgccuugaccucccaaagugcugggauuacaggcaugagccagcaugcccaacuccucuuguauucuauguacacuguuuccaaucaucuuagauccuuucccacucauuuccaacuuuuuguuuucuuuuucgaaacagggugucacuuuuucacccagguugaaguaaaguagcgugauccuagcucaccauagccacacacauccagccucaagcaauucucccaucuuggccucccgagcagcucagccuacaggugugcaccaccaagcccagcuaauuuaauuuuuuuuuuuuuuuuuuuuagagauggggucugccuauguugcccagacuggucucaaauucuuggccucaagcaauccuccugccucagcuucuaaaagggcugagauuacaggagagagccacugcacccaacccauuuugaauuuugacuuccuccucuucaaguguuccacugcugaaucgguugaaaaugaacuccuccuggauuacuuuaagagauacauugcugaucucucuaaucucaguucaaaacacacuuccacaaaggcacccagucagcucagauccuccugguccccuugaaggggagaugccaauuaccauucaccuuuauagugugucucuuauaucccccuucccuuccagagaauagcugggugucccacacgucugccagcucuguccagugcauuaauuagaucaggauacucaagcccaauaaucgagacccucguuucaaaagaaauauuguauaaccccuuaccaagguccugaaauaaaauucaugaauaacauaaucuacccacacacauaauuagcaaaaguaauaugucauaaauuuuuuuuaaagaaaacauaauugacaauaaaauaguacacauuuucaaagguaacuucucggacaggaguguaucagaagcccaaaaugaaaucgucuaauguuugcaccuacuuauagguuuggauucaagaaacauaagacaaaaaauucgccagaguuuuguuaauguauucucauaauacuuaacauuuugaaagcagcauuacauauauuuuaauacagacaucauauugguaaaccaacucugaaaauuacaaaaugaaaacuaaaacaaucauccuuauuaguagcauuugccacuuuccaugguguaaauauucucaccacggucaguuucaagcuaccaacacgaugucacugaauccagauuuuggaagaaacaggcaaaaucugcucucaugagcugcucgcuaagggcaugucuagcacccaacuauuuaaucaccaugaauacaaacagcuacauauguagacagaucacauuauggugacucaaauauuaugagcagugcugcaugauguuucaagaugguauugagaccuugguaaaagacuggaacaaaacaccacacaaucuucccuugauuuagaaggccccugcauuucuggaagacccagugcacguuguguaucuguauaagcacagggaauucuggggucagaucaauggaaacaaguuuuuuaccgaaaugaaugucugggggcacagguguauguuaccgggacgagggcaguucuuuguuauauuggacugccuauggcaucacaggauggacccguggaccccaccugcuaagugccaaaggccaccaaaaugccuuuccaaauuuccaaaaugcccccuccacuggcaauaguccuacuauugagaacuacgucuagauguuugcuacuccaaguguguuaccuggaccaacaaggcaggcauccccugggggauuaccaauuuauaagaaacacagaccacaaauauauauaccuacuaagugcccacaauuuuuuugaaaaaaccacauauauauauacauauauauguacauacacaccuacuagguacccacaaaaauuaaauaagaaaaggaaacaaagaagcucgggccccaccuagaccuacugaaucagaauccaaauuuaacaagaucccucggugauuuaugaggacaucacauuuggagcaacuacuagaguagauacugaguuuuaagacuuacaaacuguguaacaauacugcuuaaugcugacauaaacaaugcaaaauaaaccacuggcucuguagacacuacauaauuagccucccuaaguagugggaucaugccaugccaucgcuccucuucauuguaacugugcugcagaggcaagaggacuuuugcauugacugugggccuacugaauuugucaaccacagacguacaguggccuuaccaugccucaugccuccucucccugaauucacacaagaaucgcucuucaaaacuagaacaagacgugaaagaaaucaaggcacagagagguucaggauuuugcucagugucacagagucaagaaugugcacaguuaggauuagugaugguaauuauuuuauauuaaaaaauuauuccacaaguacacacugagggucaacugggaggcaauguccacaaacaguuucucccaugccauaaugauaacuuauuuugcauacaacuuuguuugugcaaagcauguucucaugugcuaacucauuugaucuuucaaacacccaguaauuuguuaacucuacucaaagacgaagaaacuguggcucagaaaagggaauggaggaucaggaaaaugaagcaacuugcucaagucacuagcuaauaauauaugguuaacuagaaaaugcaggauuugugcgcuuaccugccugaaggcuucgcuaguuccugggguugggaggucacuggaaacaaaagcacuuggagaaauaucucuagacgaugaugagacgguuuuaggagguggguucuucaagccuucuccuaacccauuccucagucccaauuuagcaucaccaaccaagccugugacuugguaggaacaucaccagggauguauuuuccaaaucagauaugcccuccagccuaaccuuauucuacccccuccccacccuccauaacagugagaaccuggagaaacuaaaaugagaaaauaaauaugugcugacaggcugggaugcaguucauuucauagacauaaguaauauuuauugcaaaguauuaacaccuauuagcaugaggaaggggaaagaaaaagucacagcccuguacauaaaaugcauccauucugaauccauaguaauccacauggguuccuagaaaggggaucuuguugcugucuuuugucaaaaucaaugccaaaccaacaaguuucagcaaagccuuuggaccucucugaggacaugaaaagguuggauauuaccaagccaggggauaguuagauguaauuacauuuuaaaaccucuccauuuuauaucuaggaacagaagagagagacuggaagggaggaagagaaaauauaucaaaauagagcaggugacucucucuggguggugggcucgugggugauuugaauuuacuuguugaauuuuucccccaaaauauuaagcaguuauuugauuuuaaugaaaguuuuuauuuuugagauaaguguagauucacaugcagucaagaaauaauacagcaaucucaugcacccuugauccaguuucccccauaggugauaucucacaaaacucuaguacgauuucacaaccaggaaauugacauugagacagucaagaugcagaacauuuccaucuauaccaggauccuccaguugcuguuuuaaauccacucugguucccacucaccccccacuccucuccagucccuggcaaucacuuaucuguugucuuuccuuuucuucucuuuucuucucuuuugagauggaguaccacucuguugcccaggcuggaguacaggggcacgaucugggcucacugcaaccucugacucccggguucaagcaauucuccugucucagccucccgaguugcugggauuacaggugugugcuaccacgcccggcuaacuuuuuguauuuuuaguagagaugggguuucacuauauuggucaggcuggucuggaacuccggaccucaggugacccaucugccuuggccucccaaagugcugggauuacaggagugagccaccgugcccagccaucuguuuucuauuuuuauaauuuucuaauuucaagaacauuauguaaauggaauccuaccaauguaaucuuuugggauuggcuuuuucacucuuuuauaguacauuugcagccaaagaaaauauucuuauuguguauacguguaagucucaacauuuuaagaugcaacugugucuuuaguucucuaagaaucaacaugcaggagcgccuaaagccuccucugaagucagcucuucugguuccugguucacugucacucugcaacgccauggcccaacuacccugucuuuuuuugacgcucgcuuugcuuccugggaaugaccaaggcacagcccuccacguacccugcuuugcaucccucugcuucaccaccacccaccacaaccugaaaagcuaccuuccaaugugcaugcagccugacagaguugaaggaggaggcucucaagcuaccagccuuccccacaaccccagagacaaagcagaaggcacacagccaagauggguuccuggccucuaacugugccagucuuucucaaaaugagaauagccuugggaggugcaaagaccuuuggagaaaccuuuggaacaacacaaaguaaauuuacucauucaagcuuucugugcccuugagcagguaggucccugggacuccauuuucucaucuguaaaauggggacaauaauacuuaccuuuauauuuauugauauuucuacacaggaugacuaugaaaauuaaguaaaauaauaaauauaagacuccuaacaccaugcccaaaucuaggaaguauagauagaugguggcuauuguuauuacaaauuaccaagucaaaauaauaaauagaaauucacuuggauuucuaaucacucaaucuuugucagccccucuuucuugguauaagauacaaaauauuugguucaccaauaaacaguuucuagguaagaaccacgcagacgccuaagaggucuguauuaaaucuucaaucuugcacugcuagaaaauaaaaaauaauaauaaaaaaaaguaucccacuccugagaaguguucaggcuuugagugaugucaaaggccuuugaacaagccuuauaagugacauccauauuuguccauuuuugacuuaaauugcuuuugguucaaccacugccgugaauugccuugaugcaauaucacacagaaugacacaaaacacagaggaaaaagcaaguugcugggugaggguuagggaauaaaggagucacugccucguucacuucucuaaguguuggaagaaaugaaaaugaaacucgcguugaaagguaaucucuaugaaccgugauaagagcaagugacauuuuuacauagcucaagucuucugguucagccuagcaguuauaauaaaagccaucuacaugcagcuaaacauuuuuuuaaguuuccaccugcucuuuuucuuuuucuucuuuuucuccuucuucuucuccccccucccuaagcagcaaagggccaucugcaauucuggaacuucuuguuaauauaaucugggcucugguuuccauugugugggaugaagaagcggcuucuauguucuagagaacaaccuccacucucccuguuucucucuucugcugcacuugaccuuccaucucucauauuuugcugccaaccucugacucugaaaaaagaaaaaacuucuucgcaaaagcccaucuacugcuuggcccccuaugcuaagagauucuguuucaucucagucccgugauuaggaauccaaaccacaggggcuuuugguguauagaauaauuaaagagaucagaaauuaggucagaaauccugggguccagccucaucucugccacuuaccaucugccugauauuaagugagcugcuacaguauuucugcaugucauuuucuacaccccgcaaauggccuaaugccagccaccucaaggaugguagcaagaauuaaaugagguacuguauuggcaaggccuggugcagugcaggaacugaggaaugcucauucucuuuccucccaaacaacauagaugacuuacuaaacauggcaaggggcagaagugucugaaaauaccaaugugagauccuacuagaagaguggaugccacccuucagguggguccacaguaguauguccuugcgggaauaaguuucaggagaccucaaucccagggaaaccacugccgaaaucacagagagggccuccuaucucugcuggggccacuggcuuugcaaauggagcauaagguuuuaccuccuuguguggcccugccaguugucccucccuaggccacagcaguacaacuugccaaggagccgucccuggauccuaccucagugugcuauuagucugugcaaaggaagaguaaaucuaacuguuaaaaaaaaaaaaugcauguuaaccacugcuguuauacccuuacaaagaagaggccaggcgguauauauagaucucuaaauucucaugugugcauacaaggucacuuucucaacgaaaucaauagaacaaugugaauacacaauuuucaugucacuauguauuuuggaguugaaauacauugaagggaacaagaauaacgaggcuuugaagaaguggcagcuuagguaguaacauaauuuuauauuuccuuguuguuagucucaaauauaucugaggauacaacucagagcucuguuuacguaaaaagucagaaacaaaaaaauaaauauguugaauucagauuugaauuuuuccucuuuuccuaccaaaagaaguugaagacauuuuucuagaugucugcuagcaauuuuuuggcaauacauuuuuuguuguuauuguuuucguuucucccuggagccuaguuugcucaauuucuucacgaggucagauuagcacagggugaguuucagaacugcuguguguucuuaggcaagucacgucgcaucucuguuuccuacucuauaaaacacauucauaauaacugaucuagccaauaggacugcuauaaggucugauaucaauaugugugugaacaacugugugaacauucuuaagugcugauugugugauuuuacgggguauucaguaucacuccaccuucucuuucuucaacacacaacugcucuacuaacaugcucaugggcgcuuguaacauugaaggaauauuuccccuuuaaagucauuuuuguugcuggccccuuuaagaggauuugaccauuaucaacguguggauuuaaagccucuauuuacuacuagaauauuuugcacaacgcuuugaaugguguaguuaaagggauaaaagcuacagacuaaaauaguaaauaaucucggaaggugaauaaauuuuacuagaaugcuggcacuuguuuucuaggugguaagaaggccacuauaauaaagacagcuaauguuggauaaugacaaaagcaaggcugucggagcaagauacacuggauucaagcccauauauuaccuuaagauccuugggcuucauuuuuggagcuuccuccuccaccucuguaaaaugggcacacuaacgcccuccaaaccccuuuaaaaauuugaguggaaauugaacaaaaaagaagacuggaaauacaguuuguagaacacucagcacagugucugguuccugacagcccuucaauaauuacgaacugcuaauaugauugcucagacuaaggugguacgcaugauuauuacaaacagucauuaucauaauaaugucauuacgaacaaucaugaaaaacuaaagcuucauauuuauauauugcauaauuuuuuugguucuggguaaacuaauguaaugauuugacauacgcaacauccugaaguuagccuuucucuuugucuguauccccuuuguaccuguaucuauaaauuaucucugcaauauacaaaaucuuuauucuguuaagaagucaguggaauguucaagaaagaucaagaauuccuggaacccugucuucaucugcaacaaacuacgcuguacuuucugaucaucggcaauggggauucuacauugcagacccugguccuuucugccagccuucagaccuuguuuacagaccuccugaggauacacuuuucucacuuacuauguuucuuuggauggcaaccuauacaccucucaauaaauuuugguuuacuuaggagcugaggggcacagaaaccuagaaaccuagauucaauuugugccgauuuaugagacacacgcacgacaauccuggaaacuuucccguagcucacuuuauaaauuaaccccuuauuuaaauauucugcagacucagcacagagcaguguucaauggggacauggucccagaucagccuuuugggccucuccauguuugcuaucagaacacacgggcccuguucggcacaaacaaugcaaauuuacaagauuuaugagaagaagggaauguuccuauccuguuguuauucaggccacagcaucacuggucuuaacaggcuccauacugcucaguuccagacguucgacagcuggacuugggaugcaugugugagcaguguucugauuugacugauggcuucacucauucacucauucacucauucagcugaaauguuccaaaugcuuaauaaacucaagacaaugaggcugaagccaaagggaugcaacacagaauaagacacaguccuuggccucaaagaacuuauauuccacugggagacaaagugccuguaugguaccauagagaaggcaugaaacgcaugagccagcaaaccuuggcuggaagccugcacuugcuugugagcugugugacucuggguaauuuaucggauccucuuaugccucaguuuccucaucagcaaaauggguguagucauacccaguuucacagaggaugcugagguaacagcauucaaucaacugcugugaaaucucuaagcaccauauagauauucaagauucuuaaacacaucaguaaugcacaagagaaaggaacauaugugcaguaaauuaacaagcgaaagacuaugaaaaaucagauacaagcaccauaagccuacugggguuaugauaaaagaguguccucacugcacguuguagguauuguaacccaauuuucugaacucgcagaagaggacaaugaugaggaaggagaauagaaagcaggaggaggaggaggaggaggaggaggagauggcugggccauuaaguaaacaugagaacagccacauuagagaaacaagcuguaugcaggaaagagugcaaguugaggacugguauaaagaaagagcuugucaucccagugcuuugagagaaugaggugagaggacugcuugaagccaggaguucaagaccagacuggagaaaaaagcaagcaagccccaucucuacaaaaaaauagucaaaauuaaccaagcacaggagugcaugcuuguagucccagauacuuggcaggcagaggcuggaggaucgcuugagccuaggaguuggaggcugcagugaucucugauuguaccacugcacugcagccugggcaaaagagcaagacccuuucuuaagaaaggaaaaaaaaaaaaaaaaagaucgagagaaaaggcugagccuggccacuuugcuuuucuauaucccaccaacugauuaacaccaauggggacauagcacauuguccaaauggcagaaauccuuuaaagaaaguuucuuacuuucagagagaaaaauaaauagaacugcaugagcucaaaagucacuggugaaauaauuauaaauggaugucaucugucuuugggggaaguucuguaaugaauaucacagaagaagcucaagguuuccucuguaaaggcgccuccccaacucaccugcuggccuguaugcuccaccaugacacaugauucccuuggguuguccauucuuuaaucacaaucccuccugagagggccaccacaggacauggauucacacuagcaggaugaugacuuuucuaauccaggaaggagagagggacgcauuuucccacacuccaugccacugccaauagccgaaccagugaagcgagcagguguuaggagagucaggguguguggaguggcagagugugguggucuuagaauaugcccacaaguucuuugauagaccucccuuccaaugguggagccagguuccccucuccuaacuauggucuuuacuaguauucuucuaaucaauagaauguagcuaaaguuacggugcuugacagugcaugaugucuaagaauggggcuuaaaaggccaugccacaucuuccucacacucucucugagaucaucacucugugggagaccagaugacauauugugaggcugcuccugaagcuguacagagaggcccccauggugaagaacugaggccuccugcuaaaagccacaucagugagccccuuggacacgaaaccuccccuucagucaaggauucugagacugcagccccagccaacagcuugcuggcaacuucagaaaagacccugagcuagaaucacccagcuaagccacucccuaauuccugacccacaaagacaaugagauucuaagugcuuacauuuugggguaauuuguuaggcagcaauggauaacuguugcagauaccuagguagugaguuaguggauccaggcaaaagugacaagagcaacacagguaguuaucaccaaaagugaggaaagaggaaggguauuugagaaaauuacgacgagaucaccaauaugcgaaccugccaaggauguuuuccuccccugugucuccuaagagacuguacucuagcuuggcuugacaugcagugcuacagauagaugcucaguaaaagcuucuggaggucauaguuauaaucauuauuuucacuaguauuuacugaguacuuauugaauaccagggauuaugcuuugugcuuuacauaaauuauuucuucuucucaauggaaauaguauuaugaucacucuuucacagaugaaaaaacucaagaaaagaaagacugagugacccaccuaaggacuugcacccaaucaucaugcagccugccuccuggugugcaggucacugaugcuggcuuugugcacccgggcaugggcaccggggucucccacguaggguaccaguguauacucaaagccacaggauaaacucacugcaucucccuagagcacccauuuuauucacugcuaagcaucuuaagacaucauuuuuacauuuacaugaacacagauauuuugagugaaauguaaacuuccauaggagcuuuuaggauacaucuuggaggcuggucaggggcuacuucaggggauaucaauccuccaggagccuaaagauauucuuugcugaaagcacuagcuaagacacagcuuauaaagggggaaaugagggcuggagggaaaacaugaccucgaaagucacagagauggugcucagacagccagggucuucagcccccaaauucugagugguucucagcucugcaagccccuccaccagccaggcugugauagcugcaagcucuggagggcuaggaacgcagucccuucuucucuuacagaauucacucccaaaacaucacauucugcccuccccuuccacuagcacugugauuacugcugcaucauuagugcccuuuaaaagaacaugguuuccaaauccuccuaaacauguuugcaaugauugcuauggcccuuuugauaaauaaaugaagaagacgcaccugaccugauggcuauagaggguaaggauggggcuguaggagaaagaaaaggacacucugcaaacgacagaaauagucauuuacaguggcaaggagggagggaacgcucugacucccagggggcccugagcugcucagauguucccuccaauacaagcugaugccguccugcuuggccaaaucgaccugaacagcccagaaagcugcacggccguaccugucagccccaaucggugcugcagaaauuuuguuaggaaaauagagguacugagauucaauuuuucgauugucugaaggcuuaauuuagugaccuuggaaaauaucuccuagaggugaaagaagaugcugggaaucugcugggaggaaggaggcuucccugguaauggguaauuuguuuacucuaauuuugaggccucuucaggcagccaagaaaauagucagauagguacuaccacuucuuagaaaaagugggggaggggagagccauagaaaccagugagaaaaacccccagccauacggcacuacuuucucaagagcagguaggcauuaugauaauauguacauauauguuuuauguguauauauauaaauaugcuuauuaugaaaauuuuaaacauacacaaagggaggacaauaaccccauauaaauaucauucagaugcaaauauuacuagaauguuaacacugcuucuuuccuucauccucucccuccuuuucuuucuucuuucauugcggcagcucuugcugcugcuguugcagaaguauuuuguuuauuuuuuuucauguaaauuuuuuauagagaugagggucucccuauguuacuauguuacccaggcuggucuugaacuccugaccucuagugauccuaccacuucagacucccaaagcacugggcuuacaggugugagccacugugucuggccccaaaguauuuuaaagcaagccccagaccucacaucauuuuuccucugcugaauguauaugucagaugguauuuagaagaggcgggguugcucuggugcucaacagcuuuucucauuaauaaaacuacucaaagaaaaaugcuagcaggagggaggagcucuggaauuaggaguuccaauuuuggcuacaaucugcaauuccuguaggaucuugggauacucugaaucucugggucucaguuuccuuagguuggggaagauaaugacuccuagaccuguuaggggaacugaaugagacaugacuuucuaaaauccuuggcacagaaccuaguacaggcuaagggaaaggugugaugauugacuauaugugccuuggacacaggaugacaacaccaaaaauaaaaagaaggcaaaaaaaaaauuguaggugucaacuugacugggccacacagugcccagauaucugacuaaccauuauuucugagugugugucugugagggugauucuacaugagacuaaccuuugaaucaguagacugaguaaaacugauugcccugcccuguagggguggaucucaucuaaucuguugaaggcccgaauaaaacaaaagucugaguaagaaauaauuuucucucuuugccugacugucuucaaccugggaugcuugucuucugccuuuggaugagguuucuaccaugggcccuucuggaucuccagauugcuggcuacacuucuugggacuucugggcuuccauaauugugugagccaauucgccaguuccuaaaaaucucuaucuguccaucugucuagcuaucugucugccuaucugucucucucucucuccauccauccauccauccauccauccauccauccauccauccaucuuccagauggacccugacuuaugaugguucugcuuaugauguuuagaauuuaugaugggguggaauggcaaggagaagaaguccaaggguuuaaauccuagcuuugccauucauggcugugucgcuuuggcaagucccuuuaaccucuauaaguuuugauuaccuuaucucuaaaagggggaaaacuacaucuacauuuuaggauuacauacaagaaugcaaugcagaaaaugcugcucaaaagacaguggccugagagucuccauuacauaguuuccaauccagcugaggcuaaauggcaauugcaauagagaaauaauaauugugcccacuuuauaggguuggaggacuagagacgauauugcuaacuacgauuaauacaguucccugcacauaauuggcacacacauaauuaauaaaggucagagugugaaguuuuguaaauaaugauagauuauaucacguuuauuauuaggacauguguccgauagaauuugguauauaguaggaccuuaauaaaugauauaguuauaaauuaaauuauuauuauauauaauuauauacuaaugauaauuuaaaaaugcccagugcagugcuggacuuuagaugguagacaccccacaggcagauggcagggaacaguaacacugauggugacgauggugguagaauccuguacacggucauauugccuaaauguugguccuaaccguauccguucuucucacucaccuccagcccaaccuccuauucugcaucccccaguuuuugccuggccccuggauuaacacccagguccaucgaaggcucuucucucuggaggcugugcuuuuauugucauugucuuugccacugugacagggagcagaagccaggucuugaaguccucagcccccaacuccuguggggcguacagauuagauuagcuggccucucucauuccuacugucacuugcugccuccuguaauguuggcaggggugucauuaaggccucacagccugaggagcuaauagacacaccagggcucccaguugccaaugccugcagcaaugugcaccucuugacacccagcagcuaauuucccuucauaaccugacaauuucaacagcaacucuguccccagucaugucaaccagcuuagcccccuuacucugacuccuaaugaggaggugcagugccugguucccauccugagauaacaacacuggcugcuggccauauguuuuguuguuguuguuuuucucugaaauggugucuugcuugccgcccaggcuagagugcaguggcgccaucucggcucacugcaaccgcugccucccagauucaagugauucuccugccuuagccucccaaguagcugggauaacagacaugcaccaccaugccuggcuaauuuuuuuuuuuuuuuauuuuuaguagagaugggguuucaccauguuggccaggcuggucucgaaguccugaccucaggugacccacccaccuuggccucccaaagugcugggauuacaggcaugagcuaccacacccagccccuuuuucucuuagaccucacucuuccagcuccuuucaguccuggggucucccugccagaaaauggggcuggaaauguguuaaggagaaacuugcagaacagaaaacagccuucgagacuacacaccugacccuggagccacagagacuccagcuccacuuccucugugaguugaugacaccgagccuuaccuuccucaucuguaaaauggucaagaucaucgugcuucccccacacauggugcuuugaugucaucugcgugaagcucuuaucacagagcccagcacuuggacagugagcaauuaacaucugcucucacugucuuagaggaucagccauucagguuuucaugcauuuacccuuucacuugaugccuauguacuuugcaguugggggaacagcuaaauuugauuuagcccccacagaaaggcauccuggaguucuggagaggagagcagguuugugaccagagaaaccagggaucaaagcucucugguucccuugcaccaucuauaacaugugggggcaggaaagcgacacggggaggaaauaaucuaaacccggcugguuaguccucaagaggcaaggaagaaacauauucaaaaaauguaauagcuugguguccggcauguagugugugaucaaugaauaccacuuccacuuacagggaaagggagauggaggcagaggacagcuaaguaaauccagaauugucacacagcuggugagagggguggcugugacugugaccucauaccaccccucaaaccucaccacugugcucuuauuguggguugaaugguggccuccaaaaaggcaguuccauauccaaaucccugcaacuugugaaggcaagcuuauugggaaucaggucuuugcagauguaauuaaguuacggaucuugacaugagaucagccaggaagacccuaaauccaaaaacaagugucuucauagcagaaagguagagggagauuugaggcagacaggaaaggaacacaggagaagaggagaaggccauguggcugcagaggcagggauuggagugauauggucacagcccacaaucacgagcagccaccagaaacgaaagaugcaaggaacagauucuuagcuagagccuccaaaguaaguauagcccugccuugauucugaaugucuggccuccagaacugugagagaauacauuucuguugcuguuguuuugagacugaguuuuacucuuuuugcccaggcuggagugcaauggcacgaucuuggcucacugcaaccuccaccucccggguucaagcgauucuccugccucagccucccaaguagcugugauuacagggcacgccaggcuaaucuuuguauuuuuaguagagacaggguuucaccauguuggccagacuggucuugaacucuugaccucaagugaucggccugucuugacucccacagugcugggauuacaggcauucccgguugucuuuguacaauauuuuauuaaaugucuuuacaaagcaacauccagacuccgaauacaacugccaaggacagcccguuaugcuauggggacuggcuggggcauagcaggcggcucuggcuucccacccuucuguucugagaugggaguggugggcacuaccucaucuuuggguuccaugaugcucacguggucaggcagaggcuucuuagggccagucuuaccagcggggucccagggcagcaugaccuucaccuugaugcccagaaaacccuaucugagcagcacauggcacacaacagcaucaauguacuaguuaacauggucuccgcuggggaucaucaggccauccacaaacucauggauuugacccucuguccucagagucucccagaaaccacagcuuggcagccuauggccccccuauucaugaugaaccacagcccaccaucgcaggcccuccgcacaguaagcccuccuaggaguuuguacugcagacucgaccugggcaauggcacacagaccucuggggccaccuuuucagcauaaagcucuacaaugcccugugggaagccaaaucucuucugaacuacagcagucaauuccagaaucccuggcuguucucaccaggaacauuuuuuguucuguuggcuaagauauuuguuacugucgugauggguguaacuugaaccugagcuucagagaagcgucuuuagccagcuccggaguaagaaacugauuccguucagcuuugaagaugccaucagcgaccaacauccucuucuuggaaauucgcgcggccaucaugcugcugcacaccaucaaaaggaaagcagauugugccucucuuagaucucacuagagcaagucaggacagugcaguaagaagacgcugcccauggaacacaccugggugggagucagcccugccacuugguugcucuaugaccuuaugaaacucacuugaccuccccgagugccggcauccucauuuaugaaguggaguuguucaugaguauuaccauuuuccccuagccuuguaggguuuaggggauggugagagagaaaccacagagcacuuuguuuauggcuauaacgcugccauuuucuacuguuacuauuacuaccaggaaugaaaacaacaaauaaaaacaaaagcaacccaaaaauugcucccaaaggaaaggugugucgcuuccucucuguucuguucucacacaaaguugccuaggacccugauaugcuuugggugugucuccacccaaaucucaacuugaauuguaucucccagaauucccacauguugugggagggacccagggcgagguaacucaaucaugugggccggucuuuccugcgcuauccucgugauagugaauaagugucacaagaucugauggguuuaccagggguucucacgugcgcuucuuccucauuuucucuugccgcugccguguaagaagugccuuucaccuccugccaugauucugaggccuccccagccgugcggaacuguaaguccaauuaaaccucuuuuucuucccagucucgggugugucuuuaucagcagcgugaaaaacaaacuaauacaggcccugaaguacuuugcuuguuucuccccagcaccuaggaaaguaucugacauguaccaagugagcaauacauauugauuagaggaaugaaugaaugaggaaaacagaguuguagagucaaugagcuaaccuuugggaggagcuuggacugaauacaguaaaucaaccaaucacacauuugagucaauaaaaauuucaucaucauuggucaguuuauuguuagaaaaacuuucuacaggcaaaaugaagcaucuaaaugugucuacauguaggaguggacuguuuauaaaaagcaaaaugagaguuauuuuuaaccuucauauauuucuaaagaucguuuaaaaucaaauagauuuuuaaaaacuuuauuucaagguuucaaucaauaaaaaguaaaauaaaauaaaguacuagaaaaauaaaauuuggauucagaggcuagaaaccuacaaugaacacgucuaucaaggcaggaggauugcuuugaggccagaaguuugagaccaggcugggcaacauaggaagaccccaucucaauaaaaaacaaaaauuagcccaguaugguggcucucgccuguaguccuagcuacuugggaggcugagguggcaggaucacuuaaacccaggcauuggagguuguagugagcuaugaucauaccauuguacucuagcucggagacagaacaagauucugucuuaaaaaaaaaaaaauaacaagucuagaaagcucaggguagccaauccuuccauccccuuagagaaacagcaaaguuaagacaugcauaucagcucaggcucggcgggccuuaaaugcacacauuugcacagauacguguauacuuuuauauaaacucccugacaccagugacugggucuguuuuaucaaacaauguccauuaaacuucagaugaagccuuuauuaaacauuugcugaaugaauggaacaucuuuagaaugcuauaugcgauuacacagacaggugaccucucucguuuugcagcauccugagaugugggucaccauggugaacauucaggugaugauaagcgaugaugacuucccuuacauuuuucugcuuuaggaagcaccugccucuuauugaaccuggaaugaugggauggggugggagucuguccuuccuuauucacacaggcggcugacacaauaaugugaucaucaacuccucucuuccugcagcccccaacccgccagccgccccagcugcagaaugcaaacaucugccagcaucauuaaggcauuucuauacagcaccauccaaggccugacccugugaccguuuccaccauuagauuugaaugaccucagcagcagggcugaaaggccggaguauuaauucacagaaccacaagcucaauuuaagauuuaauuugagauaacgaagagcuacugaaaguguauucaaacuucaaagcaugcaauaaaaggccuuucccuguuuuccaaguugaauaugaauccaauauuucuuuaacagauuuauucacaaauuuacaaacaacacgaagccucuuuucucuguuucuaauuccuuuuuuuuuuucuuuuaguuuuuuggcuuuaucaagccccuuuaugauguuucuugcuaggaaucuuuuuuagcucuuccucccuaauuuacaaaugacucuucuuuaggaauuaccuuucaauuugauagcauucuugaagagaaaguagacuuccuuaagaaucuccccuaccuuuaguucccuugcauuccaaccuaaauaugcuaagcgucuguuuauucaacaaugaugauguugcauaaaaagcuuucacccagcaauguaacucucaucauggaaagauucaaaauaauauuccacccauuaggaacacgugaccacuggguucuagugaauaucuaggcucugaagacuuuauuuauaaaauauuuagaauucuagguggggaugggaauuuuuauugguucaaguagauuuuuguuuguuuuuguuuuuguuuuucuuugagacagagucucggcucugucucucaggcuggaguacacuggcgcagucucagcugacugcaaccccugccuccuggguucaagccauucuccugccucagccucuugaguagcuaagauuacaggcacaugccaccacaccuggcuaauuuuuguguuuuuaguagagauggcguuucgucaugucagccaggcugggcuugaacuccugaccucagaugacccacccaccuuggccuccuaaagugcugugauuacagggguaagccaccacaccuggccucacguagauuuuuugacacuaaagaguuuauuuaaggcugggcaugguggcucacaccuguaaucccagcacuuugggaggccaaggcaagaggaucacuuguagccaggaguuuaggucagucuggccaaugcacugagaccccaucucuacaggaaauuuuaaaaauagcugggcaugguggugcaugccuauaguccuaccuacucaggagacugaggcagaaggaucgcuugagccugguaggucgaggcugcugugagcuaagaugccacagcacucuagccugagcaacacagugagauucugucucuuaaaaaaaaaguuuauuuuaauauuugaagaugggaauuggagaugagaauuguuagcuuuggacucagaagccugaaucuacgaugguauuugcugacuauuuugugucugacacuaugcuagguuacuuugcauuuucucaaagacucaguccagccucagaaauagacuuggguuuaaagcucagcaaccaacugaguucccugagccucugucuuugucaccugugaacgaccacaugccucagugcuuccugaaaacaacuuuaaaaguuauaaacauugacacauauauggguauaaaaauaccacaggucaucugagcuugacccugggacacuguugggaaugggugaacuuccuaggaacugcaaacacucuggucacugugaagauuacacaauggacaaaggccaggaucacaauauuuugcaauccugaaacucaucuacuuuauuagccaccggguuuucaaaaugagaagccauguggugagcagggggaaagaaggauaaaccagaggccacauacaccuguuguggggugggggcuggggggcgcuuggcuuccgacccacccuccaucauaacuagcuguguaaccuggggcaagccugugccucaguuuccucacuuuuaucauccuucugcucuucagguaacagacgaugcucaacaugcagggauaaguagaugggugugaagccacaauucccaacacagagaaggcaaauaggagaaaggccaagagaaagcacacccauacguuugaugcagugcaguggguucaauagugucccccuagaaacauguucacucagaaccaacgaaugugacuuuauuuggaaacagggucuuugcaaauguaauuaagauaaggaaugagaugagaucauacucaauuagguggguccuaaguccaaugacugguguccuuguaagagacagaaaggacacaaagccagaggagaaggugauguaagggaggaaguagagauuagaaugugguguuuccaagccaagggacaucaagaauugccagcagucaccagaaaccaggagacaggcauggcaugguuucucccucauagcuuccagaaggaacgaaccccacaaacgccuugauuuuggacuuccggccaccaaaaccaugaaacaaugaaugauucucaaucuacccaguuugcgauaauuuguuauggcaggcccaggaaacacauacacguggcaugguugguauuaaaaugcaaggcacuucccugaagacaggcccuguggucuugcuuucaccaagguugucauuauauuucaaggaagggccacacuaauccuaaguucauccacuaaucccaauaaaaaccaccuaaauuuucuuagugggcaauggccaacucuacucauggaaauggggcuuacaagaaguucucagaucaucaguaagaaagauuuuuauuuaaggaugggaaaaugaauuaggaauacugagaugucuccaaacaauacucccagaucuucguugacuccacgauuauuucuggcguauucagggcaccacuuccacuguuggagggcaugcaacgucuucaguagccaaaacuuugggucacacauggaaaggacauucugguacugcaaauuuggcucuuuggcaucaaaacuuagcaguguccaugacuguucuugcuuucuuacaacacccagaugucaguggcugggggcuucuccuaugucuccagcaagcagggacagggucauugugcauccugagagccuacuagagugccaggcccaugacaggugcucacgguuaucaaaggaaugauaacgaugacaguacagagguaaauaguaagaacaaugccagaguuauuuuauuuuccuccauaucaccacauuaccauccccauuuuacagauguugauaucaaacuaagaguauaaauuaaugaauagaugagugaauacauaaauaaguaaauaaugaguccaucuaggaaggaggagacucagaaucgaguucaagucucacucaaagaagacugagugcaagucucacuggcgcaaacacguaagcucuuaaccaucagagauauugccaagcuuuguuuacggaugaaaaugcugugagcuuguggccuuccacugugcuggugaugcagggcaggcgaaccccagaauugcggcuuaggccaacaggguucuuggcuuugcccaggaaagaauucaagggcaagguggugguguuagcaacuuuuauugaagggacaguguacaacaggagcagaggugcugcuccuugcaaaacagggcuaccccacaugcagaguacccacaguggcaauuccgaggcaguucugccaucacauuuacacccauuuuuaauuauaugcaaauuaagugguggauuaugcagaaauuucuagaaaaagggugguaacuuccagguuguugggucauugucauggaaaggggcaguaacuucuagguguugccauggaaauuguaaacugacaugacacacuggcggacacagcucauggaaaggugcacccacccuaucccuguuuuagcuaguccucaauuugguccgguguguaagcccugucuauggaguugagucuugccuccagaaucaagucccaccugcugccucacugggggucacugaagacaacuggccugcugagccggggcucauuucaccugggaaccugauggggcugagaagauccaaaagaagugaacugaacagcaguggccaacugacugagaaagagugcagaagagugaacgcuuuucuguggaaugaacaccugaguacuaugggccugcucaugugcuaagugcuucgccguuaucguuuccauuuaauuuucucaacaagccuccauucuagagcuaagcacaaugaggauuagagagauuaaguggcuuacccuggaacauucaacucagaaaucagggugcaagucuagguuuccugacucugcucuuaagccguacacuuaaccuccacuuuacauucccucucucagugcuaacgaauuucugccaauauucucacuuacgcuuaaaagcaaccuuuggaauuacguauacuggcuccaauucagaaaagacgaaacuaaggccccgaauaguuaaugacuugacuggcaagcuaguuacaugguagaggcagcacucaaaacugcccaggcuauaguccuguggcaucuuaguucacugcagccucgaccuacgaggcucaagugauccuccugccucagucuccugaguagcuaggacuacaggcauguaccaccaugcccagccgauuuuuaaacuuuuuggagagauugggucucgcuguguuggccagacugaucucaaacuccuggcuucaagugauccucuugccguggccucccgaagugcugggauuacaggcaugagccucugcacccagccucaaaacugggccugccuuguccuagggcuuucuacugcacuucaaggccugagucaaugaaggugguagaacagcucaaccaacccuaaucaacagagaagggcugugugugcuggagagggugaugguguggcagggcuggggcaggagcuggaacuuguccacacuggaaaguagaugggcucugaugugcagcccaggucucccuuccaggguaaccuguagccuucagccauuagccuuuccagggaguaccugaacacagagacuaccuucugcaagggcacauccuuccuggggcagcccacccaaucacgagucaaggcagguuuauaaaagccuggccacauuagcccaauagggauuagcucugaugggcccuuuuagcuucauaagguugacugagacccuugcuggacuccaucucagucagcuucucccucugcccacuccaucuucguuuucuucccuuccauagguguuaauuccaaggcacguguucuucacaacaaacuugcacucagagucuccuuccuggaaagcccaaugagaugguuucucauuucuaaagaaaaugaccuaugacaauaagaaggcuugaccucaucagaaaacuuuucacuggggugacuggacugccuuggaacucuuuccauccaagacagagggugaggaggcgcaaucucaggggaagagaaagggcugggacccgaagagguccugggaauuuuaggaggaagccaagcgaagacagggcccguuugccaccacacaaagacucauccccaauacccaggaguacaggacuuaacaggggcuaaacuugaacuacuuguugacauaauuagugcuggcuccaagcgagagguuuuguagccaacuuggcauggguucgugaauuuugauuggcaaauuugaagcaaaguucagccaagcuguacaucuauuuugcagugugccuuaugcacauccagagaagccaacucuuccgauagaucuuucaguuuuaugauuguugguagcugaagauauuagcucuuuaaggaggcaaaugcuucuggcaggcuggccugcacuaggaauaggagaaaugccuucugguuucuucuaaaauuaauguaauaagaugcauuaaucagaauucuaucaagucuacacacuuggcccaggcuuaagaagcaauacuuugaaacugcaguuggcuaagcuucccuauucuuugugaaucagagucaggguugaagaaggaaaaaaaaaaaaaaaaaaaaaaaaaaagaauagcacuaauguuuaagaaaaacuggcaacaggaaaauguuuaagcaacuuuucauuccuuagcuccaccagggauuacagaggguuaggggaagguuugaccuuuguauuuccacaaacguacuucagacugugggaucaaaaacaguuggucagaacccaagccaagucaggacugguuugggcaauagcucaggcccaagguauuuacuuguuuguuucugucuaauaauaacuuacucugggacuugcaauggaaucuuggcuauuucuugccuucagauguuuguaaccaggugaugaaaaauuuuggaaacugaaauagauuacacagaugaguacuuggcauugcauaacuuuugacuuaaagaugaucuucucaagaaaccaaaaaaaacugagccacaaaaucagagccaaccccaguuucuucacagcaauugcucauuuuuagaugauacucuacauuuuaaagugacauaaaaguguccugaacauuguacuacaauuugguugugcuuuuaaugugacacagcuacaucuguauuuacuauuacaacucaguacccaaaagaugaaaauuuuuaaagacaaacggccaggcuuuuguggaagaaacauuuccccucauuguaucaaaaaaaaaaaaaaaaaaaaaaaaaaaaaagaguggcuccuucuugucugguagauuucaguaauuggcaggauuuugaguaagcucuuuuaaaagcccuccauuucuauuuucacauuaaacacacuugcaauaucuauuaaaagcacaaauacugaagaacacaccaagacuaucaaugagguuacaucuggaguccucgauauaucaggaaaaaaugaagugaacauucacagaguuuuacuucuuugggaacucaaaugcuagaaaagaaaagggugcccucuuucucuggcuuccugguccuauccagcgucccaaauuuuacaucaauucuuuaucagaggguuuaucagaggggguccaguuagggauuuaguuuaaacaacagauacuggauucugccuucauuuuggggaguauuuauucacauuaaggcagaggggauuccaugcuagaaaagcagaauagaagcaggaauguuucugccauguucuggcuaugaccacuuggccuuacaguucuagggugauugagcaauaucccaggaaggacacacaaggucacccaggagacuugggaacaucgagagagagcagggccagugaauggguuggggagagaaccucugagcccuguauauaucuuggaagucacucucaaguuuauauuugggcagacagagccagaugucagcauggacucauaggcagccaagcagcaagaggagggucacugaaacacuggcagagaggucugcguacaacuguccuuggccucagacagaugcauugcaguucuaaagcucuuuugcuccuuuucagauuuccuuaaaagaacaggaagggaaggaaggauuaaaacccaggggaagcaaaaggagccauggcucagacgaaguuuccuuccagagagacucccucugcccccauaaauguguguuuuggaggacagcuuacgcauugggcaaggaggucaucauggucugagauuucaaauucuuggucaggguccuggcaagaggcagaugguacacucaaaacggguaacguaagaaguguuuaguaaaggcacuguuuguaaaggucggugcaggguuuaaggaaacagcaagguuucaugcaauguacuccaguuaguaacagcaggaacagcuccugcccuugucagcuaaaauguaugaaaccuucuuuuuuuuuuuuuuucucgagacagaguuucauucucucagccaggcuggagugcaguggcacaaucuuggcucacugcaaccuccaucuccgaggcuuaaggaaaucuccugucucaaccucccaaguagcugggauuacaggugugugccaccaugccugguuaauuuuuguauuuuuaguagagauggguuuucacuauguuggccaggcugguuucaaacuccugaccucagacaaucugcccaccucggccucccgaaguguugggauuacaggcgugagccacugugcccggccuggacgaaaccuucuacagaggaagguggugaagugacacccugcagggagcaagccugaaaauuaaauugcuaaauccaaccagaagaagaaagggcaagagagccaacuauggucagcuuccaggccagguggaagaauguggggagcacaaagguagcuggugcacagaccgcacgcgagagagcccaagggugguuuugcaagggcagaugacaggacuaguggggacaacgcccacaguuccccaacuucaaccagaaggccuuggcuguaaugucuuauacacugccaugucacauuaguuguuacaugaaggcagaacuuuuucccccaaaauaccugauuggaaaaccuugacccuggaugucacgcugguuucucccaggucuaaggugcaugauuccauagaaaagaaccaauguaauccacaaaggauacaucuugaaauuggauagguuggaaaaguacacaggugccuuuauccacgccaucacugcaaccucuuuuguuuuguacauauaugaaaagccaacauucuaaaguagagguucacuuaauuuuuuuuuuuucaagagaggcuucuugguaguuucaucacacagugguuuuauuaggggauguaaggauuacagaaacaucguauuuuuuaacauauaguauuuuuugaauaugauuugaauuaauauagaaaagugcauuuuuuccaguuuuuuagggaaaaggagauacuucaccaggaggauaaaaaggaacaagaggggaaggggaaauaaaaauuccagaaagaugaaaaauuguugauguaagauggaggcacauuuuugccaaaauucucuagaagacagaauuauuauggcuucccaguaacugacuccgcuugccggcagcgggaggaucuggccggguucugucuucuccugcaaugacacacuguccugcacugaaaacuugagccacagcccaugugccugggcaguauugguaagugcagauauucagcaaggaaagaaaagaaaacuccuaaaagaaacagcaguugccuuaaaccagcggagauauaauagaaccuauagaauuggggguggggagacaagcuucaggaagguuaacacuggggccucuacauuuucuaauauagauuaauggcuugcucaggcaagcagcuacaugcuugcuaaaugugcugaccgccugaaauuagcaaagguggugacgaaggaagggagaaaaaaaauaaaaugagcugaaucuguaugugccccacucauccuggucugacauaugacaaacaaaauuaacggcgacaaagagaaagcaguaaguaucagguaguagaaaacaaacaucgaaugaaugugauugaucucaaaggaggccuuuuguugcuguugauaagaccuuggagacacaauggauacgugaugaacacacacacaggagcucacacaugcacacacacacgcacacacauuccugcccacauauacauacaucaaagccagaccaccacagaaucagauaggcaucauuauauaucucucuaaccaggacaaaauauguguccccagaaauuagaauagaugaucuuggacucuagcaaaacucagcucaaguauccuccauucugguaaccaccugacaaaaauguuauuaaucuagcacuugaaagguaucaagaaaagcaggcuucuuggacuuaaauuucugaguguuuuuuuuaaggcuguauauuuauagcuuaggagggaaaaaaaggaaauuaaggggaaaaaaaauuaaaugaaaaauacuuaugaccuaaaacaucucugugagguagguaacgcuaugauagcaaaacaacaaaaaucagaagcaauauuaaagguacauuugagaugcugaauuuuuuuuuccuaaaaaacaaucaaccacuuauagaacaacguguauacaaguuggaaaaaaaaaaaaagaaaacaucucacaaguaucucaguauuuuccuauaacuagacggaaauaagaaauuacauggguuuaccuauuaagguagauucccuaauuguguuuccccaaagauucauaacaaaauucuuauauuugauuuuauuuuuccauuuuaagacaaauucaccagugagucaaaaccucuuuuaaaaauauauguguuuaagaagaugugaaaugauagaaaauaagacaggggaaaauauuuaaaaaguuugaaaacuuauaacacaaacauggggucuuuaguuuauggggcuuguaaauuagugcugauucugcauuagucaaggccuuuggauagauuuuuuuuuuagggggugggaggauggagucucauucugucacccaggcugcagugcaguggcacuaucuuggcucacugcaaccuucgccuccuggguucaagugauucucgcgcgucagccucccgagcagcugggauuacaggugccugcgccuaggccuggcaauuuuuuuuuuuuauuuuuaguagagaaggaguuucgccauguuggccaggcuggucucgaacuccugaccucaggugauccguccaccucggccucccaaagugucaggauuacaggcaggagccaccaugcccagucagauauguuucuguuuuuggguuuuuuuuaacaaauauuuucaagaaguuguuugacauuacccaagaacauaagaccugucauguuaaaucggugucacccugagggucucaaaacccaauggcaccaagagauggccuguggcuggcugcugauguccucuauaauguccacccucacagaauggggcauuauccuaaauaugccccaaucuuugggaugucaucuugucuuuuaaaaaauuggcagauacagugccaaguuaggacaccuaguuccuaugcauugccaugcauugguaccuacuguauuuggucucugugguggcuggggacuuugggguucaaaagagaaugagacuugauccuuuucagaaagaucuuacugugugagaggguaaacaaugaugaggguaagaaccacagcuuugaugguguuauaauagcuauaguuuaucaaguaauuauuacaugucuggcacaauucuuuaaaaauuccauuuauuccucaaaagaacccuaacagguauaucuuauuaugcucaugacucaguaagaagagagaggcuuaccaagcuuaaguaacuugaccaaguguuagggacugaauguuugugucccucuaccccucauucauaugucaaagcccugaccaucagugggaugguaucugggugugggacccuggagagguuguuagguuuagaugaagucuugaggauggguccccucaugaggggauuaguagccuuauaagaagaggacaagggggcugggcaugauggcucaugccuguaaucccagcacuuugggagacugaggcagguggaucaccugaggucaggagcuugagaccagccuggccaacauggugaaaccccguuucuccuagaaauacaaaaagggggaaagagagagagaaaaaggaaaaagaaagaaaagaaagagggagggagagagaaaggacaggagaggagaaaggaaagggaaaggaaaggaagaaagggaggaagagggagaugaagaaaguuaauagauacaguaaauguacacagugauagcuucucaaaggaauucuagugacauaaauauacuaguagauauaauuccccgaagugauuuauccaacccagagagccuaugaaucacagagagaaugaaggaucaucaauuacucagcaauugcagaauaauacaccuauguaugugagugaccauguguauacaacauaagguagaucacaacuaagaaugucacaaaacacugauuguuuuucggauacugaauuaccaaagucccuucagacuuuuucaucauuuguucacugcauuccucuaaaauccagacgagaagaggaguugucuuacuggcacacugcuuuccugucccuucccuuuauaaaccucugaaauacagugcaaguuacuaaacaccagagaagcucuuugaugcguccucgguucaccaaauaugcuucuggccacggaauccccagcucugccugcaguauuuucuaaaugucugaaugcauaguccacacagcauuacugucucuucuggcauuaugacaaaaugacugagcacuugucuuuuuggaucuugcgcugucauuugucuuuuuuagggaguuuuuuuuccccccugcauaagaugauuugucuccaaaaagaaagucuucauagaguuauuccuacagaagggagcaaaucuaguuuauauucccaccuucuuccacccuugauacuauggcccgcuucaaucagcauuaggcaggcuuaacaauuagaaccaaacguccuguucagcggaagaaauaaugggagguaaaauacuccagcacugcagaauuugucaaggcaaucaugguagcagggaaaugcuuuaaucaguuguugacuauuaauuuauuuuguuaacagcaaauauggauccaagaaucucaagugauacaggggguucccauaauacuuccuagggauguuuucugaguugacauguaauauuugauagcuuauaugaacugccaauacgcugucauucucaaauguuaaaaacaaguguggcugcauguguccacauaaauauaccggcugaucauaugaggcaggguaggugauugggcagaacaugauauuucauagcuaagcugccauuuaacagauccagguggaaauugcagaucagcugagaauaagacuguguucugauagaaauguuuugaaauuuucaguguaguuuugaaaauguauaggcaagggguacccgucacucugaagaagaauauuaaaggaccauuuaacagaacuguaugagggcuccucuuccccauacucuuaauucacugguuuaggucuggaaauuuccaucaagggcugaaggauuaccaggaagcauaaaaauggaaacuucaacauuuuuccuuugaugaauccauguucuugguguuucuauuggugcugagauuugccagaugaacaggauaccaaggguccccuaagggagacuuugcuuugagaaggugaguguggaacaugcuaacccacgggaggagggaaagcucauaugcacaugcaacugaucugccauagagggucaucauccccugggaacagugacccaagagcuuuuaggagcucacacacugaacacaccgcuauccuccccuuccuucuuccugucccagcuaagcuuugagaaauugucaugacaaccacagggucaaacaaagcccacauggccucauucacacucccaguccucuuucuagaaggcaucuggaaacagggguggggggccccuguguacuagguuaaauuucuggaguuucugaaaaacugauaggaggagggaaagaagacaugacaccaaaaauaaaggcuaacuucuaccuauuuggggcaaguggaaguuggaaaggaauacugccagaggcuggcagaguccucaggguagagggaugggcuucaacuuuaauauuaaccugaaaauuaagaagugauuucaucucauuaauacauacuagggaagggaagcagaauauaucaaauauaauaaaaaguuuucauucgaaaaaugcuuuuuucuuccuagaauaccacggugguuuuuucuuuuuuuuuuuuuuuuucaagaucucuauuggcuuugcuuugguuccuguuuccccccuaaaaaaaucuaacuucuaaaaacauucugcucagacaaccauuucaaguuauaggacacaugcucuaaaggaaaccauccaggagaaacauuugcacaaguucuccuaugacuugagauugcaucugagaagggugcagggggagaacagacagaaacagcccacucugugugcagaacgccguguguccucaguguuucucggggcccauagcucauuagcugcaguugguaugaagccugcaaccugugaggccauaaaauuccgaauaauaauucaucagguccugagaauucuccuaaguacauuuagaucaagcgcaugacauuucgccccuaauagcagcauuggcaaauggccuaacggaauuuagauggcuccaccaagccacacaacuauauuuuguguguucaaaugaggggcagccguagagguugauggguggacauaaaauagcaguuuaggcuaguggucaagaucacacaccacgacacugggcaaauuagaaccuacgcaucucaauuuacucaucuuugacguaggauauuaauauggaaccacucaaucuagugugaggacuacaugaaauaaaugcuuagcugaugcaggaaauuaaagaugauggcauguuuuucuguuggaguuuauuuuaaaccaaugaagcagugaggaagaggccucuacuucccagaauguuggcuacugacuuuuccaguuaagaacacccuucuaugacaucggaaauucacaaagguccacauuuuuaguaaucaucaauuaguaaauauguaaugaucagguuaguauggauucaauaacacuuuaaaauggauuucuacuuuacacaucccaauagcauuuacccauauuugaaaauuauuugcaccuauaucuaagaccuauuauuuacccuaccuagaauaaaauacuugcagcauauacagguuugaaguggccauacaguaguuguuccuggguugcaaacggauccauaguccaaaggggugaaugacugcucuugaggacuagagguucagggucccuauggguaucacaggaggagcauauucagagggguuaaaagaggacaugaucuugagguggaauaacaugggugccaaaaauugaggagugggguugacuacagggaguccugguugcuugggccuaggcccuaggagagucuccaaauggggaaggggaugccuuugagcacaaaugucuguggggaaagaugggacauuugaacugguugacuuuaauucuggagugaacauggaaaaagaaaaaggagaaccagucuccaaagcaguuaaacuguccgaugaaaugaaaacguucuguaaccgugcuguccaauguguuagguacauguagcuacugagcacuugaaaugaggcuaguuaaugaaaccgaagaagugauuuuuacaaauguuauacaacuuuaauucauuucaguuuaaauagccacauguggcuaauggcuaccguaucagacaaacaagcagcucuacaguuuggucaggccacuuuggagaagccccaauuauguaacaguacguuguuucuucuuucugagaaucagcugaugcccauuacaggcuggcgcccuucaaucuaagagaauauuucuuuccauaagccauaaaaugcuccuagaugaaauugacuggcuucaucccauggcacuccacauuugccacauuugaaucagguuuuagccacugucguuaauuagaauccauguagaagcaaaaacauuuaaaauaaacccgggcccuugauguuauagcugucauuuuuuuacauggccucaugauucagcgauuaauggaccuuaaaacaaucauaaaacaucaaggccuguguucaagcuuagaagaacaagaauaguuuuacuucugcucugguccucuuguuuuagauucacugggugucacuggcaucuguaaacacuuuuaaguauuuugacauugugguaugagauguuguuaaucuguuuccugccugaccuucacuggccaguggcauguugcgacucaguggaaaauucaugaaaaacagcaaggauguacucagugacauagauuaggacacaagaaaccuaaauaauggccauaaugugcagauuccaauucaauacauggacccaccaaagacuuauugagcauccagucugcaccaggcacuugguggaugcuugcacaaauuacagauuuuauuugcauaauccucagcacaaauguggggucagcauuagugucccccauuucauagaugagcaugcuaagacccagucauguggcuaguaagaggcagagguaggauucaaaagcagguuuccugaccccuugccaaauaccauucuuuucccaauaucccacugcaggacacgaacuguuugcuuauguggcagacugcaucuuucaaaaguggccauggcaguauguccagucccacauucucuuccagaagagguggggucuauuuccucucacugcaaaccugguuggggugggucugacagccuaaaaaauagaaugcaggaaaaccuagggcuauguaacuucuauggaaggccauaaaaggcaaugcagcaucugcuugguucuuucucuugggacgcucacccuuggaacccagccgccauauugugaggaagcucaggguacauggagacaauguguagguguuccagccaauagacccuccagcaagggucccacccaccagucagcaucaauccucagacucaugagugaacaaccuucagaugaucucagacccuggcuuucaagcugcuucagcugaugcuggagcagagacaagcuguuccucagagcccugcugaaacuacagauuccugaacaaaauaaauguuguuguuuuaagccacuaaauuugggggugguuuguuaugcaacaauuguuacuggaauauagucaaacuuuaaugaaacucuaaagaauagggaaaugcuucaauucccucaucaaugauauccaaauggccagaaaauggguucucaugaaagaaauccugagaggaaaaaguucaaggucuugguuguagaaaaacaccaagaauuuggaagccuuauuauaucagggaauuaagugaaacauuugaaagaaaagaaaacagacagccuaaugaauauaccacaaaguuuagauuuaugggauuauauauuuauugcuuugacugcuaagaucuaucuagagccucaaguggcuuuggauuaauucauuauuuggcuuugaaagauuucuugucuuaagaggauccuccacuucugucucgagauuauaggguggcauuggguguuauucccuaauguucaaaagaugagaaaaauguuccuggcaugcuagaaagaagacccaacaaggcagaaaaaaacucuuaaucuuucuauauucgcagaucuuggcacuguccuugacaguuuggagaggaacugaaaacagaaacaaaaacaaaacaaaaacuggauaucuauggagauauagccguauaaagaguuaaaggaaguuggcaaagagugacagugacuuauuuuugacacucccauguuucacccaaauaagaagcuguuuaagucuuaacagugauuaaucuaaaaauccaaaguagaucccacucuucugcaucuaccuucaagaugccucaaaucuaugcuguaggccgggagcgucagcucacgccuguaaucccagcacuuugggaggcugaggcgggcggaucacgaugucaggaaaucgagaccauccugcauaacacugugaaacccugacucuacgaaaaauaugaaaaauacaaacaauacaaaaaaaaaaauuagccaggcgagguggcgggugccuguagucccagcuacuccggaggcugagacaggagaauggcaugaacccgggaggcggagcuugcagugagccgagauccugagauggcgccacugcacucgagccugggcgacagggugagacuccgucucuaaaaaauauacauauauaugcuguuuuggauuugauucuccagaggcaguggugaacucaucaggucucucucaaauacacuuuuccuuucuugguuaaauauucuuugccuccuuaaacauuucacaaucuaguccuuaaauuuugauauuuugguagugauauucuuaauuucauguacaagaccacaugcagaaaaguacuuuuauuuuuaagauggguugcaaauaucaggagaaaggggcauuuugcucaugcaaagcuucccaaauacaaauggaaacuucccaaauaucaauggaaaccauccauagacauugguagcaauauuucaaucuuucaggaauuguuaguuuggaggaaauuuagauuacuuggguggcuuuuaaaacccguaauacugucauggcuacauccuaaggaucacagaaugccuaagguauaaacaggauuuuuuuuucuuuucuauugauggcugugaauuuucucugcacaccugaacuaucaagguaacuuuugcuacaaacagcauuuuaaaauuaucacauaaaaaacuaucaagcacuaaauuagaaaaaaaacagaaauuugaaagugauaguuaaauuuaugaagcaauucugcuacacucaaaggcucauugcuugacauguaaaacauuuugagcuacguguaagaccuggguaugaauuucccuccagugggagaaaccacaguucucaucaggcuccaaaugagagccacacgcagaacauaugcgcuucgcaugugcgcuuguuugcaugacuaauggaguuaauauuaaaagucuuuucucaucauuucaauucuuucuuucuuuuuuuuuuuuuuaauuuggcugagcgccuuuuuuccuaccuccaagagcuguuaauuuuguucgcugccgagcaaaagucaaagucagagucuaaacagcuuguaaugaguuuucaauggcccaucucaaugaaauugagggcaaagaccagccggcucaggcagugucagcccucagaauuuauuagugagggcgcacuguguucaggggaaggcauagaggagggacugcaguuccugggcucuucaagaggacccccagcccuuauuaaaaaguugugacagcgacaggacacaugcuaucugacccaucugccacaaucuccacugcggcggggucaaacuugguugggaaugaaggagagggaagucagaugaaggaaagaaguguuuccaucucauagugauggggcuguuucuaucuuucuaucucaucaucaaucagcuaagaaggaggggcgccuuccuucuuccaagaucaugaaguaccaccaggccaccucccccacccacacacacaccuguuugucuggugaugguuauuugggagaaacgaagcaguacucaauuuuugagcucugacuauuuuauuuguucaauucuuuuaaaauuccuccaucaugccacuuccaacagauccccugugguuuuacuuccaagaaugccauuuaggcuggacacgaugggucaugccuaaaaugccugcacuuugggaggccagggugggaagacugcuugagccuaggaguuugagagcaaccugggcaacauagggagaccacaucucuacaaaaauaaaaauuaaaguuaaaaacauguccagguauggugguauaugccugugguucuaagcuacuugggaggcugaggcaggacgacugcuugagcccacaaggucaaugcugcagaaagcugugaucgcaccacugcacuccagcaugggcaacacagcgagacccugucucaaaaaagaaaaaagaguaccuuugaaacccacguaauacuuuucugcacaaauuuaaaaccuccauauaaaacagaauucugcaugagcuggagaaauaaauacuacacuugagaaugaagagcaauuugacuauagacuuucuggccaaauaaauacucugcgaagccacuacaauaacacacaagagcacguggugguuuggagaggaaaaaaaaaaaaacucucacuucuucauagccacagcuuuuuauuuaaggaagaaccuaugugguuuguguuaagaacugacuuguugugugaguggaauaaaucagaacuguuggauccugaaagacuaauuuauauauaauugauauuaaacuaugacugauuccaagacauuuuuuaaaaauaaagcaccuacuagauacucuugcaccuacuggccacaguacaaggcaccaugaauuccauggcaggccuggugaugaaaaucauuucaucuuucuugccacucacucguucauuuuucuguuuguuguuuuuuuuuuuuuuuuuuuuuuuuuuucagaugaagucuugcucugugacccaggcuggagugcaauggcaucaucuugucucacugcaaccugucccuccuggguucaagcaauucuccugcuucagccucccauguagcugggauuacaggcgcccaccaccacaccuggcuaacuucucuauuuuuaguagagacggggcuucaccauauugcccaggcugaucuugaacuccugaccucaaguaaucugccugccuuggccucucaaagugcugggauuacaggcaugaggcacgguggccagccauucaaccauuaaugcauuacuuuagucacucacuauauucacaaauauuuauuaauuaguuguuaaggacaaaacuagugacuaaguuuuggggaaaaugguuggucuuuguccucaacuauuaauaauuuaaguucugguaaaauuucauaaaauuccagauuaauauaguggauuuccaaagccuuccauaaacaacuguuuauuuaaauacacuugcuuccucggcauuuaucuuguucaaccuaccuguucaauuccauucacagaccuacccucuuucucucuguaacaauuuauguuccuuucuguguccuauagcauugcugggaaaaugaaacacccguuaaauaucuuaacacagagccugugacagaaagccuugcacgcauucaguaaacaccagccaaaaaaaaaaaaaaaaaaaaaaccuaaacaaacaaaauauaaaacaaacuucgcucuuuguguuguauauaucuggauauuucaaaagcacgucugaucuaagagugagauucacgcacaggcacauuccuugucacuuucacaaugacaauaaugcuaauaauaauaaccagcagagccaggagaagccaccaugguacaccagccucugggauaggcccuuuccacacaucaucucgguuaauucucugcaaggcagauucuguucuuaccccauuuugcugaaaaaacauugaaagagguuaagcgauuuacaccaaaucacaaaaccaguuaauuuuagaucaggacaaucggacucaacaaucuauaaaauaucaacauucaguuuaaauuguauaucuuacacagcuuuaaucuccuaaaaaaaaugaaaugucccuuugucugaaacugaaaugucaucaauccauauacacuaaggagagggacaauggcaggaugggggugcaccugcucggaagagguauccacaacucaccacucacuuuaaaacucuguggauaacuucauucagaaacaaaguuaaggagagaaauuguuaauguggggugagagcucaaaaauuugcccaguaaggacuuuggcugcauucaaaugcuagaaggauaaauauccucaucggaagcuaaaauagcaaggguuucuuuauuuuugagauagggucuagccuugucacccagguuggagugcggugacaugauaucagcuuacugcaaccucuaccuccuggguucaagugaccuuccugccucagccuccugaguagcugggauuauagcacaugccaccacacccagcuaauuuuuguauuuuuaguagagaugggauuucaccauguuggccaggguggucucaaacucccaaccucaggggaucuaccugcguuggccucccaaagagcugggauuacaggcaugagccaccaugcccaccacaaaaauggugagugguguuuguuuguuuguuuuaaugagguagaaaccacuugagaugaguaucacuugaaccugggaggcagagguggaggcugcagugagccaagauugcaccacugcacuccagccugggcaacagagugagacucugucuuuaaaaaaaaaaaaagagguagagagagaaugacaacaaaacugcccagaaaaguggagcaugaaauaaauaaacuauuacauggggugauaguuugcauuuaugcucacuuuuuuuuucuguuuuucgaaacuuccauuugagaguuugaugcuuaaugguuauauuggggaaugccuugcaaaagcuuucuaaacuaucagacugaguguugacugaccacaaucugucaagugagugcuggggaggagaugcuaucucaagagaaguuugcuguggcugcuacaugccugacacagacccagacacacugaccuuagcuaagaaugcauuugggauuuuagacaauucccucauucugaaaagaggccugaagucaggaacccccuaaaauguuuucaguugaaucuuugcuguucucagcuuccccuuuggccgucagcugccacugcaagccauuuagcaaaggaagcgaauggcaaauucuaucacaguggggacagauucugcauauuaauucacguuugcaggcuaauuaugaccauauaggcuuacccccguuccuagaccuccaaauucguaggagaaagaagaaguguggauaccacuuuauuuggggccauuuucauagccagugacuacaggcaccuacacaaucauagccugcagauauuauauaacgacagcuggucacucuauuccaagcggaauuuuaaagcaacauauuugucuuuguguuaaaagcacacgguacacauuuacagaaaaacaggcccuggcauuugucugaaauacuguggcugaaaagcucgacuuuuuuuuuuugccauggaacaaugaacauuuacacaaucauuaaaaucgcaucuaccgccauauuuuuucuccuucucaguuuuaauacauuuuuauaauugcauugaagauauucuaacccuguuuuuagugcaaagauaaaauuuaugaaccgugacaaacguaucaucucagagccaacccgaaggauaacaaugugcuugaugaaacccaaguguuccuucccuucugcccauuuuaauggggaaggagagaaaaaagaguucaucggaaccucagaccugcaaugccagacgcgggggaaguuccuaacuagugccugagauggaggacguauuucagggaaaaguagucauucacauagaaauuuuucuaaagcuacauaacuggaacuuugacuaauaugcauuuaaaauuuguauauuggguauaauugggcagcuucugucaacacagccaaagauaucuaaauaaauuuguucucccaauggcaugcccaauucccccucucuccauuuguguacuuucuuuagagaagguuuuuggacaauauuagagagcaggcagcauaaaagagcagaaaggucaguaugcaaagugccacagaacaugagcuccaagguucagggggccguccaaagccaugugaccuuggccaagucccucggcuucugacagccucaccccuccucaauuccauacgcagagauucggaguggacuuuuggggucuaaaaugacaugugaugacgauauuauuuaaaacaacauaaaauaccuccaacuuugagacucuaucccuggugaguaaaaucaguuucauaagaaaaccuuaaaugcugguaaguucuuaaaaauccagcaagcacagacgugugagcauguguuugcuaacccagauggacaccauacauuuuuuaaaagugauuuuuguuagcaucuacccugggguuuucauuccuucucacagacuguacccugcccaugaacucuccguuaaagagacggcaagacacaagccuaacuccagaugaacuuuucugcaccgugucccuguuucuuuagaaaggcagaguuuuaaauauuuccuaacuucacauaauagccuugcauaagacacaaaugccaggaaccauaaugaaguggagguaaucuacacaauuuaaaaacacuuauugugacaaaauggauugacaagguauagacgauacaagcacauauaaaugaaaugcaucccaccggaaaagcauuuugcucacauuguuguuuacggcuccugaauuaauagaccaagaaaggcaccaccggccccaacaaaaugccauaaaaccacuggcagcaaguggugucucaaacuuuaauuccccuggggagaaaaggacacugccuaaucuguauucaguccugacauuggccgcaucugauauggaacauuagcuucuaagucucucaauagaccaguguccuucaguuuauauuacuuuauguuaauaguagaaaaauuacacacaacaucauuuaucauuguuauacucugcuguacaucccauagcuuauuuuaauauauuuauuuaccccugagauggugagaaauuaaaaauauauauguuucgagaaaaaccuauauggaaagaucacuguaaaucucuuaaaaaaaaaaaaaaaacccaacaacaacuaccuuggggggagggaggaauauauugcauagcuaagcuugugaaugauaagaugcuuucugucuaaggacucaaguacaggcuguacaauaauuucuggggcaugaguacauaacaaaaaagcggcauauuaaugauaaaauagcuuuuguucccgcaucgcaccaguuuuuucauuugucgaugacauccuuggguuguguuauuagcuuuuuugacaucugaccucuagcuagggaaaggcaagauuuuuuucuuuuuuuuucucucucuugaaaagcgucaaucugagccugacuucuacucuuuuugacccagauucuggaagcccaaagcauaacuucaguuuggauuaaaaauaacaaggcuauccuuucuugcucacguuguggcaaaggugccguggcuuugguaucaugaccucugcgcucugguccaagcucuguccuuugcucccuauauaacaugagcaagcuaccccaucucucugaaccucagcuuccccagaaacaaaaggagaagacuggauuccaugggcuaagauuucucauagcuccagugaauuuuuaguagacuuugcuuuuguuuuuagagacagggucucacccugucacccaggguugagggcaguggugugaccaugacucacuaccgucuugaccucuugggcucaaucaauccucccaugucagccucuugaguagcuaggacuacaggcacgcgccaccacgcgcagcuaauuuuuguauuuuuuguagagacagagacuugcuauguugcccagacuguucucgagcuccuagccucaagagauccuccugccucgaccucccaaagugcugggauuacaggcaugaccuaacgcaccuggccuccaguggauuuuugccuggagauuuuucugggauauuguuugcuacuuaucauaguuccuugagacuggacgaaucuuccuauuuuucaaauaagcacauggaagcucaggaauauugacaugacuaaagccccagguugaaaaagcagccagacuggaguuggaacagugccucaauccuggcuggcacucuugucuugacuccaggcugccucgagaacaucucuacaaauuagagcaaugggaaugggucuacuuuaggcauuuggggaaaugacuacaagcucguaccugucggggcugccuuuuuauauuugauuuuccuuuuuuuuuuuuuuuuuuuuuuaccacuuugacccuuaaaauugcauaccuuguguccugcaugauuauacaauacagucuuguaauuauguguucuuauuugggucagagguggcugacuugagaucaugucuucccuuuagcagguucucuucauucagaagccacucucauggauuaugucauuucuuccacauccaaugaggcagacagggcagguacgauuuccccacuucuauugauaaagaaaguuggggcccagcacaguggcucacgccugcaaccccaacacuuuaggaggcugagguggguggaucacuugagaucagguguuccagaccagacuggccaacauggugaaaccccggcacuacuaaaaauacaaaaauuagccaggcaugguggcucaugccuauaaucccagcuacuuggaaggcugaggcaggagaaucaguugaucuuagcaggcagaauuugcagugagccgagaucgcaccacugcacuccagccuaggugacagagugagacuauggcuaaaaaaaaaaaaaaaaagaagaagauaaagaaacaugggaucaaagguucuuacugaccagccagagcucacacagcaaugaguggcuggauggccguugggaacugaagaaugcuucuggcuccuagcccaggcagggcccuuucuaauacuuugcaaugaugcugauaaacagauauaucucuaacaaauauggacaauaacuccuuccaaaaggcaaaauaaaacucguaucauuuguacaagaccaugcaauuuaaaagcaauauuguaagcaaucuacaauagaaagcaagccugagaaggcaauguguucacugaaaacauuucucuugccuccucgaggcaucaccagacuacauuucccagaaucccuugcaguugguugugaucaugugacugaauucuggccaaugggaagcagguggaagugaccucacugcuuccaggcuugaccuauaauaacuccuuggaaacuuguacuuuuucuuccccugucagaugucuggacuuaaaggauccagcagaggauuuggaggcuccaggguauggcugagcccaagaugucaaagucugggucagugaaucacaguaugggaggccaguugcugaaugucuauacuaauuguuacuucagcaagcaaucaacgacaguucuaggaguuaacaguuaagucaauccugauuaaggaagaaaguccuggaaggaaggcaaggggcguuucuaaaugugauagcuagguagacauucagagccauucucuuagccagucuaaaguauuuauuauauauacugucuuugagcaaauauugccacaaacuuccuuagugggucuuaggauauuuaaacauucacaaaauguucuuugccuuaucuuagacaucaucugauuuucuuccucaauuaucuuccauuucguucgcuuacuuaaaccuuauacuuuuguuuccacuugacaguaauaaaagccaacaucuauugcauuuauuggguacucacuauacgcuagccacucuacuagauacuuuauacucaauaucucauuccauccucaaggacauuagcuagaugucaguauuguccccauuuacagaugaaaaaccugagguugagaaauaugagacuugcccacuagaaugaauccccagagccacacccaaugcugacuguguauguuaauaaaaaaauaaaaauucaaaagccagaauuauacaugaguguuccauuagugaggcguggugcuccaagaaagcacugucccagaaaucugugugagaaauuauacccugaauccuuuuuuucagaauugggaagacucagcaguggacuaagaagccagguuugauguagaggaucuugugagcacuccaucuagauggagguugaagacaaguacuaguuguaguccauggguagccuucccaauucaaggaucuccuuuccauccuacucauucacaaaacagccaggaagacagaagcauaugguguuaaagagucagcuuucaggggguuggacugccuggacuuaaaaucuacccucuacuuaaaauccugaguaaauuauauaaaguauuuaugccuuuuuuuccuuacauguagaaagagaauaucugugaagugugaauaacauaaugcccgcaaagcacuuagcacaauaucuggcaccuuuugaacacucuauaaauguaagacauucuugcugucauuaucaauaucaucaccaucaccuccuccaccaccaacaccacccucgaaaacaggauaugcuuaagcaccaacguccaaaaugaguuggcuggaaaaaucgccagcucaaagaucaguguuaagccuccaacucccauuacuuacagacuucccaagaugcuuacgugaugaugauaacauuaauuuaucaaccauagauauuugcaguaugccaggcacagggcuaacauacaaaaggcaagucauuucuuugucacuaacccagucaaagucagacaggugucagcagccacaguuggcaguucugugcccugugucugcaccuucugcauuagaaaggaucugccuaugcucacagccugaacacaugggucuccaucuucuccagccacagcaucacucugauagcagagcuaauaauaacaguaagcguaaugacaaagauaacagcugcaggaaugacagcaacagcuauaacuuaccaaggucuugcuaugugucagccauugugcugaccacaugaagaugguacuuuaguuaauucucacagcaacacuaagagguauuaggguuauuaccucuuagauauuauucacccauuuuuuuggaugagaaaauugguauucagagaguuuggguauuuugccuaaggacacauagauggaaggauuugucauagucuuuuggggcuuuuaugacaaaauaaucuaagcuggguagcuuuuauuuauuuuguuuuuuguuuauuuguuuguuacaaauaaggcagcuuccugagccagaacagaccgagagagacuccuggggagcuuugaaaaaaagaaauuuauuucucaugguucuggaagcugggaaguccaagaucaaggaagcagcaaauucaaugucuggccagagucccgccuccucauagauucauggauauucuucuugcuguuuucucacaugguggaagaagcaaggcagcuucuggggucacuuuuauaagggcacucaugcaauuaugcaggcucugucuucauguccaaaucaucucccaaaagaccccaucuccuaacaaaugaaugcuggggugacacagacauucugaccacagcaggauuugaaucuagccugcuguaacccaaagccuguguuacuaagaacuuugcuauauggcaugggucuuucugagcccuaccugcccuacauccucuucuauaucaaaaauuucacuuuuuuuuuucaaauauuuuauuuuuuguagagaugaggaggucuugaacuccugcccucaaaugauucuccugccucggccucccaacgugcugggauuacagacgugagccaccuugcccagccaaaaauuuucauuguuucuaaccuggauuccucuucaaacccuucuaggcaauguuuaucccacugcaaggaugaguugcauuugcaacauuucugaauguaauuauaaguuauuuccauaauggcugaauagucugaaaaaaaguuuuuuuugcugugugcuauguaggcacauugaauaauauuuaaacaauaaagguuaccucuuauguacuacagcuguguuuuaugcuaauaaccagaaucauuuaaucauuaugagcuaaugaccugcaaaauuucauuuaaaaaaugaagccauaucugggucucuggaaagcaaaacuggauaaaaaaugaggaaagucaauguucaauuuguauucuugaguggagagcagccguauagucugugcaguuccauaccaaguuugagcauuuaaacagaggcaggggccuggcauggugacucacgccuggaaucccagcacucugggaggcugaggcaggcagaucuccugagcccaggaguuccagaccagccagugcaacauggcaaaacaccgucucuacaaaaaaauauaaaaauuagcugggcauuguggucccaguuacuugggaggcugaggugugaagaucacuugaucccaugagacagcaguugcagugaccugagauugcaucacuucacuccagccugagcaacagagugagagccuuucucaaaaaauagauuagauauagauacagauauauagauaagaugaaagaaagaaagggggcagcgggggcaaggaaauuccgcaucuuaagggacuuaaugguaucacuugagcaccaacgaaauaaagagauuuccuauugcauugccaugguuaucaagguuugggucugcgucuuuccuucugucuguacagcacucuguccuucuaguguggauucuguuacugcuaaauccccggggugagcagagagcagagcuguggacaaucagagcucccugcuggcaaucuuggugaggauccuggccuuccuuggcuuucccacccugaaccacucuuugcuuuggcuaacccucaucuuaagauuucuacaggugagaugccucuauagacuuguauaguaagcucuauccauugucugccccaaagguauccuuccucuuuccuuacuaaaauaauuauaauucuguuugggcgacagagcaaugaaucaaaaucaauccaagccagugugaugugacaaauuuguauuaaauggcccuaaguuuuuacgaaccccuuauccaugcccucugccgugcagacuugcagcaccuuuucagucuguaagugggacauacuuccucacccuggaguacgaccauaugauuugcucuggcccagaaugaagaagcaauaggaagccaucuccgagcuuuuuauguuucugccuguuuuuuucuguuucuaccuuuaaccaugaaaaggauacaugugggaaguagaggagagagauccaagguggggcuggguuacuccagccaaguccagccuagaucagcccauucccagccccauugccagacucgugagaaagaugagcagagcaaugcaggggagcuuagccaaggucaccucaaacccagagauggcgagaaucgaauguuuauugcugcgggccacugaggucuaauggugguuugugaugcagcaagccugcggcaaugacuaagggauacaggcaaccguccugcucccccgcaccagggacagggcuaagcugacuaugggauguguagcucaaggugaaauaagggaauguccaguacugacuucugaaagaaauuuccucccuuaaaaaaacaaaaaacaauaagaaaaacuugugaagagaaggccucuucuauguauuuuuuguuucuuguuuguuuguuguuguuguuguuguuguuuuugagacaaaaguuucacugucgcccaggcugcagugcaguggcgcgaucucggcucacugcaaccucugccucuccgguucaagugauucucccgccucagccuuccaaguagcugcaauuauaggcaggcgccaccaaaucccagcuaauuuuuugcauuuuuaguagagacgggguuucaucauguuggccaggcuggucucgaacuucugaccucaggugauccacccaucucauuaucccaaagugcugggauuacagguaugagccaccgcacccagcccuucuguuugccucagauucacuaacuucagauggccugcgaagguaugauccuuagagcagugaaacccaucuggggaacacaagagaaaggccaagaccacgacagggcaaagugcugacaucaaggagucacucagccagcccuggaacagucuccuccaaauuacguuucaggagaugaaugaugucuccacugcccaugccagucucagaucggcugcuccugccugcugaaugcuuccuaauacauaaaccugagacugccguugaguccagauccacaacacccagcacaucaccagacacacaggaaacccgagugccugguggaucggagggaggguguguguuugcuucccaugaguucaugaggccgcccugucccggcaccuuacgcagauacagcccacauccagaugguagucaggaaagcacugagucacagaguuauuccucccacugaccuccaacccccuucuucccugcccuuccuucaggggcccuguguggaggcuucugaugaagaacaacgaagauuuuccuuuuuuucacuuuuuuuuuuuuuuuuuuuuuuugagacagggucuggaucugucacccaggguggagugcaaugguguaaucuuggcucacugcaaccuccaucuccugggcucaggugauccucccaccucagccuccugaguagcugggaccacaagcaagcaccaaaacgcccggcuaauuuuuguauuuuuuguagaaaugagguuucaccauguugcccaggcuggucuucaacccuaggcuuaagugauccucccacuucugccucccaaagugcuaggguuacaggcaugagucacugugcccagccaacagugagauguuacuaguacuacuuauuuguaaaccacagucuuguuuugauuuucucugaaccuuuguacuuguguuucauguccaaggcaugggugaagaaagaaagaaaauuaaucugccagagagaaaacaggcuccucuuuucaguuucugcuuaucuccuccauguuaaauaggguuguccacgguaguagauacuggucucuuuuggcugaacucuuaaaguuguagguagaccuucugacuuuucuagaggagauuuaaguucacuguguguagacuaaaaauaauaaugcugagcugggcacgguggcucacaccuguaaucccagcacuuugggaggcuggggcgggcaaaucacuugaugucaggaguuugagagcagccuggccaacaugaugaaaccccaucucuacugaaaauacagaaaucagucaggcgugcuggcgugcgccuguaaucccagcuacuagggaggcugaggcaggacaaucaccugaacccaggaagcagguugcagugagcugagaucgcaccacugcacuccagcccgggcaacagagcaagacccugucccaaaaaaauaaaauaaauuuaaaaaaaauaauaauccugaaacaauaacaguacucgauuuuagguauuaaaugcuuccuaugugcaagguguuauacuaagagccuuacaugaauaauauuuaauccucuugaguguccaauaaggaaagaacaacuauuguuagcauuuuauagucagggaaacugaggcuuggagaggugaaguaacuuguccaaagugacacaauaaguggcagaauuggaguuuaaguuuacaacugucugauuuggaagcccaagauccuaaccaugcugccauauggucacaggaauuaacgaaaauauauccccuacagcuggagggggaaaaacuggaaaaugagcuuuuccugcaaguuguaugucaugguguuugggagcuggccaaccguggcucacaagagcugaugacuguucaaaaaauaugcaagccaguuauugaacacugccaugauuaaaauuuaaauuauauugaucuuaaaauucaaauggaaauacaagggacccagaauacccaaaacaaucuugaaaaugaagaacaaaguuggagaauucacaauuccaaauuucaaaacuuacacagaguacaguaaccaaaacaauguggcaauggcauaaggacaggcauacagaucaaugggauauaauucagaguccagaaagaaauacuuacauuuauggccaauugaucucugauaagggugcaaagaccauuuaauagagaaagaauuaucuuuuuuaaucaaugcuucugggacaaauggauauucacauucaaaagaacaaaguugaaugccuaccuuaaacuauauagaaaaauugacguaaaauggaucaaaagucuuaacauaagugcuaaaacuauaaaagucugagaagaaaauagaggggugguuucagggaaaaacucuuuucugaaaccauguuucccuucugcucucacaccaccaugacaaucaacacagaagacuccucucaccaaaugcgagaggaggggugacaccacagagguaaacguucaugaccuuggauuugacaauggauucuuagauacaacacccaaacuuuuguuguuaaaacuuuugugcaucacgagaugauaucaaaagaauaaaaagacuacccacagaaugagagaaaauguuugcaaaucauuuauaugauaagggucuaguuuccaaaauauauaaacaacuuuuacaacucaacuuuccccacauacuaagcaggggacagcagcugggaguccuccaauucaauccugacacugucuacguggaguuaguuggagguuggaggcucaguccccaagacugccccccauacccccagacaccaauagcaagucagagacuucagaaugucuggcugaggggcuucagguggaaguucccauaacccccucuuuggguuugauuaauuugcuggagcagaugacagaacucaggaaaacacuugcuaccccuuacugcuuuauuauaaaggacaguacuaaggacagagaugaaaagacacauagggcgagguaugggguaggggcauggagcuuuccagcccuuccuaggcagccacgcuccaggaaccuccuugucuucagcuaucuggaagcucccaaacccagcccucuuggguuuuuaugggagcuucaugaggucagcauuccuuuccccagggcauaaggcaggacugacucucuggggagggucugaagacucacaaucaaaaagguggggaagauuagaguccugccuuggggcaggugaaagaaggacaggagacaaagagauucuguuuccugaugccuaacacaggcaauauuguaacaauagacugcaacaagggcuaugagaguuaugagccaggaacccuauauauaucauaacaccacaggaguaaauguuuauguccuuggauuuggcaauggauucuuagauacaacaccaaaaacagaagcaacaacauccaaaauagauaaaggggacuucaucaagauuuaaaaucuuuguucaucaaaagacacuauaaaaagaguaaaaaagccuacccauagauugagagaaaauguuugcaaaggauuuauacgauaagggucuaguauccaaaauauauaaacaacuuuuacaacucaacaacaaaagccagaugacccaguuaaaaacugggcaaaggacuugaaucaacauuucuauuuuaaaaaagauacaaauaaccaauaaccacauaaaaauacucaacaucauuaaucaugagggaaaugcaaaucaaaaccacgauacaauuucauaccuucaaagaaaacagaaaauaaaguguuggcaaggauguggagaaauuggaaccuucauauacugcaaguggaaauauaaaauggugcagccuccguggaaaacaauuugguggcuccucugaaaguuaaauauaaaauugccauauuacccagcaaugccacuccccaaaauaugcccaagaauggaaaacaggaguuugcagaaaacauaaaaacaguacauguaugaucauagcagcauaauucguaacagccaacaaguagaaacacaaugaccacccacuggcaaauggauaaacaaaaagugguauauccauguaacagaauaucacucaaccauaaaaagaaugaaguacugauacauucuacaacauggaugaaccuugaaagcaugcuaaaagcaagaagccagacacaaaaggccacauauugugugauuccauuuauaugagauauccagaauagucaaaucuauagagacacaaaguagaugugguuaugaggggcugggggaaggaggaaauggggaaugaccacuuaauggauaugguguuucuuuagcgggggaugguaaaaauguucugaaauggcugcugauuguggcacgauauugugaacguauuaaaagucacugaauuuuacacuuuaaaauggucaaaguggugaacuuuuuuuguuuuguuuguuuuauuuuuguuuuugagacacagucucacucugucgcccaggcuggaguccaguggugcaaucuuggcucacugcaaccuccgccucccagguucaagcgauucuccugccucagccuccugaauaccugggauuacaggcacccagcaccacaccuggcuaauuuguguauuuuuaguagagacaggguuucaucauguugcccaggcucaucucuaacucuucaccccaagugauccacccaccucagccucccaaaguguugggauuacaggcgugagucaccacgcccagccccaaagugguaaauuuuacauuauguaaaucuuaccacaauuuaaaaauccauaaagcauguauuagaaacauucuuggcauguagaagauguuguguaacugccugcugucuuuaaugauaagcucuuuaaaggaaacagugauugagugauaugacaaacugccaacuaugggcacagaguuacuuuuacggggacaaaaagauacucuaaaauuagauuuugaugaaaauuacauaaccaugcgaauauacuaaaaaaaguugaauguuacacuucaaaugggcuuauuggaaaguguaugaaauacaucucaauaaaacaauuaaaagaaaaacauuauauaagguuacuauuaaauaaaucauacuaaaaaguacuaaguacucaaaacucaugacuucuaaauuguuuuacuacauuuuacuguuaccuaugcucuugaagucauugacuguauccuguguguggugaaaauacuauauaauaacguguuccccaacuccacuuucagugaucucauauuuauaacuuaaaauugcucaggguaccacuauuuacaccauggaaauagacauucgcuacaaauccaggugucauuuauugcuuuauugauugucucgacuuaagaaagugggguagaaaauauuaauucaggccaggcgcgguggcucacgccuguaaucccagcacuuugggaggcggagacaggcagaucaccggagggcaggaguucaaaaccagccuggccaacacgggaaaaucucgccucuacuaaaaauucaaaaacaauuagccaggcgugguggugggugccuguauucccagcuacucaggaggcuaagccaugagaaucgcuugaacccaggaggcggagguugcggugagcagagaucgcgccacugcacuccagccugggcgacagaaugagacuccaucucaaaaaauaaaauaaaauaaaaaagaaauauuaacucaaauucaaaagugugucgcucuacagaugcuacauuaugaguagcagaaaaaaauugaagaaauauuuuuugguauuuuaaaaccauuauccaauucagcaaagaaggauaagugaaguucugacauaugucuuauuuuguuuuugccuuacuucuuaauaaaaaugaaaauaucaaccaauauucaugucacagcuacauacugcaauuuuauacugcaacaaugguuuuguaauggauauaauagcgcagcaaaaaucagaagcauuugguaaaaacugacuaucucgaauuuauaagaaacaguacuguguauacuauucuucuucuuauuuguaaauuauaugcuacccauauuucagagaaauaauaaauaauaagcuguguguguacauguauaggugcacaauguguuuguuuguuuuucagagagccaguuguuaaucauuuaccagcacaccacuggcugccgauguguguugcagagugagaccaccuuggguccucaaacagccuuaacugaguuucuucccuagcugcugcugcccaagaaacauucagagcagggugcucaaagcugcugcugggaagugagaauuucugcagccaaagguugcaccugcccaucgaaggugggaagagaauuacugcagccuuaucuccuuugcugagagcgccugcuagcaaaagacacuucaucuuacuuugcuuaauucuuagacagccagucacacuugguuauuguuuuuaguuuuacauacuaguauugaauuauuuuuauggauguuauuucucaguuaguauauucccuggagacugcccaagucuuuagaauuuaacuucuccuuggcuauaacugcuguugccacaaguaccaccuacgagcugguuucauguuccucuggcugcuccugcccacgggaccuucugaacaacugcaaaagggacaccucgcuuccucguauguggucauagguugugaguaugaccacagauugucaagaggcauucgcuggacaccaaggagaacacauagacaccuucaaccaugaguaucccuuggggauccuugggaccgacacaugugaguccuuauuaugaaggucaggagcugaccuugcagucacugugcucucuuccagacugcccaccaggcuccccaacucaucaaccaccugacugggggcagcuaaaacaguaacauugggaaccacugacacugacugugagccuagcaaaugccaaacucucuucuaagugcuuuauaucuauuaucucauuuaaucuuuaaaacagcucuuugcgacaauuccuauuaucaauucccccuuuguagaugaggagacugagcucagagagauaaaauaauuuguucaaagucacaagccuagcuccagagacuguacucuuaucuaguauauuaauaaucccuaauggguaagaacuucacucaccagcggccuaagggcuccuggguggagaaaaacuaaguggagucacagauuucugauucuuuagucuucagauacaaugaggagacugaggaccuguaaucucaucagggucacaaaaggagucagggcuugacuggcugucucuuuucugccugugaacuugagcuuaucccuucuaagccaagguuuccucaucuauaaaaggaggauaauaguaucuaccuaugacaaggguugagugauugaaugaugugcacguuacaugggaaaagcaauggcacugacuuauaggguuguuauaagaauuugguguaaaugcauuuaaaaaaccauaagcauugcaugguacaaaguaagugcucaguacaugguaucuguugauaucaucaucacuaucaucaucauuaucaucaacaucaacaucaucccaccaucaccaacauuaucaccacuaucauuaucaucaucaccagcaucaccaucaccaacagcaccagcaucaccaucauuaucgacaucaucaucaccaucgucaucaccaucaucaccauuaucaucgucaucaccaucaucagcgucauaucaccaucaucaucaccaccaucagcaucuuaucaccaucaucaucaccaucacccuccuaucaccaucaccaccaucagcauuaucauacuaccaucaucaccaucaccaucaucaucaacaucaacaucaucacccucaucuucaucaccaugaucaucaucaucauacuuuuauucagaagacauuuaugucuuuguaaaagauaugggguaugccaggcacauccuuuguaccacacaaauauuacuccuuccucuccuucccaaaggcauagggcuucaggucucauacacaucaaccucuuacaggcccauucuggccucucccagcucucauucagaggcccuugcuuugguacaaagagcuacuuucccuuugcagaaagagcuuacauaaaauaaagcugaguuguggguacaaacuccuuccucucuucugucucuuggucguguagcuaacaauuucccuccccuucaaggccuggcccuguaggcccucuccaucagcccaagccugucuccacuggccauggcauguuucauucaacugcacagugccacacacacuguaaggagagcuuaacaggagccuguugaaaucuaaaugucugaugacuaagagaacaguuaagucaagucuggugcauguaucuccaauuaucaggcagccauuauaaaugaugggccauuauaaaugauggagaugugcuuuuguuuuguuuugguuuuuccugauaacuugaucauagcugcucauuuuugugcauauaggugcauugcugaugcuuuccauauugaguuuaagugauaauuaaaaugacuucagaaagaucacacuaggauucaguauuguaauucaaaaucccuguguucacaggcaggcauagaaauggccugauguaugagaaaucuaugccuaagucaaaagagccuuuguaauagauauaaaacaauacauucugagagagaagacauuuuuggaucauuguauaauuaacaauguucuucgcacucuuagugaaacauaaaauaacaguacaucuuaucaaugauugauugcaucacauauuuauaaaauacagcauaugagacuucuguaaugauguaauaauguugucugaaauaccucaaauugcauauauaguaugaucacaauuggaaaaaugcaaaaaaaaaaaaaaaaagauauagaaaagaaagaccggaaagaaagaaagguaaaagguuaauggagccugcauuugggaggagaauaaagauggaauccucuuuggcugguggacggaagggaaugcauuaauaauuuuugguccaucacucuugaauucaauuaccaaguaguuuggaugauuuuuccucccuacucugggagaguauuuagaaucguuggaaugcuguggaauaccaauguugguagcguugccccagcauaagagagcucuaccuuucuccuagauugugggaaagagaaauccuagaagcuguggcaaaaacaguggccaaagaaaaguaggaaaacagagaggauggagagggagcaagaagguucuugaaaaagcucgugcagcugaagguaaagacagcggucacuagagggaagacagaagccaggagcagagaaguccaguggggucaaucggaagggauagguggccugaagaggaaggacagggugaaggugauggcaaggcgagaaggcuggagggggaaauuaaagccagugaagguggugauuuacauuugcugccaaauguaacagcuucaucuauuucuccccgcagccgccaccuacccuuccaaagacagagaguucaccaaaaucugguagagguuaaaagggcagguuuuggaaccaaauugcuugugcuggaauccucugccucagcuuacuuggagaaugaagagaauaauguuauuuauuuuacaggguuguuuuuacauguaaagaccugugaacauugcauggagcaaauaaguguucaaugcauguuaccugcucauaacugcuaccaucaucgucaucauuacuucuacuuagaagaaaauauucaugucuuugacugacuaauuuuauuugagauggagccucgcucuguugcccagacuggagugcaggggugccaucucagcucacugcauccucuaccucccaaguucaggcgauucucuugcuucagguaggauuagaggcaugagccaccaagcccggcccaauauucaugucuuuguaaaacacugaauaacuuuuggauaaagugggggugggggauagauaaacauguuuuaaauaggaagcacacaaaagcaacagguauuaacccaucgcccauuaaagggucauaaugucuauaccuaguaaugccagcugauaaaagaaaagcaguucuugaaaugaaugcagccuccuuccuggugaggaugguagagggugggcuagaggugggaggggguaguaagacugacggaauaccagugguggauagcaagguggggugcagauuucugagaucucaaacacagcuccccuuuccuguccuuccaacuuuuuagaaauugaggugcagaauuuccaaaauagcucuauuuauagcugagugcccaguuccaggcagacauuaaagaauucccacccacauaggcuuuggaacaagccaggggucacaacacaccccaucaacacuucaguuguggugaaugugucaucauuucccugucuugauuuaccugucagaaacaacagcauuuguuuggcucuagaaagcuaccugguaauuaggaggcuucuguuuugagguugcagcugcaaaacaaucuuccaaauguggagagguggcagaggagucacggcacuccuucggccacaccagucugcaggcuggccccaaggugacaguccaagucauccugcacacuucugcugcugcucucugaacccaugcuccccaaggcagccagacagaucuuuaaaaaacaucacugcccugcuuaaugcccuucaguggcuuccuuucuucuuuuacagugaaauccuagcugguauccaccacgauccccuaucccauccuaugcuagccauacgggccccuuucuuguucuagcuaacaaagaggcugagcuccuuucugccucagggacccugcacuuccguucaccuugccuagacuguucucccccaugcagcgcuugcacuguuuuugauucuuaaguucaaacaucaccuccuuaaaauggucuucccugucuuuccuccucccccgaaguugcuuccacaaggaccaguuuaauuucuuuaacucccucaucacaguuucuauuuaucuuguauauuuacuugcuuacuugccuauugucuucuucccccgcaucacggaaguccuguuaagucagaggccuuuuuguuuuugacuuguuuaucauuuuauuucagcacucagcucugcaagacauccaaaggaugacaugaauuaauuaauuaaccagugaaugaaugaauuaaucaaccagugaaugaauaaaccagucaauucaugagugagugaauguacccuuaagcuucuugagucggggaagacaagaacuuuauggaucucccucuccugacccccagcuuccagagauguuaagaaugguauggguguuuuuucuuggaaggagaagagaaaaccaggugagggcuggagaggaggggaugcaggugaccauagcauuaccccaaguuguguaggaccccaggggcucacagggaccugaaguacgagaaccauggccacaccauuaauuuauuucaacacuugagaaaaaguauccauauggcuucuacuggguacugccauugacuauguuccagagauguugacacagaagacacaacacuaaacaagaaagggcuuggucugguagcuuuucauuauugauuuguggcugcaauucagagcuucuguuuuaaucuauagcaggaagaguagagguggcagaaaguguuacauccacccagucccaaaggcccuucuccuuccccuuuccuuccuuggggccagagaggguacagaaugagagccucagucuagaucccaccucugccaccaacgugcugccuaggacaagaaugucucucacauccugguuaggagaacaagcuucugaaccagaugggcuguggugaucccagucgcaucacugaucagcagugugaacuggggcccucugcuacgauucccugagcuucaauuuccuacuuaaaaugaaguggguaauauacucuauucauagacuugugaggguuaaacaaucuguacaaagagcugagcacaaugccuuggacagagugagcaacuaauaaugucagcaauccucugcaguggcagaaacacucuuuucugagccuuaauaccccacuuuaaaaaagaagaaaggggggccggacacgguggcucuuaccuguaaugucaagcugagguggaaggauuucuugagcucaagaguucaagaccagucugggcaacacagcaaaacugccucucuacuaaaaauaaauaaaaguuagccaggugugguggcaugcaccuguagucccagcuacucaggaggcugagaugggaggaucccuugagccagggaggcagauguuguacugagccaagaucaugccacugcacuccagccugggaaacaaagacccugucucaaaaacaaacaacaaaaaagacaaguuggagucacauuuauguuuuccaacacugagauauguagaagagagaauuuuaggcgauagagugaucucuaugaaucccuuccggcuauaacauuccacaaguagauuaagcucauugguuuuauucagacuggucauccccugaaauagauggagaucagaagcagcauuuggagugaaucaaacagauuauugccaaggggugaacaaggggcgacauccuaucccuauccagcaccaccuuaugggaaaaugaacacugcugggucaauguggguguuucuucuaggaggagacgccggggcuuuacgagcuggcgaacacaguucccuuuccaugaaaaggacagaaauggcucaggguuggggacggcggugugcucuuugguuugaguuuuucaagagaagucuuccuucaggccaaucugcaaaccuucccuugaacucaaacaggaggugaguagaugguaagugauguucccauuucacauacugagaaaacacagcagagaagcuguaagauaaaaugacucugagaccacaccuugaauuucauaccuugaauuucuauugcgucgcucuucugagaagcuuggaacacucacccaaauugugaaaugacuuggccccguccucacagucauacugagaccaggauuacagccugaacaugugacaucccagucaacaacacaugcaucaaucauacugagguccgacauuaugucaauaccggcauauuuauuaguuuguggucuugcugucaccucguuccuuuaccaagugguaaaucaguuacgugaaaccugccuuccacccaagcguggacugcuggcggcguaucagugguuaccaaucaccagaguauugccaagagcuccacaaaggagacacaggggaugggagguuauucaagaaauaggcugccugguauggcuaggaaaucaggcacacccugauuuaacuauaaagcuaacugugugacuugggguggggaucaucaccaguuugaacuucagacuucccauccuugggauaggcagccauagcuacaguaaagauaaaauguaaaugucuuuuuuuuuuuuuuuuuuuucagauggagucucacucugucacccaggcuggagugcagugaugcgaucuuggcucacuacaacuuccaccuccuggguucaagcgauucuccuaccuuagcauucugagcaguuggaacuacagguaugugccaccacacccagcucauuuuuauauuuuuuguacagacaggguuucaccaugcuggccgggaugcucuugaucucuugaccucaugaucugccugccccggccucccaaagugcugggauuacaggcgugagccaccaggcccagucgaaaugugaguuucuaugcaaagugccuauccuaguaucuggcacauaauagguacuuauaaaaugauuaccuuuuuagguaaaggcuuggaacucugugcuggggagucugcccugaggucuuuuuugacuauugcaaaaauuagcuuucucagcacccuguacaugucucuguguuaaugcuuauuauaccacgcugggacugucaguguaaacagcugaccacucaguaggaccaggggccucuuagcagcaggcacggugucuuucuacgucuguauuugcaaugucuacucugugcuuuccaauacgacagccacuagacacaucagcuacuuaaauuauuuaaauuacaaaaaauuaaacuaaaaguccagccccuggucauacuagucacguuucaagugcucaguagcuacauggggccacuguccuggacaacaucaucagaaaguccucccuuucuuuguacaaauuccuguuggauggcauugacaccugagaggcacagaggaaaugucacugucuucuaaguaggaaggaagagaugggaaaaaaaauacagccucugaaauacagccauugaaauacagccauugaacaauggcauguuggacccuagaaaccaagaaacaaugauucugaaaaaauaaucacugaaacuuuucugaccuaaacuucauucccaauuuuccucauuuucaucacauuuauccuaaaaugucaugcaaaaucugaaaacacauauacucuguaaaaacgagaugccaugagugguaugguuuggcuguguccccacccaaaucucaucucgaauuguaauacaagcuguaauccccacauguuaggggagagaccugguaggaggugacuggaugaugggggugguucccccauucuauucuugacauagcgaguucuuacgcgaucugaugguuuuauauguggugguuuccucccucccucuuucucucucccucccugccccucuugccugccgccauguaaggugcacuagcuuccuuuccaccaugaucguaaguuuucugaggcuuccccgaccaugcagaauugugagucaauuaaaccucuuuucuuuauaaauuucccaaucucgggcaguuuuuuauagcagugugagaccagacuaauaaagugagcuaaacauccauccucacuccaaaucuguucauuccauaaagguaaguauggcacacacugcugcugcuaaacaggucaucaugucaagguuuccuaaacacuuuuccaggugcuauuuauguaucgucauauuuaauucucauaauaaccacuggaauccccauuuuacagaugagaaaacugacgaacaguagguaugaguugacccaggucacacaguaagcaagugucacagaggcaggacuccaggcagaggggcuucgcacgagaugccaagguccuaucccagccacugugcuuacugcccaguaagagccaaaccaucccaaccaccgagccaagccaauguagccugugcugcuguuguucacccacaauccuuagacacaaaaguuguuucuagagaaagacuggaaaacauccuucugagaugaaugcagaaucauuuuuuuagcccaagccaugcauucccuucucucccuuuuacuucccaguaucuucuaaguuuggaaguuggaauaagguuuucugaacuagccaugguguuauacuccuauagguuuaagaccaucuuuggaacacauagcuguguccugcagagaaaaauaaauaaaugagaaaccuaguaagugucagucaucacagggucuuacguuuagaguagugauggccacugacugaccuugucuuugaaggauucaagcucuuacaggggcucaugauauacuguuuaccaacauccaauaagacaggguuaaaacggaggaucacauucacucauagauucagucgaaaguagugggccaaaagccacugcuccauuggcuaaaggaaaaauaaagucacuagcaaugaugcuaaugauuauuauaauaauacccaccauugaaugaacaccuguccccuaugugaaccauugcucgcaccauauuacuaaggcuccugucccaucuauaagaaagacauuuucauccucauuggagcagggugaaguuguggggagaggugggggagugaaacaccaugcccuccaagguuguagacgggaugagcaguuucaaagcccauacucucccuugauaccccaccccccggagggcgcuacagugacuucucuguuucaacaagagaugagaaaugagucuggguaucucaguucuuggaguagacaagccacaaaagaacaucacuuugggguaaaagucaggcccuguuuuacucaucgaaaaguugcccaaaaacuacauguucguggggguggggaggggaugacacacugugauucucaaaggcauugcugugaacagucaaaacacucauaaauuucaaacccacaagauauuuuuguuuugugauauuauuggccgggcugaauacaguccugauaaucuuucaguucaaugaacaggcagaagagaggagaggagccaggcaggcaaaaggaauugagguauuucaggaaccagacacuucuaaaaauacagccacauuugauggagugaguuggugacucugucacucuucuucuccugagccugagauggcuccccacccucaggagugagggcugugaugucucucgccaucugcccaacuuaccuaccuuucuaguucuaccugcagccccucuucgagcauacaccacaaauaucugcuacaggggaccccaugcuguccaugagugcuaugggcaacggugacguuccaucugucuuagugcucugcgguaaacaucugcucaauaaggggauggacuugcagaaugggcaugugauaggaagcacaagaucuccugggagcaccucacaguucagaacaaugccaugugccaggaauugccuuaugcuaucauaugugcccauguguguguauguguguguguuggguggggacauguacagccuccccuccccccacacagacaaugagucuuucaaggaacugcccggagccugggagcaccucaugguuaagaacaacgccaugugccaggaacuaccuuaugcuaucuuaugugcauauguguggggggggagggggacacguacaggcucaugcgugugcgcacgcgcacacacacacacacacacacacacacacacacacaaaaugggucugucaagaaacugcccgaaaaaaugacaugagacacaccaacguggauuccaacaccuaucaucauucagaacucuuucuuuuuuuuugagacauugucucgcucugucaccagacuggagugcaguggcgcgaucucggcucacugaaaacuccgacucccugauucaagcgauucuccuuuuucagccuccugaguagcugggauuacaggcgccugcuaccacgcccagcuaauuuuuguauuuugaguagagacaggguuucaccauguuggccaggauggucuccaucuccugaccucaugaucugccugccuuggccucccaaaguacugggauugcagggaugagucacugcacccagccuagaaguaauguuuaauaaaaaucuccagcccuucuuucagaaggaccuagacgggcuuccuucaaggaacaugaaaaaauuaaguugauguguggacaccaacauaugcacaugcaucuuuaaacagugugaaagagucucauuucagccacaugcuuucagagucauguuuucaaauuccaugaagggccugggaaaacuguguuaaauuccaauucuggaucucccauacaaguaugcgaaugaugccaacagaaguuaaauacaauaaucguuuugcagccaagcucccuguucagaacucacaugcaaaguacugccugaucccaauuagcucaaacuuguuuuugcuucucuuuguuugucgccuccugcccaccuuccagggacuccucauuuuggguuauuuguucagacuucaacuccagacacaccacugugauuucguuuuuaauaaacacuauccagugaguagcggaaaacaaugagaggcaccugcacucuauuauaacuucucauuccacccacgagugcggagcuaugaauaagugagagccccacuagucuaagaauaguaacagcguuuucccaucaacacagcauccuccaacuucagcuaacacaagggacaaaguacccugcugcccgccucauuguuuuaaaugagggaggaaugucccgaggggagccaaaugucugcgcucugcagccaaugacuuacccaugggugggaccagaggaugguccauuccaagcuaggaaacagcugaacauuccugaaaccuuagggauagggagugcuaaugacugacaguccagaagccagagccagaaguuguaguagaaggaacaugggguguggaaucggagaacacaaacucgggcucuacuuauuaauagaacaaauauauauuaacugcccaacaaauguuuaggcacuguucuagcggcuuaggauaccgacaaaaucgucaaaguccccugcccucaugaagcuuacaaucuagccacucacuagccacugagcaaguuaccuaauuucuuuuuguuuguuuguuuguuucuuuuguuuguuuguuuugcuuuggagacaaggucugcaaaacagaccuugaugcccaggcuggagcacagcggcaugaugacagcuuucugcagccucagccuccugggcccaagcaauccucccaccuccaccuccugaguaauugggacuacagccauguaccacugcaccccauuauuuuuuugauuuuuacuuuaaguagauacaaguucacgcuauguuguccaggcuggucucaaacuucugagcucaagcaauccuccugccuaagccccacaaagcgcugagauuacaggugugagccaccgcgccuagccaacuuaccuagguucuuugagccucuguuccccuccuguggaaugagcuaaacauaugccuaugccccaguggcuugaagccuggaauuagcuaguaguagccaugcugguaauaacaaucaccacuuuuuuauuuguuuguuuaaucucuuccaaaguauuuguuaccuacaaaagggaagauaauaacuucacacugcagaacccagaagucaucacauuaaccaaaugaucaagauuaacauuuccaagaagaauuacacgucuacuggaaucaaccuaaauguccacaaaugacagauuggauuaaaaaaaaaguagugaauauacaccauggaauacuaugcagccauauaaaagaaugcgaucaugucuucugcgagaacacggacggggcuagaagccauuauccucagcaaacuaaugcaggaagagaaaaucaaauacugcauggccucacuuacaaguggaagcuaaaugaugaaaacucaaggacacaaagaaagaacaacagacacuggggccugccugaggguagagggagagaggaaggagaggaucagaaaaauaacuauuggauacaaggcuuauuaccugggugaugaaauaaucuguucaacaaaccuuugugacaugaaguuaccuauauaacaaaccugcacauguaccccugaacccaaaauaaaaguuaaaaaaagaauuacagguccaauuaacauuuccaguaagaacacacauauacacuaauaaucccuugguaaaauacacugagagggaaguaucauuuuuguacuauucuuuucaaaaaaaugguuuuuauuguaguacaauguauguaacacaaaauuugucauuuuaacuuuuuuuuugugagagagcuagacugaacucguuaaagcucaccuuugcugugauccaacucuuauuuauuuauuuauuuauuuauuuauuuauuuauuuauugugagacagagucuuacucuguugcccaagcugaagugcaguggcacaaucuuggcucacugcaaccuccaccuccuaggcucaagcaauucuccugcuucagccuuccaaauagcugggauuacagacacccaccacaaugcccgcccaauuuuuguauuucuaguagaaacgggguuucaccaugcuggccaggcuggucucgaacuccugaccucaagugauccgcccaucucagccucccaaagugcugggauuacaggcgugagccaccgcacccagcgcauuuuaagcauuuuuaaggauacaauuccguggcauuaauuacacucaugauguugaacaaccaucacuucuaucuccaaaacucuuucaucaccucaaacaguaauaaccaccuuugaacauauauuuagguugggcaugcauguucuucaaccucaacagaagcuggggguuggaucacugugauagcuuccuaacuggauacccuguuucagucuucaccaccuaucccuuaccaauccacucaacacagcagccagagcgaucuuuucaaagaguaagucaguuccggucaguucuguguucaagacuauccaaauggaucuccaucccuuaaaaugcgugcucuggccaaaugcuaauucucuucccuucauccacaccugcuguguugcagcuggcuuacuugcaugccaugccggcugaccugagggccuuugcacgugcgguuccuucugccuagaauguucugccuccagcaaucccuuccuucaugucucugcuccaaaugucaccuuuuuagagaggucuuccuuguacagucucuaucaaacagcacacauaauaauucuuacgcuccucgcucugccuauuuucccauagcacugauuagcaucggugccaaccguccacagaugacgucucaguaccaggcacauuuagcauugcucggcuugggaggaaagaagaguuuccccuuugccagcggacgccauguccagcuucgccaguagagggcgcugcagggacacuggcgcagacggguucuggugcgaagcucccauaggggcaucucccugugggcgguucacuucggggagggggggagggggcgggaguuucccggcacuccaccccugcaggcugauuuccagagacuuccuugguaggcaccucccacagacguccuucccuggcaccacagagagcgguuucccagugagucccaccuuuaugggggcuucagugagaaccuuucugccauccaaugggccauggcccaguccagaucccaguccuggcccguggggaccccagauuugcucuuuccuggguguacugccccaucccccauugguacuggcugcucccaaaucuguauucuuggauucuuuagaguuaaauuuuuuuuuuguuugagacagagucucacucuauggcccaggcuggaguacaguggugcaaucuaagcucacugcaaccgcuggcucccggauucaagugauucuccugccucagccucccaaguagcuggaacuacaggagcacaccaccaaccccgacucacuuuuguauuuuuaguagagacgggguuucaccauguuggccaggcuggucucgaacuccugaccucagugauuggcccaccucguauucccaaagugcugggauuacaugcaugacccaccaugcccgaccuacucuuuuuuauuuuauuuuacuuaaagacacggucucacucugucacccaggcuguaguacagaggugagaucauagcucacagcagccucaaccucuugagcucaagcgauccuccugcuucagccugccaaguagcugggacccccacaugcuccaccacacacgcccaacuacuuuuuauuuauuuuuauuuuuauuuuuuuauuuuauuuuuuauuuuuuguagagacaggaccucccuauguuguccacacugaucucgaacuccuggacucaggcgauccuuccaccuuggccuuccaaagugcugggauuacagacaggcaugagucacugugcucggccugauucucuuuacccuuuaguagccaaaacccuguuguagcuaauaauucuuaauauuaaaucuucccuguuaaaauuaugauauaguuucugucuccuaacuggauccugacugauggaguaacagacaugguaaaaauaaauaaauaaauaaauaaauaaauaaauaaauaaauaaauaaauaaauaauguggggggugggugggagggauuacauuuguuaauuacccauuuuaucuccaucugucacagaaugcaagcaaggacuuugcuuuguuuaccacgauguccccaauggcuacaacaugugcuugacagguuacaagcacuggauaggaaggaaggaggggaagagagggggcggagcaagagacauugugaaaaagagaaaggauggagggaggcaggauggauggauggauggacagacggauggacgauggugacuccccccaacucccagguggcauuacacgggcuguaacagcgccugguauauaguaagcacucaugaaauagucauauaugaaucucuuugcagcccuuacauaauuuccauuuaaccuuuccauccuuccaccaauuauuuggaauaccaaaauaccucacuaucaaaugccagagccuuauaaagauggccuuguggccccugcgccuacccaaccccaacaacucucuugaagaaaaauaacaacaaauugaccagagacugaaaaaggaaagcaucuuugaaccacaccuucuggugcuugguuuuauucugaugcucaaaacagaauggaaaccguccuccuccccuacaccauggcgcagcgucagcuuccugcuuacaaacaacggcauuggcgggucaugcucuccuuucucuuugacuggaaagcccuucagggucaguaccucauuucuggugugaauauucacuuucucguuccacaaaaagacccaccagcaagcugugaaaugagcauuucacaaaagcauaaaacacgccgauaauuaaaacgcugggcaauuagagugacaaacuacacuccccaaucuacagaguuaauuucacaaccucugaaaauuauaaaggaaaucuauuuagaaauuaggaagcuccaaagccuuuuuuuuuuuuuuuccucgagaugaagucucacugugucacccaggcuggagugcagcggcgcagucuccgcucacugcaaccuuugccucccaaguucaagugauuuuccacucucagccuggugaguagcugggauuacaggcgugcgccaccacaccuggcuaauuguuguauuuuuaguagagagcggguuucaacauguuggccaguguggucucaaacuccucaccucagaugauccgcccaccucagccucccaaagugcugggaguacaugcaugagccacugcaccaagccaggcaacuuuuuuuuuuuuuuuuuuuuuaacucaucuaucacuuuuuggcuugcuugagauuucacucuccaacuuuuuucuacugugaccuaguugcuucagaaucauacuggcuguacuucuuugcuuauaaaauaaccgacccccccgccccgcagccuaaaaaagggacaaaauccaaagccaagaauuacaauuacccgguaaaacacauaauaagaauacaauacagcuaaugaaaaagcacaggggguggaauaccaaccuccccaauguaaacaacaacugucucuuucaauuaccguuuucuuuuuaccucaacuucuaaacaguacuagaagacauuagcacaguccaaacucguggugcuggaagguuaucauuagccaaaagaaagcaaaaauagaaccaaaaagccaugugaguaucaaaaauggauguuacuuucuccaaagaagauacacaaacggccaguaggcacgugaaaguacgcuuaacaucauuagggaaaugggaaucaacacugcagggagguaacacuucacucagauggcuauucuauuuuuuuaaguaaaauaaguauuggguagauguggagcaacuagaauccugaugcacugcuggugggaauguaaaaugaugcggcugcuguugaagacaguuuggcaguuucucaaaagguuaagcacacagauacgaaacgacgcagcaauuucacuccuagguauacaugcagaagaaucgaaagcagagaucugaauagauauugguacaauguucauaggaguauuauucaaacacacacacacacacacacacacacagacacacacacacucacacagaaacauuauucagccauaacaaagaaauuuuguggcaggugugguggcgcagucaucucagcgcuuugggaagcccaggcggguggaugaccggagcacaggaguucaagaucagccagggcaacacggcaaaaucugucucuacuaaaaauaaaaaaauaauaauaaaaauaaauuuaaaaagccaggcaugguggcaugcaccucuagcuccuugggaggcugaggugggaggaucacugaagcccaggaagucaaggcugcagugagcuuugauugugccacugcaccccagccugggcaacagagugagacccugucaaaaauggaaggaaggaaggaaagaaggaaggaaggaagggaggaaaggagagagagaaggagggagggagggagggagggaaggagaggaagaaagaaagaaauuuugauauaugcuacaauauggauugaccuugaaaacaauuucauagaugcagaaaguaaaguagggguuaccagagaccacaagcuuggggaagugaggaaggggcaguuauuuuuuaaaagaugugaugaaaauauuuuagguauagguaaugcugaugguuacacaacauugugaauauauuuaaugacuaugaauuuuacacuuauaaauuaaaaugauaaauacuaaguuguguacauuuugccaaaauaaaaaaaguaaaggucacaaaaccugaacauuaaaaucuguggaagagcuugaucugcccuugcucugagccuguucaggcccuuuuuucaaacaagucuaacaaacuugauuaacugaauuccuugucuuaaaaacuuuggagagagcuaacucacaaggccucugagcauguuuuucuuuuuuagagacaaggagacaagcucucccucugucgcccaggcuggagugcaacagcacaaucacagcucacuucagccuccaccuccugagcucaagcagcccuccugccucagcugccugaauagcugggacuacacggaggagacacgacagccggcuaaauuuuuuuaagacguggggucuugcuguguugcccaggcugguuuugaagccauagccucaagcaauucucccaccucagccucuccaagugcugagauuacaagugugcuaccaugcccggucuccucugcacauuuuaauaaggcuagcgacacacaggagagaugacgaagagcaaggcuuucuaccagcgcuaggugauucaaguuuaccugguggaauccuuuuuugaguagcccagaaaaggccaaggcacgcaguauguccugccccuggcaaauggaaccugacccaguucccaccgacuaucaggggacgguaugugugaccacaccucugaccacaaaucauucaccccgucccacuccuuuggaacugcucaugucaucugugugccugggcucuguaaaccuuuucugugcagacuugggucucuccagcuguauuuccuggaucuagucauacuuuuguuauacuuucaagccacugggaucccugaucaccccucacuccucacaccaaugggcauggaagccacguaaauuucugccuccgcaaugccugugccacccacucuguccucucuguucccuuaggcuccaccaucccagggcaggacagaaauagugcgaugaguucucugacagagguugugauuuuugccucuguuuucucuccaugccagucccuccucggcacaacugccagagugaacucauuaaagcucaccuuugcugugauccaacucuucuuuuuuuuuagacagagucucacucuguuucccaagcugcagugcaguggcacaaucucggcucacugcaacgucugccucccggguucaagcaauucucccaccucagccucccgaguagccaggauuacaggcgcccgcuaucacaccuggcuaauuuuuguacuuuuaguagagaugggguuucaccauguuggccaggcuggucucgaacuccugaccucaggugguccacccgccucagccucccaaagugcugggauuauaaguaugagccaccgugcccggccccgaaucuuacguggaaauuucagggccucucaccugcuuccugaagucagagcaaagcccucacccuaguguucaacgccucuaccagaaggucucaucacugucccuaagcccauccucuacugggcucuucucauuccugacacuuccuggacuuucugccuuugcucgugcuggauccucugccagggaugccuuuguugucacauaucccaccccaauccccacacuguggggccacugugaucugcagcauccuucaaggaccaucacccuaccacauccccgcacagccgccacccauccucuccaggcacucauuucgagaugcugagacuucccuuccacuguccuguugggcagggaucuggguucuuguccuguuccuuccugcaucccucaaccauaucuuaaguuuucugaaagcucaaaaaauauuguaagcagauguguaugcccuaaaggcacaaugcagauaauucaacacuugcguuuuuaaaaguuauuuuaaaaaagaacaaguguuauauccauaguaaacucaacaaaccuuugcuaugagcaacaauaucaaaugagaucagaccuagguaaguuguuuaccguguucaagacacugugcuagaaacuuugcaagcaguaccucauugaauccucacagccuuaggaaggagguacuagaauugcacccauuuugcagaugaggaaacugaggcuuagacugccacuugucuugguuaucaaagguaauguuggaaagccaggaaucaaaccauagcagcauggcuuccaaacccacccggggcacggcacaugugagcgaguaacagaugaaggccaaaggagaaaugucaacacaagaggcagaaagcagagaacacagguucuagacaaacagguaacugguuuggaugaaaacagucuuaauuuuacaaacccacucccagaagaagcaccucccuaccauaccaauuucccuuccaacaagaggacagaaugccuccaagugggccuggaggaggaggcggccuccugugucaagcucacagggaauuaggacuugccagguucugcaaugcugaccaaaaggccauacucacuggacuggguggcagcuccuccccacggagaaauucuggcaggaaggcggagccguuuaacaacacccggccgcacuucaaaacaggguagagccggaagacugagaacaauauggcacccuguaaccugcugaguacaggagaaacacagugacuuuucggcaaaaguggugacacgauuuuuauccuggagcaccagcugauccuacucacaucaacccuucuggaucucucugagcaaauauuucacauauccuacgcagcuggugccacuccaagcaugaucugggcagaggcccaacauguaucccagcccacaauagauguggggcagagggagaguggggcuucuucagcucaagagugcuaaaggaaauagaagaggguuuuggggcauugggguguacacaauugcauacagacuccccaaaaacucugcagggcaauuagaaagaggagagccagcucuacuaugcugacaauuaugcuucggcuaggucuuaacugaaugcuggagaaauuaagucaacaugagaugggugaaaagaagaaucaaaaggaauugagacaaaacucgugaauaccaaauaacaacuucguggaacaaguauuuaaugaguaccuaauauguucagggcacuguacuaggugcugggcauacaguggugaccaggacagauuuuguuucaaugacagcaacucggcagugaaaaauaccuuaagaaucaaagaaccugaguuugagagauuuggaacagaguuucauacucuauguaaaaaauugcauucauguuucucucccccaaaaagugccucuaucccaaagagccaaugucuuuuuggacuauaaacuacuugaggucagaagaugugaccaggccacugccugguagauagcagguauucaaugaguucuggaugaacagaaacaaguaaaugcuguaauaaacaugugagggucgaagaagaaaucacaugggaaauuggaacauauuuugaauuaaugagaaugaaaauacaacauaccaaaauuugcaggaugcagguaaagcaguacuuagaaggaaaaguaucgcuuuguaauaaacacagaucaagccauacgccaacugcuugaacaaugguuuucuggcccuugacuguaacgcuuucaguacuucagcucccuaucuccacagccuacaauagugcuuuggcacagaguaggugcucaggaaaaaucugcuuuauugcaauaugaauguucuaguguaagucccagagucguacucaguuaccccucugcauauggagaucuauugcucaucugguccccccaccaggaaaaucuuccccagccuuuuguugugauuguuguuugucguucuguucucagccuucaauaauaacacuuaccaaacuggguguuaacuaccaugaguccuucaaaguagcguugcauuuaauaugccuuaacaaguaggugcuuuuaugauuccccauauuacagauacagauacugaggccagagagguuaaguaacuugccccacaauacacagcugggauguaguagaauuuggacuugaaaccagacagugcaaauucagagcugcuguucucagccacaguggauuccugccucccaauuagcuuaggaguaagcuccaacgggcagucucccugggaagcaccccuccucugugccccgagcccccugugcccacuguuaguacugugucaccucgacucauggcagcagugugcugcccuaugcucugaauuuugcauuacaggggcugggucguauugucuuugcagccucaccacaggcugagcacauaaggaaggcucacuuaaugucuauucgacucagugggaagugggggcggugagcaguuccccuucuaaaguacacacgagucaccaagagacucugguuaaaauucagacucagcaggccuggggucagucaggccugagauucuguaccuccagcaagcucucagcagaugcugaagcugcugguucauggaccaagcuuugaguaccaagaggguggaugaaagggcacagucuuaagacacagcugcuguaugcucuuggcugaggaaauuccugggucugugauuuuggucaaaucaauucaccacuuuugaccuugguuuccuaaucuauaaaauggaaaugauuagccauaccuuacaggauuacugugggcaguuacaucagagaacuucagugaaaaggccagcacagaguugacaccaaauaggaguaauauuucuucaaucuaagaaauucucaugauauuuacuuguugauucauccucacugcacaguuucucaaacauuuccuagguggucuuugucuuauguauauaauugauccccucacacacucacacacacaaggagauaaagcacuaaugaacuaaguuagcacuaaugaacuaguuaguuuuaaguuagucuaugucgggucagcuuuacugcaugauuucucuccuaaguguguugacaauuaucuuucuccucacaccaagggguuaauaccuaaauccaaaaaagaaugugggauuucaaagaggaccuuguagugccacaaaggagagcuucaaagccaaggagguauuaaguguuucuugucagacucaaccggguggcccagaugucacaaagaacccaaacaugucagacgcccccacaaaccaaucuccucuagaccagcgagaguccugaggucaagagcugugagcccaccacaaaccacagggaaacuaucaggguagaugagcagagaaagaaaagcagcagaccaaccacuacagauuucagccaacacaaauuucuccccggugacaauggugaguuugauggucugggaaccgagagggcacuaaacagguaaacaaaacuaaauuaaaauguaaaugcuaaagaguucucccugaaaacucaucaugucuuuuaaauuugugaguaaaugggccaggaaaauccaaacagauugauaaagacaagcagauccgacuucuuggaggccgugcuuucugaacucuuuugcuuauggucuacuacaaaccuaguccagaaaagaugaggccauuaacuauauuuggaagaaaaagaaaaugcaauaguucuuauaagaacacaacaagaaacagcccccgcucagucauuagccuguaauaugguuuggcucuguccccacccaaaucgcaucuugaauuguagcucccauaauucuuacguguuguaggaggggccugguaggagauaacugaaucaugggggagggucuuuccugugcuaugcucaugauagugaauaagucucaugagaucugaugguauuauaaagcggaguuucccugcacaagcucucuucuguucucugccaccacgugagaugcgccuuuccccuuccauuaugauugugaggccuccccagacauggggaaaugugaguucauuaaaccucuuucuuuuguaaauugcacagucuuggguaugucuuuaucagcagagugaaaacagacuaaugcagccuguaaugcucuccaggcaugagagguauucugccucaaagagucucaugucccacagcagcuuugcucccggaaaucagcagcuugagacaagccgucugaugcugacuguaggacuuggcugugagcuccaaagacaagggcaaguaccuguucuuggaggggagacacagacacaaaaccccaagugcauugugggcauccucuccugacugugugauugggaauaagcuuagguuugaggaguguguugggcugaguaauguuucuugcugaaggugucuaaguccuaaucccaccugugaguaugcuaccuugcaugauaaaaucaaaugcaagugugauuaaguuaaggaccuugauauggggaacuauccugugauaugguuuggcuguguccccauccaaaucucauauugaauuguagcucccauaauucccacauguugugggagggacccuggugggagauaauugaaucacaggaucgauuucucccauauuguucucaugguagugaauaagucucaugagaucuaauguuuuuauaacgggaaacuccuucaccuggcugucacucucucucgucugcugccgugugagaugugccuuuugccuuccgccaugacugugcacccacccuagccacauggaacugugaguccaucaaaucucuuuuuguugauaaauuacccaguuuuggguaugucuuuaucacuagugugaacacagacaaauacauccuggaugagccuggugggccuaaugcaauuaaaagggucauuguaagagggaagcaagaaggucagagucacagaaaaaagaagggauagugaaagcagagauuagagugcuguggccgugagcugaaaaaugccagcagccucuagagacuggaagaugaaaggaauggacucuccccuaaggccugccaacauuuugauuuucacuccauaaaacucacucuggagcgaaaccuucagaacuguaagauaagacauuugugcugucuuaagccucugcauuugugcuaacuuuuuacagcagccauaggaaacuacaacagggagcauacagucucauguucaaauuccagcccugcuucuuccaaauggaugauuguaggcaugcaguuuaacaucccuguguugccauuucucauccacagauugagaauucuuuagaggguuaguuuaaaggauucaaugaguaccuagguuugugcccgagauaugggcaggcucacccacugcuccuugaugacacuguaugucaagaggcuucaagggcaaacaccaccaaaauccucacuggcuuauuuuaacucaacaggcucucacugcuucagcagcagugagagaagaaaaagcagagagaggguagaauagaaaaagaaacagaagaauauuuucugugccuugccuggcucuuuauggcagacagugcacacuuacgaauucauuucucaccaagcauggcauccuguuauuucccugccaugcccaccuucaaaacaucuuggcauucaccugaaauggguucccaguugauuacccuguucuaacacuucuccguguaaucuucccauagucaccacuaagcaccacauauaacuucacugaaaaaauugcacagaucagccaggaaucccuaacuggcacccauauacaacuuguacuaccuuaaaucaaaagugggaauauauugacccacaaaaauagaaagggaaguuccagguuccugcuagacaucaggagcuucgaauuaaacacaccuaaaauaugcccuggguuuugucugugaagguuuuuuguuuuuuuuuuuuuugucuuuugugguuuuuuuuaaugcaaaauauaaaaugcuggcuugggaagaagauucucuuccaaaucuugaacacaaaaucuucaaaugguuagugauacaaauauggcaacugagauacauccuccuuauagcaaaugcuaaugucuuguauacaucauugcccuuaaccuucucaccaccccagugaguauaaauuuuuaacuccauuuaucaaugggcucagagaggucaaucaauaacacacagggaggaaaggggacacgauuggaaccaaagccagagcucuuaaccuccaugcuguagaacgggaaggacaagcuaaaaagaaaccauccacgguugauaguuucugccaugcagagguagcacuuggaauuguguugaaaaguauagauaguggcguuacgacacuggcauuacaaagggaaacacacuugggggaagccugcuuccaaucugugguaauaaacaugccuaaccaauuuauggaugauuaagguggcuccuggacccugcauuaaauaauuuuggugacauaguuauuauucccuuugucuugcccaauuaaucuacuugcaaaagaucuugcuuugguuuuuaauaccucucuacaaguggcucaucuuccauuugcccaaagagaacacaagcauugggcuuagaguauucucugguaauaauagcuacauggaauuacuauaguucuauuuucuuuguauauagguuuaucuucaucuauauguggcaaaucauauugaucuucccuuuacgauggaaauagaacauuuccuuuuaaaacaaaguuaaugaaucuaugaauugauuuaaagaaaaauuucaacauuaauuagaucuucaauauuuuaaauauuaauaauaauaggggcacauugugaagguggggaaagauugacagaaguuugaaaaagagcauccuggcugaucugauagaaggucaguguuguggaaucaauguguccccccaaacucauauuuggaaacccuaaucuccaaggugauauuauuaggagggggagccuuuaggagguacuucagucaugagaguggaacccucaugaaugagacugguggacuugucagaagaggcugaagaaagaugaucucuuccucugucauguaaggacauagcaggaaggucgcuaucugucaaucagaaagauuauuuauaggaaaauuuauuuacuuauauaaauaaauaaaaauggauuuauuuauauaaauaaaauguguuuaugugaauaaauauaauguauuuauauaaauaaauaaaauguauucauucauauaaauaaauacaaauguuuuuacauacgucuuucaaaauacaccaccugcuuuaauacggcacuuauagaagaguuaacuggguuaaauggugaaaccccaacuaccuguaaaauuuagcugucucaacaagcucaugcagccaggguccuagaugguauuugucaggcaaacacaucacaccacuaacugaugaggcaagagguacagaagcaacagacaguguccuauguaccuuugcaaaagcgcagcucccucuaaaugguggucaugcuggggugcuggggugcuggggugcugggguaggugguaagaaaguaacaauuaacugguuuucuuaccuaaugcugaacaguuaaugguuuagacucuuugaaugggcaguuauccacuguuguauaacaaauuaucccaaaacuaagugggcugaaacaauaauuaacuuuuauuaucucgcacaagaauuucuguggugcagaaacuugugagcagcuuagcucggugguucuagauaggggcucaaauaaaguuccagucaagauugcagcaaaggcugcaaucaccucaaggcuuaacuagggcugcagaaucaacuucgaacgugguucacucacauggcuguuggcaggaggcucaguucuucuacacggguaugcuugaguauccucccaacauggcagcuggcuuuuccuagagugaaugauccacaucaguaaggcagaagccucaauauuuuuauggucuagccucguaagucacaugcucugaugucugcaauacccuaucgauuauacaggucaguaguauuagguguccgagaagacuaugcugagacauggcuaccaagaacugagaaucaccagaggccacauuccccaacuuagguuugauucuuuguccaccaccuuaaaauuagauaugguaguugcuuaaugguaguuuaacggaagaaugaaugaacaaacagggugaaacaaaggaguguaaaaaugcuagaauuuacccaaucaguacacagcgucaguaaccaaugaaacucucauaggaauaucaauaaagcauucucagaacacuaaaaauaauuccuucuuccaacuuuucucguguuuuucaguguguucuggcuaaaguccaucuccucauggucuaagguaaacuauugccuaaucaaucuuuuucuggaaucccagacugagggagcuucagagcuuccugaauaauguuuaagaguccucuggaguucuguccuaucucaaccgccuucacccuggcucccaaagcugcucauuuuauugauuuuuuuuuguuuguuucaaauacacauuagauaaacccaguuuugacagugaacaaaacugucugccaacaugacaucuacuucugccacuuuaagcaacagggccagcuggaaagggagaaaaagcguaugugucaaagaucccuauuagccagaggcaguacauacuagaaauucaagucucuaggauccccguucguguuuuauauacucucuccuccccuuuccaucauucuucccuuuuucaaauaaaagacugaagauggggugaauucugagccuucucaugccucagaguucauacaugaggccuugucuccaagagacuuggucauacaagcaaaaagccaucauuucuuacaggccucugauuugccagaaaacugucuccuuggcauauguucuucucaucauagcguccugacaaaaauccuaugaaguuacaguaauucuugauaugacuggugcauagaggaggagaaaaaucuggggugguuacuuguagacccaaagcuauuaaauggcgaaagugagaguggaaccagguauguuuuuguaauuauccccaugccccuuuucaggaauaauauucggcauauuuaauagcggguacugaacuaucaaaauggguauuugucacauggcccuggugcaggguccugaggcuuccucuccccaaccaaggcaggugauguuccuccaggugacaaaucacacaggaaucccaguggguguguggcacugagaggcuucgggcagggcuauuuacuaaauaauguagaauuauuugauauuacaacaccaggauacagccacucuggcagguacugacucaagaacaucuuuguuccucccucaucaucaugcagccuuaaauuaaucaguaucacaagaccccaucaucccaacauguaauaucaugguccaggggaauagcaacaaggccugcuuuaccuggaccaggaguccugggcuacccacugcauuuucuauauugccuucucgaaauguacaagacauucuccaauuccuggaauuaaauccuucaaggaagagagucucuuuuuuccgguguuuucuuuuucuuuuuuuuuuuuugaugaaacuuuuuuuuuuccuuucacuuuaaguucugggauacaugugcagaacaugcagccuuguuacauagguguacaugugccauggugguuugcugcaccuaucaacccgucaucuagguuuuaagccccgcaugcauuagauauguguccuaaugcucucccuccccuuucccccuacccccagacaggccccggugugugauguuccccccucccguuguccacguguucucauuguucaacuccuguguauucuuuuaauaguauaaauggcuggcucuuuguggacagcauucucuucccuggggacagcaguaccaccccugcagauaauggacagugcaggacacagcacagacugugaguaaguuaucacccaccagcugagguaguacagcucccaggcccaaccgugcagaucuauaaguagaggccuuagaggucaucucauucacacugucaaacucagcaacucuggugauggagaagaaaucuuuuuuucuuauuucaagaaaaccaaauaaaugcacugcauaaccaaagccaugccuuuauuugugucaaggcuguacuugcuaauuaaaaugcccaguuuccaugcuuuuuuuauauaauuaaaacauccaaagacugcaacugguugauaaaugagaaaaugaauuuuuauuuaauaaauaccauuuauuuggagagaaaaacaaaaacaaaaaaccuuaagagcaggaaauccaggaaggugaggaaaagaaagcgguagguacuaagagaacauuggcuuucaaauccggugccaaacucuucaaaacccugaucuacaaauucauaaugaccuagucauucauucauucaccaguucaauaauaagacacagguacauacuaacuugcacacugaccuuaggcugucugaaaucagccugaaugccuucuuccugaaacucacugauugcucaucaguggcccuuaaggaagaaggaagcaagaaucucaggaagagaagugaggcauccuaaaguccauccucaccgagugaagacagagaagauggcauccccagggaccaaguucucuagagaaagagcugccacagagcaaaagagaaaugccuggcggaauccauuuauaaucacaaucuaauaauacuuagcaaugcccaaugggauaagccuaaagaaaauuaugagaguaauuacaagaguucacauuaaugauaauuuaauaaucauucucuuuggcauaucucuuuucuugagauggauaaauuggauuguguuagacagaauuccccuguuucugccacuuaaaagucaugugaccuuggaauagccucuucaauucuaugcuuccuuaaauuuauauauacauauacauauacauauauauauauauauauauauauauauauuuuuuuuuuuuuuuuuuuuuuuuugauauagggucuugcccugucacccaggcuugacugcaguggugugaucuuugcucacuacagccuugacuucccaggcucaagcaauccucccaccucagccuccugaguaccugggacuacagguacauaccacaaugcccagcuaauuucuguuuauguuuuguagagaugggauuucaugauguuagccaggcuggucgcaaacuccugggcucaagcaaacuaccugccuuggccucccaaugugaugggauuacaggcaugagccacugcaccugggcaaguuuuauuuaagaaggcuauaaugcacuaaaacucugcaguaauauuugcugcaacaaagaaaacugagaaguaucuuaagacacaggggugacugguccucccaaccccaauacucuucuuacucauugucuuuguaccuggauaaugaaaugagaguugccuaagagguucuuucuuucuuuuuucuuuuuuuuugagacggagucucacucugucgcucaggcuggagucugucgcccaggcuggaggguagugguguaaucucggcucacugcaagcuccgccucccggauucacaccauuauccugucucagccuccagaguagcugggauuacaggcgccugcccccacgcccggcuaauuuuguuuuuguauuauuaguagagacgggguuucaccauguuagccaggauggucuccaucuccugaccucaggugauccacccgccucggccucccaaagugcugggauuauaggcgugagcuaccgugcccagcccuaagagauuacugaaaucacugccucuauccuggaagaaccaggcagacaaacggccuagaauuauccccacugauauuuaagcuggagugugccguugcugcugguggcacccagccaagaugggaccaggacagauuuagaucaggaagccugacuccuggaauuccuggccagcuagguaaggcggcucgccaggccauuuaaguaauuaugugauuaaauuuauuggagacuacuuauuacauaaaguuguggugaagauuaaagaagacagggcauauaaacucauuagcacaaagcagggcuccauaaaugcuaaaccacucucaggggaaaacagaagacaaauguuuaucuuaaagaauuuuaucaugauuugaaagugaguuuaaaaaucugcugaaccuguuagcuaaaucauauuagaaagaauauucuuggccaggcaugguggcucacaccuguaaucucagcacuuugggaagccugaggucaggaguuagaaacuagccuggccaacagggcgaaaucccgugucuacuaaaaauacaaaaauuagccaggugugguggugugugccuguaaucccagcuacucagaaggcugaggcagaagaaucgcuugaacccaggaggcagagguugcaguaagcugagaucgcaucacuguacucuagccugggcaacagagugugagacuccgucaaaaacaaaaaggaaagaaagaauaucuuuguuuuaaccugauagucucuaacacugacagacaaaauauuaaagaacauuuaccaauauuucaagucacucaacuacuuaaagguauauuuucaguacgcaucgaagugaaucacucaaaagcagacauuguacaagagauacucuuuuauggauugagacaacugacugauuauuuaaaacaaagacaaaguuuuaccaauguuagaauuuauguucacuucugugagugaauuuugugucgucucucuccucauccuccuccuuauuuaaagaaaaaugccaauucucuuuagaaguauuguggcagcccacuuccacguggaggcaccagaagaaagacacaguuggguuauucauuuucaucugggugaccacucugccuccagucuuacucuaaaaugggaauuaauuucuuucuuaccuucccucccuccuuccuuucuuuuucuagaaaauccuuucucuuccuuuucucucucucucuuucccucccucccuccuucuucccuuccuccuuccuuccuuccuuuccuucuuucaucacaacaugucuacguguugguaaggaacugaaccuacguauuuuuuaacucugcagaaauggcuuucuuggaguauuguuuaauaucaaacucuauuuuuguaucuacauaaauauaaggcaugcaugacugauggaagaauguuuuguuauuuuuaguaaacuguuuuaaaaugcuguaucaccuugucuuuuuauaugaguuuugggucuuuacauguauauuuauauacaaacauaugcauauauauauauauauauauauauauaaaaucugauaaauauauauauaaucugauaaauauauauauauauaaucugauaaauucuuacaguuauguugcaggacagagguguguuacuauacaccucuguuucuuuuuuuugguugaaaacucuuugcuuuugacucccaggaaacccagcuaaauuuaaugcuagaugucagaaauaauucauaaaguuuccagguauauuuaucucauaucuucuucuaacuaauuucugauauguaguucgaaacacaaauuaaauacaucugucuuuuauauguaguguacuauucccuuuugagucaaauucuuuuuggaaguaggaaugguuucaacuguuugaaacagcacucuucucuuuucucugcaaccuugucccuaugaaaaauaaauuggagauuucucaaaggucuaaaaauagaauuaccauuugaccuagcaaucuuauuaguggguauacauucaaaggaaaauaaaucacucuacuaaaaagacaccugcacucacguucuuggcagcacuacccacaacagcaaagacauggaaucauccuaagugcccaucaaugguggauuaguuaaagaaaaugugguacguauacaccacgaaauacuacacagccauaaaaaagaagaaaaucauguucuuugcagcaacguggauacagcuugaagccauuauccugagcgaauaaaugcagaaacagaaaaccaaauaccgcauguucuuacuuacaagucgaagcucaacacugcguacacaugggcaugaagacaggaacaauagacucuggggacuucaaaaggggggacuagggagggaaggagaaaaggauugaaaaacuaccuauugaguacuauguuuacuaauuugggugauggguucaauugaagcccaaaucucaguaucuugcaagauauccauguaacagaccuacacauguaccccccgaaacugaaacaaaaaauaaaaaauaaaauaaaauaaaucccaguuuacuuacacaugauaaauaaaugaaacagcacuguucuuucuuuacuuuuucuaagccaacucacacuuccugauccuaauggaaauccuuucggguucacaacuaggaguccuggucccauucuuacagaccacaggaggggcaagacagcuaugaaauuuugugccucucauuucuguccugcagagaaacugagccucugaauaggaguucaguggagaucacccaccagcugaccugggcaguggguuuuucuuccuguuuuugaauaaggcagcagcugaacuguacaaacaccucuacuuucaccgagguguugcucacuauuuuauuuucauuucucuucuuccuuguuuuuaaggugugaaaaagacuuucagcaaugccuuccauaugcugucuuauuuuauuucuccuauuuuucccugauagagucuaucuacuacugaacgacaagaagggauuguuggggggagcugagagucacucugccaaaaagcaucugacuuguaaacagugcaagacuuuuaaaagucuacucucugaccuucuauuuugaggacccucaaagugaagaaagucaaacuugguauuaaauaaccacccaggaugugguugucagcuugagguguuaagaggaacaguuuauaaaaagccugguuaaauauaggaaguacaguugcauuucagguaacucgagauuugaacauccaauacggcuuuaacggaggcaaucuauuuggcccauuuucacagauauauauuaaaugacaccuauuuugaggucuauaauuuuuccuccuuagcuagaccagaaaacacuuccuccacccuaauucaugcuuccuuauccuccaaauguauauccuccacuuuuuuuccccacugaaauaaauacauccuuaaacuacuuugcauagcccuaggguaaaacaacaauuguaacaacaacaaaacauuaaaugcuucauuaugauuuaauauucuaucaccagaacccaaaaccucaguuugacuauuuugggucucucucuuucucucuuuuaaacuauuauuaaaaugguaauuuuaaugcaaaaggcuguauucaauuuuaaaacauuguuuuguuuugaauuucagcugucuugaaaguccauuuuuuuccccuuuccucucuguagggaagaggauugaacuucucucgagcucuguuuccucauuuguaaaaugcaggaucuaccuaugauguaggugguuaaacaguagucugugugugaugcauggcacacaggucaccccauggcagugcauguuuuaucugcguacccaugcagacagcccuuggucauggaggacuaugccaccauagccucgguccaccaaccccuaagcacuaaaacacauccagaccaugugaucagcaauugauaauuuuagaauacacuuggcuaauuucucugaucccacugcuacaaauaaaccuugcagucguugauuuggucagguucaaauuucaccacggcccuacgggcauaaagaugaauuauuugauugcaaggagaaauaagagaccaugugucaggcugcuuugcaaaucaauucaccuccccugcaaagaugcuccuuccuacuuaagauauauggcuuuacaaggauuugggcagcaucuguguuugccgugucagagggcaagacgcaugcagauguaauaucaccgagcaguguaauccgagugugcaugaaaaauaacugcagagggaaugagggaacccuuugccacgggcccugacagcaccucaaauaagcacuuuaccuaaucucccuuguugauuccuaucugggcccagugacuucaugcagcugccaucugcuaaccaguuagggcauguugaucacggacguauuguaaucagagcugaggucuccaaugguaaagcaggcuugcugccaagauggggcaagacccuaauaagaauggcagaaaggagccgaaaggugaacuuuacagccagcaugccuggauuaagcuucuauuuuauuuaacucuguauccccagggcuuggcguggaaaaaugcccaguaaauacugcagauagaaaugagugaaagacuuuccauaaaaagugaagcacuuccaccacuggguaacaguaauuauuugcauagagucuuuugagcuauuuuauaguagauuaaaauguuuauuuguggugagcuaucugugguagacaagguucauucauucauucaucagauauguauugaguggacacugcccuagcuuuggugccuguucaccuuuguagcucaggaauucggcaaugacacggggugcaauggauaaaugcgagauagaggaguggaggguccggucugggagagaaagagcagagucugugaaaaaacuaacagacaggggacacuucugcagaucccaagugcucuggccaaguucaauacucuucggcgcagauggacuuggaguuucuuaggcugcuacgcaagaggaccacuaagaagcaugguuauuucggcugcaggaugcugagucuaagaaaaacucaggcauccaagagcaugccccuccacugacagguggaaaaacugaggcagagagaaagauuauaguuuauccuugaucauggagcagcuuggagacagagguaggacuaaacucugguauguugagcaauccaugcucugccaagcugcagcaucuccucuguaggcuggauaagcucaugggcugacgcucuagggaagaagaggcagacaguaaucgaggaaacaauuguauacauauucagaaagugguaagugcucaaaagaaaagaaacagagugggugaggagaggcaggguuugaauucgacuccaccauuugcuagcuaaguaacucagcuugccaaggcucucuuagccucaguuuccucaucugaacauuacgaaggcucauuguaaugccugucuccuaggguuguugggagaugcuaagaacgcuggcacauaaugagcacuucauaaaugauggguauuuuuauuuuauuauuguuacuuaaguaggauggucaggguaggccucugagaaagugauauuuaaacuguguuagaaagauaagaaauuagacagguguggucgcagaugccuguacucucagcaauuugggaggcugaggcuagagaauugcuugaacccgggaggcagagguugcaaugagccgagaucgugcuacugcacuccagccugcaugacaagagcgagacuccaucucaaaaaaaaaaaaaaaaaaugggcaagaaagugccccccaccacucuucccaggcaaaagaaacaacauguacaaaagccuugaagcagauauaggcucugugggucccaggaaaagaaagaagacuagagugguugcaggauauugggaggacauugggcacagcuacuugagguaggaaauaaacugagaggcaggcaggaguucaggucuucaggacauguagacccuggaaaagagcguguauuuuuauucuaaaugguauaggaagccacuagggauggggagugguguauucaucagcuacugccaaaauacugccgcauaacaaacaaccucaaaauuucaaggguucacaagaucaaauauuuauuuuccucacucacuagucuaagaauugguugagguuggccugauauugacuggguuugcugaaaauggcuccaggguauaagucagauucaggucuguuucaucuaucucauucugcagcccaagcugaagaaaaggcauuggcuaugggaaaaaugcaggaguacaaagccaaucaugcaagcacaucucaagacucugcucacaucauguugacuaauaucccaugaaaaaaaaaaauuacaaggccaagagccaaaaauccaggagcaagaaaguucauuucacugcucaugaggccauggcaagggugcugauaucuaguauuacuacaaugcacuuuagcaggccuaaaguccuggaguguacuggaguguaguggcaugaucauggcucacugcagccuuaaacuccugggcucaguugauccuccugccucagccucccaaguagcugagacuacaggcaugcaccaucauucccagcuaauuuuuaaauuuuuuguacaggcaaugucuugcuauauugccaaggcuggucuugaacaccuggccucaagcaauccuccugccuuggccucccaaugcacuagaauuacaggugugagccaccaugcucaguccuguuguacuuuagacccaacuacgucagcuuucugcugacccugcuuugacaaaugcccaaaccacccaugguucaucauaucaaaacgauguccuuggacaaaucacaugcugguuugcaccaucuuagcucuggcuuuccugagcauuuuggcuucuuagaguagccccccuccaccucuccuuguggauggauacagauuauggcccuucccaguagccuucugagacguggugcaggguuccaguucauagcagcuggagucagggcuggaaggagcagcgggaguguuuuccuuggcagguuucuggcaugcacacguuccuaguauuaaaauacaaugugcuuuuuccaaacuagaugaucuacaccaaccauuuuaucuguaaacuagcccucuacccacccacccucaacucuggucuuggaacuauuugaaggggggggaaaaagaggaggaagagggaggaggagaaggaggaggaaaagaagaaaucuaugaggggguguggcagugaggggguggaugucuaugaaaauuuaugugcugaaaaacagcuguaaaauguuuaauguuucaaugaacguuuuauguuuaccauaaaaaauccuccagccaagaagggcuuuaaaauguuacauuuccaaacagauccacagaaagaagcaaaaaaaaaaaaaaaaaaaaaaaggauuuccacaaaccccucucuauggagugacccccaaacgcuaaacauuaaaauaggguccuucugaccuaggucaauguugagggagaaaagaauaacaggcaugacacagggagaggccggcaagaagaaugaaaaauaugcucauguuuuucaaagcuaaguacucauggcagaaagccuuggaaauucaggcuuuugaaggcagagguggaggaaggcggggaagaugcccagcucagccaaaagcuugcugaaagauucaaauguaaucaaucaguccaccaacaggaagaacuaaucaagugccuuaauacugaguucuuccaggaaagauccuggcugaagggacacuggcuuucacagacagaggcauguucauauucaaacuccacucuaaacuagucuuggcuccuauagucaguuuuuuuuaccucuugagaucuccauuucuucaucaauaaaaugcaguggcaggcgucacuggccaacacugaauaaaugguaugugcugggaagcagggacuggggaagccaggagucaugaugaagucagcuuagcgcagccugaaucagguagggaaauuaagaccugacauaggaggaaacagaaaacguugaagcuuggaggaaaacuagaguguugcucuucuuugcuuacccaaugacuuuagugaagucaccaugugggucuucaggccaaccaaccaguuuuacuuuuuaaucucccuuguaauuaauauuuuccacacuguuuucggguaauagaaaugcagugcaggcugguaauagaaauacacaguggcucacgccuguaaucccagcacuuugggaggccgaggcagguggaucacuuaaggucaagaauucaagacuagccuggccaacauggugaaaccucaucucuacuaaaaauacaaaaauuagccaggugugguggcaggugccuguaaucccagcuacucgggaggcugaggcaagaaaauugcuugaacccaggaggcagauguugcaaugagccaagacugugccacugcacuccagccugggugagagacagauacuccguuucaaaaaaaaaaaaaaaaaaaaaaaaaaagcaguguggaccaugggcccuuccuaaucuggccccuucaagcgucuucugcauauaaugaucaugcagucacuauaaaaaagcaaacaaauaaaaaugaaacgucacauguaccuucugagacacaccuugcaguuauagccuauguguuucuaaaguccugugccuucagcuuacuauauccuuccuuaagcccugucuuuucacaaacucuuacccagcucucaaaacuuaguucaaauaccaccuuuacggaccuucugaucuguaucaaaugccuguuuacuguguucucagagcacacgcugcugugguguaccccaauacucuucauaccacauccagacauucauuauguuacuggaggagggcguccagguucuuggcguuuugaauaaagaauuggacaaaacgcauaaacaaagcaaggaaagaaugaaacaacaaaaguagagauuuacugaaaaggaaaguacacuccaaacggugggagcagcccaagcauagaggcucaagagccugguuaaagaauuuucugggguuuaaauacccuauagaggucucccauuggccacuugguguacaccucauggaaaugaaguaauggcccacaaucagucagauugguuguggaaagaaguuacacuccuaugcaaaugucugauagguugugaaaagcaaccaaucagagggugaagcgaaguuacaaaguuacagcuccuaugcaaacggcugaauggucguggaaagcaaccaaucagggguacuuucaauuuuccaucugcaacucagaaaaguggggagggguugcagagggaguagccucugguccuuuuauaacuuaguuguggaaaguugguguuuuccuuuugauuuaauuauacaaagucaacgugaaucagccuuagauucccugccuccagauccuguucuccugccucacuuacuuuucuaauuucuucucuaaaugaugcuucuugaggguagacaccgaauccucaucaucucaggacacaguacaaaauacagcaugaagcagaucccugggaagauucuguuugagaaucaaugaguuaagaaacaaaugacagcaaacacagucuucuuucuagauuggcaaaugagggaauacuggucucugagggauacacagggccaaucuccucacugucaccuugcacucagagagauaagauggcuuuugcucuccagugcagaaagaguggccuccucugccagcaugaaccuugccugggaacugauaucaauaacggcugcagcacacagagaaagacacucaagugucuccuccaaggagagagacggauguuuccuucgggggcugaucggguucacuuccuguucaugagcacggcagacaccuaaccucccggcugcaguaaggguugggacuguauguggggaguugggguacugugcuugggagacauuaacgaggccccucuuacucuuccacaagccagggccuucuccuuccucuuuuugggaggcccaggaaguggcccuuuccuugaccagacccuacacugggaagcccccggcucugaccaugagacucgcaauggcuguucacuggacaauuucaagugaauucccgcaaaguuucccaagaacaucagauacaaaagaguugauggauggaaacucacacgauaaaccaaagugaaaacaaaacugugucgcccaaccccaugugaacugaaaccgcagggcagaacgcucugacuccgcagacauaaacaguuuuagccccgagugagucaccagcgcagccagggcaaagcuggagagagauuucucgugaugcgcuggggaucgcugugcguuccuuucccuagaaacugauuugucauuugagucagaggaaagaacauuucuagggcaccuaguacauaccagaggcucugguccacgcuguagauaaauacuuccaaccuguuuucacaguaaccugcauaggugcugacuauuaucuccauuugcacaugaagacacagaagccagggcgcugaaacacuuaaccugagccagagcuagaaguggggcucuguccugcugcugcccuucaccagaggacacccugaagcccugaugggucacaugagucugcguuuucccuguccugaguggucuccaaacugccuugaucauggacuauuaucaguaaaaauaaguuuugagcacacucaccccuaguauuuguacacugauuuaucgacaaacgauguacaaucuacauguaauauuacaaaacauugcaaggaaaagacauuuaaauggguugagauaaaagauaaagguaaauaggggcuacuauguuuucuauccauauccuagugcugaggucacaggguugccagguugaaacuauacauagacaucguagggggugggaagagaggauaggaggcagguaaggagggagagagacagagauaauguccaguuaaauguggaacauccuuuugcuaaaaaauuauccauuguuuaucuaaaauuaaaauuuacuuuaacaucuuacuuuauguuguauguauguauuuauuugagacagcgucucacucugccgcccaggcuggaguguaguggcacagucucaacucacugcaaccuccgucuccuggauucaagcaauucuccugccucagccuccugaguagcugagacuacagagcacccgccccaugccccacugauuucuguauuuuuaguauagacaggguuuugccauguuggccagccuggucuugaacuccugaccucaagugauccacccaccucagccucccaaagugcugggauuacaggcaugagccacugugcccagccagauauuuuguuuuugagacacagucucacucugucgcccaggcuggggugcaguggugaucuugggucacuucaaccucugccucccagguucaagugauucuccugccucagccucccgaguaacuguaauuacagacaugcgccaccacgccagcuauuuuuuguauuauuaguagagaugggaucucaccagguuggcccggcugaucucgaucuccugaccucaaguaaucugcccaccuuggccucccaaaaugcugggauuacaggcgugagccaccgcgccugaccagcauccugcaauuuuauuugcuaaacauggcaaugcuaaggagucaguaaaugcuuucuguuacaggauuauaauaaagauucuaggcuuugugggauaaauggucucugucacaacuacucacucuccuacugcagugugaaguggcgcuaggcaguuccuaaccuaacaggcaugacuguguuucaguaaaaauuuauugauaaaaacgaguggcuggcuggacagggacuuugcuggccacugccccaguggaucaucgugguguaucccacuuaggagacccauggccuguaagagaagggcuuguauuugcacaguucuccaacaaugugacauagugaaaaaauaaacucuuauuuuuucugugaggguuucuggugggggcuggugaguagacaaaggaugauaauggcaacucuuuuuaucauaggaguuauaagaggagcaaaagcaucucuaagacacgcucaugcacacacguacacacacagagugcugcaaccaagauauccaccaggguggaccugcauuuggugugucaaauugaaugcuucccuugccccaauuacuagcgcuucaaucggccaacuggcagccauaacaacacauuaaccuuuuugccaaaucaauuucaccaaguccccuuccagcacuaggagaaaugaaacggcgccccaugccugaaagacgagugcucucugcacaccacacacuguggaaucccccucuacacguggaacucugaauucuagcuccuaaacagggaucuucucauggucagagggcaacggaaaucaguuuuccaaggcugccuucccucccuuccgcagccagccgggguccaaagguccaagccaaaggacgcugccaacccuauuagcagagccaucuucacaaaucacgucagcauuuacugugcuucaagagaggcugcuugauuuaacucucaggagccccccgacggguaauuucacuuagaagcacagaggacagugcaggcagccgucugagucgcaucagcauuguaagaacgccugaagacuccagccuuccugagucccauuucuucaacuucaggcugauggugcuggagcucacucucuaagaaauggaguuuucaggagaugcaauuauuuucaaacucagcagugcuacauggcauggggcgaaugcagagaagggaccaaagcagggcagguggcaaaggugaccacaguggggucaguuagguggucaaauguggugacagcaggaggcacaccacagggcucgacuccugaggcaaugucuccaccggugagauaauuuagagagaguaaguugacugaguucaauguguauaugcauccuagcaauaauaaaugcacaauucucugacccagauuauucaaaaacauauuuccugcuucuucuuccauaauaaggaauaucugggguuuuuguuuguuuguuuguuuguuuuuugagauggaaucucucccuguugcccaggcuggagugcaaugguacgaucucggcucacugcaaccuccgccuccuggguucaagcgauucuccugccucagccucugcaguagcugggauuacaggcaugcaccaggaagccaagcuaauuuuuguguuuucaguagagacgagguuuauccguguuagccaggcuggucuugaacuccuaaccucaggugauuuaucugccucagccucccaaagugcuggauuacaggcgugagccaccaugcccagccaaggaauuucuuuacacucagcccagcccucuucuuaccgaccuguugucacccaacccaauuccacaacccuuuccuagagcuuggaggaaccgaagauguguagugugccuucugaaagcacaugacauccaaucacuguugggugccuccaaaauuguuggcuaaacaugauccuaaugcccucugcugcgaguguugggaacgucugggcaccaaaacccaguaugaccaucuugcuuugaccaagcugaacaagcacccuuccaugaaccacaaacaacauggccuccaggaucacacuuucauucggcaaacacaauuuuagccggguacuuaagaauccaggggaaaagucaugguccuagcucugggaacucagaagucacucagagguuaccacuggccugcugcaagcuuccugugacuuugcagcuauggggcacagugaggaacccucuauuccuuuauucugguggcagaggaagucuauccaaccaggaaaccauggcuucuaguuguugaauucuauccuaucaccuacgucuuccuagggccaggacuaaauuggcagcaugagaaguugcauuuaggggaccccagcaaugaaggcaaaugaucagcacuacucuaauggguacaaaaauaugaagaauggaauguggcuuaagggacaaucucuaucuaccuccuaccucuuaauauuaggacuaggagacuguggcuuuguggucaaggcaauggcucuaggguugcacagcccuggucuaaccagcugcagccucuguucgcauucacaccugucaaaugggcacagucuccccgacccgucuccuacacauucuagccaggagaagcaaaugcgaucaaggaaaugaggaugauuuaaaaaccacaagcguaacaaaaauauaaauggcuguucagggacuagauaauccagcaguuguuuugaacaaacuugcacucuucuaauaaaagugagaaaaauacagauauauuuguauuuuaacauaugccaauacucccaaaggaguggaauucucauuauuucaaaauucucuuuuuauaucgugacacuucauuggccaccugaauccagauuuuccuuuguaaaacccagcaucauacacagggagaaucuucaaauggcacauuacacauaaauauugauuuuaugccuaauuauuaccauacugaaaaaacaaucauugugauugcucuguuucacccagacacaagagcacaccuaauauauaauauuagaaaggggaaaaauuaucuacucaacuccagcagcuacugaaaucuuaaaaugacugcagucuccucucaguaacaaccuucugaacuuuuaugagucggacacacacaagggcuuaaaaaaugucacuuuaccuaauugaacuguuuuucaggaagacauaauuagaaccucuagcuuucuggaagugggcagcugccacuuaggagcccaccuugacuugcuuauggccacagaaguccaccgggcucugacagggaaaccccugcuauguuaaaacacauggacucauguuggugccuuucucuugggauggggaaaauugauuaaaacaauaaauacugauauagggaaaugacugacugggaacucauggccuuuggaagggaucggugagggaauaaaguggcccaaggacaaaccacccaggacacacuccagaguuuacaggcuucucuucugcaaacacucuguaaaaguuucugccagaugggggaaaucaggugaggaagaaaaaaaugggacucagcaaaggaccaggacaucauccaugauaccuagauucuuauaccccuuuuccucuuuuaauauaacccuguagacugggagcuaaacuaugaggaugcaaaggcagaagaaugauacaauggacuuugggaacucagggagaagggugggaguagggugaggaauaaaagacuacauauuggcuacaguauacacugcccgggugauggguacaucaaaaucucagaaaucaucacuaaagaacuuauucauguaaccaaacaccaccuguuccccccaaacuuaauaaauacauauauaaggcugggcauuguggcucacaccuguaaucccagcacuuugggaggcugaggcaggcggaucauucugaggucagaaguucgagaccagccugaucaacaugaugaaaccgcaucuguacuaaaaaauauauauauuauauacauauauauacacauauacauacaaaaauuagcgaaguaugguggcgggcgcuuguaauuccagcuacucagaaggcugaggcaggaaaauagcuugaacaugggagguggaagcuguagugagccgagaucauaccacugcacuccagccugggugacagagugagacuccaucucaaauaaaugaauaaauaaauaaacaaaaauaaagacagaugagcaaggaacgaccaaaaaaauagacauauaacccacuaaauguaauuauuucaagggccccacucaucacucugcaaaccuagucucuuuauuggaaucuguuuuuuaugggcuucugugacuaaggcaauaacgcaauacacaauagcuauaugaaaaccauugugggccgggcacauugccucaugccuauaaucccagcacuuugggauucugaggcaggggaauuguaugagcccaggaguuugagaccagccagggcaagacggugagacucagugucuaaaaaaauuuuuaaaaauuuaguaauuagucagauguggaggcaugcgccuguagugcccucccuacucaggacguugaggugggaggaucacuucagccuagaaguuugaggcugcagugagcuaauaucacgcaacugcacuguagccugggggaaagagacagauccuaucucaguaaaacaaaacaaaauaaaacaacaaaacaaaacaagaaagaaagagaagagaagaaaaggaaaacauugugugccauggauacucaugaauuugaugauauguguguugucacaugugagacuuugagacaccaacgguggucaggagagagcaaaggugacuuugggaagaagcagaagcuguugguggccuggucagauccccuuuuagcagcugcugugccauuuccuagcuuuugugaccuucucuggaaaauuucacuuugcuggcauccuuguccaccuugcccaagacaccuggcaacauacagguccccaugaggauagccuaugacuguccgacacgaagguaccacagcccggccuucuggccucaagcgggucaaguuugaggugugauuuuuauuccagagccccccaaggauaaaccugaagccagacuucauuugagaccacaucuucucuucacuucugucuccuuuccuauguuguuuuccucaccugucacacauuugucccaagaacauucccuugauaaagcaagcgaagccgaaucccugucuucaucucuagucugcaccacucaacaaaacacaggguucagacagucaacagaggccagaaucgcuugagguggcacacuaguuuucucacagguaaauugggaaggcccaccuauucggaggugagagaaagagaacacuggguauacgguuucuggauagacaagaagggacucagaucccuggcccuguugcagagagcagaaagguguggagcauccccugauucacaaagccuugaccagauccuccaccuaaagcaaggcagggggcaggggccuucagucaacaacauucuaaaguuagaguccauugguaccaucauugacauagaacuaguacuugagccaggcaucacgguggccguggugacgccaggagaagaugaagaggccagcagcagggagaggaacugucugcugucuccucauguacagggcaggcccaugccugcagacacaaaaaguugacuugugcagguaugcucugagcaucuguauggcugaguauaaaacaggaacacucagaguuaacaucggcauaaguccucgaguucaagcacgucaaaacaggaucuugccucuguauuagucaggguucuccagagaaucagaaccauauuaguguguguguguguguguguguguguguguguuugugugugguguguaugacaucucuuauugguucugauucucuggagaaccugaugaccaauggauugauagauagauaaaauaagaaaaagucucaagauccgcuauaggcaagguggagagccaggagaacugauguguaguuucaguccaacuccagcaagaucaaaacacaagaaaugcugaugcuucaguucaagucugaaggcaggaaaagacugaugucaggccagacgugguggcucaccccuguaaucccagcacuuugcgacgucaaggcagguggaucaucugaggucaggaguucgagaccagccuggccaacauggugaaacccugucucuacuaacaacacaaaaguuagcugggcaugauggugggugccuguaaucccagcuacucgggaaggcugaggcaggagaaucgcuugaaccugggaggcugagguuguagugagcugagauugcgucacugcacuccagccuagccaacagagccagacccuaucucaaaaaaaaaaaaaaaaaaaaaaaaaaaaaaaaaaaaaaaaaaggacugaaguccccaccugagucaucaggcagaaggaguucucuuugaaguagggucagucuauuugcucuauucagaccuucagcugaugagacgaagcucaggcacuugagaacaaucugcuguaaucaggugacugauuuaaauguucaccucacccagaaacacacucacagacaccccagagugauguuugaccaaacaugugggcacccugugacugggaccuaaucaaguugaaacaggaaacuaaccaucagguucaguuacacauaaaccagcucugcucucaaguucagugagguccaaggucugaggucccagguagguaaagaaaugucucccuucacuagaaaugucaacccgcagaccguaagauuuaaggacgcacagguuaaauagguugauucaugcaacaaacauuuacuauauuccaauuagggcuaucauagggaagguguuaggggccaaacagcgauauaaauauugaugauaaauucaggacuccuaagcuuauaucugaggcuacccuccugagaugcaugugggggaaaaauacucccuuuucagguaucuugcaauccuugcacuuauaaaaaaaaccaagagucucauuuugaugugugucuuuaacaccuaacauuccaauuucagucacuggaaauccuaagucucuaacuagaauuuaauacuacucuuuugcuuuaguuuucauuuuacguguguguaugaauagauggacggauggacgacuuauuuaguuuuuuguguuuuuuuuuuuccagacaggaucuuacuuuaucacccaggcuacagugcaguggcaugaucaugacucacuggagccucggcuaccugggugcagaggauccucccgccucagccucccaacuaccugggaccacaggugugccucuaugccuagcuguuuuauuuuuuguagagaugaggucucuguacguuguccagguuggucucgaaauccugggcucaagugauccucuugccuuggacucccaaagugcugggauggcaggcaugacccacugugccuagccuaguuaguuauuuuauuuacuuauuuuuugagacggauucucacucugucgcccaggcuggagugcaguggcaugaucucggcucacugcaaccuccaccucccaaguucaaaccauucuccugccucaggcuaccgaguagcuggaacuacaggcacacaccaccauacccggcuaauuuuuuuuuuuuuuguauuuucaguagagauaggguuucaucauguuggccaggcuggucucgaucuccugaccucgugauccgcccaccucguccucccagagugcugggauuacaggcaugagccaccaugcccagccaguuauuuuuugagacaaggucucacucuguugcuuaggcuggagugcagugguaugauuguagcucacugcagccucaaccuccugggcuccagcaauccuccugccuugaccuucugggaagcugagacuacagacacacaacaucacacucagcuaauuuauuauuuuuuguagaaacagugaucucccuauguugcccaggcuggcaguauauuuauuuucagggauccuuuguauuuauggcaaaugauauugcucuucuauuuacuuuaguauuauagaaucuucuuuauaaauagcugugcauaaaaacauaaguaaauaugaacguaauuaaaaacaaaugauguaacagcggagcaaaugggacaaaaaaggcggaaguuuggggaacaugguuuuacauuauuaaaaugugaaaaccguaaaagcaaagagggguaaaggaauggguccugacaaagacuagaaaagaaaagacgagaaggaaauaaagagccauccacucgagcucaguaaugcugugacaacagaauaaaugccacuucuuuacucuugcgaaacacagcgcuuauucucaagaaagaaagaagucaaaccuaagggagauaauuccuaagcccugccuaagaguuacagaaauaauuacuucuaccugccagagauuccaaaaccauaagaaaacaguccagauaggaguaugcaauuuccccuuauuuacuuuuauuuuauuuaaauuaaccaagggaguugagucaaauuucggugaauucauauaugccugcaccuaucuaggugguuaguuaaguauacaguuuuaauuucugauaaaucuuagcuaagauuauugauuagagcauagcccaguuaccacaucuuuaucaaauuacccaaagacuuugaaguguaaaucuaccacaugcgcuauucaugaauucugugggucagcaauuugaauauggcacaaaggggacagucagccucugcuucacaguguuuggaaacuggaaucaucugagggcucaguuguuggcuuccuaucugaugacugaagcugacuaugacuggcggccucaauuccucucuauuugggccucucacggucuuccuaccuacgcuagauugaguuuccucauggcaugguggccaaauuuugaggguaagcaucccaugagugagagacacaaccagacggaagcaggaucaucuuuuaugaccuaacuucaagagucugcagcgucaccuguaccauauucuacauaguaauaaguaagucaguaaagguggcccagauucaaguuuugggguugggggcucacaccuguaaucccagcacuuuuggagaccacggcaggaggaucauuugagggcaugaguuugagacuagccucaccaacauagcaagacccuuucucuacaaaaaguguuuuguuuguuuguuuuuuuaaauucacugggcaugguagugcauaccuguugucccaacuacucagauggcugaggcaggaggaucaauugagcccagaguucaaggcugcaaagagcugugaaggcaccacugcacuccagcuugggcuauaaagcaagacccugucucucaaaaaaaaaaaaaaaaaagagaaagaaaaaaaauuggcauuggggagugcuauuagacuuuaguuuuuguugcauguuauaaaacaacugcagaguggauucaugacagggaacuacugcccagucugcacccuggccuuauccgcuucuucuuacaggcuuuccagucaauaaugaucaugacgaugcuugaucauacacaugaguacuugaaugcaaagcugaagugcuucaugccaucuauucugaauuucaagguacugaucuucacaaccgaaaaagcccaaauaaacgaggaaauaaagaagguaagaaagggauagauaagaaggaaugaaaggaaaaaggaauuaacaaagggaaacaagaaagaacagaggcuuauauuccuucucuuuguaacaagucuauguugaaacacugaagauucaaagggaucagugcagaaagauuucccaaggagccguaguauuagugugcaucuuugaagucaugcaaucuauaaaaaggugcggaaaucauucagccucuaccugaaaaagcagaggaauuggcagcuucaugugagcgugccucugugcucuaaauucuuaccucgggucuaaccuuggacacaucacacugccaugucaaguaccaggcccugucuuuaauuaauacagauaaugaaauauuagccacggucucaguugcccaagaagaguuagaacuccuuggcuuacacagcccaguuaaaccagauucacucaaaaaacaaaagcaagcaauuucccacccaugacaucaaauaaaaucaacauuuucuuaaaucaacacuaaacauaauguguuggauaguacgguaacaucaauaucaauggcucugcaguugauuugauacuguaaguugaguuacuuuguuaaugauaauaauguauuauucuaggggaacaaacaaagugaucugaauuuuuaaaucacuacucaguuucugcaucuccuguggcugcuaaguugccaagauuccuggugguucccuaauggaaaugacucuccacauuccaagugauaagccacaagagaaaacugugucacuuuuuuuuccuaaaagauuuauuucuccugaggcuggguuggugguuuauaccuguaaucccagcacuuugggaggauaaggagggaguaucgcuugagcccaggaguucaagaccaucccgggcaacacagcaagacccugucucuacuuaaaaaaaaaaaaaaaaaaaaauugccgggcgugguggcaugcaccuguggucccagcuacuuaggaggcuagguuggguggaucauuugagaccaggcgguugaggcugcagugagcucagauggugccaucgcacuccagccugagcaagacucugucucaaaaaacaaacaaacaaacaaaagauguauuucuccuggacucaugugaaugaugaguccuaggaaauaucuuaccuauagagcuagugugccugguacaucccagcacguggcuuauaugauaaugcuggaaggaaggaaaugggaagaaaaggaaggaggcagagagggaaggaggcaaggaaggaggaaaaaaggaugggacaguaaaauugagguacuaacgucguucauaagaucauccugacagagacgcuuuuugggaagcaacuugaccauauguaaccagagcuuuaaaauaaaauagaacaaaauuuuauauucuugcccaaguaguuucauucccuaaagcuaaggaauccuuaagcguuuauagcaaggaguaaaacaccaucaccaccauguacacaacuaaaaaauggauauaucaaagucacuguuacuuaucauaagaaacaacuggaaguaacacaaggaugauguugcaagguggcagcuucgagggaugaggaaacuaugaccuucgauugcucuggaucuggcauugcacugugucuguuuacauucauagucuuguuuaaaucuaaauagagcccuguggguuugggaccacagugguuucacuaucaggaagaaagcacugcauagcagguucaggccucaaaacuguagguucaaauccuguuucugacccuuagcagcugagggacuucaagcaaagcccauuugcauuaguuugcuaugucugcuguaacaaauuaccacaaacugggugccuacacacaacagaaacuuguucuuuugcaguuccggaagccagaagucccaaauuaagaguuagcaggacugugcuuccuccagaggcccuggaagagaucuuccaguaucucuuccagcaccugauggcuccaggcauaucugagcuuguggaugcacaacuucacccucugccuuuaucuuugcauggacuccuccucuucugucuuucucaaaucucccucugaccuucuuccauaaggaugcuugcauucuacaaaggcacuuuuuccaaguaagggcauauccacguguuacaggaauuaggaugugcaugcauauauauauuuauuuuauuuuuauuuuuacuuuuuuuuuuugaggcagggucuugcucugcugcccaggcuggagugcaguggugcaaucauagcucacuacagccucaaucucccaggcuuaagcaauccucccaccucagccucccaaauagcugggacaacaggcaugcaccacgaugucuggcuaauuuuuuauuuuuuuuacggauaagguuucaccauguuggccaggcuggucucgaauuccugagcucaagugauccgccugccucagccucccaaagugcugggauugcaggcaugagccacugaaaccagcaggaugucuuuagggauaucuuugguggggcgggauaucuuuagggggaugacccuacaaaccacuacacuuuuacuaaagccaacguuucucacuuaggaaauaaaguccauccuaauccucuaucucuccacaccguuggaaugacuaaauuaggugaucuaugcauaguuuguuauucuugugaccuccauguaacaaggaggaaacuccaacacaagguuuaagugacauaccugaggucccauagcauauuagcagcugaguguagacaaggacacaaugucacuuaacucucuuuacaaggaagauuguuuucccucuuggaaucauaggaugugaaaacuggaaaaggcuauacagaucauguagaccugugguugucaaagugcagucaagggacccucagggaugucucugagacccuuccagaagcucugugaggucaaagcucuuuucaucagaaugcuaaggugucacuugacuacuuacuuguauucuuuuacaacuagacagcggaguuuuucagaggccacaugccaugugauaucacaagagacugaaugcaggaaaagaagugagaaucuggcugucuucuagggaaccaagcacuggagaagaaauguagcacaacgccacuuuucucuuuguuugaaaauaugguuauauuuuauagaaauguuauccauggccaggugugguggcuccugccuaucaucauccuagcacuuugggaggccaaggcgggagaaucgcuugagcucaggaguucaguuugagaccagcuugggcaacacagugggaccccaucucuacaaaaaauacaaaaaucaacuagguguaguggcauguguccguagucacagcuacucaggaggcugaggcaggagaaucacuugaacccaggagguuaaggcugcaguaaccugugacugggccacugcacuccagcuugggugacacagugagacccuuucucaaaaaaaaaaaaaaaaaaaaaaaaaaaggaaggagggagagaggaaagaggaagggaguuaucuauguucacuuguaauagguuucuuacuuauaaacgaauuaauaaagaauuugacuauuucuauuuuaauuucuaguaugauaaauaucaguaaaaaugacccagauaaacaaaugcuauuuuggguccuggauaacuacuaagaguuuagaguccugauaccaaaauauccaagaagcacugauguagagcaaggcaggcacauagguaggacacacucuaccauucccugucucaccaccagggagacaaggagcugaccucucccauggaguccaauccccaaguccaaaguccuccccacacagcacuacuauuagccuuucaguuguuacugaaagaagcuugacauaagggaaaaagaagaauuuaagggaaagguaugagagaguucaaagaaucgaagggaauguuucaugaacuacagcaguagcaccagggcccccacggacuggaacucaggacccagaccuugugucccuccuuucuuucucaucucugcuuucacugggacucgcuaugggcuaggaaacacguacccuggcaguucuguggugauguauucagaucaccaggaccagaggacagugucaaaggcacgcugaugaggacccucauuuguuuuguuucgcuuugagauggagucuugcucugucacccaggcuggaucucagcucacugaaaccuccgccuuccggguugaagugauucuccugccucagccucccuagcagcugggauuacaugcguuugucaccaaacccagcuaauuuuuguauuucuaguagagacaggguuucaccauguuggccaggcuggucucaaacuccugaccucaagugaucugcccaccuuggccucccaaagugcuggcauuauaggugugagccacugugccccacugggccucauuuuucauauuccauggaugcauucugcauggucugccaagggcacugggacuggcgaugccacgugcuggaauaaggcaacuuacaccacggaagauguagagggcugcucucaggaaaaaggaaaagcacauugggaugaccaaaaacacaaaagcucagcacugugcagacagcccuaacagguuagagccacccacggaaaugauacccagugaccauuucaacucccgacucagcuccccucaacucucauuguacagaugaagaaacugaaagccuccuauuuccauagaacuauucuggacuaccuccucauugccccaugcaacucucaccacagagggaaauucaaccacagcauccccuggcaaaaaaaaaaaggaacaaaacaaaacaaaaccaaccaaccaacuaacccuagggcuuuacauaaagcccuaauaaauuguuuaguugacucccuuccuccauuaauugcucaaauaaauuguuuaguugacucccuuccuccauuaauuuaccuacuaucccaugggggaacaaaaagcacuacuguguauugaauuaagauaggcugggugcagugguucaugccuguaaucuuaacacuuuggaaggcugagggaggagaaucccuugaggccaggagcuugaaaccagccuggccaacacagggagaccuccccgccccgucuccacaaauaauuuaaaaauacgccacgugugguggugcauaccuguggucccagcuacccgggaggcugagguggggaagaucacuugaccccaggagguugaggcugcagugaaccgugaucaugccacugcacuguaaccugggugacagagcaagacuguuuccaaaaaaaagaagaaaaaaggaaggaaggaagaaaagaaggaaggaaggaaggaaagagagagagagagaaaagagagacacagaaagagaaagagagaaagagaaaaagagagagggagagagggaggcagagagggagggagggagggagggaggaagagggagggagggaagggaagcagggaggaguaaaaguaagaaagaagaaaggaggagaacuagaaggagaacaaagagaagaagaaggagaaggaggagaaggagaaggaggaggagaagaaaagaaaggaaaagggaagaggaaagaaaaggaaaggagaaaaaagagaagaaaaggaguagagacagagagacccaaugugaaugacaugcagcgacaaaggcagauuggagugaugcaccuacaagccaaggaacaccaagcaccgcccgcaaugccaaaagcuaagacaaaggcauggaguagaucaucccuggagccuucagaaagaacguggcugugcugacaccuugauuuuggacuucucacuuucagaacugugagaugauacauuucuguuguuuuaagccauccaacccuaagaaaccaauuuuauuacuuuguuuuaaugcugcugauaaagacacaccugacuuugggaggcugaggcggguagaucgccugaggucaggauuuugagaccaccgugaccaacauggugaaaccccauuucuacuaaaaauacaaaauuagccgugcaugguggcagaugccuauaaucccagcuaccugggaggcugaggcaggagaaucgcuuaaauccgggaaguggaguuugcagggagcccagauugcaccacugcacuccagccuaggcaacaagagugaaacuccaucucaaaaaaaaaaaaaaaaaaaagaaaagaaaagaaaagaaaaaaggaaaaaaaaagacauaccugagacuggguaauuuauaaagaaaaagaaguugaauggacucacaauuucacguggcuggggagaccucacaaucauagugcaaagcgaaaggcacaucauacauggcaguaggcaagagaaaaugagagccaagugaaagguguuucccccuuauaaaaccaucagaucucaugagauucauucacuaccccaagaacaguaugggggaaccacccccaugauucaauauucucccacccggucccucccacaacauaugggaauuaugggagcuacaauucaagaugagauuuggguggggacacagccaaaccauaucaccaauaaagugcauuaaugcaacaagcaccuguaaaauaccugcuacguaccuggaaucacuacuaggugcucagccuccagagaugcaaggaaaaacaaagcaacacaauugcccuugaggaacucuuagagguaagaaucagauggagauaugucugaaaaacuacacacacacacacaacuucaucaaaucaucaaaucacugcuccccagaaaaugucuccuucaggguucaggagaugguuaauauuuauucagagcuuacagagugcgagcuucaaucucaagggugacgagcugauuuugauguaaacugagagggaauugcauggaaauguuuucccagcucuggggauucuugucauuucacuaggggacuacacauaagugggucaauguccccaaauuccccuccuaaauaacauaaggacuguaaauaauggacuguaauaaugucgauaaagaacuauaauaauaucaguaaccguaaacauuuauuauaaugauaaugcaaugugcuaaaagcugggggugcaaugugcuaaaagccauuuaccuuaacuucuucuggaacaaggaaaagcaggaaugaaggaaaaaaaauauuuuaggaguuguugcuaaaggucacaucaaugaaaacugucucuuuuuuaugcaaguuaaucacagagauaaugaauccaacuacuguauuuuaccaaauggggcuuuuuucauugcugguaaccagaggcccuagaagacugcucaaccugugacagguacucacuaaagauuuaauuacagguuauaaaugacggagugagauaugaaccgggauguggcaaagacuggcuaaauagucacuacucccauuuuccuccucguccugcacauccugaauuuuugccaagguaaagagguuggaucugagauaugcugcuuccaguccuggcccagaaaacauguaguccuaugcauccucucccgcuccugcugagccugaaucagaggguaccauggaggccauggggggauggauggugaaaccacugugcaggugaagucuagguccucaaauaauccaaacuagacugucuuuggggcuauaaacaaauccucauuuuuuacagauuaaaugugaaaucacugaaauuuggggguuaucuguuacaucaacugcuuagucugagugauacgagaacaagaagcaaguuccauuuuugaccuuggcagaggugggaaagcaauaaagaacugucaggagugaacccagagagcacuccaaugcccggauuagcagaaagcuuuccaacauuacaggaugcucucagaaucccgagagguagaaaagaaaagaaaagaaaaaagaaaagaaaagaaaagaaaagaaaagaaaagaaaagaaaagaaaagaaaagaaaagaaaagaaaagaaaagaaggcugggaaucaagguagaagaagugugggaguagaagaagguaguagaagaugaggcuggaaagagagaaacaugcagauaagaacaagguagcagacuucuguuguggcuucaguucauuuauaauaauagcuuggcaccaucagggcaucuuguggucacuccgccuucuccugccucacuucucauaggggaaggcucuuuagcaaaagccacguugacagacacugaccccaaggcaagagaccaugcuucaugaugcugggaguuuucaaaagcuucccaggugauucuaaaauguugcaguggcauaaacuuauaauauaaagaagaaaauaaguauucuguagcugcuaagaaagccugacaaucagagggaaauguucuauuaacgaacacaagcggcaggccagcaguugacgggaugaucuuucacuuuuacucaaucagccuuaagguaguuuaauccagguacucaucauuccuggcuuccucacaucauuuucuuuuuugagacaaaaucuugcucugucacccaggcuggagugcuccagugugaucauggcucacugcagccucuaacuccugggcucaagcaaucuuccugccucagccucccaaguagguggggcuacaggcgugagccacugcgccuggcuaauuuuuauacuuuuuguagacauuagguuuucauuauguugcccagacugaucuugaacuacugggcucaagcaauccuccugccuuggccuccuaaagugcugagauuacagccaugagccaccacacccagcucuucacaggaucuucuauuccuuuguuuauuuagaggaaaaaaaaaaaaaaaaaaaaaaacagagacaaacuacaguuccuuuaaaucaugcuccaguuacaucccucuucuacucuuguuagucuuuccauuauaccuaccaggggauaagcucacauagucaucacacaaauucuacagcuacuggaggggcagaaaaacuccucgcuuuguacucuuacugaacuccaugaaauaaaauaugaucauaaucacaacagauaccacuacuuacuggaugcuuccuaugugacaggaacuaugccaaguacuugacaacugcugcucauuucauacggucacuuuucagcuauuuucuccaucacugaauccuuaaacacacccaugaguuagauacugcgaucuccauuuuacagaugagaaaacugagaccaagagccuugaguaaagaugcucaaagucacuugagaaaacugguaagcgccagagcuaggacugaaccccaaguccgucugaacccggagucagugaccauaacuacuacaggagcugcggucaucgugccuugguguccucuacuggacagacagggagugagccacgugcuggucauuuccuuggucuccuuugggacuggaaugucaggaucaugaccuuaaucaaggcacguaaagcaaaauauaauacaaagucuuagcuucuugauuuaagcaaguauuaauaugcaaaauaccaccuucuagaaaaaaagaaagugccuggaugcuaauuuaauacuuuacauacauggcugcuuaauaggcaaaaaguagcaaaggaaagucacauuuacaaaguuggguuuccugagauugugacauuaucgacaauuccagcuccuacgcacgugugcguuugcucugccaaccucuucauauggacaaaaaguugggccucuuuauucguaggaaaggaagucggggguaucuucggagcaccugcuauguaccuggcccuguguauguaaucucucauucgauucccagaaaaacucugugaggaugcuacuggccagccaauauuuccgagaggcucaggcaggucaauuuauuucuuuaaggucacacagccagugacggaggaaucaaauuucaaagcacauguccugcuuuauaaaaaauauuucuaacacaagugguucaggcugcccuaggcuuaccauugaugacuucuaaagaagagcaaauacucugguucccccagcccacaaccccgccaccagcaauagaguuucugucugauggcugaacacuuuagagaacacuuugucugacagcugaauacucuccagccgacaauauguucauacaauaagaauaauuguugucacuacacagauuuuuaaauacagaccuaaaaauuaaacaguaaauguaaaugguauuaugauaucuuuaaagccugaagaagaaaagggggaaauagaauaauggaaagaaguaguucaucaccuucaucaugaaagcuacuuuuuuucuuagacauggggcauaucaauuaaagauacuguagaaaguauaauggccuauaauauauuuauggcacuugccaauugugggacauaucccacgugguauccacaucaugaaaaacaguuuauggagauucugggcuaagagauuuauauaaauauauaucuacaagugaucaccaauaaacgaccucaaucuuauagacuaauaagaaugcaggaguuggcaauaguaaauucaccagcugaaaggcaacucuccaggcacgguggugauuagcguccacuuggcuccccugaugauggagaagugcucuugguuucauccugaggaugggggaggaacuuaucuuuuaguuaggaccaaauuaauuuuaauccaucuuuguagcuccugucuaauuucuucucuccccaagaaaguaucuaauguacuuuuggaggaaggcacuugggcacugcuuguauaauagaguuugagaauaacccuaaauucuagaagagacaagcagagaccgguggaaauuuauaguguaaaccacgcuugcagaaucauaaaacucggguguuuucuguuauauagucagagccucauauucaauucaagggucaagaaugugaaaugcuggcagguuuccuaggacaaauaugguggucugaaauccugaacaucuggcucugucucucacagacacauuaugauauaaaauccugaaagagaguaacuggguccuaaggauuuuuuccagaagaaaagugucauaaaaaaaaaagaagaaaaaaaaauaacauugcaaauugggaauuucaaaauauaaaaugauguauaaguuuuuaguuuucguguuaacagaucugaccauuggcaagcaaaauuucuugugaaaagaaagaaaaauaauucuuucuugugaaaagaaagaaaaauaauucagaaagaucuauauaaccgucagguucagaugauuaagauucccuuguuucacacacgcgcacauaaucuucaagucuaucagacgaaucacagugggccuuaagucuuacugguagggucuaaaagaagcacaucaauuuucaaacacucaccauuuaaaauuagggcaagaaggaauauugucaguaagaccaagaagcaagagugaggcauuucaacuugcagaauaacaauacgauuaaauugaaaucguuguuuucugaaaacagucauuucauaaaauguacaguaacgcuuuuauauguaaauuaucuaaacugaaaaaaaccuuccacuuuaaauugaauugagacuagcuuagaauagaacacuuuggugaaaacgugcuuaaaaugaauaaaacugcaaagggaaacaaauaauauuuugcagaaaaauacugccaauaaaugcuggguuuucuuucuuucccgucauguauuuguuuguuuuugauugguguuuguuauaauaagagaaaacauaauaccccugguuacaaauucauucuuaacuugaugaagcuuaaaguuaagugauauuuuccauuugguaaauuacaaauguuacuaauacauuucagaggaaauaaguauauaugaaaauuacuaaaccaguguaagacagagcaaucuaacuuaccugacuagcuuauuaaaaaggcucuuccaaagcauugaggggucucuuuucuuuuaagguaaccuuaaagucccccuucuccuucuuaauuaacgacacacuugucuccuauuuauucgcauuucaucuagacacuccuccuuccagggccaucauaacauuucucgacuuuuucagugcacaugugacaguccacccgaaauugugcaugccuguaaggcaagcuucugauuauuguuucuucuuggaucccacaucaccugacagaagauuuagcaaaugguggucucacgggaggaaugagcagggaugguuaauggggcuuccacagggaaggcuccccagaauaacccuucagccauggucacccguuuuguguggaaguucguaugccaggcugugugcuaaacacauuaccugcacugacuguuucuguugaucagguucaggcaagaaaacaggcuuugggaagaaagagaucacccacaaucacacagaugauacaugaugggcuuggauuugaaaccaguugugcgucaugaggggcucauagucuucaccaauacccuuuagcucuguuggaacuaaguucuacuugucccuucacccaccuaaccccccugcuaccaagagugccugggaucuuacagacucaaaaaaaugugaaugagugguuagugcagauuauuucaagagagccccagaugccauguucuuuaggucaugagucagccccauccaccccuccccaauucuucaccuuuaccuccucagucacauccaugccuuuauucaugucuccuccaaaggaaccaauagaauaauuccuggcauauauuagugucucaauaaauaugugucaccuaaaugaauacuucuuuuaaaaaaacauccuucagaaacauuggaacucuccuaagcuaucuagguagugucucacuauguuggccaggcuggagugcuguggugugaucauagcucaggguagccucaaaauccugggcucaagggauccucccaccgucacccuccagaguaccuaggauuagaggcauggaccacccaugcuuggcucaguguauuaauuuucuaaaagauaaauuuuucugacuggcaaauucauuuuuauugaacaucauguguucuacucaaauaugggaaagagaacccuccuauucaguuauaaaguuuggcuccaacucaagugagcaaaaaaacauuaaauuuauuuaacuccaaauacuauaaaaacacaaugauaacuucugagcuagucguuuuuuuaaauuuuuuuggcaccacaauaauucuuuuaugaugguauccagugagaaucccucacggacuuuucucuuaacauggaaaugcauauggucucugugguacaacagcuguguaacuacauaauuguuuacaaaugugcaaauuaaguacccaaaccaauaaaaaauaauaacuugggcagccauaaaaaagagauacuauaaacaugcaauggcccauacuuucucuauaaauaaccguugaggcaaaaauacaaccaccagaaccccuuguuugaaauccccuuccauaaagcaaauaacguuugcagucuggcaggcuaauaccauugugcuuucccaagcaaaaaugcuuauuaacauuuaucauuuagaugccauuaaaguaacuguaguaaaaguggauccauuuacaauaagacacuugguguuggguccacuaugucgugaauagguuucaaaccaguacacagcuccuuccucaucaccaaacaggugggaaagacagagagggaaauauaaauagcaggaaggagaaaaaccacagggcauccuucuaaauauguucccaccuaccuccauccuaauccucgauuagauccaucagaguccaacccaaaggaagccggcauuggaguaucaaagaagcaaugaagucuugcccuucagugccucuucuuggaaaaccccucuuucauuccauucugucuccuccgugugucuggggaaacuccuauucauucaucaaaacccaacucauuaaucucuuccaccaggaaaccuucuuuguccaccaucaaagagagcaaaucacauccuucacagcagacccuuccaacaguucauauacuuaauacacauuuguugaccaccuaccaaaagccaagcaccacuguucaaaaggugcuaaagccauagcaaugaacaagauaaggagcucagucuauaagucaaugaauauauacaguguaauauuaagcaggauuguauuacauuauuucaauuacauuauugcaaguucugcacuuauuguaauuauuaugcugucucucccaguaggcucuuaacuacuggaucucuauauuccaugguuuuccaauuuagcaaugcuuaaugaauugauuuaaauuaaauuuaaaaaacacacuuacucuugguauagucuaggucaaccacuaagccuggggagacagacuagauuuacacagagcaccucuguucucagggagcuuacagccaucucuuggaauaaucacugucaucaccaugugaugaagccauuuacccuuuuaaacuuuucagagaaaacauuacuuucuguuguccucacagacaaccaugggagguguuauuagccuaauuuuacgacugagaacaucaagacauuccuuauccucugaucuugggaaagggggcaggauaugcccuuuugaaacugaaaauaagauaauaaacaugaagccagugagaucagguaaagcaaaccuggcugaagcugcacacagcugugguugcguagggaggguaagcucaggcuauggaccaagacaaugcugggccacguuucuccaggacuauaaggaagauccugcaauucgaauagagacgcuuuuuuuucuguuccacaccucuaagaaaaucucucuggagguggucccaugauucuccuugggugugaugucacccaaggagcagcacagugagaggagcguuaucacagaaccuauagagaugaggguuaucacagaaccacacgaacuugccuggcaggggcugggaagacacuggcauggaguacacacaggugacauagggacccaaaagugagggcauccccuaaaauaagcagugcaucaucuuccucugccaaauaacacucaucuugaagggcaggcagcauuuggcaggagcauucaucccuaggguugcugcagaaagcuacugcacacuggguggcuuagaacagcaauguacucuuuugcaguugcggaacccagaagucugaaaucaaggugucaacagggccacauucccuccaaaggcuggaggggaggaugcuuccugccuucaggagcuucuggcagucccagacauucccccguucaugauagcacaauuucaaucucugccucugccucuacacggcccuauguuuuucuucacaucaucuucccucuaucucugccucugucucugugcccaaaauuccccuuuaugugcauauuggauuagggccuaucuuaaggaccucauuucaaugugacugucugauuuuuuuuuuccccuuuccuuuagacauuccucuugaugauaaugauuaucagaaugcaucaucccugggaccaccauaauuucuugcucaaaccucuguaauaccucuggugguggacauuuagguuagaggcccuaucagcccuucccaaggcucuaccucuggcaggcuuccaucguaucccagcauuccuugcagcucaggggucaugugacacagcccaugccaaauagacacaugcagaagggaguugauagauucuagaaaagcuuuugcuuuuccugauaaaauggucagacacggcugggcacgguggcucaugccuguaaucccagaauuuggggaggccaagguggauagaccaccugaagucaggaguucgagaccagccuggccaacauagugaaauccugucucuauuaaaaauacaaaaagcugggugugguggcaugugccuguaaucccagcuacucggcugaggcaggagaaucgcuugaacccaagaggcggagguugcaaugagucaagaucacaccacugcacuccagccuggacaacagagugaggcuucaucuuaaaaaacaaaaacaaaaaacgguggguaggggugggggugggguggagucagacccagcugguaaaaauuccuaccccucuuuccacagugaaccugugguggccaucuacgaucccagaagaaugaauaaccuagagaaucacaaagcuggggaugaagaacuuugacaaaugugcaguugcugagccggcuggaccagugacagcaauugccucccucucagcuucuuauucagcaagaaaagacaaagcucuguguguuacaguuagcuuuacuuguguuuucuuuaacuugcaacugaacucuuuucucacugauaaaucuucuaacugaucucuguguuuccaauccuaauucaucacaauccauucucuuuuuucuuaauagagauggggucucacuauguggcccagguuggucucaaauuccugggcucaagcaaucaucccaccuggagcucucaaagugcugggauuaugagccaccacacccaggccaugacaauccauucucuaccgagcaguuauaguguuguccucagccgcaugauauuauaucacaaucacgucaucuaucauuucaaacaugucauuucauauaucacaccauaucauuccaugucuuaucaaucucucucuggcuuaaaaccacucacugguuccucacugcagcuagaauaaaaucuuaaguccucaccuugguuuacaaggcucugugugaucagacccaugcacaccucucagccuucaccuugaaucuucccuucauuuauuccgcccaaguuccauuggacuucagugucucaaacaugcuacacugcuucuuacuaccagaggucucauuuaccguuuccuccgccugggacacucugcuuccacacuuuuaaguaacugacuuuuugccauccuuuaugucauaccuagaauagugucuugaauauagauggcugccaagacaugauauggugugucuguguccccaccaaaaucucaucuugaauuguaucucccaucauccccacguaucaugggagggacucggugggagguaacugaaucaugggggcaggucuuucccaugcuguucucgugacagugaauaagucucacgagaucugaugguuuuauaaagggcaguucccuugcaaaggcucucuugccugccaccauguaagacgccccuuugcuccuccuuugccuuccgccaugaucguguggccuccccagccaugugcaacuaugaguccguuaaacuucuuucuuuuacaaauuaccccaucucagguaugucuucacuagcagugugagaauagacuaauauaggacauauauguugaagaaaugacaguacaucuaacacuuccuaagcacuguaacgugagacggacuuauucuagaaggggcuucacaagagagcuuuggguucaucagucucuuuaagucaucauuuugccuucuuuuccccaguucccuuaccuuccccccaaaugcagugucacggaaagagaacuagaguacacacaagcccucguagccaauuggagacagagccaggacuacagacagguuuccuguuccccaacgacaguccucggguguuucuguuccaucaccccaaaucauauucagaucaggacccuggcggagguaucuguuuccccagagaaugggacuguauuaucuacagggguugccauaagaaaaugugacagacuagguggcuuaaacaacagaaauugauuuucucacaguucugaaggcugcacauucaaggucaaggugucagcagguuuggcuucuccggaggccccuugccuuggcuugcagacagccaccuccucaaugugucuuuugccacuguggucuuuccuccaugcauaugaauuccuggugucucugugcauccaaauuuccucuuuuuauaaggacccaaauuaaacugaauuagggaccauccaagcaaccucauuuuaacuuaaccauccuuuaaaaggcuguaucuccaaauagaguaacauuaugagguacugugaauuagggcuucaucacaugaauuuuggggacacauaauucagcuccuaacagauaccaaauaauaacagcaucaagacggagcucugcugguccuguuaccaugaacuaguugucuacuccagcucacaccaugcccugucuagaaguuuuggggugugcuacuagcuuuuuuuuuuuuuuuuuuuuuuuuuuuugagacagagucucacuuugucacccaggcuaaagugcaguggcacaaucacagcucacugcagccuccaccucuaccaggcucaggcaauccuccugccucaaccucccaagcagcugggaccacagguaggcaccaccaugcccagcuaaguuuuuaaauucgguguagagaugagggucucccuauguuacccuggcuggucucgaucuccugggcucaagcaguucuccucccucagccugucaaagcacugggauuacaggcaugagccacuacaccaggccugauacuagcuauuucuaacugcuauucuuggcagccugccucuugagaccucugaauaauauuuucuuaugaaaaauuuucaacauaccccaaaacagagaaccuaauuaaaugaacccacagucggccaacaauaauuuaacaugaacauuuuccaaucuugaauuauuuacgcuauuacucuaacaguuuuuuccgcauuauuuuaaagcaagucuuaguuaucauaucauuucacuuguagauuuuucgguaugcaucucuaacauaaacucaauuaaaauauuauuauacuuuaaaaaaugaaggcuacucucuuaauacuaucuauuagcuacuccauauucaaauuuuccuauuugucucagaaaaaugucuuugagagcagguuccccuaaauccaaaucaaaaugagcaucacacaauccaucugguacuaugugucuuaagucucuuuuaaucaauauaagacuuuuuuuuuuuuuuaagauggagucucacucugucaccaggcuggagugcagugguauaaucucggcugacugcaaccuccgccuccuggguucaagcgauucucccgccucagccucccaaguaacuaggccuacaggcacacaacacuaugcccagcuaauuuuuguauuuuuaguagagacagaguuucaccagguuggccaggaugguuucgaucucuugaccucaugaucugcccaccucggccucccaaagugcugggauuacaggugugagccaccgcgcccagccaaugcauauagcauuuugucuacagccguaccacccugaaugagccuaucccacauaacauuucgaagucaauugaacauuggcuuauuggucagagcauuuucucacucaagacaucacaaaggauacaggaauggauauaagacaucuauaaugaauauaagauauaggagaccaagagcucaggcgcccuaugauugggaggacguuggggcuucuuugccgaacuagcacagauuauggaagauuuaauguccaagagggaagcuccugaaagagaugcucuuuccuuuuccaagagagcuuuguucugaauuuggauuaauuuagauggcgcgugcacugagggaauuuguaagauguguuuacggaauaauugugaucaauacucgugcauuuacagugggagagugugugcaggaggcuuugagaaggcuccugugcgcucacucuuuaacacuggucaauacucauaguaaagcacuaacaugggaauuggagggaacacuuauauucaaacugugcugcguccccuuauggaagguucuuucauuuggccuguucgucucaaauacauuuaucagacgauguuauauaggaauggcacuauaaaaacacauuuuuaagcguuaagguuuaucauuccgucaucugcucacacuuuaaucaccacaaucuuugcggcuggccuuucaaacuauuauucuagaacagcuguaugcucuaaaauugauagucuucuuaguugauacauucacaaaaaaauguuaaauauucaacaagauucugaguggcugcagccaccuagucuucaaguucccuccaaagcauauacaguggccagauaugagcaucauguuccuauuuuuugaagaacuauucagccaggcuguugcuaaacaaaccauagaaauaguaaaugucuucaaaagggaaagugauauuuuuuaacguauauauacauccacaucacuuugaacauuucaaacaauuuccaugaugcacacuuagaggcuuccagauauaucugcuucccuauuauacaaaggccagacuagcaagaacagagaggacacaaagaaggucccaccuaauuuagccagcaggcuuuaaagaaacguguuggaaguaaucucucuuuauaacuuacacccuccacuuucuaagaugccugucggguguugguuagguccugaaaucuggccuugacaaacauguaaguuauuugugguccagauuucaauaaauaagcaagcacaaaacaaaaugugaaaagaaaggagaaaaaauucuaaggucccuuaggcuuuggcaugguggcucacaccuguaaucccagcacuuugggaggccgagugaguaggaucgcuugagcucaggaguuugagaucagccugggccacaaagggagagauccuaucucuacaaaaaauuaaacaauuagcugggcacgguagcaugaaccugcggucccagccacucaggaggcuaagaugagagaaucaguugagcccaggagguugaggcuacagugagccaugaucacgccacugcacuccagccugagugacagagcaagacccugucucaaaaaacaaaaucuauauauacacauauauguauauauuuauauauauuuuauauauuuagauauauacuugcauaaauauauaaaaauauauaaaauauaaauauuuuuaaauauaaaauauauuuauauaaauauauauauauauauauauauauaugagauccauuagcuuuaauugcaucaacagaagggauaaauucuugcaucccacugguguggccaaugcugcauagcagaugcggaaggcucuggaggguuagugcgcacugggaaaaggaaggauggagcggcuagaagcagcugccgcauuucuugaagacuacuuucagagacaaaucucccugcaguuaacuguguguggaaaguaaugacucucaaugccauucaggaaaccaguccccaggugccccaagugugcacgccacugggugauuugaacggggaaagccuguucuuaggccucuaggugguaaacacaagcaggucaacaugaggcagacaucccuguaggaguaugucacugccagcaaaaagaaacacacgaaauagcagaaaauaaacaacugcuccuggcccaggcugguaagaaaggcaacuaucggccgggggcgguggcugacgccuguaaucccaacacuuugggaggacaaggaggguggaacaccugagaucagggguucaagaccauccugggcaacauggugaaaccccaucucuaccaaaaauacaaaaauuagcugggcgucggguggcgggugccuguaaucccaguuacucgggaggcucaggcaggagaaucacuugaacccagaagacggagguugcagugagcugagaucacaccacugcacuccagcgugggugacagagagagauuaucacaaaaaaaaaaaaaaugcuuacuguugcuuuggaagaagaggccccaacacaaagccaauuucacaugcaucagcagacuuggaaucacagggcaguugguuuucauucccuguuaaaaggccugaaaugugaagguacccacagcacgcucaccugaaaaccccuuagcagggcagugcagacaggcaaguguucaggaagauguucuaaugaagagaagaggcacaccgucuaucagauugagagggccugugucagagaugaacagaauacccugguaauaucccaaucucaccaaggcugaucugacagagcccgauuacuugcaacaggcugggcccgcuacccaggcccugugaaccggaauggccgagaaucgcgggcuuuccuucagccagacaacuccaacaagcuucucucugugaucacuacguaaguuaaaugaguuaaucuuguuuuccagaugaacuguuauuuugucucccgcaggcagagauuacgggauaaaagcauuguguuaacaggagggcugggggcuuuccagagccacauuccacacacacagaaccccucucuccaguucuuccucccauuucuauuuuuucauggauuuagagaacgaggaggagaguagggaacuucaaaaugacacgcagggcgauaaaccuuucagaugaaugaugucacuucauaaggggucagggggccaauuuauuuucacguuucgaaacauaguuuaugagccugauaaaauuuaaaacacuucuagggcaaaauggaugugcaagugacacugaguuuugaacucuuucccugccuucuuuuuauuuuucugacuuacucuugaaacacaucagucaacaaccagcuuauacugaggguccuuugcauacaagcccuuugcugggcgcugugaaaaauaauuuuuuuauggccaacaccugguuucuucccucaaggagccuuaugccucugucacugauuucaacgucauguaucuuuuuaauuuuuuaaagccauuuuggagugcggacaauaauaaacgcacuuggaggcaaagccacugaacucacuggguucuaaucccagugguccaccacaguucacugugaggucuugagcaaguuacuuaaccucucugaccccuagguuuuuuaaucuggaaagggguaacaaguacacccaacuuucagggcaguugucaugauaagcaacagaguaugcaaagcuuucagcagaugguaaacgcuugauacagagucauuucccaagguagugucagaaucacaggaggaaagauaccaagacccugugacacagcagggcagaaacaaaaagaugucacagguaggugcuacgucuagcaaauaaaaacacaggaugccgaguaaaauuugaguuucacauaaacaacaaaucauuucuuagaaguauaucccaaagaaaauuuuuagaguauaugcuccaaauacugcaugggauacauuuuuaaaaaauauguuauuuaccugaaauucacauuuaaccagguguccuguuuuuguuuuuguuguuuuaagacacagggucuugcucuaccacucuggcuggaaugcaauggugcagucauagcucacugcagccucaaauuccugggcucaggugauauuccugccucugccucccaaggugcugggauuauaagugugagccacuguaacaggccagguguccuguauucuaucugacaauccuagccaugggauuucaggucagaagaccaaagaucaaguguuauuuacuauuccauuaaaaguaauggcaaaaaccacgauugcuuuugcaccaaccgaauagcauugugacuuggggacagauacuuuauuuauuuauuuauuuauuuauuuauuuauuuauuuauuuauuuauauuuuugagacagagucucgcucucuagcacaggcuagagugcaguucuccugccucagccucccaacuagcugggacuacaggugugcaccaccacaccaggcuaauuuuuguauuuuuaguagagaugggguuucaccauguuggccaggcuaguccugaaugccugaccucaagugauccacccgccuuagucucccaaagcccugggauuacaggcaugagacaccaugcugggccuuaaaaagauugaauacugcagauuuugagcaucuguagccuuuauuucugacuucgguuccugauauggcaagagagagcucagaugcacagacuuuuccaaagcaaaccuugcagaaugagcugagaaggaagcuauaccaacuagcccaagaagauguccagaaccucugaugcuugugcauaaaaaggagcaaugcuccuggugagguggcacagacaaggacgcauggccaaugucuuauaccuugcacacuucuuucccuauauuuagugguuacacaauuguugagaaauguagagauuuuugcauguacguuaacuucugcuucuauagcuuuuuaauauaucugaggaauuauuuuauucccaaaagacugauggugcucugaugggaguaaggggugguaaaagaagguagaaaaauaaaaauaaacccuuuaacacuaagauuauuugagugaucagaaucaacacuauaggaaggcucugugauaaccuggaugucaauuauuccagcacuuuguccuugaaggggaauacguucuuuucugcuuaaaauauuccaugguuuacauggaucauggucuccuuaggccuacuaggcaacugacugauucacuuccaaaggcaguuugugccaggcaugacggcugaugccuguaauccuaauacuuugggaggccgaggcgggaacacugcuugggcccagaaggucaaggcugcagccagccaggauugcgucaauuacacuccagacugggugauaaagugagaucugucuccaaaaaaaaagguaguuuguauccugagucaguugcaaggguagcugucaggaagaaccaucugaggugccaauugcgucaguaccauguguacccacaggucaaaagggaaacugcaaggaucgagaaagagcagcugaaagagccuuuccucuccuggauaaguuuucaauguugccauaauuggaaaaaaacuauuuucuugggaccaauuaccaagccagagagacugcaccaagugugcugagcucucuuguuccugccugcagcuucuuuguaguugacgaaugaaagaauauaaagggaaaugaaaagcuucaaaaagaggagaggaagagccccaggaaagcaacagagauggagcucuugauuacagaaagaaaucugaaauggaaucgggaaggcucaggaugcccccagagagauuccuggagaaggcaucuaauuuaacagcagagagagaagauggcaagggugcuuuagccuggcucuggaaagaaauaagagauguguugaaggaugugugugagacugacagacacagacagacaaaguuuauaugggucaaauaaggaaaaagugaaucuaaaaagcuacacauaugcacgaaaacuguuuucuuuuuugauauccuuauuaaauagggggcuugauaagauggaaaugccuuaauuaagaaugauuuuuauaaacaugcugugaucacacuugccaucaaauaugggugaauuuagucaaaaaaaaaaaaaaaaaaaaaccugccauaacucugacuggagacaaaguaugugucauuagaaugaaagcuucuugagaauacacaccuaucugagucacugcuguacgcacagcaucuaaaccacguuccacacucaaacauuccuuaguguguaaauaaacagaugcuuauaucuagcaggucauauuccuuacucaagauacacuaccaccaccuuguggcaaaguaccagaauuguaggaauaggaauaggguuuuuguuuuauucuuguuuuuucauuuuguuuucaauguaugugugcacaaaagcaguaugugcucugaugguacauacagcauuacacaaagucaccaaaggcauagaaaaggaaguaaaaaagcaaauaaauaaauaaauaacuaaauaaacaguuuuacaugggugaucauacagcuacaacaucagcuuuuccccaguccuuuucuguuacuuuaaguauuuacugcaugaaacccucccagaauuuuuaagcugcaccacugcaggcuaagagcagagccagcacuucuuacauuagcaaacgugugaggcgaagggagguuugauugacaacugacaaacugaugacagaacaaagaaggagccuccacuugggaacacaacgcauuuuuacagccacuuucgccuuggcuuguuuuuauauucuccccaaagaagucccuuugacucucuuauguguuguuuuguguuguuuuucauauagaccauguugucagcuagguccggaagcaacaaugaauauaaaguacugggcaggacaacauuugauaaauguaaacaauaugcauagagaaaaccucucagaugaaaaauccacauacauuuuuagcggccgucagacugaaugcaaauggcuuuggaaaauauaagugguuggcuuuuuaauaucaaagaaaaucacagccuuuucucuaacacugaaaacacugcggcacuaaaaaggaauaacuaacucaauaaaccaggcagcucauuuucagcaugcaaaagucaugguccuugcccuuaccuuagaagcaauguugcacuucuagaaauguuaaauggcggacagguuaagaaaaccaagacugucgcugguuuuuaaggcuuccuccucuuuaaaaaaaaaaaaaacaaguuguauuuuagaggaagaagcagcaauuaaaaaaaauaaaagaguugggguggcccacaaaagaagccacguaaugucaaugcucugaaacugcucagccucaguuguuuuccaagucaacaugcuggcugucuugccugaaagaaaggagucaacagggagaaaauaauagagcauuuccagaauucacccagcagcucggaaaacugucugcuuacuauuacacaguuuuaacaugucauaaucauuuucacaguaaagauacccuuccugcaguuuagaccaagaaugcaugacuaauuuuaaccacuugugcaaaucuccuaauggaaauuucaaacggcuuuuauggauuagaguuucguaaacuguauggagagcugcaacagauacuaagucucguuguugcucaugucagcccgucagugccuaaugaguuacugaagauccgugggcaaucauacacuacuuacagaaacuauaauucuuguuggcacuacauguauugugcauuauauguauaaaagauaaaaccaagcauugugaaaaugcagaugaaugagaagggaagggagguaggucaugugcugacaucuuaaguuucaccagaacguagucaagaugaggaaauuuuggagauacccgcuaugggauccaaguugagaucaucaaaugcuaagguagguugcacuguuuccauuuuauagacagauguugaggcucagagagguuacauaguugccacagggaacacagcugcuggagguuaaaaaaaaaaaaaaucacagccugccccuuuccaccaugacgugcuggguggaacaacaucuagugaauugaaacagauggcugggagauuuaagaaucaaguucacuuggagauggauaggggugaugguugcacaacaggaaugcccuuuuaugccacugaauugugcacugagaaaugguuaaaaugauaaauauuaugguauaaaucuuuuaccaaguuuuuaaaaauaauaaguuccaaaacucuuucccacugagagauugagaagaucagagucauaguucagaaaaauguucugucauacccaguucugugcccacagcaguaccagcaacucagagcauaaaaaucaaaauauucucccugugaagucaaaaucagugagguaguuggaaacacauuuugggauauucuucccaacccaagaaauucaagcauuugaaauuuccgaguuacccaucuuuuuuauggugauucuuucuuuuuccaaaaaaaaccaaacaaacaaacaaaaaaaaacaaaaacaaaacagcaucucacucuguugcccaggaugaaguguaguggugagaccagggcucacuacagccucaaacuccuggacucaagggauccuccugcuucagccucccucugaguagcuggagcuacaggugcaagccaccauccccagcuaauuaaaaaaaaaaauguguagagacagagucucuauguuacccacacuggucuugaacuccugagcucaugcaauccucccaccucagccucccaaaaugcuggaaugacaaguaggagccaccaugcccggccuuaacucccauuuuguuagaaauuuucacaggaaagaugggagagaagcugacuuaugagagaaacaagguagaugggcugccggggugaauguggguaguuaugacacacagagaaaagagacagacucuugucaggaaggagcggagaagagaaggaacaucauaaaaacucacgaccaccccucccucucuuggcucuugauuugccuccugacuaaaagcaaggucccugcagcccucuaccuaacaucccaucaucggaggagccuucucugaucccaacaagcacugcaagauuccauaauuacuuuuuagaucaauuuucuuaggaaagggagcggagaguuauccuaugaugaucuacaagagcaagugugggaguucuggaaaaggaggagagcucccaaggcaucuguuuccagaagcuccuauauaaucccccucuccugcagugagcaaagcaggauuuaacaaugguggaaaaggacaguuguuccaguuauguguuucccucgacccgcagcacacagagcuucuccaaauacacaugcaagaggugugcagacaaaucugcuuccucugcgaucuuuccauucucaauucauguucucuuucuaaccuuuggcuuucucccuaccaguuacaucauuucuuuuuuuuuuuuuguucuuuuuuuugagacagagucuugcucuguugcccaggcugaaguacaguggugcaaucucagcucacuacaaccuccaccucccagauucaagugauucuccugccucagccucccgagcaagcauuugggauuacagacaugagccacugugccuggcuaauuuuuguauuuuuaguagagaugggguuuuaucauguuggccaggcuggucucaaacuccugaccucaugggaucugcccaccucagccucacaaaguacugggaauuacaggcgugagcuaccaugcccagccugguuacaucauuucaccagcuucucugucuacaagaaagcacuacuggcuauuucuuccuuuuuauuuuauuuuauauuuuauuuuugagacaaagucucacucugucacccaggcuggaguauaguggagucaucacugcucacugccgccucgagcucccagucuuaagugacucuccugccucggccuccggaguagcugacacugcaguugcaugccaccaugucuugaaaauaaauaaauauauauauauauauauauauaacuuuauagauauaaauauaaaacuuuauauauauauaaaacuucugcauuauuuuauauauauauauauauauauauauauauauauauauaauuuuauguagcccaggcuagucuccaacuccugggcucaaaugauccucccaucucggccucccaguguucugggauuacagguaugagucacuucaccaggcuuccuuugccuuuuauuacuggggccuuuucccuucucacuccauagacugcuuuacgcugagagcugcgccaucauggagagaaacucaagauguguccccagauggcagcucagcagacugcaucucagagcaagggcccacugcuuaacugggucccaaagaaccccuacugcagcuucccagcuuugagggccugccuggcaccuuugcaugcucccuucgagcucauagacucuugguuuccaagcucucccugcagaggagagggaaagaaggagugugggggaggcagguggguggagggagagggagauauauguugaguauaucggggggaggcugggaaaaagagaaaaguagggagagggaguagagacagguagauagaagagauagagguagagagagguaagggaggaaggccuggguucaaauuccagcacugccaccuauguggccaucggaccuucaaccuccugucagauggagggggugacuucagaagaucaaaaagaagguaaguaggccaggaacagugacucaagccugaaacgccagcacuaugggaggccaaggcaagaggaucacuuaagcuuaggaguuugagaucagcccaggaaacauaacaagacccugucuuaauacagauaucccuaguucuuuacauguacauguaaaguagauaacuaaauaaccacagcaaauacccacugauacucacugcaugccagguccuguuauaagugcuuuauguaucauuauuucauucucacagcuaccuugugagguaacuaucacuagcccaccuuuaaagaggagaagauuaagcacagagagguugaaaaacgugcccaagaucacacaucuacaucuggcagacccuggauucaaaccuaggcagccuagcuccaggacauuguacuuccuucccccuacaacacccacugagagcccucaauaaauaucaauuucuugcccucugccuuuugagaugauuuucaccauagcccuuuggguugguuuucaauaaaccucaauccucuggguguugugcuauucagcuuucuuccauuaguuggaaaucauucaauaaauauucacuaagcacccgcucagugccaagcaccaugcuagcgauggcuguuccuccaaucccugguucuagaggcuguggccaacaagacuaugagguggccacaggcucacugcaggcccaggaaugccacaagacacacgauauggaaguauaauaugauggcacagugaggaaugguccuaugacaggagguaacagcugagugccccuuccuuggaccugguggguuuccugccugugaaggcugcacugacaguaaauuggggcacaccucugugcacgugguugguucaugcuauggacugaauauguuccucucucuuccaaaugcauauguuaaacuagaacacccaauaagaugguguuuggagguagggccucucagaaguaauaaggucacaaagguggaguucucaugaaugaaagacacacaagagagauggucucucucucucucucucucucucucucucucucucucucucucucucugucuacuaagugaggacacagcaagaaggcagcuguccacaaaugcagaaaagagcacucaccagaaaccaaccaugcuggugcccugacaucugacuuccagccuccagaacugggagaaaaaaaaaaaaaucaagccacccagucaacgguauucuguuauagcagccuggacugacuaagacaguccacguaacuaguguggguugaaaaaaaugacccuaggacaguaucucuuacugaggguguagccagcaucaagagccaggacauuucuauguuguaaguauccacccaccgcaggacccucugcguccccagccaccuccccuccccaagaccaagagugccccaguuaccuugugaguacuaaaaaugccauucccaaaugucccccucauagggacgggacaaugccagucuccaugaaaaaccauuaucuuagaagaugcagcuacaaagagaaauacccugauauuacauggauauaaauuaacaagaaugcauaaauuccaugaaguuuaaaggugauuuagaguuggccagaagaucauuagaagagccugaaaaaaggcaaaccucaauuaagugagguaccaucugguagaggcuguagauaucagcgggcagaagagggaauagcugacucuccuuuuuaaaaucacagaagcauugauaaucauugauuaaccaaaaaauaaugcugcuguguuagcauauauucacguaugugguaucucaugaacuuguuuuucuuucguuuuucgguuucuugagacagggucucacucugucacccaugugggaguacaguggcacgaucucagcucacugcaaccucugccuccugggcucaggauaucuucccacuucagccucccaaguagcugggaguacagucacaagcuaccacgccuggcuaauuuuuuuuuuuuuuuguauuuuuuguagaaacacggcuucaccauguugcccagucucaaacuccucagcucaagcgauccacccacauaagccuccaaaagugcuaggaucacaggcgugagccaucacaccgugcugcaugaacuuguaauguuuaacugaguuaggccuuccaaagcagagguugggaaacuauggcugaugggccaaauguggcccgugaccuguuuuuauaaauaaaguuuuacuggaacacagauggugcauugauuuguguauugccuauggcuacuuucauacaaaguuagagcugaacaguuguaacacacaccaucugaacugcaaagcuagaaacacuaucuggcauuuuauuuaaaaaaaagucugucaaguccuauucuagaauaacacauuggccuaacaguuucuauuuuaaauguacaaaugauaaucauuacagaauggugaccauaaguugaaauacuacauuuauaaaagugucagaacauuaagaaaacuuaagguuuguuuguuuuuagagacagggucucaccauguugcccagcuggagugcaguggcuagucacagguauagucauagcucauugcagccuugaucuccaggccucaagcaauccuccugccucagucuccuuaguagaugggacuacaggggaauuccacugcaccuggcuuaagaauacuuaagguuuaucauauggauauaacaaaauuacauucuugggaaguuugucaggaaaaguuccuaaauaagaaagcaagauauuaauauuagaaauguagcauaauauuuuuaaggucuguaccuaaauucaaaaaugagaugaaacauuauucuagaucuccucaaaacgacugcuaaaauuugucagguuuguaaacagaauaauaagaaaugcaaguuggaauuaaaagcuuaaaaaggagcuaggauuuaaaaucuguaaugcgaaugaaaugaauuuuaauuuucaaaauguagcgaaaccucugugcucacaaaggcuggaagauaccccaaaaaucccauuaaccaucuguaucucucaucucccuucgucugcacacugauggggucagugguaaaccuaauugaaaguacucaagaaccucaucugagucuucacugucaccagugcccgaauccaaacuccaucuguguugucugaccuuguucagaaugugucucucuuugacaaaggggaccauccuagggcaaagaauuucauagaagagaaaccucaagaugccaaugagagaguugaaaauauauacaugaugacaacaauaauaccacuuuacaucauuuuaaguagcauuuauaauuuauaagcccuuugaaacacauaguauaucuugaccuacuaaaacaguauagcaacucaguuguuaacaggaguuuugaaacaagaaaaaccuggagugauucuugcuuacagguagcauggccucaagcacauuacuaaaccucuuaguuuucucaacccuaagccagggguaauugcaccuccuucaugggguauugucaggaccaaaacagauacagaugcuccucaacuuaggaugggauuaaacccuauaccgaguugaaaauaccauaagaugaaaaugcauuuaacacaccuaaccuacucaacaugauagcuuagccgagccuaccuuaaauguguucagaacacuuaaauuagccuuucccugaucauuagugauguugagcauuuuuucacguaugguggucauuuguguaucuucuuuugagaacugucuauucauguccuuagcccacuuuuugaugggauuguuagcuuuuuucuugcuaauuugaguuccauguagauccuggauauuaguccuuguauagacguauagauuuguauagauuuucucccacucugcggguugucuguuuacucugcugacuguuccuuuugcugggcaaaagcugauuaguuuaauuaagucccaccuauuuguuuuuguugcauuugcgauaccaucuuacuccugcaagaauggccauuaccaaaaaugcaaaaaauaauagauauuggcgugaaugcggugagcagggaacacuucuacacugcuggugggaauguaaacuaguacaaccacuauggaaaacaguguggagaguucuugaagaacuaaaaguagaacuaccauuugauccagcaaucccacuaauggguaucuucccagaggaaaagaaguccuuauaugaaagacauacuugcacacgcauguuuacagcacaacaauucacaauugcaaaaaugugaaauuagcccaaauggccaucuaccaacaaguggauaaagaaacuacgguauaaauauacaauggaauacuacucagccaugaaaaggaaugaacugauggcauuuucagcaaccuggaugggacuggagaccauuauucuaagugaaguaacucaggaauggaaaaccaagcacuguguguuuucacuuauaagugggagcuaagcuaugaggauguaaaggcauaagaaugauacaauggacuuuggggacugagagggaaagagugguaaaagggugaggcauaaaggaguacaaacuggaugcaguguauacugcucgagugaugggugcaccaaagucucgccaaucaccaguaaagaacuuacucauguaaccaaauaccaccuguaccccccccaaaacagguggaaauuuaaaaaaauuaaagaaaauauaaaaaagaacacuuacauuagccuacagcugggcaagguuaucaggcaacaccgugccugguagaauaucgauucuuugcccuugugaucacugggagcugcagcucgcugcuguggccuagcauugugagagaguauccuaccacguauuacuagcccaggugaaaaaaaaaaaucgaaacucaaaauguaaaguucgguuucuacuggauguguaugguuuucucagcaucccaaaggugaaaaaaucuaagucaaaccauuauaagucagggacugucuauagagucugaagucacuuaggacccugccugguacucaggugcagccuaaaucucagcugcuaucacuguaaccaauaugagcuguagaaaaucccgugauguggcaaagacaggaaggcagguauuaguaucacucuuuguuaaggaaguugccaggcagagagaguuaaaaagacuugcccggaggaauguagccccuagguaggcagggacaccguauuucugauucccaccccuaguggcuucucuccuauguuuccugcuucuccugcuacaucucaaacuugaccguguaucagaaucacccagaaagcuuaacacagacugcagccuacaggcucccacuucgucucccuccccaccagagauucacauucaggaggucuggggcggggcccaagaucugcaucucuaacaaguuuccaggugauggugaugcugccgguccagggaccccacuuugagaaccccuggucuaauucagugcagccccuuuaaggaaugacaucuguccuuccacagcguaccugaugcacacccaugggacauuaaaauauugggcaccuggucaaugcucaauauauguuuuuauugguuuucguuuuugucacagguucccugugucuggcucuugguucucuuggcugacaacuugauccuucauuccuuugauccauuccugcauugccccucugauuuggaauacacaguuuuauuuccagcugugaccuuggcugcuuuccacaaagacuccgacuugccagcauggcucugcucucucugauccagcccgcugaacucuccuuggcagaccauagccucacaggugggaucugcaugcuacucucugaugaagucagcuaaccgcccccaugaccuacuucuaucaugaaagacaagcuucucugcuccaaaagaaggguaucaaugugcucccgaaucacagaaaagagacacggcaaauagggcaagaggagcaaaaacucauucauuguuuccugcuuaaaaaaugagggagggacauaugggaggauucaaauuggagugagagaaaaaguggggggaagcugcuuugcuccccacaaccuaaaauaugugauugccuguggauguaaacacaauaauaauaauaauaauagaauaauaacaaaagggaacuaauacuagcaggguuuucauaccuuaacaguacuuugacaacaaauguucauauuucauuugaaauuuaugaaaccuuugugccuguaaucccacgaguaguaacaugguaaaugaaaguagcaggcagucuagaucaauaauauuuugcuucauauuggaagagcauuugaaagaagcagcuugcuucaucuauucccuguguuuacaauccugguauuggaauagacuggggcuucuaagacuggcugggaaauauucauagauguguuauuaauuuaugggaaacugaaggaccuaccucaagguuuaaguaggccauuuagaaagugcaggaagcagauguaaagauacauagcagaaugcagcggaaaaaaaaaaagaguaguggggugauucaggacuuaaaucaagagcaggaagaguaacuucaaaaagcuguaauaguugauauuccaauaaagcguucuuaugagaaaaagcaaucuguucacauaugaauucugccauaugcuucugucuuuucauggucuagaaggccaugucaguaauuuccaguauuuacaugggcaugcagaaugccuuugcugguuaaugugaauaaaugggcuggauuuacuguguuucuaguguucaauauacacaccaugcaggcugcuaccagaggcaaaguggaauuuauggguuugcacugaauuucaaauggauacuggagcaaagcaauggaaagcaagacugacguggugucugacgcuucucaguggaggcugcuucugccuugacaaugggaagggcauuguuucaggaaagggaggaaaaguccagcuaagaguguggcccuuuuugucaaguauuugcagaagcaguaaagaccauggucgcagcuuguagacagaaccacacuuuccacaggucucuggggggaucgcuuugacccgaccccuaaccucugacuguaccauuucuaaauccauuuuauuuuauuuuauuuuuugagacacaguuucucucuguugcccaggcuggaaugaaguagugcgaucucagcucaccgcaaccucugccuccugccucagccuacagaguagcugggauuauaugcacacacuaccacgccuagguaauuuuuauauuuuuaguagaaacaggguuucaccauguuggccaggcuggucuugaacucugaccucaaccgauccaccugccucggccuccuaaagugcugggauuacagguaugagccaccacguccagacgucuaaauccuuuuuacaucuugauuuuuuuucuguaauguugccgagucugcuuaacucugagaaucuuacaaccacaacuucagugggaaaagagaggguauucacagcuuaaauaauaauuuacaagcaugaagaaugaaaucacaucuuccccuagaucaacaauucucagccuuggggcugcgcauguuuagagcugcauaguucucugugguaagggccacccugugcaauagagggcgauuaguagcacaccugcccuccauccacucgaugccaauaguuaugucaccgcaccacaaccaacaaugucuccagacauugccaaauguucccgacaggugacauugucuccacugcccuagaggagggccccccaccugaaauacuacucuaugacuauuugguucuguguauauuuuaaacaaacauaauuauuucuauuauauuuguauuaucaugguuagggauuauguggaaaaaaauagaagcuggaaaacugggacuaaauaggcauauaggguggcugacagagcaggcagcauauuuuugcaauggaacuuagaaguaauaaaggaaacagagagaaaauuaacuggaacacugagaaauuccucugagauaugcagaggguccuguggguagugguggggacgggaagcauucucuuuguaggcuagaccucuagaaccauaguaaaaaccaugagguggagauaaacaaugcccagccagaaauacagaaaggcagucaauaucugaguugaacaagagaugggcaaauaauugcuuuuuaaauauacauugucugcaacaaagcaacauacauuuacaagcaucuugcugaaccuuccaaggaaagagaucuaaaagguugcuggcaagcucuggauggcaaauaaaaaugaauaauaugauguccauaugguugggcuuucaaacucuuccguggaugcaaccccauagcaaaaggcauccccagggagagaaggguguuuaauaacucaaguuuuagcuuuaaaacaccaugcaaacgauaucuucuauuacagaauauucauguuuguuuuuacuauaaacaacauggccuauucaccaaaaacaguugucucuuuaagaaaauaugccuugguuuccaaugacuucaaaugaacucugguaucaguacccccaacagggaaaccuggggccacucauaccccaguuuaagaagcaugaaauuaagagggucuucuuguuucacagggaucauaaacaaccuauuuaugggacuccacuggugacccuaguccuucaauucauugcuuccacaauuguuaaguuuuauaaacaugggggugagagauucaggcauauggcccuuacagucagagaggaacgucuauaaaucuacagguguuacccauaagagcuccuuggacgucuuagaacccaaaggcaggcauucuuaaugaacagaugucagccaggugugagccacuuugaagggggcaucacucuucuguaauuccuuguaaaugggagggauugauggaaacaaaucuccuuaaaggcaauguacacuuugguaaggacugaagcuuugggaacugguaaggaagcuaugguuucuuuaaguccuuucagaaaaccuuucaaauguucaaaaggaauuggaaaacaaaaguuguugcuucucuuccauuuacuauuagauugagagaaauggacuagauauuaauaaaaccuuaggaguuagacaguuccagguugaaguacaaccacacucccuuccuaacacauggauuuccucacuguauuaguccguuuucacgcugcugauaaagacauaccugagacugggaagaaaaagagguuuaacuggacuuacaguuccacauggcuggggaggccucagaaacauggugguaggcaaaaggcacuucuuacauggcaguggcaagagaaaaugaggaagaagcaaaagcggaaacuccugauacacccaucagaucucaugagacuuauucacuauuaugagaauagcaugggaaaggcugggccccaugauucaauuaccucccccugggucccucccacaacaugugggaauucuggcagauacaauucaaguugagauuuggguggggacacauccaaaccauaucacucaccuauaaacugggagcuaauaguaacucucuccuacagggauacugcaaggguagagagagacagugcuuuauuauuuuuuuccuuuuggagacacggucuuguccuguugcccaggcuggaguacaguggcagcaacacggcucacugcacucucaaccuccuaggcucaaacaauuuccuugccucagacucccaguuagcugggacuucaggugcacaccacuauacccagauaauuuuuuuuauuuuuuguagagacaggaucucacguuguugcccagacuggucucgaacuccuaggcucuaaccauccucccacuucagccuacuucagccucccaaaguguggagauuacaggugugaaccaccaugcccagccagauguuuucuaaagcacccuguaggccaacuuaggagauuuccuuucugucaccuuugucauaagauaaagcuauguugaaaaugaaauaauuguaaaucuuuuacaagguaagaacucaccaaagucacugacaaucagaagugaccuccuucuaccaggcagucugaaaccuggaaucacaaacaagagaagcauagcuaaaauucuaggcgcuggaccuacaucuauucucuuaucgcacaaacacugggggaaauacugugcuuuugcuuuuaugaacuucuaaagcaauaacgacugguauucaaagcacucuuacuuucaaaaagaagucauuaauacauuuuaugaagucagaacucauuagugaagauguaucgaguaugucugcuuaguggagauuaucaaagggggucuacgaauggcguuggacauauagauugaggccugguuucacaaauggauaaacacuacagaaaccucaacacaaaggcuucggccaccugcaauauuugaaaacccccagguauugauacggugcuaagagacaacaucaagccauccuggguaggcugcuggagcucuugaaacauacgcauaugccauucauuuuacugaacgguuuauauagaaucacuggcagugcuuaaauaauucagggacuuaaugguagaaguuuauucauacaugcauccaggcugugacuggaaagcacccagauggagggacaagacaaagaaccagguugggaguauccuucugaguuugcaacugugaauauauucaugugugugcccuauuuccaccaaaugcuuucaugucuucauucaauaaacauuucuucuucuuuuuuuaauuuucagacagggucucauucugucgcccaggcugcaguacagugucacgaucauggcccacugcagccuugacguccagggcccaagcaauccucccaucucagcuuccugaguagcuaggaauacaggugaaugccuccgcaccuggcuaaguuuguuuauuuuuuguagauacggggucucacugugcugcccagggcagucuugaacaauucagcucaagcaaucguucugacucagccuuccagagugcugggguuacaggcaugagccaccacgccuggccaacaaacauuauuuauguguucaccaugugcacuauauccggcccuacacaacacaugguccucaaaaaguuggcaguguggaggggggguuguuaaaaaguuauccuggccgggcucgguggcucacaccuguaaucccagcacuuugggagcccaaaauggauggaucaccugaggucaggagaucgagaccagccuggucaacauggugaaaccgcaucucuacuaaaaauacaaaaauuggcugggcaugggggcgggcaccuguaaucccagcuacucaggaggcugagguaggagaaucauuugagccugcgaggcagagguugcagugagccaagauugcaucacugcacugcagccugggcaacagagugagacccugucuccaaaaaaacacacaaaaaaaacaaaaaacaaaguuaccuugacauuuguuaaaaugguaaggaagacuuuaugcaggauuauuucaacaggggucaaggcuguugcaauaggggagagagauagggcucaacuccaaauauaauaaagacagcuggagauuuauagucaaggaacagaguagcaggggagugggagggucaguggaugcaaauuacuacaaggaaccacaaggguaggaguauuccaacuuaaccaaguuagcaggauuuuugcugaaggcaggcaagggugaucagacaugaagggugaagggauucucucuagacugacuuagaaugacucuuacaaagacuggacuaugaagauccagcaaggagagaggagcaaggucaaggucuaguugagaagugggcucugaggagcugagcuaaaguuuggucaaggauucuuugccagagggaaaagggaagacagaaguugccccagaacauuaugggacucagccagaguuucuuaaagagauaugaugucugggguguuuagagagcaugagcaggacuaagcaaagagaaaaauacaaggcgugcagacagcaugugugugcaaagcacaguuuggcaaccuuccaauggugacguauggcuugaacagcauuucucaacaaggucacuacugccauuuugggcugaaucauucuuuguuggugggguggaaguagagggugggaguccuguguguuuggagauguucugcagcaucccugacuguauuagucuguucucaugccacuaauaaagacauaugcaagccuggguaauuuauacagcaaagagauuuaacugacucacaauuuggcauggcuguggaggucucaggaaacuuacaaucaugguggaagggaaagcaaacaugucuuucuucaaacggcagcaggaaggagaggugccaagcaaaggaggaaaagcaucguauaaaaccaucaaaucuugugagaacucacucccuaccaugaaaacaucauggggguaacugcacacaugauucaaucaccucccacugggucccucccaugacacguggggauuaugagaacuacaacucaagaugagauuuggguggggacacagccgaacccuaucacuaaccccuacccaccagaugccaggagcacucucccucaaucccuugccccuuccccaaguugugacaauuaaaaaugccucagacauuaucaauuaucccuugggggaaaauuugccccgguagagaagcaguggcuggaaggauggcugcaaaacuccugcaggauggagggggacaguugucuccgcugaggagggcaccuguccugggguguaaaggugauauaaugaaggcaaaaguuucuauucucucaauaugguggguuaauaugcaauagagagaggaaaaauagaaagaagugaaugagacuuagugcaucaggaccugaaaaaguaggauuugucaggaucuuuuuuuuuuuuuuuaaaguaacugauauagugacucaucaugaaugaucucgugaauuuucucucagaaaauuuuccuauuucugauuaagaucuaaggauaaagacgaugcaacaagaaauaaaaccaagcuuucuacaacuuaaauaaaucacugcguuucaaaacauuuggacaucuugucacuuuuaucuacacaauaaggccucacauuuuuuuuuucuagcuuauauuugaaaugcauuucuauugcagaaaacuuuaagauauauagaaauaauaaccauuccuggucugugaauuugaauuguggccugugacauucuaagaagauuucaaaaauuauuuacuaauuuaaauaacuccuguuucggcagcaauuggcagcaaaccaaguagcaaguucauuuguaccacacuagaucugaccucacuugcauuuucuuuuucauuucuagcacaauuagcaaaagaaagggagugggccauuuaacaugcguuucuagcuaauuuuuaaucuguucuaaugcaugaauuuaaaaacgccuacuugagagcuucagggauuacuaaauaauaagcccuaaagguuccaaaaucugguuaauagucagaccuggagaauaugaaauacaguguuaauuuagaauaacauaaugccuaaaaaugaagcaaguuagaucuaauugagcuaugaacugcuugccuaguacuguguaauagaggcugugcuaaccaaggguuccugagcuauagauaaccauuacucuuagaaaauauguuuauuggggucucucucucuucauuacccaaccucauaaaguauaugucugcguauuccgauaaaacauagaauggcaaggcagagucacaauuaggacgcccugagaagcugcaucauaaaauggugucugucuccaaaugauuguucacuuaaccgugauaaauauuuaucagcaugcaauagaacaaauccuucaacaaucucaggccacacugaaaaugaaggacuuucgcauuuucgauucucuucuuucgauagguacaaugcuuuaaucuaaaauguaauuugaugagauuuugauuuuaaauuagaauuacgacauggagauguuaagaacauauuggguucauauuuccaauaucuacuuaaagcaacuuggauuuacuguuauaucaugaacagagacaagagaacuguguugaacaguguaaauaugaaacacugcuaauuugggugguuauucaauguauaaccuuuuaugucaucaguacucucauuggaaaaaaaaauguguuuuaaaugauaaaauaaagaugaaaauaaacuccuuaaugaucccuacucucuuguuggccaugaugugccaacuggggaaacauaaggaaaacugagauauagaucgugauguuccacuuaacuugcaaggcacaagccuuagcugcuuggauauggaaacuguuuauuacuauguggcuucaugcacagucaacagaaaaaugccuuuugaaaagaagaacacugccuuccugggugaguuucgaaaacgaagccugucuccuggccagagaaaacaguuucugcaagucaacucugucucuguuagauagcuacagaaggcauauggagugcaggguggaguugcuuauaaacauaaaugccuacugggccuuuccuaaaacaacuggauucccggaaaaauguccuuaucauugguucucaaacuggaggacuuccgaaaaaacaaauuaaaacaggaguuccuccaaaaacacaaauagcugggcccacuccccuuuaguguuucuuauucaggauuucuggggugaaaacagaaaauaugcauuucuaacagauuucuuuuuuuuuuuugacagggagucucgcucugucccccaggcuggaguacaguggcaccaucucugcuaacugcaaacuccaccucccggguugacaccauucuccugccucggccucccgacuagcugggacuacaggcgcccgccaccacgccuggcuaauuuuuuguauuuuuaguagaggcgggguuucaccgacuuagccaggauggucuggaucuccugaccucgugauccgcccgccucggccucccaaaguccugggauuacaggccugagccaccgcgccuggccuucuaacagauuucugagugaugcugguguugcuggccugggagccacacuuugagaaccagauuccuauagccaaagaaggauccagaaggaaaaaacuuccagugaacaucugguccugacuguaugaaugucuuuccccaaucuauagaucccaaaucuacuugcacuuucuuuuccuuuuaucucauucucuuuauuucuuccuuuccugcccuuuuguuuuauuuccauuucaaauucccuauuucuauuucucuucccauuccccguggguccaugucucuccucccucccuacccaccucucuuuuuucuuuuucuuuuuuguuuuuuuuccucucucucucuuucccuuucuuggcccugcucucagaucuuucccucaacaauaaucagccucccaccaggcucucaacagugaccgagauuacagauacaccacacaugggagaaacacacaagccaagaucuuacuccuuggcaagccaaaugaggggcaacugucggaauaauuucaaagagggaggacaggaguucugugcuaagcauucaauagcagaagcuucucugccuuugcauuuagcaccacacaagcaaaacauauauggccaugugaaauauacacagaacaguuauguacguacugcuggcagauugacuagauucucaacauuaauuuucauuuugggggcuauuuuugcauuuuaggauacauaguccccaggucuaguuuuaaaaugcacuuaacucccaugcuaggugaagauuuauaacaaaagugacuauuaggagaacauucccaggugaagaucuaccauagacagacuuagcucuuuauggccuuauugugucagacucugaauauuagacacauacaaaaaaaaaucacagaaugaaaguuauuaggcugcagaauagcuucccaagggacguccccaggccucaucacuugagucauuagaaacaagaccaaaccaaacacuugacucuaccauuagggaauacuccugcccuggcugaggguggacaagaugaccucacagaucucucccaguccucccagggucauaaaaacagaauggaaacucugacuagacaucacgcugcagagagaaguggagauaccaguagacugaaaagcaagaucucagaggguggacgauguuacagugaacagcacagagaaaaaauaauccugaggauuguggccaaaggacaccccagaauaaaaaucacauugagaacacuccccaaagaggcccacgaugcaauuuugcagacagagcuguaaaacaacauguguucacuaguuucugauacauacuaugaguguuccuaugcucugacuauaaaaggagugaugaauuacaaguguauuuccuggcucccucuuuucugaagcuauaacugcuucacugaaacauaugggaacaaagagaagcucaacuaggugacaacuauggugcuuccauaguucaguaugaugcgucccacuaaaaaguagaguuuaaagcagcugaaaccaagauuaaccuggaagaagauaacaggucccccaaccccauccaugagggcagaguccuuucucagccauuagcagggacgguggaguguucugugaggucccacauggcuucuccaccccagggauguugcagcugugaggcacagccugagccagcgggcaugcuugcaucacauccaggucccguaauaaaucugagggaacugcaaaugggugggguggagaggaauucuggacuugaucugacucaacacgccacagcugucauuccaacucacuuggcccuaaacugcaaaaccagucaucccuacccacuggcacucccugcuaaggaaaacccucaugguucauagguccuucuacuuagguggguuuuguauuaccugccaccgcuccccuuccccacucugaguacaccuggacagaccgcagguccaaucauacaugagccaagggcaaaucuguccagaaguuugcucugcaaucuaccaaugggaaagaugacucaugccaguggauuucugcgcuagggaauugggaaaccaacucuaagccuguugcagcagggacagcugauaaaaagaugccaugagguugaguugaacugcacggccaugagcuaaaaaggaagcaugugcgagccaaaacugugagggagaagaaugaauaaauccagcagcagcagaaucagcuagucagaaaaagagaacgccacaguugugcaggaggggaucgcaagagacaguuacccaaaacugccuccuuuccucagcuugccaacauuaucucuuacaguaaaccuuuuucuuagaagagguggcacaaguaaaacucuguuccuugugaccaaagacgccgaauuaaacacucagaaaaucugaauuacauacaucuugaugagugagcucuucaugcccuaaaucacgacuguuggauauuuaacuugaaaaugcccacaagucccugaagaccacaacuuaucaaugguauugaaaacaagaggugaggcguggcagcucgugccuguaaucccagcacuuugggaagccgaggcaggaggaucacgugaacccaggaguucaagaccagccuaggcaacaaagcgagacuuugucucuauuuuucauguaauuuuuuuuuuauuauuuuuauuauuuuuuuuugagauagagucucccucugucagccaggcuggagugcaguggcacaaccucggcucacugcaaccuccaccuccccgguucaagugauacuagugccucagccuccagaguagcugggauuacaggcacacaccaccacgccuaaauuuuuuuuuaauguuuuuaguagagaugggguuucgccuuguugcccaggcuggucuccaacuccugagcucaggcaauccacccgcccuccugagcucaggcaauccacccaccucagccucccaaagugcuaagauuacaagugugagccaccgcgcccaccuccuugucucuauuuuuuaaaaauaaaaaugaauuuaaaaaaaauuuuaaagaccaaguaacacucaguguuuuccuuaccugcucuuuuggaaacuggaaaucgauuuuaggaauauuucugggauagaacaaaacaagucaucuggagucagaacccagguucuaaaugacgauccuuccuaccccaccaaagguauccaucacagcagccuacagauucauuuauugaaaucucacaucuuagaaguguuauccucacagaaucauucauuuacgcggggaaaucacucacuuggagcuuaugauguuuagucacgaaaguauguuuuugcaaaacaccuacaaugcauuaucuaaagcugcuaagcaccacuguucuauuugcagcaggcauuaaggcauuauccuuugucccaugcuguggacaaaugaauggugcaagaaguacuggcuccaaauuaccgugaaggggagaaauaccuuucuuuaaaauuuuauuuucauuuuuaauuuuuuaauaggguugggaucuugcuauauuucccaggccaaucucaaacuucucaagcaauccuucugccucagucucacagacugcugggauuacaggggugaaccaccacauguggccuucuuguaucuucagagacagggucucgcucuaucacccaggcuggagugccauggcaugaucguaagucguugcagccuccaacuccugggcucgugguauccuccugccucagccuucuguguagcugggauuacagguacacgccaccaccagacccggcuaaaggaaaaauaauucauugaagacuggugccaacuacccacaugcagaaacauucauccucacugguacaaaaaaacugagcugaaaggugugagccaucuuucaguggcucuacuuaaacuauuaaacuaccaaguauuuuaaacuauuaaguuuacuaguuuaaauagaagauuguuauuucaugacagaagaguggcauaguggguuaggcccaauuuucaaauaucaagcgauuguagcagauccugauuuguagguguaaaaaauaauuaguaaaaauaaaauaacaguaacaccaaaggccauuugcugagugucuacaaugucaccagcugcagacuuuacauacaugcauuuucucagucgucacagucauuuggagcauggagaacaacucuuuacaaaugaaaagacuuuuaaaaaucacugcuccaacuguggucugagagcuguaagcaucagugacaucugggcgcuugcuagaaaagcagacuccugggccccaacccagaacuagagaaugaggggcucugcgggguggggcccgagacuuguguuuuucuaaccagcucuccagcggagucucacaccaaaguugaagaaaagaagcccugacuuagagaguaacuuuccaaggccaaauagauaguacgccacagagucacugcgcacgccuuugugcugaguauuggaaacugucccauucacuucagguaauuaacgaagagcugggcuggggauaaucagguuaacaccuguaauucaggauuccccugagaucaggagcaggaacucucaaaccucggucugucccuagagauucuaaugggcagagcccuguauugccccuuugcuucuucccuuuuuccuuuuuuuuuuuuuguauauggaggaaaucuuggguggcacgagcccuguuuuuugaagucauaauuaaaagggcucugauucaagugucuaggauguuuccuuuauuguuuuauagaugaauguggaaaaaaaauugaccuuuguuuugguuuuuugagacagagucucgcucugucacccagacugauguauaguggcaagaucauagcucacugcagccucuaccucugggcucaagccauccucccaccucagccucccaaguagcugggaccauaggcacaugccaccacguccagcuuauuuauuuauuuauuuaugagacagucuugcucuguugcccaggcuguggcaugaucucggcucaaugcaaucuccgccucucggguucaagugauucuccugccucagccuccaaaguagcugggacuacaggcaugcgccaccacgcucaacuaucuuuugcauuuuuauuacagaugggguuucaccauguuagccaggguggucucgaacucucgaccucaggcaaugcgcccaccucggccucccaaagugcugggauuacaggcgugagccacuaaguauggccuaaauuuuuuuaguuuuuuguagacagagggucucacuauguuacccaggcuggucucaaacuccuaggcucaaacuuuccucccacuucauccucccaaagugcuaggauuacaggcaugagccaccaugccuggccaauaaaacuaagcuuuaaccaucacagcagguacugugcccaacacugggcuaagugcuccauacccaaacugugcaaugggacacucuacugucacggaaacguucuuucuguaugugcuacccacagugggagccacuagauguguccggauguuuagcacuuguaaugugugagugagagauugaaucuuuaauuuuauuuaaaauuuaauuuagcuugaaauggccccacguguccacuggcuaccuucaaguauuggauagcccagcucuacauggcuuuuuguuuguuuguuuucuuuccuuugagacagagucccuguagcucaggccgcagugaaguggcaugaucaugccucuaccucccggggcucaagcgauccucccaccucagccucccgaguagcuaggacuacaggcacgugacaccaugcccagcuaauuuuuguagagauaggucuuuuuacgucguucaggcuggucuugaacuccugggcucacgcaauccucccaccucagccuucugaguagccaggacugcagaugcaugccaccacaccuggcuaauuuuuguauuuucugcagagacgggucucguuaugcugcucaggcuggucucgaacuccugggcucaagcuauccaccagccucagccucccucagugcugggauuacaggcgugagccgccacgcccagccuagauaccuuuucuuauuuaaacuucacucuaagccugugagggcugaagcuaauguuaucccuacuuuacagaugagaaaacugaggcuugcagagguaaaauaaagaaccgauaggagcgcauggagucaguuagugguagggcugggguccuaagccaggucugcucugacuagaggauuugcaaggcacaaaagcacucagcugccauugguuacggagugucugggaagcugcugcucagagcccaccuaagcaaaugcggcagcaaugacagcauggccccuaaaacaguugacucugagugucucuuucugcaggcagcaagagugcugcuguucucuuggcagccaucaaugagaagauguuuggacauuauucucauguuauuaaaugugcauuuuccacuuaaaaauaaggagcuucugucacaaaugauuuauaugaaaacaauacuucuccuggcaaggaaacaggaauaggagcuuguuacuguuccuuucaagaauuaaaagagguggggagaaaagccugugucuguauuauauuuauuuuuuauuuauuuacuuauguuuugagauggagucucacucugucacccaggcuggagugcaguggugcaauuuuggcucacugcaaccucugccccccgggaucaagugacucuccugccucagccucacaaguagcugggauuacaggcccacaccaccaugccuggcuaauuuuuguauuuuuagcagagacaggguuuuacugugauggccaagcuggucucgaacuccugaccucaggugauccacccgccuuggccucccaaagugcugggauuacaggcgcaacccacugcacccagccaccucacccaucuuucuaccucuaccucaacgccaucaugguaagaaacggguucuaggaucucgggcaccuguaaucuauucucuaccuuucacaaagcaggucacugggggacacaauccucccugaauccaucccuagguccaagacgcuggugucuccacagaguaacugcaccagccucagcuucaccaaauggcauccuugagauucuagaaacaggcuuggcaauugcccccuucccugcuuuccugucucuccacugggggcaauaugguugugggaggaaaagggucuagggccaggcugaacugaugccguaugccaggcccacucugaacaaagugugcggugccagccuggguagguggcuuaaccucugugagccucagucgucuccagaguaaacugggaagcacagggacucuuuauggagcugcucugagaagucaaugaggggaugcauguaaagcacuuaaccccaggccacgcacaagaagagaucugaaaaaaggucaguuuccuaucguuccucccuuccagcccuccgucaaaaucuugacccucuuuuagguuuaucucagacccaaucuuacucaucaagacuucccuacccuccaagacuccauguguuuuccuguuuucauauuuuacagaucuguaccuaugccuauuguaguucuuuauacaauuaucacaucuuggcauggacucagcuuccugagcacuggaucuccgccuugcccagcuuuuccuuccagguugcaaccagcacguggcccugaacaaacaggugcucaaauguuuguugaauugaguuucuauaaagauugaggccaaacuaaaauaauccauucauucauuuauucacucaauauagauaaauauuuuuagacagaaggucucgcucuguugcccaggcugaagugcaguggcccgcucauacccuacugcagccuugaccuccugggcucaagcgauccuccugucucagccuccugaguagccaggauuacaggugugacccaccacacccagcccauucacucacuuuucauuaagcauguaaucuaccaaaugccacguaaggccacugguacucaggacccaggagagaccaaggcagacaaaaccuuaagccuucauucacucuccaguggggagggggagggcagugagacaauuagcaaguagacagauuaaacagagaaaugaugucugcuaaggagaaaaauaaagcaggguagagauucagggacggcagaguuuggaaagaaauuugcuauuuuaaacaguggcuaaggaugucaucccugaaaaggacauauuugggcaaagauuuguaggaguggaacgggcuacuuuuuagaaauaacauuaauuuggaggcaggaaauuguacgccuaagaaauguuugguucuguacucagaaggacaccauaaaggaaauacaaugugaugucacugaccacccucaguucccauguuuccucuguuuuaauaccagcuaguguuuucuggacauauccuaugugccaggcagugcccaaaugcuuuauagaccugaguucaucacaagagauaagauagagaccagagauggaaaaagucaccacaugcaugccccaggcagguaucauaaaaggugaaagucaggugucccacacuguaaacaacauggaguuuuggggguugcaugucugaaaggacccauaacuauuccuccuagagcagaggcugcuaaugaguaacugaccacagaacaggcucaggauguuugaccuguguuuuugaaagaagcuggaaauccgaauuuuuuuugugaaacuucucaacuugaaaacguuggcaagccauugcaaguuuucaaaaacaggaugcaggccaaaauuuuauuuaaacaguguuuucaggauguauguaaucucaacauugaguuuucaaccucuggcagaguguacguaaugaguagacagagaaaccaaaaacauuugcaagaauccugucaaacagcugccugaccccuauacccugaggccggguauaauucagguuugagaagagccugauugccugggacccccucaugcaccugcccaggggacagcaagcuuuggggucuguaaacacuguguccuuauguguagaugcaauauaaugccuacgagaauuugaaugcaaaaacagcucaugguucauuaaaaaaaaaaaguacgcuagguauucauaaaaacugcuuuuguugcuuuuuuaaauuugcuuacguucuaccaauaaaaaugcauuuggcaaaauaguccagaggaaacaccguuuuuauucaaaacuguuuuucuuccccuuucacuugauacuucuaaauuaacuuaucaauaauguauuaaaguaauacucaaaaauggaacaauacugcaccuuuaagaaaauauuauuuuuccugagguccuaucaagguaaaguucaucaguauucaaagaaugagcaaagcacuucaacaauuuauuucaauaaaagaagacuuagcugaaacgaguauaaaugaugagaacuugcuuuaaacugauuuauucccugcagcaauaaaagcaauguuucuucacucagcuguuuaauaugcaaauaugcagaacauccagccccugacagcacaucauuaauaaaaccuugcacugagcagagugcccgauauuucauccugaugaaaauacaugaugaugauuuuagacuguagacuuugaguuggaacaaugugcuuuccuggugaugaaacccaccagucaccaaagguggggguggggagcuuuuuagguaagugauccaauuucugcaacaggaacucccagaguuaaaaaaaaaaaaaaaaauaguaaauauggagggcuguuaauagcucaugcuaccaaggccuaagugacaagaucugaauggagggcaaugcaggaacaaaaggggacaaagucugagacccucgcuucuuuagaggaugguagcagguuaauuuucuguguuuuguuucggacucuguagagagcaucccgcuucuucugcuugaugguagcuuuauauccaaauagaacaagacagcaagcuauagagaagacacggcgcucaggaauuugaacccuugggggcucucagucugguugucugguugucugauuacugucccagauuugcuuauggaguaguaacgucuggauuacucugagauucuuaaacaagcagcggagaagaagcuaaaaaaaauucuuuguacuagaucauaugcuuucccuuuccacuaaaaucuuggauugauuuaaaugguuuguggugggacagagaaggauuuaaauuuuuucccacuucuuuaugacuucuuacauuuuccaaauuuucuauaaugaguaugccacagguaugaucagaaaagucaugauuuaaaaaaauauauauauuuucuuuuaauaauuuuuuaguacagacaaggucucgcuauguugcccaggcuggucucaaacuccuggccucaagcaauccuucugucuugcccucucuaagugcaggguuauaggcaugagccacugcgccuggccagaaagucauguuuuuaaaaauuuaauuuauuuuuuuuaaagacauacagaugggcuagugcccagggacaucugagguugcgagcaguagggcgggagucuuuucacugcucuguggagccaucacauaaacccccgugcuugcucucaaaauaaauauuugugaaaugguuaaaugagucacuaguuguaagugcuuacaaccgugccuggaacauggcaaggcccauaaaaguauuuguuaaauaaauaaccaauaaauuagauuaaauauuuaaaguacuuuagucugcagagaugaguuucuguaaauauuauuuauuuauguagaugaacgauaugaacaguuuuuuaaaucuuuacauuaaucuuacuacaguguacgguucuugucucaauuacagcuguagcuuaaagaacuucugaauuaaaaccccagcuucucugcuugauuccacgugaucuugagugagucacucaccuccagaaaccccauuuuccuuaccuguuaaauauacauaaaaauaauccuacccauuuugaugaacguuuugaggauccaauaugaggauccgaucaucuauguaaacauucagcacagcgccuugccuagagcaaagacucacauguaccauuuacuuagcacuuaccauguaauguacauauauaauauuaacacaaauauuuaagauaacucuucaagguaagcaugguuaaucauguuucacugaggggauaauaaggguagacaacuugaacaaacccaugcauacaccuuggucuugaacuugggucugucaccaaagaccacauuguauacugacuuuauccagaucugcucuuucuuccagaaaaaaaaaaaaugaaaaaugaaaaaucagauacaguaauuguuuaaaaauauaugggaagaguacauguccuuccauuacuccucuuuucaguugcagucauagugaaagauucuccauuuguucuuguuuauuuuucuuuguuuaauaaguauuuuaaaacagguuagguuauggggcaggagauaaaggcagguggccagaaguguggaaccuagugguuaggagaaaauaauaagaguaaacuaugaaguucuggcugggugcuguggcucaagccuguaaucucagcacuuugggaggcugaggaggguggaucaccugacgucaggaguuugagaccagccuggcuaacauggugaaaccccaucucuacuaaaaauacaaaaauuagcugggcaugguggcggacgccuguaguuccagcuacucaggaggcugaggcaggacaauugcuugaacuuggaagggagagguugcagugagccaagaucgcaccacugcacuccagccuggggaaaagagcaaaacucuuucucgaaaaaagaaaaaaaaaaaaaaaagaugaacugguuggaacgaguuggauggggagugcuuccccacaucucucuuaugcacccuauguuccucccucugucacaaguguucucuucauccaaccaaaacaauaagucucugagccaaaggaaagagagcuguuggauuuuauuuccaaauauuucaauuauaaaucaaucacuuagcaaaauuccaugaaguuugcgaaauuucucuuugagucgguucccaucgagaauccaaaaagucuugggggcaaaauuucaagcggucucuugcagguuuuaguaaacuucuccaagcuaguacuuuccauguuucugauuuuaugugcucaguaauacacccucauaacucaaaugggaugaaccaauuaaacauuucccuguagucucuaaaauagcugcucuuggcauguuuuuugcauggcacaaaccucugcgggaggauacgauagaaaucuugcacuauuuaaauauagaauugggacaucaaagaaaggguuguauugaaauaacauggauaauuaaggaaguggagaacaguaauaacugauuuacauaaaaugcuaaugagucucuugacuuguuuggcaauuugcacuuuaggcuucguaaugguggcuccaaauuuaugaucuaauuuuuaucuuaauauuuucuuuuagcaagucguaaccaacacuaaugggugccugccaacgucuaacuccuuuccccuucaaccauccagaagcuucucuuuccaaucaaguaugcaaggcuuggggauguaacuagucugugaguuuccuggaagcccuguuuuagagggguuucguguuauggugcuggugucauuaccgaugaucaacaguguucaaaauguucacaguuggcuaagauaacugggcuggagaauaaacgugguguuagagaggcgaagaguuuccuagcacagccagcucucugcuacucagagaaagagacuggggcagggcauccucucucuaaggcuagugcuuauucugcaccauucuccagugccuuucacuuccaagaagaaauuacaugcucugaaaauuccuguuuuauuguacucuucuacugaucucaccucacagggccgcagccucccgugaaugagaaugaggacuugagcuguuccuucaggacaugucugcacguugaccuucagcguacccuauuucccucugagcccucuaagcaugauccauugcuuucucaggccauucccccuucaccccauugacggguuucaaagcuacuuaaauuuccaaguucugacacacggcggcgguggccggggcucucagccuugcccucuuauggauugcacaaggucaccgccagagagacgaaggaggaaggcacagcauuuaucaggauguauugcuuuacuuuuucuauccaucaccaaggcgaugauucuauuuuagugaaaauccauagaacuccgaucaagucagauggcuguuaucauuggaaacucaagagcugucaggccauaaucaguacaaaugccagacccuaaaauggggggcugcagaccaguaacgguccucugggaaucuuuuuggucauucccguuuuuaaaauuucauccgaucacuuuuauuuaaguaucuuuucagcuauucuccuugcaaaugguaagaucugguucugcaaguugcaaagaacccauuacaggcaauuuaggcacaguuuggagaugcaaugacuucucuugccaugcuacacugccgacucugggccuaaugaccuggcuacccaucaggauaccugugcaugccugaaugaucacagaaaccggaacaugaggagugcacacacccacauuccagucuuagucaaaaucaccaauccauacacuauuuucuggugucuucaauguauguauuuucugaucaucgcacuuggcuauagagugcaaaguuaacaagcacuuccgccuugagagcuguauuuucaugaugaaugccccugcuugcauuugcaugugguugggacaguuuuaugcuacgguuaucaccuugaacauggaaaaggaaaauucuaaagcucccugaaaauuuccuuuggguuugucuucuggucauggauuuaauuaaaucugacauuuaaauaaaaucauuuaaagguauuugcugcccugccgguauccuaaacuuuuacaaaaguggagaguugugaaguaagauaacagaaugcuuuuuaaucaugauccuguagcucaaagugauacuuaacucuuaacuacccaaaagcagaugauguuccugcuuuugcguaguagacugccaaggaucauauuuuuuccacuacccaguugaaggccaaauccuaacggguugagaugagaaggaaugaagugaguagugccugugugucuaccucaccacuuuuuaagauguaaauccauuuaauugacauguauuuuucuacuuuacaauccauaucuugaucccuuuuuauuagcaaggcaaauugaauacugauggugcuuucuuaaauauacuuauguucuaaauaauagcauucuaaauaguaaggguagcuauuuauuggucacuuacucugaaucaggcacuaugccaaaugcuuuacauacacugucucauuugugccuuaaaaucaccuccaaaugagauagggaaucucuacuuuauagguaagaaaaucagggcucugagaguaccggcaauuaaugagguuaucauaaaaacuagaaggggcaggguuguuguacuaaauaagcuaaaccaucacaaguuaucuauacugguuuccuagggccacaggcaaauugucuuaaaacaauagaaauuuauuuauguuuuauuuuuuaauuuuugagacacagucucaugcuaucacccaggccggagugcaguggcacaaucucagcugacggcaaccuccaccucccaggcucaaaugaugcuuccaucccagccucccaaguagcugggacuacaggcaugccccaccacacccggcucauuuuuugguauuuuuuguagagacggggucucgccuuguugcccaggcuggucucgaacuccuggguugaagugauccaccugccucagccucccaaagugcugggauuacaggcaugagccacuguaccuggcccaacagcaauuuauucuuucacaguucaggaagccagagguuugaaaucugagugucugcaggcugagucccuucuggggguucugcaggagaaaugcuugcaggcucuguuccagcuucugguguagccacagccuuggcauuccuuggcugguagauggcaccacuccaaucuuuacuucugucuuggcaucaccuuccucucucggugucucuguucugucucugcuaaggacauucuuauuggauguagggcccacccuaaaccaguacgaucacauucacaucucuaucuuuauuucaguuacaucuauaaagaccuuauuucuggguagguggaguggcucaugucuguaaucccagcacuuuaggaggucaaagcaggagaacugcuucagcccaacaguuugagacuagccugggcaagauggcaagacucuaucucuguuuuuuaaauaaaaauuuuuuuuuaauuaaaaaggccuuauuuccaaaugaggucacauucugagguuccagauagacacgaauuuggggggacauuauucaucuaguacagcaaccaucuguaauccaaaccuggggcuggcuggacucugaagccuguguaccuagccauuuaucccauaacccacauucagagggugacaugauuuccgaucacacaccacugguaaguuucucagagaucagcccuaauaguucucauaacguaacacaccaaugcagcauguggcacugcaaugcucauaaugcuuuuccugcauauuuccgggaugaaccagggucacuggggagcuuggaaagguguuuccuuccagaaucacgggagggucggaaaagacagaugcacagaaaaacauccaaggauaugacccuggguagaagaguggcuggcauucaacacacgcugccuggccuuccuaaacuccagcugugguuagagcuggaccugcuggugaaagggaaccagagaauaaggggugaauaagagcucagcuggccucuacugacgcagagaagcccucacaacaaagauggagcuuccgggggcggccgggaacaggaauuuaaaauucuuggccaccauucauucccucuuccugccucuggaggaaaaagaaaaacgagccaaauaacagcucuacauuacuggugggggaggaugaagggagaaaaggcaaccauuuugagaggacuuguucuauuaauaagauugugcuuaugaaaaagcaguacaugugcaagaaaaaaacguaacguggagagaaacuuuauuuuuccuucucccuaaacaucuuauuagagauuauuuugaauaaugaagucuucugagucacugaaauaaucaauaggggugccaugugggaugcauggaugcaaauuucaagggaacacauauugaagggaugaaaggcaauuauccaaugaacuguaacuaguuuuuagcucaaacaaaaauuauaauacuuuuggaacagaaacaagugacguauuuguguuggauaucugaaacugacucauuuaguuccuguucaccuuccagcuaggucacguuucucaaccugggcacguugacauuuuggggguagguaacucuuugugguagguacuguccuauggauuguaggauagucagcaccaucacuggccuugacccauuagaugacaguagcacuucuuccugcuuccaguucugacaacuaaaaaauaucccagacauuguaaaaacauccccuggggagcaaugcugccccuggauccuaccauucuaguugaagaaguuggaguuaaaacucccuuuccagacucccuugcaacuuuguuuauagacacaaauccaucccaccaauugcuuaggcacugccaugggacacuugggacagcaaaugugagggaagggccauauccagcuucuuuggggcuucuccucuuagcaagggagugugugaaggaaguuuuuugucuuccgguucuggggucccuucuccagcuuccuugugguggagauggggccacagcaacggaggugguuuuggcuuauccaucugcuuagcuccaguuguagcuucaguggaagggccuuccuggagggucacuucuguauuauucaggaagccguucugaaggucaaccucaaaacuacucuuuuagcucuucuaacaauuuuuaaguaccaaauugccuuuauuaaaucucucccuuuuaaaaacaugaagagguucgcauacccuauguggaggcccgaugaagagaaccugccagggaguuaucaagugaacaccacgugucucaucaggaagacucagacacgcucugaaggugcccaugucugagcugcuguaccugcuauucccucuguucagaaugcacuuucuuccuuuuauuccccaucacucaacuuccaggguggucuaccuacaaacacccauguagauuccaaagcccaucugaugccugcucuucucagggguaaagcuuccuccuucuuauccucacccccugcugucacuccuucaccuguuccccgcagauaacaacuccugucucucaccuaccucucuugguaacuuugucacgccccuugccacacuaaauguucuaauuguuuguuccugcuuguucuuacucaacuguucccagggccuagcccagaguaagaauauaaugaaugaugaguggauauacaaaggaaagaauggaaucuuggaaugucauuccugguuaccuuacgacauuuaucuugugguccuugcccucaaaguacuuacggaauucccaagaggagucaagucgaacaggagaaaagacaggcguggggguaugagaguuaaguuguauguuuuuuguuuguuuguuugagacaaagucuugcucugucacacaggcuggagugcaauggcauagaucucggcugacugcaaccuccgcuucccagguuccagugguucuucugucccagccucccgaguagcugggauuacaggcaugugccaccacagcuggcuaauuuuuuguauuuuuaguagagacggggcuucaccaugguggccaggcuggucuugaauuccugaccucaagugauccacccgccucggccucucaaaaugcuaagauuacaggugugagccaccgcacccagccaaguuguaugguuuugauggcuaguguauuuaagaagagcuuuggcugagagcagcacagagugugaugugacggggcagagggcacauccuagaaacagauaaggaacacacacagagguaugggauggaaaaaaugcaacacugccugguaaccacugaugccuuauagcauaggcaaacagaugcaagcugaugcgagagaaagacagaaacaaaggagagagcucucaaaugaguucauuugaacaaugagcagaguaauggguguucucaucaauauucuauuauuuucaucauuaucuuuuuuuuuuuuuuuuuuuuuuugagacggagucucacucugucgcccaggcugggaugcaguggcacgaucuuggcucacugcuaccucugccucccagguucaugccauucuccugccucagucucccgaguagcugggacuacaggugccugccaccacgccuggcuaauuuuuuguacuuuuuaguagagacaggguuucaccguguuaaccaggauggucuugaacuccugaccuugugauccacccgccucggccucccaaaguguugggaauacaggcgugagccaccacacccaucauaucauuuuuaauuuucuaaaaaaaguaggaugcaaaaaaguagauauauauugagauaacccauucaauaaaaaugucagccuguccaagcuugaaaaugguguuaaaagagacuuacagcucugcuucuagaaagauagucugcuacgaggggcagaaaccuaaaauuuaaaugccaaagaguugcagacauguucacccauagaguuucauggaagcuacuagcaaacacauaaagugguguggagaggaggagagugaaaaguacuauuuaagacgugacugaauuuaaaaagcaaguacacaaagauccgauacucaaaacuccucugaccauuauguaagagacuuuuaauucagccagcaguuggguuuuagaguuagagauaaaaggaagacaacuaaacuuccccuaaacccuuuuaacccccuuuugugauggaacugucacccccuggacaucaacagugucuugggagaagcugccuucugacuuaugucugaauuuaguauggagccuccuuaggaagccuucguagaacgcugcauggcaugaaaauuaaauguaaacuuuuaucucuucuuucuagaucuccuccuuucaaucacuaaucucuccaggaaagaacacaaccaaacagucccauuaggaaagaggcagauggaacugauguaaauccccccugaauuaauggaccugcucuuuacugcacgauggcccuucccaagaugaccuugccaaucagcagaucuuguuuugucugcauuuuccagugacuccaggcccacaugcgacugaaggaaucugcuuuauuucuuaaggcaguaccccaaucaaaugguucuagagaguaaauaaaauuugcugaccuaggcagaucuuuaaaacaauuuuuuaaaggcaaauuacaauauucaaacuuuguaaaaauaggcuguaagcauguaauggcgugacacacuggggcuuggguuguucugauguguaaaacugggaucccucuaggcaugccgauggcaguaaggagccagguuaugacacaguuacaaguaacccccaaaucucagugucuuuuuaauuuauuuauuuauuuuuaaagagacagugucuugcucugucacccaggcuagagugcaguggcaggaucacaguuuacuauacagccuugaccucccgggcuccaacaaucccccugccuuagccuccugaguagcugggacuacuguggcacaccaccacacucggcuaauuuuuuuaaauuuuuagaaacauggggcucucacuauguuaaccaggcuauucucaaacuccuggcuucaagcaauccuccagccuuagccucccagaguguugggauuacaggcaugagccacugugccuggcccccacaucucaguaucuuggccaggcgcagcggcucacgucuguaaucccagagcuuugggaggccaaggugggcagaucacuugaagucaggaguucaagaccagccuggccaacauggugaaacuccaucucuacuaaaaauacaaaaauuagccgggcaugguggugcaugccuguaaucccagcuacuugagagucugagguaggagaaucacucgaacccaggagguggagguugcagugagcugagauggaaucacuacacuacagccugggcgacagagcaaguaucuuaaagccacaucagagaagcacaauuaauguuuccaugugugucuugggucagcucaggauucuugcuuuuguccuaccacuaggacccacccugacagggcaaucggaaucuggaauacugccagucagcgugguagagggaaaggagauuaugaugcagcaggcuggaaucuguuaaaguuucugccucaaggagacacacgucucuugcccccagauuccacucgccacagcaaaucacaugucaggaaaguacggccuucccaugugcccagauggagagggaaaacucaauaguuauauucaguaacucaauaauaauaauucaauuauuuaauaguuauauucaaauucacaguuaugaauaucccuacugaauccacaauggguaaggcagugucaugcauaacugaaaacucucuucucuacacucccuuaggaugugcguggcaagauguggcagugccggaauucagcccgugacuccagaagcccgcgugccaacuuggaaaucuguugcccgucaucacagcucccuacuccaggaacccggaccaccacagaaaauuccacaaagccccgggcucugcuaucuuuuguccccaucgcauuuaccuaauagaugauccuaccaauucccauuggcagcccuuuguaguguaaugaacaggaugcaggcugaugaaugcagccgcugcacagaaaacgucaguucuuucauuaagcaaaccuucccaaguucauuguauugaaccaggguuuaggcuauuaggcugacacaugacagagccaauuccagucacauuguaagugccuauucauguuuggcaaauuccguuuuacgcacaugcacacauuuagaauuggacucuuguugccugcaaauuuuuuccccuugaaaucuauuuuccuauuuuuaacuguuaauaauuaagaaaaaucccacuuuaauaauugagccucaaggagccuaauucagggaguacauaauggaugggcacacagaguuucuacucugcuggccguucggcaugcuuggucuuccuagacacacugauacggauacaccgggcucaucuggaaaagggaaaaucauaaaacaucuggacacagaguuuugacacugccagcucuucacucugcucacauuuuaagugggagacuuuauuuacaagcuuggaaucccugcuagugagaggggacaggacuaagggcauccuuugaggguacaggcugguaaugauccagccugaucgaggaagaagcucaaagcagccacagcagccaggagcugugacugcuuuuucuccaaccugccacuuccuacgugggcagucauuccacaucacucacgcagcacacauaaacugggugccuccuggguggccagcccacacugggagucaggguguguacaugaagaguuaggggcuugugguccagugggagggagacacgaaaacugacaauuacauuugaauaugcucaguguggucauguuuccugaauccauccuguuuucucuaucuccauuauugucaccuggucaccuuaguugcucucuuuaacuccagggucaccucccagcauauccuuuagcuuucacuccugccuccuacgcauuguccuccucauggcaaccauggcgucuuuuaaaaccaugauucaaauuaugucaccuguuugcuuaccaccucccaauagugaucaccauaagucaaggaaaauccagacgucauacaguggcugcacaugugugguuggccccccucuugauagcguugucuauuaucccuguuggcuccaaacccauucaccacuuacucucccuugaacacaucgaguguguuuccaccccagggccuuugcacuugcugcaccugugcuugagauuuucuuugcugaggucuuugcauggcucucuucauucaggguguaguucaaaugucaccuccucaaaagccaucacugaucacacacacaaucacuaucuguuuucuuucccuacuuuauuuuuauuuaaaugaugucagacaugucaagacacauccuggaugucauagacaucacugcuaagacaugccauaaagagauauuggaaugaaaauagaagucugcccuaaaacuuguauaugaauguucauagcagcauuacucauaauagaaaucagaagcaaccuguggcaacgcuuauagaaguguuacccauaagagccagaaguaaccagauguucauaucgcaguauuauucauaauagccagaaagugggaaugacaugaacugugaauggauaaacaaaguauaauauauugauagaauagaauauuauuuggccauacaaggggaugaaguauuaguuagauugguucaaaagugauugcaccaacauaauauuaauacaugaaauaacacaaaccuugaaaacauuaaaugaaagaagucaguuggccacguauuguaugauuccauuuauaucaauuacccgaaauagguaaagucauagaaacaaagucaaugaguaguugucaagagaucggggguauaaaauagggaaugcuggcugaaggguacaggguuucuuuuaggggugauaaaaauguucugaaauuagauaguggugaugucugcacaaguuugugacuauacgauaagccaaugaauuguccacuuuaaagggagacuauugcaguacugaauaaucucagucaaaaaaccaaagcgauaggaugugacuuccaagauuaaguuaaaaaaacacccuggcugcggucucucucaccaauucuugcacucucaccuucucacuuggacaaaagucagcugccacguuacaagcugccuuuugcagaggcccauguggcaacagccaacaaccaacagccaaaaagcugagucccagagcccaggaaccaccaaaacacuacaucuugccaacaacugugcagcuuggaaguggauccuucccgaauccagccccagucaaugaccacccucaauuacagccugcaagagaugcugaaccaggcucaauucuucauccaaagaaagcaaaaugaugaauguauguuguuuuauguuuuuuaaaaaauaguaaaauaaaaaucaagcccacgacugccuggugcuccuucuguuuucucacauugccuuccucauccugcauccuugcaacugguccaaagggccugauagugguaucgggaugagcaccuacaugguaggugcucagugagguuuucuugaacugaguaauaauuuccaauacuguuuucuccacauaaagcuagaaaauucucucagugggaaacagaacaaacgaaagagaaaaaaacuagaugucucauugcgcucucuuauuuuccaguccuguauaugcagaugaaaugcugaccaacacucucagugaauccuggugaccuugccuugccucugacuaaaacauucuucuauguacagauagcaggagguucuaagaucuggccucgguuauacaaaccucacuuauuuacuaggcaauucauccucagaguagcuccccacugugccucacugugaagcacuuaauccuagcuuacugcaaaccccaaagucagggcauucacuacuacuacuaccaccaccaccaccaccacuacuacuacuacaauuauuaucauuauuuugagacauggucucgcucuaucauccaggcuggagugcaguggcacaaucucgguucauugcaaccuccaucuaccgggcucaaaugauccucccaccuuauccuccugaguagcucagaccacagaugcauaucaccacgcccagcugauuuuuuguauuuuuuguagagaugagguuuugccucaggcuguuugcccaggcuggucucuaacuccuggacucaggcgauacaccggccucggccucucaaagcacugggauuacgggcgucagccauuguacccagucuauuaacuacuauuauuaaaagauggcaucaguccagaaacaauuugcacugcccuucccugaagcuuuuccccccauuccaugcacagagcccccacccccuccccaccucucagcaacacaucucuuccaagagacauuuauuacagggcugucaacacaauccuaccuuuacggaaaaugauaaaaauaagaaacaccuuacaagaagaugccgcggugaaagcuaaaucauaaauguuuaauaaggaaugaucaaauccagacaaauaacuguucaaucccacuuuguauuaagcagauaaagucauacagaaaaucaaugugauguauugaaaggggaaaaaaaaauugcccagcuuagggauuggacuacacaguguuaugaaguggucgcuucagaagaaccuuacgauacaauagcaacauaaauuuuaaaaaauggcgugcugauugcugacuugugggaccugucaauggcauuccaguccucucuguugcugcugcuggagauaauuucuggggggccacaggcauucucacgugugaaugguagagaggaaauugguuuaaccauucuagaggacaguuuaguaauuuuggugaaguuaauuguuucaaagguguacacagugccuuuguuccaccacuucugcugcuggaaauccucccucccaauauccuugcucaagcagaccaaauauacaugcaggaacauucauuacuaagucauguguaauaguaagacauggaucuaacuucaaugucuauaaauaggaaugaauauauuaaaugacaccaugugauggcauauuauccgucaugcaguauuaggagguugagcuacaugugcugguaccaaauaaucuccaagauacuauuaaauggaaaaaguagguaauaaacaaaacauagccaauagucucaguugcaugcauuuuuugaaaaggcuauccauaucugcaacugaugcuaaaugcauagaacguuucuggaagaauccauaacaaacuuuuaaugauggcugccucuuuuggagagaggucugggaaugaaagaaauuuuacuaucuuacugaaaggucugaaacguuuauccugagcuucuauuccuuugauggguuauuuucccccaagugaguagggagcugguggcaagcaaaacaagcagaaacaacacaaauaaacaguaaacacuuuugcaggaccaggaggcccugaguuguuuugugaauucucugaaaaaaagacagaaggagcuuugaauguuacucauuauaugcccaccccagcuccucucccacuggcaacugaaaaaugaaagcuguguuaaguggccccuuccaccucucaggaagcauaucaaugucuccaauuuccuucuguuuccccaagcccacaacauaccuccucaaauaaaaugaaccacugucugccagggaagagggaccuuuaguguacggaagugcauuuuagugaugggcucacaguggccaguccgcaucuaccacuuauucuuuaagguaauaauaaccucccuccugcugacaauauuuuauauaaccuguaauuaaaaacaaaaaaagcagcacaguccacaauaguaaacagaugggaaaggcccucugaaacagaggauccaaaaagcuugcuaaaaagagcacacacuugcacagagaagauaaacaacucuggugucacuauggugaaugauguguuugcuuugagguaaaauaauaggaaaugaggaucaauuaacaauguacugaugagcccuacaauuacugggcuuuuuuuugcaugcacuaacagcauguuaaauuucugguggugacagcccuugggaugagaaggcggcugauaguugagccuggggacccggacuuugcucuuccgaaauaaauguguaaggagagucaugcuguguguuuaaguaagagugacuuguaaaaaaagaaaaugcuguucucccuuuaucuuugacaugacacuuucuaucuucaugugggcaaauauaugaacauugucauuuuucuaagacuuuugggcacugguaaaaugggaaggaaaaggcuccuuuagaaaaguaaacacaacucuccugaacucgcuccgauggaggcagagaugaguaguacagugcuuugcaaagcaagugcacuuuggaaacauuugauaauugauucaaaugaugucucgaaagguuuuuuuuucuuaucuggcauuuuugaucagaaguucucaaacuuuaggcaccacagaauccccuggagggcuaaaacuagauugcugagcccuacucccagaguuucugguucaggaagucuggcgggguggggcgagccugagggugagcacaucuaacaaguucccagaugacccugauguugucgcuuggggacgagccuuugagaaccccaggcgcgaugguuaggagcucaggcugugcaacugaaaaaacugggcugaauuccugauucugcuacacgguuaucucugugagucacguaguuauugaaucugucugugccucaauuuccucaucuguaaaaugaggauaagaauaccacgugcucauacuggguuaaagagcauuucuuccaaauuuaugugugcaccagcauguguuuuguuuuuuuuuuguuuguuuguuuguuuuuuuuugagacggauucucacucuauugcccaggcuggagugcaguggcacaaucucggcucacugcaaccucugccucccagguucaagggauucuucugccucagccucccaaguagcuaggacuacaggcacgcaccaccauaccuggcuaauuuuuguauuuuuaauagagaagggguuuugccauuuuggccaggcuggucucaaacuccugaccucaagugauccgccugccucggccucccaaaauucugggauuacaggcaugagccaccgugcccagcccuagcaugugaucuuauuuagaaauggaaucuucacagaugcaacuuguuaagguaaaaugaggucauccuggauuccagugagcccuaaauccaaugacuugagucccuauaggaaaagggagcaaagacagagagugaagauggccaugugaaggcggaggcggagacugggguucugcugccacaagccgacgaaugucaaggauuaauggcagccaccagaggcuggaggagaggcacggagcaggcuuucacugagagccccgggaggaaccaacucugccaacaccucgaugucaggugucuggccuccaaaacugugagagaauaaaucucuguuguuucaagcuaucuagucuauggcacguuuucaaggaagcccugggaaacuacacuacauuacagaauucuugugaggauuaaauuagugacuacauggcaaguguuuagagcagggcauggcacauaaugaccauuaguaaaguaguaguuuauauuauuauuugggucuuauuaauacuuucuuguucauuacuuugcuauuaaaaauacuuucucauggaaagaaccaaaacuguaagaggauaaagcagggguucucauccaggggugauuuuguuccccagggguaucuggcaguaucuacaaauguuuuugguauuuugagacuugaggaaauagaagaugcuacuggcaucuaguggguagaggccagugauguugcuuaaugucuuguaacucacaggaaaucccccccaacaaagaaucuccuggccuaaaaugucaauagugccaagguugagaaacuccaggauaaagugaaaaaucaaagucacuuggccucugaguccacuucccaaggugagaacaaaaguaauuuauugaguauuacacuauacuuucuaaugagaacaaucaccgccaggcucugcacacuacuccagcccccgaaaaacaaaaaaacaaaaaacaaaauaacacacacacaaaaaaacaaaaccuguuuuaauaaaaaaggacaacaaugaaaauccagagucaagcuuggcccaagagagggagccucaagcaguuauuugcgccaccuuccaagcuagaaaaggcaaugugaccucuuguccacugagaaucacuuccaucacauccaaggaaauucaagaggggacuaaaaucugucaucagaaccugacugcaagaaacaaagguccaguaggcugugggccucuggcuucagucccggccagggucacgucuuuaacuagaggagggguuagacucugggucugcugauucuucuguguucuccuuuuacugaccccagcaugcaucguaguggcagggaaccaccuggacccucacugacaagcuuguccaauauuguucuugacaugcugcagggcccugggagucgggaagcacaggcuccuuuacaggaugggggagaacuaugaggaagcaagaaaguccccuuccccccaccucauuuucuucccaucuguggguuaagggcauuuggaaggguggaagccagagaagagcgucuucacucaccccaggcaaggguggcaaugaaaacaaaaggggugaugguggagaugaugacaauggacagacucagaguaaaaaugacaaaccucagugaugagcaggacacauugggugguggugaaggugacgcaggggccaaaguggcagccuggugugugaauugcgcaauugcaugaaugauggcaccacucaauuagccagaaagcccuacaaggggcugcauuauuuucagaaauaaaugaguacacgaagcaaaacgcucauccaccaugugcccgaagacccuaacacuccagaaucugagcauggaccagacgccaugauggucagagcagcgguguaucgacagccuucccuaaacagagcggcuguguaucuacagccuccccuaaaugucuuccuguuucccaugaaacacaucaagucuagaacucaccagucuucugugucagagcaaucugccuaaggauuguggcgcuuggguuuggaaggaaccccuuguaaggagagccaggaagauccacgaggaugugcucagugggugccgauaugguugggauuugugucccagccaaaauuucacaucaaacugcaauccccaauguuggaggaggggcccggugggaggugguuggaucagagggcugauuucccccuugcuguucucaugacagugagugaguucucaccagaucugguuguuuaaaaguggguaguaccuccuccuucgcuccuugccuccuacuccagccaugcagaacaugccugcuucccuuucaucuucugccaugauuuuaaguuuccuuaggccucccuaacugggcuuccuguauggccugcggaaccaugagccaauuaaaccucuuuucuuuauacauuagccagccucagguaguccuuuacaucaaugugagaacagacuaauacaggcaccaggaggggacagagaaaggacaugcauguuggagugggugaucccaaaaaaggccucaucagauagcauugaucuaccaccgaaggaugauggggagacugaggcacagagaggugauccuaccuuucacacacacccacccacccacacacacacaaauguuaugagaaacaacagagcauaacuuucauccucauguugacauaauaauuuugauucuuccccaucccauacuguacugaagcaaaucagaaagagagaagaauaacccacacccccauuucaaaacagaccuuugguauucacccuagaccucacucaauguuguguuucucuuuuuuucccccuggcaaaaccaaggcuucuccccaggcugugcauuguggauuuuaagaugcacaaagauaaccacgcucgaauacagagcugggguacugagaaaaggaacacacacagacagcccacagggucugugaaaaucaagcccacaucaccuaaauauagacuaacuucuaaauaaggcuucaaaucacagauuuguuuacuuucauuuggugauaauuguucacagaagaacauaucagaaaauucuauaauaggaaccacagccaggaaauaguaaauaauuaaucacccucccucccagccccuugcaucucuguugauauaaaugaccguauaauuccaaacccaauuaucacuacuuagccguuccauuuuguaguuaaaaccccacaaaauuaaagugcaucaauuguuaaugguaauagaccaaacaagggauuaaagauuauuuuaauguuuauuuccugucaagagaucuuuuggcaggaaacacagcagacaaaaggcugcacacucagaugagauucauauauuuaaaucuucuaacuucuaaaaacauuauggaucuaauuacuuguuuaauuuacuuguucccucaagacacaggcugaggagaucaagccaacguuauuauaucaaguucucagaaaggacaggcacugcucgguagcauuuuguaagcuguugucucuaagugaucaaaucaaauuagugcccacgccccaccacccugagaagccagaugaggcagagacggagagcagacuaugaagggagugagaccucaguuucacucucagacugcagccuagggcaccuauggccacagcgaguccccgaagcuaguuugagccgaguuuccuuaacuguaaaauacgguugauaaggaccaggaugcaggccaggugagaaggucacagaagacuuggggaaaggcacagaguucugccaaagcaaguaccgacacaaaauguaaacucagacauuuggaugugguggugcucauuuuaaauguggucacauagaugaucaauguuuaauuaaucuuucuaaauuaucaagauacucaugcacacacauacacauaugcaucccccccaccaagaaaaaauuugacugcugcauugacgggaccuuacgacccuacugaagaaucacuggucuauuuccaaaauucaaaacaacaguauguuucaucacaaugucaaaucaaauaauuaggauguagguuaagaaagguuaaaaaaauucacaggccccaaaaucuuauuuuuagguuucauacuggauauguaauuuuauacacacacacacauacacacagagagagagagagagagagaaagguauagauagguagguacauuaaaaacaagugaucaccuaaaaaacuauuuauaucacggagaaaucagaaucugaaaagaacgugggccucuucuccaaagagcucaguuuauuguuuuaccuauuucuuuucugccacuuuuauuaaaauauaaaaaccauaaggguagagauaacaucuguuuuguucauuacuauauugcuaacauuuucaauagagcauaguacacagcaguuaguugauaaauaccauaaauaccgcuggugugaaggaacacgaugaugaggaugacgaugaugauuguaagauuauuuuauauuuuuacaaagggauuuauguuucauaauucucauaucacuaagcugacuucauuuaccaauaaagaaucugaaaaccaggguuuucagggcugugagcucuauucaaaucgcccacccaggugaagagccgaaggcaauuugaacucacacuuucugauucuaaauccugugcucaucuugaguccagacccuggccuuugagaguuucucucuaccuggauuuaggagaaggcauuuugcuuuaaguagcaauaugacgacuucagaaauuucugcaauaguugggguucccaaagcuggauacgaccuugagcagaucuuaauuucucuggaucucugcuuugccuuuuguaagaauaucugcagugugaaaugugaagacguuugcucagaccucucgcgugauuagagauguguccugcugcauguaauagacaacgugauucaaacccaacucaaaauauuaaguuggugcuaaaaguuacugugguuuuggccaucacuuucaauggcaaaaacugcaauuccuuuugcaccaaacuaacagcuuauuucaugaccaguggagguucggguuaggaggcccauaggacagcugaaucaguggcucuaaaaugccacaaugcacccagguucuuuccacuugcuccucuguccuacacagggucauuuucaacuaaggucggagguuguccaaacccaagcuggcaacugcuaguccaggcugcgccaguguccagaggaagcagaaggucucucuuccuguguaucucuuuuaggaguaggaaaccuuccucauaagcacccuccauauccauuggucagaacugggucacauaccuauuucuaaaccaaucacuggcaaggaacacagcauuaugggcuuagacuaaucauuagaggcaaaaggauuuuggggagucaucuauuauuacugcucugauuacuuuuacaaaaaguguaaggcaaaaauaaauaguaaaauaagccugaguuauuuuuuaaaauaguguccaaauuauaaauggccuagcuauccaacacuagggaaugguuacauaaaauacaauucauuuacaugguguaaucuuaggaaauuacuaguauguuuuuucaagcaauguuuaaugacaugagaaauucuuguuuuuuuaauuauauaucuaugugccuauauauuacgagcccaauuuguugaaaaaaaugcuaucacucagaagaaagaaaagaacaugcaacaaaauauuaagagugauuaucucaugcuaguggaauuaauagaacauuuucauuuuccucuguccaaguuucuaaauuuuucuucauuuucuucuccuucuaccauguauauuauuuauuaccauaaucaaauaacaaaaguucauuuuucaaaguaacaaaugauaugugaacuccagaacugugaugggcaagggggagucaaaucacguuuuaugccuggguccaaucauauaauuuacuuauaugaugaauaaggaagaugaauaaauucacagucuaauauauacacguauuaaagaaauaucugcuucuuuaccaagucuauuuuuaucacagaagaaccuaaaucugaaaagaacaaauuuggcaucuuuuccacagcccccaauucuugaggaugauaaauccagagucauggguggucgaggaaucuuggcugugugcuaaugauggcaggagcuguccagguaacacagggagaccccgaacacgcugagaaauaccuggagcaccagagaggugagucaacugcugaggggucugcauaauuuauuacaacuuuuuuuauaguccuuuauagaguccucaauuguauuuggaauucaugggacauggcuuccaaacaccuuuuucuuuuucuuuuuuuuuuuuuuuuuuuuuuugagacggagucucgcucugucacccaggcuggaguacacuggcgugaccuugacucgcugcaaccuccaccucccggguucaagugauucuccugccucaggcucccgaguagcugggauuacaggugcucaccaccacgcccagcuaauuuuuggauuuuuaguagugacagguuucaccauauuggccaggauggucucgaucucuugaccucgugaucugcccaccucagccucccaaagugcugggauuacaggugugagccaccacgcccagccccaaacaucuuuuaagugaccaggagcccuggucucaagcuggcuucuggacaucuggcuuaucaugaggccucauagguacuuccuuuaaaacaguccuaggaaugccaauaauacauccaccuuauaccugaucuagguagaaaauaauccucauaauaauguaacugauaauggcaaccaucccugugccugccauugcauuuuacuuacacucucucucacucccuaugggaauagcuagcaauacuccccauucuacacaugacaaaacuaaggcuccgaaagaauaaggcaugaguccaaccaaucaguuuguuagaagccagauucccauccaacagugucucguuccaaagcauaaguugauacgaaagagguucuucaucaaagauuugggcugcugcccuccuacuccucaguuauguacugaugcuuaacaccugcacaggugggagaaggggaggcaguggucauggccuggggacaugagcugggucugugugagcaauagcacugagguucuaggcaaaaagcaggaacggcuaagcauggaacagguaaaggcaagaguuuagcccuagaccucaggugagcaucaaggauagacucuggccucaugccagcccaucuuugauaccauuuuaacaaucugcucacacuuccagggaccugcauggcuucugaccuccaggggacuuguucuccugccagaguaaaacacugaauagcugcuuguauucaaccugacauccacagauauuuaagagucuaauucaaucguuauaucuuuucuguagacacaaaggaaccacagccuucuggcaccucagggcucucucgcucgcacucacucgcucucucucauuugccuuucuuguuuaagcaugccagggaugcacacacgugaaagagggcagauuaaguaaagaugcuguacaguggugcuacuuugaugcuuaaaauauaagaaaacuuuguggccuucugaucccaacugaggaaagccagguaccugggccuugggucaggggucuaaccuccucgugaauacaacaguugaacagaugggcaauggcuucagcagucaaggagcuaucaauccaacagcagaaaagccaaaucucuaucaguccuaagcuuacgaaucccucuguuaaggagaaucacauuacgauaagguuuuaggacauaaaccaaacagccaagccaccuuuucucuauuccauuuccaauggaagaugugccaaguaagcaauaauauaaauccgaaauauucugucuacaucagcguggcuggcuggcaaaaauccacaguggaaccuuugcaggccagcugagauuugugggacagggggagacauggcauggaaacccauuccauaaccuuucaccacgcauaaaauuuacugugaauggaauuccuaaaaguccauguuggccucugauuuaaaaguauuaaaucugguuuccugagaacaccuccauuauaauaaauacaucacuaugacaacauaugcuaauuacauaaucucaaagaccagagugaauaaccuauacaugaaaaaugcauuugcaggcagguguccuggauucauacgacucgggcuuuagauuuggguugagucacagggcaaaucucaagcauugcaugggcaggcugaugucaugguggacagccuaggaagcaaggcacacggacaccaauuucacacaggugacaaaaugaaucuguauucauuugaaacaggggcagugucuccagcuuauggaauuuaagagagaaauuaucuguauuuuuacagacagcaguauguuauucugaaagacaaaaagcggauacacauacuucuucaucuucaaaguaaguccugaagaaauuagagaaacacuauggucacuguauguaguaauguguuacaaagaaaaaugagauccuuuuuaugcaaguuagccaaacacucuuuuuuauuuuccuuaaucugcguucauuuguccugcuuuucucccuuuucuucccuccuuccucugacauuucagccaguccuacuagccucuagcugcuacgacaguuacacagauaaaguacaauaggcuuccaauauacaaauaauacuguaauugaaagaaaaaaauauacaauggaaccucccuccauagaauuacagauaagagaaaugaaucaagaugguggccagggcuguugauccaaacacagacacagauuuggauccugcuuccacuacugugccuuauaccauauguggaagacaaggucauuuaauuccucuguaugcccaucaaucagaccugcaaaaucaaggcuuugaguauuuaaguguaagguuuuccuaaggguuaaaugagauaaguaaacccaaguuauacacuguagacuuaacacaugaaauaauaacauaacaacaguaacaaauaauuuuagcagaggucaaaagggggcagagucauaaguaaaggacagaagggaaaguaagcaaaaccuaagaggugggaaaggccaaggucaugguauguauuaacaaacgggggaagagccuggggaaguagcucaagccuguaaucccagcacuuugggaggccgaggcaggaggaucgcuugaggccaggaguucaacaccagccugggcaacagaguaauaccccaccauuuuuuuuucaacagcuggguauggugguacccaccuguagucccaccuauucaaguggcagaggugggaagaucgcuugagcccgggaccuacaggcugcaguaagcuaggauugcaccacugcacuccaaucugguaaacagugugaaacucugucucuaaaaaaauuaaaaacaggucagucacgguggcucacgccuguaaucccagcacuucggaaguccgaggcgguuggaucauuugagguccagaguuugagaccagccuggccaacauggugaaaucccgucucuacuaaaauacaaaaaaaaccaaaaaaauuagcugggcuugguggugggcgccuguaaucucagcuacuugggagacugaggcaggagaaucccuugaaccugggagguggaguuugcagugagccaagaucacacugcugcacuccagccugggugacagagcgagacucccucucaaaaaauaaacaaauaaauaagcaaacuaauuauuaauuaaaaacaaucaaagaaacaaacaggaaaagccaugugggaaaaaauuaaccuagugcaaagcuaguguaaaaauaaacaaagggaacccaaauaauaacaaauagaggucacuuauucagaacuuccugcagccaggcagucagccaccaucaguuguguuuggcagaggcucaaaggagguggagagaaagaaagcuuuaugguuaaacaaaaaagaaaguggaugacuuccaguaugcuccgauuggaggcuguggacauggggaagccggaggugggcucccuagaccaggacauccuguaugauugguuuggggagcauauguggcuuucucugguugguccugcguuggaaguggggacaaaauuuagcaaaaaugggcauuacugaccaaguccugaccauucugaguugacugcuccagagcuugugggucggcauucugugacaaaauauggucuggccauuguccauguguaucuuuggugucucauuagcaagauauccuagggaccagugacuguuuaccuuacaaccaucugcaaaaaugaucuugacaaaaacucuuccccaaagcaguaagugcaggggagccggcuggcuccugaugaaggagugagcacccaccagcguuuccuuacaacaagggccucgcauucucagagggccuccagacuaucuaaaaaccagccccucaccaccuugggucuuuguauagggauaugcaugaauuagagaggaaaaaggugguuugacguccuaaagaaauagccguuuuucauucaacuccugggaggugguaauguauucagucaccuuucaacauaauuccugucugacugauuuucucucuggcuucaucuucuccaagguggcacacaccuguucugggugaauaagaguaagugugggguacagauagggaggguucaagaagccaaaugaauaauggaaaauacuaagcgaaagcaaaugagaaagaaaagcccaccguucauaugaaauuuuuggcaaaguugauuacuaauguugccuuuuagaaaaauagcaauaaaagccucuaaauacucagagugagagagaaaaaaagagcugggaucccccaaagccagaaauauuccacuugacauaaccagacuuagcuaacacguuuguggcuucuguucuagaaauuucugucuuggguccaguuagaucuggguuucaucucuggaucugccacuuaccagccaggagcuucugagucacccugcagacuauuuugagguauaagaaggugauggucugauguugaugugccugucagcacucaguaugcccucaggaaaugguagcuguuauuuuauagaauggggaggaaucugcccacccuuacgggacaguggcaguggagcuuugagaagauggagauuaggcuuagcauaccucagacauccauucccuucucuaacagaccccaaggugcuuugcaaaugauuucauuguguacugaacggguccaugaucauggaaccgugugcuaaucuguguaaugauagaaaccuggagacccacagaagcaaugagaaccagcagccagucucccagguggaaggagggcuaaacaauggucugcagcucaguuacuccucauccucgccugggccgggccagcauccacuccccuuccuguaaagcauuuggauuuccuuggggaaacagcccugcccucuguccugauccauguguucugagaucucacaguagcaagugacucauguugguucagugauucccagaggcugauucaaggauguccccagcuagacccaggaugguggacuccagauuggggcacugggcaguuucacauccucaaggcuuggccaucaucggggaaggaaguugcugggucacaaagggagagcugggcucaaaaggaagagaaagacucuugaugacaucuguauaucugggcccagcagagucugagccaguuacgugccuagaguugucacuuccacaaggcauccccccuccaacccaccucgcuucagcuaguugggugagacuucucuuacucacagccaacacagccuaacacagcgugacacagcagaguuaguuucggcugaugggagauaaaaggaaggcgauucuaggcauggucccugacuucagagagcuuauguucuaguucuagaaggaggcaaaaccaaguaaacugaaaaauaaaauuuaaaauauauacgccaggcacaauggccuguaauccuaucacuacgggaggcccaguagggcggaucaccugaggucaggaguuugagaucagcuuggccaacauggugaaaccuagucucuacuaaaaagacaaaaauuagccgggaguagugguacauacguguaauuccagcuaccagagaggcugaggccagagaauugcuugaauccgggagacaggggaugcagugagcuaagaucacgccacugcaccccagccugggugacagagugaaacuuugucucaaaaaaaaaauuaaaauauauaaauugcguugaguguuaggaggcuaaggaaagaagggcuaagauggaggauggagggaccuuacuuucuuuaguuaggacaggauggcaggcagaauaauggugccaaaaggccaaguguacuggcucacaccuauaaucccagcacuuugggaagcaagaggauugauggagcccaggaguccgagaucagccuggcaauagagcaagauaucaucucuaccaaaaacaaccaaaucaaaaucaaaaggcauccaugcucuacccugaaaccugcaaagguguuauuuggcauggcagaugggacuuuguagagggauguaaguucuugacaugaggagaguaugcgcaguuacccaaggaagaccaaugcagucacaaaggaucuaaaaggucacaaauaaaccuaaaaagaugacaaagggggagaggagggggagagaaggagcagagccagggacagaauugaagacgcugcacugcugguuuuaaggauggaagauguggccaccagccaaggaacacagguggccuccagaaaucgaaaaagucagaacaaauucuccccagaagcccccagagcccagcccugccaacaccuugauuuuggcccaaggagacccugcuauaguuuggaugucuguugcuuccaaaucucauguugaaauuugaucuccaauguuggaggccguggcugaugacaggagucuagguuacggggguggaucccucauggcuagauuaauguucucccucuauuuguucccagagaguugguucuuuuaaagucucuggcaccuccccuccccucucuugcucccuuucucccuauauguucucugaacaugcuggcuccccuucacuuuccaccaugaguagaagcugccugacgcccucaucagaaauacauuggcaccaugcuucuuggacauccugcagaaacaugagacaaauaaauuuccuuccuuuguaaaugacccagcucaggcauuccuuuauagcaacacaaaaggacuaagacagacccauuuuggacuuuugaccuccagaaugguaagagaagacauucaugguauguaagccacccauggguggucauuuguuaaagcauugauaggaaaaaaacacagauggucaggaugggccucucugagaaaggagcauuuauacugacaacuaagcaaugaggaggugguacccuccucaaggguagaacaagaccacgcaggagagaaaccaguacauggaaaaaacccuucgauaggaaagagcuugacagauucugguaacagcaagcagaccauuguaacuagauuguauauugcuuagccuugggguuuagagaagaauuuaaagaacuuuaacuaugcaaugcaacccaacuuuugaagaaaagaaagcacuauuuaaugauuuccuucaucuuaaacucauugaagaguagaaccaaaacucaccguuuacuaauaguaacgaguucaaagaauuccacaaaaauacaauuuuccuuaguaauuccuaucuauauuccuaacaugccgucccgauuuucuacaucuauccucuucuacaugcucuccugcuguaccuacuaguguauucuuaagccugacucauaauagucacgaaauaaauauuuguuggauaaaagugccgagguuuggcugggcacaguggcucacgccuguaaucccagcacuuugggaggcaaaggcgggcagaucacuugaguucaggaguuccagaccagccugguaaacauggugcaaccccaucucuacuaaaaguacaaaaaauuagccaggcgugguggcaggcuccuguaaucccagguacuugggaggcugaggcaggaaaaucauuugaaccugguaggcggagguugcagugagcugaguuugccccacuguacagcagccugagcaauaagagcaaaacucugucucaaaaagaaaaaaaaaauaagggcccagguuuuugguuugaaaauacgcucccugacgcuauauaucccacaugacuugcucuccuaagucauucuagaaauaauuaaaauuuuuguuugcauagaggagggaggugacauaugggguaggugucuguccaucuguccaccagcacuaccugucugaucagaugcuuaggguggggaggacagggagaaguaguauuucauucauucauucauucauucauucauuuuugagacagaguuucgcucguugcccaggcuggagugcaauggcgugaucucagcucaccacaaccuccaccucccagguucaaaugauucucccgccucagccuucugaguagcugggauuacaggcaugcaccaccaugucuggcuaauuuuguacuuuuagaagacacagguuuucuccauguuggucaggcuggucucaaacuccugaccucacgugaucugcccaucuuggccucccaaagcgcugggauuacaggcgugagccaccgcacccagcuguguuuuuuguuguuuguuuguuuuaauaaaguaucaucaagauaucaagggagcugcagguuacuaauuauggcaacugucucaggcugggaagaaaguuuuuuuuuuuuuuuggaguuagggggcuuuccuccaucccauuucaacugcugagcaagcaaagagugauaugaauaaacucuacaggcacaagaagucuagggcuuccuuuuaaaucaguuccuagaagguaaggaacccguauaucauagugagacaaucauuuacaacggggccauuauuaggagccaagauauaaaaaucauacaugaaacagccuuauaagcagauucagcgcguggcugauuaaccucccucuccuacagggggcuggaaggcucuggggagugcuaaugagauguggaagucauuugccuugaggucacagguuuaaagcuggacauguuagaagucgccuaauugcuacucaugggugacuugguagcacaccuuaugagcugggagacacagagacagggguucaagccccggcacugucccugaacuagccacuggaaauuugcaacaguuacagauccuccagaagccucaguuucauuacuaauaaaaccuugucacgguugauuuuguuguuuucguuagccaaauaugacuaugcuuggcacaugguaaaaauuugauagaugauaauuauucauguuuucuaggcauacguguccuuuuuugacuucuuagacauuaagagggcaagacaugcugcaaauauuacaaguuccagagcugucggauccucuugggucuggauagcugcauagagcuuuucugccuguucagguaaacaauggagagcaccuuaucuuggcuuaucuaguugggguuaacagcagcagggauaauaguagcacuaacauuuacuuugugccaggcacaguuuaaguauuucaucuccaugaacugauuuaauccuuagagaaucaccgggaagcaggucuuauuauuacuauuauaagcuaucaucccaggauuuuacaccaaguaggaugagugccauaauuuggcaguaggauuccagaauuugguugauuauuaaaguauugccuaauccuaaagagcuggacaguuagaaaagagauguuuuuccugcaucugucaugagugugccucacgcccugaguuccccacugagguauccugaugugcacccacacacagccucagcagaagcaaaagaaauaccauagcggucgaggugggaacugccauggacaccaaagaagggaaacaugaaagggagucuucauccauaucucagcuggcaguagcccacgacaaaaacauggagacucaacuugcccggaaaucucauccaacaaguggcuccugguggcgcgaaaaucacaggaacaaauaacugaggacuguggaccuaggcagcauugaaucugaccuggugcacauacauggagcucaguaaagucgacagauuccaucagggccgaaauaaaagcagggagcccaaagagaaagaagcaaggagagagacuuugagcaaaaaaggaaagucagcauaaagggacagaacaaggaaucuggagacagaagcccuggguucaaaucccaacucugauuccuaguccuauccuuuauccuccaccuccucccuacauucuccacccauuuccuuaaccuugcaguaagucaacaccuucuugacaacaugggaugcuauagaauggauauucacaaauuaucucuggauuagggauuccaauucaaguauauauaaaagugccauauauuuucuuguuagauggagagaaauugucaauuauuugggggacagacagucuccuacacaggcaugucacacucaauguacuggaguauuuaaguguuaacucuccaauaaacucguugcuguuuuucuucuuuuucccccucuuugcauuuuccaaggacuuacggcucuugauaaaaggggaggaauaauccuuuuuuccgugucugcgaucaagaucuauuugguaagccacuccucuaauacugccugugcacagaaauaauuucggcuccccguuaauuuaaguauugaacugaaauucugcagcugcuuucugccaagcuugaaagcagaaauuaauuucaaugacccaggcgaguggaggggagcucugucagguaauuagucuucgucuuuugcuacucagggucuaucacuguguuaauccauacauaaaccuaggcauucccggagucacuggcaaucugcggggccguuuaacuaccucuugcuuggguuaaccacgagccgggcaucugcaggaaaacagaugaaggcucccuuucauguuucccuuccuucuaccuauuuagggccagcagaaugaaugagcugauuuacauguucuuuuccccauuugauugagucugcaguugauuaaauagagcuuggggcgugagaggggauuggguggggagagguucccacuccugcugcuuucugacucgccaguuuauuaaugaaagagccacggauauugauaacccugacacuacaagugcagcaauuaaaggguauguccuuccaggcuucuaauuaaaaagaaggcuuuuucucuccaggauggguccuauugucauauuugcauuugauuguggcuccggucugggggcuucucugccuuuuccuuuagaaaaaaaaaaucuccugggggaaacuuagaccugaaaaaaaauaaacacagcgugaaaggcuuuguugucaacgggggucauuuugaaauccaaggaagagaauuuuuuuggaggaggcaccuguucacaaccacagccugcuucucucccaaacccuccucucagcuuugaggaguguuucagcuguucuauguuacaguaaugcucaguuaggacaauuuuugcagcugguuccuuuccuuucccuucccuuuuccuuccuuccaucuguccuuccuuucuuuucuucuucuuuuuuuuuuuuuugaagacagaaucucgcgcugucacccagacuggagugcaguggcaugaucucggcucacugcaaccucugcuucccagguucaagcaauuccccugccucacccucccgaauagcugggauuacaggcacacacugccacgcccggcuaauuuuuuguauuuuaguagagucgggguuucaccguguugcccaggcugguauucaacuccugagcucaggcaaucugccugccucgaccucccaaaauguuaggauuacaggcgugagccaccaugcccggccccuucuuucuuucaccaacuuuuaaguuccaggguacaaugugcaggauguguagguuuguuacauagguaaaugugugccauggugguuugcuguacagaucaacguaucaccuacauauucagcacgggugguuguuucggaugcaaaccccugcuucaugcaguacaggaacccgcucacaucaauggcaggagccugggaggugcagaauguggagacgugagccuauaccuugccccugugcccuuccugccaauucugaacaccaggauucuagcucagagcggccgacuugaguggcacuccaaauuuucaagggaagucagagaucuggauuuggaagugaaacauuccuucaauaguauccauucgcuaaaagucaccauaggcgcaaaagccaaaaaaaaaaaaaaaaaaaaaaaaaaaacccaacaacaagaagaaaacacacacacacacacccaugacccaaggagaggacguuggcaacuccagacacucucuaucggccucccuccaaaccugaagauccauuucuucucaauacucaaugcuuuguguuucuauuuugaaccccucauuuaaagaaaaugaaucugccugguguugcugugucacuuuccuaucuguguggucacaggcuaugaaacugccccagcacugugugggauucaaaaaggaaaccagcugugcccugcgaacaccugccucccacucccuccacaguugacauuagaucaccacucuaucuuccuauuacucuucauccucacacagaagccaaucugggccuagcaugguggcucacaccugugaucccaacacugugggaggcuggggcagguggaucaccugaggucaggaguucaagaccagccuggccaacauggugaaacccugucucuacuaaaaaagacaaaaaauuagcugggcgugguggcgggcaccuguaaucccagcuacuccagaggcugaggcaggaaaaucacucgaaccugggaggcagagguugcagugagccaagaucauaccauugcaccccagccugugcaacaagagugaaacugucuggaaaaaaaaaaaauccaaucugugccccuggagucugaggggaggccucucucuccaucccacccaccaccagguccucccagaggcaacuccggguuuauucucagcaaugaacccacuacaggaucucaaacacucuuacuuuccuucugugcacuuccauuuccucaucugcaaagugagagaauaauucugagcccacaggucuguuaugagguucccaugaagucauauacggcaaggugugagcccaggugccggucuccuuguaaggacugacccagcuuggguugcuucccugcgugugucaucgaugccugggcccacacugcaugugucauugaugccugggccuacaggacuuugcgcacaugcagaaguacuuuguacauccugggagucaagucuuccaaacucaacagacuuuugguuucaaguuuucaccuugcccaaaaagaacaauaaauguccaaguaugggacaggagacuggucuuuuaggcccagcuuuucuagcacuaaaguguguuucuguucaucccccauaagacggguaaaagauuauaaaggaaagcagcccugauacccaguaagccuuuaggaaauuaagcccccacuaccagcaccccagagggaaucauucucuuguuuuacacugauaucucucagguuuucuucaaaguucuuuuuccaugccuaggacuaaagcuugcaaauagaagaaaaaaaaaauuccugaaucuucacaggagcuacaacugugaaaucuccuaauuauuucugauuuuacugugaauuccuagaaaugccacaucuccucccaacccagagagagagagcacccugaggaagagaaaagcucuaaugcucuaauguauucgauuggaaucugaagugcucuaucucuccucugaccgcccccgcccuucccuccagccugcugcuggggcaccauggaaaagucagaagcauuagucuggugucaaguggcacugcuauccacauucuaugagagucaauugcaauuaacagggucauucagaaaaggcagguacaggccagacaaaaggagugcagacagaucuuaucagagcccaaggccaacaagcugggucugggccuuucagauguugcuugcagaggaaacaaaaaaaaaauggugguggaaggugguagcgguuggaaaggcagacccagccagagggggaaaggacagggaaugaaaagagcugggcaacugaauagagagguuuaaagaacaaacacagacuccugggccuaugucuuggguucagauccugacucugccccuggccacuuaggaaacuugggccauucaaccccuccaagccuucguuggcuugucugcaaaaugggaauacaaaucgagcauuccuguuuuuuaaacugucauguaaaauaauugccaugggaaacaguguugaggguagugccugauauugggcaguuauuagaauaacuaagagaagagcuuagcuuggauuggggaaagcgguacggagaacccagagagaaguggaugaugugagcaagcuucccagggaagaacucaaacacugcacagacaggugagcaaguugaaagugauucugggucuaccugguagaagaaaccauggagaccccuucccccaacucagaggaaggacggacccugcaaggaagggaugcugguaccaauuacagaggucccccucugcguucccaaaggcuggaaaguggagacacacacaacacaauaggcccuggccugggacaauguuacccaggcccuagguccccuacacaucccuccauuuugacacucuuagcugccaccaaagguguuuaaagcuccuuucaaauggaagggcuuaagcaccuacuccgcgcuuagcucugagcccuucaucaaggagcauacaggaaaacaacgucuccagcccuuccuucuuuuaucuuucuuugaucugggaaugaugucagugaguaaggaaaggggauguaguagaagguuccaaagcaaccgaauuuccaaugucagguggaccacugaugaguuacaucacuguggaccauuggcuggguaucuuuaaaagccucaucuguaacguggggccagaaacaauuuuuuuuuuuuuuugagacagaguuucacucuuguugcccaggcuggaacacaguggcacugucuuggcucacugcaaccucugccuccuggguucaacagacucugcugcaucagccuccaaguagcugggauuauagguccccaccaccaugcccagcuaauuuuuguauuuuuaguagauaugggaagggucguugguuggggggaguucaccauguugcccaggcuggucucaaacuccugaccucaggugaucugcccgcuucagccucccaaagugccgggauuacagacaggaauauuucucaacacagaguuauugugaagauuagaaaaugcaggcagugugaugggcauugcaugcaugcaguuuauuuuucauuaguccacauuccuuggugugcugcagaugagcagggauuggacagcuugaacccucaaccugucucaaaugcgcacuugccucuguugggaauugcacagacaaggggaacgcguccaaaccacaccacccucuaugaccagauaaggaguuuuaacuaaugcacaggcccucagauugguccuuaacaauuggucuuuaaaugaugcagcucagggcuguaccaugaagagcguaucugaaggagcaaccaaauuaacaggagguugaaugccucuugccucccuuccagaagcaaacacaugacuccagagcagguggggagaugccacuccauucuuacuugcugagcuagguugccuguuuuuguucacacaccucaguaagugagcacuuaccuuucaggcccucuuagaauuccagaaacuugaggcuaaaaauccauuaauuaucaguuuuaaaaguucccauggagugagagaaaagagggucauuacuaguaagcaaaaggacugagaauggcggauggggagggcagcuacucuauuuucuauuaggaaaaaaaagauaguacacagcagaaccucauuaagucaguaucaguuuauucaaaagagcuuaucauuugcaacaacuauuccccaaucaacuggaugccucuacuguaaucuccuuuaacacugaaagucugaugauuaaauauauuaauauaucagagaggccaaacuugguuuauucaaaggugggggucuuuggcugugaugucucugaggugucugguagagcaauugacacacaguagguuugcaauaacccuuagcucccuccccuugcauuugggacuaucaaagcuuuaaccuggucucuaauaugucuaguccuuaucaauaauaaccugguuuccauuauaauauacuaccuuuuauuaaacuggagccagaaacucuuaauagcaagagccugucaaaggcauuuuaaucacuacuagagugcagaugucucuccuaggaaaacacaggcaguguuccgcagcgagcauaaggaccguccaucuaccuucguguuggcaggaugaguuacggaauuguauuaaccgugcaauuaggccaaggcuuccucuguacuuccacagugaccucucuuggcucuguauaauacgaggcacuuuucucuguguccugguuuccaaagcaucuuuuuccccuccaauggccaccaaugauaucugcaaggaaacgccaacuucugagauuugggcacgccuuccacuagcuguuuuuccaacauggacauccagcucaagggcaaaaugaugcccagggcuuuucauaaggacgaugacgacauugauguggacggagaugauguugacagcgcuaaguagugaguacucaccgucuuagugccugugugaaugcuggucaagcauuuuuagcacuucauccucucaacaacccuugaauaaagaaauaaccaacaucuucauuuuguagaugaagaaacugaggcgcagagaggaugagcaacuugucugcccuccccacccgccagaaaguaaguggcccagccaggauaugaacccaggugcacgacuucuaauugugcauguuucacaauucuccuucccuucuugcccagucaaggacaacacauuagcgcuccccuaguuccucccagaugagcagucgcagagguccccuaaucaggaucuaagggaguggccuagauccaaguccaccugccauccuuccucaggcuuuuugggcgauggauuaaagggacaaccaggcaucuguccaacaggcaaaauacuuaagguuuagauugaaagggucucacgcaucuaauucuaauagcccagagccagaccccagcaaauccugagucaggaagccuuugacugcagauguugaguggcaagagguacaguuuuggcauuaggcacauuuagauuugaaaucugacuuccuggcguaaucacauugggcaagguuuccuaucuguaagagggggaaauaugucccgcagggaagccgucaggguuggaugaggaaucccaaacgaaagcauggggcugaagcugguaugaauuuauuuacaggcucuuuacugcucuggacccuuucccuccuccucguucacaaagucagcacuuuucucaagcccaccuaaacaccagcguauacacaugcacgcgcacacacacacacacacacacacacacacacacacacucucucucucucucucucucucucuccagucgggugcugagccucuaaacuauuggcccucagcuucauuccguccagaugauguuuaucggcagaauccacugauuuagaacuuuuuuuuuuuuuuuuuuuaacacagagucuugcucugucacccaggcuggagugcaguggcgcaaucuuggcucacugcaaccuccgccuccuggguucaaaugauucuccugccucaacuuccugaauagcugggauuacaggcgcccgccaccaugcccagcuaauuuuuguauuuuuaguagagacgggguuucaccauguuggccaggcuggucucgaacuccugaccuugugaucugcccgccucgcccucccaaagugcugggauuacaggcaugagccacugcgcccggcugucccuacaacuuugaacagcuccacuugcucucccagucaaacagcauuuuuggugccugaaugagggaauaagugaaagagauaaggaugacuuaaaaauaagagcugaagcguaucauuuccacacuuggacauuucagcauccauuuauaaugagauacuugucauacacuuaacuaacugccugcucuuagcucaccacuauggcauuccuauucuccuggacauuuguauuuagacacaaaaaagcgaaucucuaaugcuaaaaauuuuuauuccaaauguacaaaaaggucucucucugguacagagucauauagcugcaucuccaaccugcaccuucucuggguucaagagugcucacuguaugaaaaacaggguccaaccccacagcuggcugucaguuggcucgaggguugccucuuuggucucucuaggggcucagacuaauaaaaggacacucagccuuuggucggcagagcuggaacuguucucagcaaugagaaaucuaaaaaaaaaaaaaaaaacaccucagaugguuccuccccugcucccguaggugaccuacaugugagugggaaggaaaacaggucccaauccccguuugaugcacucgggaacacagcccggguugcaccgcacaccacagccuggaguccucuugaugaaucauacauaagucggagaagaaagccaggccugccagcccaacuuugcacuucacagcgaagcauaaaagcacgcaggagguagcacaaguugcuuucuugagaagcgggccuugcagcaauguuuaugaaaaggaggagaccuuuguaguggcaucucugaagccagaggccugccagcguacucaucagaaacccgcacagugaaagguuggaaaccagcguugccaugcguuagcuagagaacacgggcaggaccuaaccaaaguucugaacucgugguucuguuuuaaagucauacgguacaaaaugcaguaucaccugcucaggcuugaagacaggaaggguggagagggaggggugaaugaaaaauugcaauccaagagcuccuagguucaaaucccugcccugucccgaccuaguuggguagccccauagaagauacuuaugcucugcaauccuuaacuucuuguuuuuuuguuuuguuuuguuuugagauggaaucuugcucugucaccuagcauggagcgcaguggcacgaucucagcucacugcaaccucugccucccaggcucaagcgauucuccugccucagccucccgaguaacugggauuacaggcacacgccaccacacccggcuaauuuuuuauuuguaguagagacaggguuucaccauguuggccagauugcucucaaacuccugaccucaagugauccacccaccucagugucccaaagugcuaggauuacaggcaugagccaccaugccuggccaccuuaacuucuucaucuguaaaauggggauaauaaauguuggaucccucuccaacauggcccuaccuuucuauuacacguagcagggguggagaggcgaucaggcaagaauuuggccaaguaggccgggcgcaguggcucacagcugcaaccccagcacugugggaggcugaggcggguggaucaccugaggucaggaguucgagaccagucugaccaacauggagaaaucccaacucuacuaaaaauacaaaaucagcugggcgugguggcgcacaccuguaaucccagcuauucgagaggcugaggcaggagaaucccuugaauaugggaggcagagguugcagggagcugagaucgcaccauugcacuccagccugggagacagaacgagacuccaccaaaaaaaaaaaaaaaaaaaaauuggccaaguaagugggggaagagagugucugugguaugaggaggacacuaagggguucuaucaacaccuugcucguuucucccaccccuuucuuggccuacacccucuucaaaaaaauaacaucugcgacguuaaguaggaaagcccaaaagaaaggacucaaauacggagguagcggaauaacucaauaaugacucugauacuuugggcaugcugaccuacucugugucaaauacuauucuacguguuuuagugaauuauaucauuuauuccucacuccccuccaaaacaaucccuggaagcaaauacuaguaguauuaaccccauuguacagauauaaaaacagcucagaaagacaggggcauucugcaacuugucacuuaauaugagagaacuggaauucaacccagcuauuucugacucuugaucucaaguguuuuucuaucaagcagcuccuugcgaauuugcuaguuuggucuccaguuucuggauuucauggaccaagaagacuuuuauuuuuuuuaagaaaaaauugggaggucugaaaucagguugucaacuuuguuuuauuuuuccgaguaagcagacuuaaaaaaaaauaaaccaccuccaaucacugucauuucauagaagacagaauaauuuaaaucaaaaagugcauguaagacagaagugccaauaaaaagagagcaagcuucuccuacuucuaaucacuuugaaaagaauauuuuggcuggguauggugguucacaccuauaaucccaacacuuugggagacccaggugagcagauugcuugagcccaggaguuagagacuagccuuggcaacauguugaaacccugucccuacaaaaaauagccaggcacgguggcacacacguguagcccuacuuggagggcugaggcaagaauaucucuugagccugggaggaggaagcugcagugagccaaaaucgugccacugugcuagacccugggugacagagccagacccugucucaaaaaaaaaaaaaaaagaauauuuuaacacugaaaauaucuguugaacauaaucucauaauaaaggacaaucauauaaauuaaacugauuuagcuuuauaugaaauaagucauacaucuguccuaauucuuccgcaguuugccauagcuggaauaucuugaugaucgucaguuugaguucuguuuuggggaauggaugcuggaccuguccagcucugucucagcaaccaugagcagaaauauucugauguggugaggccuugacacaagccacggagaaucuugggugaggaagggguggaugagaugucacgacugaccugcauccacuccuaaaugugauuuguacaguugucccucaguauccaaaggggacugguucaaggaacccccccaaauaccaaaauccacaaaugcucaagucccuaacauaaaauuguauaguauuugcauauaauguaugugaugcuccuguacacuuuaaaucaucucuagauuacuuauaauaccuaauacaauauaaacacgauauaaauagugguuauguuggauuguuuaaggaauaaugacaaaaaaaagcaguugguacauuuucaguacagauaccacccuccguuuguucgaaugcuuuuaaucugucauuaguuaaaucuacauauguagaacccagagagaggggggcugacugcauauggccucuuucguucauucacccaguauuuguuggcuauuuucuugaggucuggucccaacuaugucuuaggaauacaacugugucaggcacugaaacgccaacccagguuuggugguuugcaaggaagacucauaagacucagcauacggucacacucauggcugagauuuaucacagcaaaaggaugcaaggcaaaaugagcacagggaaauggugaaugaggcgaagucuggagaaaaccagguacaagauuccaaauguccucuuccaguggggucacacaggaugcauuuaauuagucccccagaaaugagcugugaaaauauauaugaaguauugucuaccagagaaauguauuagggacucaguguccacaguuuuuauuggaaguuggccacguaggcacccucucuguagcauauaacaaaauuccagccuccacaaaggaaagcagguauuccacaugagcccuauuuuugguacaagcagucuagacagagugagccaucuuuaucugaucugggaauggugacagcccuccuaaauuccaaguucccagaugcagccaagagccaagcuugcgacagucugcuguacuaacucuuucccacacagcaacagugagcaaaauaggaccccagugccuggccuugugaaacuuacagccagaugaggaauacacaaucaucacgccaucaucauucauucauucauucauucauucaacaauuauuuuugaggacucucucugggccagugacuggugacagauuuucaaugaaauagacuaaaaucccugcccuugugaagcuucgagucuacaugagugagacauuguaagugcuaaggagaaaaaaagaaggcagggaagagaaguggggaggacaaauacaguugcuggaaaagggaaaauuaacugaguuuggauaauuuucugugaucuacguuaauuuucuauuucuaaaaaucuacuucuuagauaauuuucuaaaaacuaaaacucaauuaauuuucuauuucuaaauuaguuuuuucuauuucuaaaaauccacuuuuuuggaaugaguucaaagaaauacuuauaugaaagaccccugcaccccagagaaagugaugauccauuugaagccuaaaugaugagaaagaguugauuagcuaaagcaggaugggaagacuacucuagccagagacaagagccugugcaaaggcccuguggcaaggagcaggguagguagcagguuucuggggaaagugguacaaaguaagcugcagagguuggcaggggucuugcaggcccuggaaaggauuuuguuauuuuauccuaagggauauggugagccagugaagggauuaagcagggaguggcaaguagggugguggcaagaucagauuucuauuuuagagaaaugacuccagcuucugccugaagaagggauuucaagagagucaagaggggaagcagagaugccagugagaaaucuuacugacaacacugcuauauacggcacuaacucacagauuuggaauucacccuacauugcuaucaagugugcuccugggagacaaaggaaggccuaaccucaccaaugucuuaugaccccaucccuugcagaggaaaaaaaaauaaaauacccaagagaaaaagucuuccuguuuucagagucuuuaaaauggcauaagaaccccaaagggaaaacuccaacaugggaaugcgagcaguggugcccuuugaaaaguuuucauuuuauuuuaacuuugcuaaaucuacuuacauucacauuuugaaauauguaagcacaauaaaacacugcaguuauggucuauuggguuaaaaauccaguuuuuggaacggguucaagggaauacuuauauaaaagaccugagaauggaaaguaauucugcagauaaaauagaacggaaacaucuccuaaauaugccucuuguaagauaaaugcacaaugaggagggggccugggaccaucacuaaugggagauucacaacaguggccucuuaaucccucacgaaaccagcuggaagggaagcgccuggcuagucgucggcaucaacauucagacuuuuccaaaggucucuccucuuccuuucauaauucauuugaaagcaagaaauuaacccugaauuuaaaacagugaaauuccauucuagcacgucacucacaaagcacggagugaccaugguguuuauuuugcaaaguuccagacaaagagagcuaaaaaaaaaaaauugcuggaauaaauccaucaacaggcaucucagugcuuauucuguguaauuauccuugcauggggaggcauacaaaaaaaggaagaaaauauaguucuuauccuuaaggagcuggcaagucuguuagguggguacuuuucagcuccauguauauaucagguccccuugggagcuugauagaaauacugauucucggcacccacaaucccccaaccccagaccuaguaaaucagaauggccacacggggcuugggaauguauauuuagagcaaacaaaggggauucugcuggaaggcugagauucugaaacacugaacugaaaagaaagggaaacuucaggaaacauuagcaccacucaaugugacaugagggagaggccuuacuccuuaguuggccaaaccguccacucaagguagcaucacucagacggcagccaugacaauuccaagcauccagcuuuugcuuucccaccuccaacaaaggaagcagauccucggugugaagguucauuccacuguagggccacuaucuacugcuccuugaaaauccuuacaaaaucugacacacccuguaucuuuccuuggguuaaacacaguuuacugaacucuucaccccugguccugaggcuacucucccaaggacaaaugccaguuugucaacagagcucucaacaggugacacucaaggcagaaaacaagauuccagacaaguucuggccaacgccaaauccacgggauucuugccucucuugauccagacauuugauguugacuaacacugucuaagucggcaucaucuugucagagcccaacacccugaaaucacugcauacucuacucugcaccuuuugucuagucaacuuuuccaaaaugaaauagaguuaacauaggugccuccauguuguuccagagucuucccaggauuugcaucaaaguuauuuauuucuugucccugucaaugacucuucucuccccaguccacauucauucuuugucuuccuauuuauguguccaguuuuuccucuuuauucuuuuucuucuccuuuucucugugauuuuacaaagauuuccaacagaacaccugaacucucauuggugacuucuuguuggcauccugggccauuauucaaagacuuacaggaucacagaaugucaagauuggaagaggccuuggagaccagccacagaaaaccccuugucauaaacuaugguauagagaggacacagguaaaacugaaucgcccaaguuugggguuaagccaaaauuaggauucaggucuucuccauacugaguaguuugugauggccucccuuugggacuuuaagaccagacuaguuggccaaucagguuuggagggcuauccccuggggagguaugguagcaaacacaccuggggcacagggggaagaguggccugaaaggggccuaaauuaugcaaaguaaaauguaaagugggagaacucacccacacugccuacugcucuaguaugauuuuuauuuaaaacaaaaaaaagaagaauauggcugagauuccagaaauuauaguagcaugcugcccuuuguguauguaugagguggggggaagagggaagaggaggcacaaaaagcaaaaaagaagugaaaacaaaaccaaagauaaaaacacaccacaccaugauguguguacaucacaagaacacaggagccaacagcagcaacuuuugaagaccaaauuguuccaucuggaaaaauuuaagcaacaaaauaaauaaaguaguauaggauuauaacauaaagcauaaaauaaauguccaugaguguaccgugauauaaauaaaugauuaaauaaauaaaugggggagaagacacaaauauuccaugcagaauuccaaguaguuuaugcagauacucuacccucgaagagugagaacauuaaauccccacuccacaagcaugagcugggcacagcaacacuccuccaaaggcagcaguguggaaaguagagggaaagacuaagugugcaguggagaaaccuaaugaacacuaccuugaccaggugaaucagagucaccaucaacagugaagagucaugaugaagguggaaugcuugauacgaugugaugaaaacagaccucuggggucuuccucccugaaauucauuaacuccaguaaacucaugagaaaaacaucauaaaaaucccaacacaggagcauccuacagaauacccaaccagcacuccucaaagcugucaaggucaucacaaagacaauucugagaaacugucacagccaagaagaugcuaaggagaccugacaauuaaauaaaaugugguauccugcaaaaauuagcugagcgugguggcgcaugccuguggucccaccugcucaggaggcugaggcaggagaaucacuuaaaccugcgaggcggagguugcagugagccaagaucgcgccacugcacuccauccugggcaaaagagccagacuccaucucaaaaagaaaaaaaaaauaaauaaaagugguauccuggaugggcuccuggaacacaaaaaagucauuagguaaaaaauuuuuuaaaaaccuaaggcaauaugauaaacgauggacuuuaguuaauaacaauauuagguugguaaaaaguaauaacaauauuagguuggugccauuacuuuuaaguaauggcaaaaacugcgauuacuuuuaaguaaugcaaauuuuacuuaaacuuacuuaaaaacuuaaguuuuaaguaauugcauuacuuaaaaacuuuuaaguaaugcaauuuuaaguaacggcaaaaaccgcaauugccauuugccaauuacuuuugcaguuuuugccauuacuuuuaaguacuggcaaaaacugcaaaaguaauuggcaaauggcaaaaaaacugcagaaguaaaaccgcauuacuuuuaauagcaaaaaacacauuuacuuuugcaccaaccgaguauuauuauuacuauuacuuuuaauggcaaaaaccacaauugcuuuugcacaaccuaauauuucaguaucaauaauuuaaucuuaauaaauguaccaaauaacauaagacguuaaaauaauaggauaaacuggcuguuacacacaugggaacuugguacuacagucuugauuuuucuuuaaaucuaaagauguucuaacgaagucuguuucaaaaaauaaaauauguaccaacugaaauuaaacaacagcauauagaaaagcauauggcauucuaguaguagguuguggauugugugggggugaauuucagggauccaguuacccucaaauggaacacgcuggccuuggauggggaggcuccagggauuccuccccuuuagugaggagcucagucaggggaaccacagagggacugaggcuaaagaguggggcuggggcagcgaccccggugaccccagccuaaacgcagaacugcagcuguccucaugaagcugaguugucaaaggaucccucagcgugauuggugauguucuccagcaaaguuuuaguagcuuaggaauggcagccaagacuucagacagcuugggaccugccauguguggcggcuacaaaucaaacgagugccagggaagacaccucuucccaaagacaggcucuuguuccagugauggaggcagaacucagggucagcggggacauuaaccaggauaugaagggggccaugauguucuuacccuuuagguaaaaugaacaggguuuuguguguacagacuccaggugaacaucaccuuucaucaccaugccagcauucaaaaucauguucauacgauaucugcuccuuuaggcaaacaaauucaagccagaaaucguacagggaauaauaccuucucguucaccauugugucguucugcaauaaauaauuuccagccagggugcuggagaauuccaaaugauagacauauuauguucaugaaaggcaacuuugagaaaaaucuugcugcaauaaaagugaggguuuuuucccccuucucagcaucucagcuugccauagaaaugagugauuuucugaauuucugccaaguuagauggguucaguaugcuauuagauuagucuguuuauacagaaacagccaaaaauaggaaacacacagaagcuauuaaagauauuguccugugagggaaagauuugaaugguuuucuuauugcaagugggaaauaagauaugagucaguauuaaugugauaaagaaguuaaugcacucuaaagcaaaccguccaaaucuucgucuuguuucagaggugacaauaaaaggaacauccagacaauuauuuaggguuugguuagcaaaggaggcagagaaacuuugcagagccccugccaguuggaaauacauguccuuuaccacauaaugcuggggcacccagggaguuuuccgaagggaacaugauuccacgaaaaaaaaaaaaaaaagauuagaaaauaaauaaauaaaacaagguuucagaaauucaaaagcaaaaauuccaauuucacuuuugcccuugaguuguugugcaaacaaauggaaaucauaugaccuguuaggucaaugugauucaagaagcaggacauauauugaauucuacgugcaagaugcuguggguucuuacuuuccucaucuauaaaguggauggugcaaccuggacuuugaaguccccucauuucuccucaguaagucccaacuugaccuguagagcaaagacuuugccacauucuggucacaugagcugcuccugaugauauuuuauucuauacaauaugugacucuguagguggaagugugucuaaauaauguccguaugaaucccaguaauguauguauauuauuuucuucuucauucauaguggaaaauaaugaaaaauagaacuuuccucaaaaaguacacuuuuuuuuuuuuuuuuugagacagagucugacucuguugcccaggcuggaggugcagugacaugacucagcuaauaacaucauggcuccuuucacaacuugguuaaugucccagcugccaccgcacucacugcaaccccugccucucggguucaagugauucucaucccucagccucucaagucgcugggacuacaagcaugcgccaccaugccuggcugauuuuuguauuuuuaguagagaugggguuucagcauguugcccaggcuggucucgaacucaugaccucaggugaucugcccgccuuggucucccaaagugcuggaaugacaggcaugagccaccgugucuggccaaagaguacagguuucuuauaagaucaucaaauucccaucucuccucugaaaccuggugaguaacuuagaacuugcugugcagccaaaugccaaagaaagaugcagucucugucuacuauccaggguguacacauuuucuguugccaucuaacaaauuaccaaaagcuuaacagcuuaaagccacauacauuuauuaucuuaaagcuuccauaggauaggagucugggcauggcugagcuggguucuccauccagggucuuaccaugcugaaaucuaguugccuaguggggcugcggucucaucagaggcuugacuggggauggucaaucaccuucaagcucccuuagguugcuagcagaacucauuuccuugugguuauaggacuaauguccucauuuucuugcuggcuuccuuagggcacucucagcuccuagaagccaaaugcaguuccuuacugcaaggcagcuuacuuuuucaaagccagcaauggagagagagacucucuuauuuuagcuccucuuuaagggauuuuccccuuacuaagucaggcccacccaggaggaucccccugcucauuaacucaaaaucugucucauguaagaccuuaaugguauuuccaaaaucccuuugcuuugccauauaguguaaccgaaucuaaacaguuacauccuauuaucuuuuucauauucuauuggucagaaguaagucucccauaucccaccuacauucaaggugggggaagggugaucacaucaggccuuggacaccaggaggugggguaucacuggggccgucuuaggguccaucugucaaacagaggaagaaacuacaaggguucacuuuuuuuuuuuuuuaagauggaguuucacucuugucacccaggcuggaguacaguggcacgaucucagcucccugcaacccccgucuccuggguucaagcgauucuuaagucucagccuccuguguaccugggauuauggguguacacuaccacgccugacuaauuuuguauuuuuaguagaggugggguuuuaccauguuggccaggcuggucucaaacuccugaccucaggugaucugccugccucggcgucccaaagugcugggauuacaagcaugagccacugcgaccagccacaaggguucacuuuuaucagaguagggucagaauuuauuuaaucacgagcuuagaaacuuggugcaggagagaagaauggagagaaaaaggauagaaucccaaauuucuucccaauagucauaucuuuucaagguuuuacuaaaauuaucugcugcccagguaugauguaauaaaauacuggugugcuuagaaugcacaguuaaacuucagcagcuaacaacuggguagccaaaacuuuccuucaacuagcccaagaaugacauuggacauccaggagcacuaaaacaucaagaaaaaccaguacaauuucaaagacaaaccuguguccaguugucuaaaagauuaaaacaagaaggcugggcacgguggcucacgccuguaaucccagcacuuugggaggcuaagguaggcagaucaugaggucaggagaucgagaccauccuggcuaacauggugaaaccccaucuuuacuaaaaaauacaaaaaauuagccaggcaugguggugagugccuguagucccagcuacuccgcaggcugaggcaggagaauggcaugaacccacgacgcagagcucguggugagccgagauggugccacugcacuccagccuagacaacagagcaagacucugucucaaaaaaaaaaaaaaaaaaaaaaaaaaaaaagauuagaacaacacaagguuaaaggugcaagugaaucauugaauauacuggccaauaaaagccaaguucugagacuaccaaauagaaguaaaauggaaauguguaucuaaguagagggagagaugcaacuggaagaagaaaagaauaagcaacuccaagagggaaaaauaaaucaguuaccaggggagaggugaaaggggugaggaugaggagguaagacagcagcagcaaacugcccacuaggaggaacuggguggguggugaguaggggguuagaagggggcaugaaaagauagaucugugaguuaauggaaaguucaguuaaccagaaugauaugccaguuaaguacaauuccaccgagcuuggcagccuuauucuggccauuaacuuuaauguuucgcagauccccagcauuuucacaggugugaguuaaaaccaucugguuucugcacuauacccugcccauuaaaacccagcauuuucaaagauaaacuguggaccaagguggcagcaggagaagagaaaggaaguuaaaggcugccacaggcuuuaccuuaaacagaaggagccuuucaacagccuuugaguuggauuauuuugaaauugcaauguagaaaaaacuaaaaauacagugagaugcuuuaaucuccagaaacacaaucuggguaagugaauugcucaaaaauaaaauuccaaccaaauauacgcaauacguagugaccuggacaugaaaaaaugaaagaagaaauaaacugaggaagaaauccauauccaaaaguaugucuuuauaguagugauauuuauaaauuugacacacuugccagcagagcucacuaaagauuauuucuaugcaaauaugcauuuugcuaacccaucgcugugcaaaaaggaaaaaaaaaccauauuuccugaaaaucaauucuugugcaguacaagugcaucaagaagcaggaaguacacugacaaauacuaaaaugugccaaauuuucaaacuucucaggggacaagagucccagauaagguggcagaggacauaaaacugucccacccuacccacuaucuagugucuagucuggagaggguacaugaccaaggcagcucugccaaugauacagcuaucuucucccauccagggaccaaguuucggccuugaaugucccaagcaccaugguuuuuuccaguugauacagaaacuucuacacgagucuguuggaggaaacuugucaaaccuaagcaccugauugauaggaggcacaaugcagggauucuauacagacauucagcagguucuuagcagaaagccaugggccaauccucuucuguaccuuaacaaacagcccuccuaacagcacaauuaaaacagcuugcugcuucuugguuaagccaguuccuuagauuucucauuucagaaaccaaaagguauaguauuauuauucauccuacucaccauuagcuacuagguacaccauccucaucaacugugugccaaauacuguccuagguauucuaacucauuauuaauuagagaugaucuuccauuuggcagaaaaggaagcugacguuagagauuagucucauuuucucuuucacuugguuaaucaggaguagugcacaugcuacaggaacucagauaaagauaaggccuaugguucuguuacuuuuauuuuuauuuauuuauuuauuuauuuuggagacagguucucacucugucgcccaggcuagauggaguacaacggugcaaucaugguucaaccuccuuugcucaagugauucuccugccucagccuccugaguagcugggaccacagacaugcacccccaugucucauuuuuuuguugcuuuuauuuggauacagauggggucucaugauguugcccaggcuggucuccaauugcugggcucaagugacccuccuaccuuggacucccgaagugcuggcuuuacagacaugagccaccacgcccaauucacaugguucuuuuuacuaucacuauugccuccauuuacuucuguauuuaacaaauuguauaauaaaauugagauuagaaguggcaucacagcaggagcugaaaggggauaggaggagguuggcaggguccuguaauuauucuguguauaacaugugggugcgggucacccaugugcaugcaguguguacaaauuuguugagauauacaccuggagugugugcccuuuucuacuugcauuacacuuuuuuuuuuuuuuuuugagauggcgucuugcucuguugcccaggcuggagugcaguggcgaucucagcuuacugcaaccuccgacucccagguucaagcgauucucaugucucagccucccaaguagcugggacuacaagggcaggcccccaugcauggcuacauauauauauauauauauauauauauauauauauauauauauauauauauauauauauauauauauauauauuuuuuuuuuaguagaaaugggguuuugccacguuggccaggcugguuucaaauucccgaccuccagugauccucccaccucagccucccaaagugcuggaauuacagacaugagccaccccaccuggccuaacacuuaaaugaagaguugaggaaacuuugcccagaaauuucaguaucuuaaagucuuuguucuugcagcagcagugggaguugcaccuuucucugacuccaaggccuccuacuuggagaagauccaugcugggcacauccaagguguccgcguauagccugucagcugggucugagugauuggucacugaccaauucaggccacagggcagcgacuccaagcuuccuucuccuccucucaggucucagguggggaagacaguggggaauucucucaugagucauuauacauauuacaaggaagaaagcaacucuagcuuuauucccccggaucaaacauggauccuguugagaagaggucucuuaugagagcguacugugucccagacuuuguauguggaagcccaaacccccaguaccucacaaugugacuguguuuggagacagagccuuuuaagagacaguucagguaaaauaaagucauuauaugguggacccuaauccaauaugaccagugcccucacaagaagaggccauaaggaugcaaacgcacacagagggaagaccaugugaagacagagaagauggucaucuccaagccagggacaaugguacagagagaaaccaacccugcugacaccuugaucuaggacucccaaccuccagaacugugaggaacuacauuccuguuguuuaagccaccugaccugugguauuucuacagcagcccaagcaaaauaaaacaagcuccagagugagaacugcgucagugcuuuuccauuucagauggacagagguuggagagcaaggacuuuagaaucagugagaucgggacucaaguccccacuuugugcuguggccuucagugagugauuuccugccuccaagccuugcgucucucagaggcaaaauguggacagucauggccucuuaggcuugccaugaaaauuuaauucaagaacacaugaauagcacugaacacuacaucuggcucauagcaggugcucaauaaacacuaauuguuaacauuauucauaugaaugauaauauaaugaagauuaaaaguccuuucccacucacacuuuguuauaaagaugggcaaugugcacaugaaaagaugcuaggcaaagauagauucauauuuugacagaaaugucaaaauauagcaagacaccuucauuccaucauucaaauaaacauuaacggaguuccugggaugcuggaggcaacauguggauagggccaaugcgugagaugcccaagauggcacagaaaagacagccaugcacaaagauuuccugggacugggaagaaugcagcggggcccacuggaauaccugagcgccaugcaagcuugaggagcagggggacucacuucuaguuugggauugggggauacaccucagggaucaucaccugcuuuccucagaacacacacaagcacguccucagagaaagacgugggugcuucuuuauguggcuucuuaaguccaccacuugugcucggcaaagucacugcacugagcauugugaaugaacgaucaauuucacgaaauacuuaggcaaagcagcaaagccacaguguggucacuuuuuuuuuuuuuuuuuuggauacaagguuucucuguguggcccaggcuggggugcaguggugcaaugucggcucacugcaaccucugccuccugggcucaagugauccuuccaccucagccuccuaaguagcugaggccacaggugcacgccaccacgcccaccuaauauuuucuauucuuaguuucaccguguugcccaggcuggucuucaacuccggggcucaagugauccaccugccucagccucccaaagugcugggauuacaggcgugagccaccacaacaggccuaucaccuuuuaaagacuaaacugaccaguugauguggaggguugaacagaauguccaagcuauuuuucuggccaugugcauguuagagaugcauggcaaggcugccaaaaucaccacgcuggguuuugugucuucucagaucaugucuacuaucugacaugugucucuuguuaaagcaaaaggaacauuauaaaacauuauuguggucugaauguguccccccaaaauuuauauguugaaauucuaaccuccagagugguaacauuaggaagugcggacuuugggagguaauuaugucauuagagugaaggcuuccugaguaggguuagugcccuuuuauuuacuuuauuauuauuaguguugauggagucuccucccucugucucccagacaggagugcaguggcaccaucucagcucacugcaaccacugccucccagguucaagcaauucugccucacccuuccaaguggcugggauuacaagcacaagccaccgagccuggcuaaguuuuuaguuuuaguagagacaggguuucaccaugucagccaggcuggucucgaccuccugaccucaagugauccaccgagacaccugccucggccucccaaagugcugggauuacaggugugagccaccacuccuggccauuagugcccuuuuaaaagauaccccagagaguugccucugcuaguugagaaaauagcaagauggacaccuaugagaucaaaaacaaauccucaccggacacugaaucugccagugccuuccucuuggacuucucagccuccggaauugugagaaauacauuuccguuguuuauauauuauucaguccauggcauuuuguuauagcagcccaaaaaaacuaagacaaacauccuacuugcuuauauaauuaaaaaaaaaaccacaaaagugugugugugcuuguguggccgugggaaugcauacacauggcagggaaagccgaagacaauugcuaccaauacccuuuccaggccaaagacacaggguagggaauucuacguaggaagugagaagaauagcuaauguuaucuucuucuuaaagauuauccuggccaggcacaguaguucacgccuguaaucccagcacuuugggaggccaaggcaggcagaucacgaggucaggagaucgagaccauccuggcuaacacagugaaacccugucucuacuaaaaauacaaaaaauuagcugagugugguggcgggcgccuguagucccaacuacucgggaggcugaggcaggagaauggcgugaacucgggaggcggagcuuacagugagcggagacugugccacugcacuccagccugggcaacagagugagacuccgccucaaaaaaaaaaaaaaauuauccuauugauuuccuaaaacagcauuucuuccuucccuuucuuucaaccacuacuguuuauuuauuauguauuuauuuauuucauuuauuuuuuggaaauggggucuugcucuguugcccagacuggaauacaguggugcgaacauagcugcagcaaccuccaacuccugggcucaggggauucucuugccuuaccuuucuaguagucccaagcagcugagacuagagaugugcaccaccacacccaguuaauuuuuaaauuuauaguagagaugggucgugcuaugcugcccagccuggucuugaauucugggcuucaggagauccuccugccucagccucccuacguguugaaauuacaggugugaggugcugcacccagccccaacaacuucuuuuuagccaacuauacaccagguaccgagucgcggagaggagagcaaaggcagcccaacuccuaggggaccugacgucuguagcagagccugaaacuuaggaucucccauuagcgccuucaacaguggugaugcccuuucaaaaaacagagaguuucuagaauguuauuacuuagcuuacaaccucuaaaaaauaaugggaaugugaguauuuuaauuuagcuaaaaauauaaacuuguacaaauuauuuuacacauagaauuucacuagaguguccccagacucaggaacacccccuauuucugaauugacaaugcauuagcccuaccuucuagcaagauuagggagggagcuguauauaacacagcccagagcaaaacgugauuaaacauguaucaacugauuaaagcaagcaucacaaagagcuauggaaaaggaaaaucuaagaauggauuuaaaagauggcuugauggcugcagcaaaccaccauggcacauguauaccuauguaacaagccugcacguucugcacaugcauuccagaaguuaacuuaaaaaaacauuuaaaaaccaaaacaaaaagacaacucugucaauauuucuggaguguacauaaaacacgucaaggaagagccugcuguuggccccgucccucuucauguagcguuaguaucaaaaaggcgaggcccuguaacuggacuaagguggaggggguggucccucaucugccauacaccuaugucucucuagcucaaagacccacacauuccccugaaauuaagagaauggcaucaacagguguucaaucugcuccccaaggucagcuucagaagugagcccagcaggacacacaccgugaacaggguggaucugggcuggcccagaggaccugccgcccucaccccagccagaguauaggagauaccucagggccccggcucaaaggcagcaauguggacucagaauaaaugaugcauugaagauaugauaagcaugauuuuaccaaaaacagaacaauacacacacaaauaaaccauguuauucuacuugauucccucugcuuugugcaucuauuuaucuauacugcccaagcuggaaaggacuguaugaaacccaaaaggcugucaacacagauaguucuuucaauaaccauuugauggcaaaagcagucuacagcugacagaaguuguuugucccacugagugugaauauucauucauucugaugugagauauucaugugcuuaauuacaaggugcuaccuccaggggugacacaacaugcaagguucagcgcauuuucugcaaagagccagauaguaaauauuuuaggcuuugugggcauaugguuacugucaugacuacugagcucugccaacguagcugaaagcagccaucgcaguacguaaaccaacagguacagcuguauagcaauaaaacuuuauuuacaaaaacaggccagauuuggccuaugggcugugaauuugcugaccccuguaauacacagaauacgcaguguauucucuucuuaaaauuugaaaacuucugaauucugaaacacauccggcccccaaaguuucugauaagggguugggaucuuguucccauuuuggaaagcauucucggcuggaaaguucguuccaaagagcuggggccuuccuccagucacugcuuagcuagcuuucccagguauucugcagccaucucuagcaauacuuacacaacaacaguaguggugauugcaucuugaauccggaauucagguguguugaaccaguggagaacacccacuaugggucaauuccaucagauaauuugcaugcagguuuuguagagggagaaagcauaaaugucccuuguaagggggagaggaaacuggcaggacagcgauucugccagagguagguuucccagaugacccucauagacaccaaucugguuucaggaggggccuuguaacagggacacucaggcaaccccaggguccagaugaccaagugcgacacagcauggggacaaaucacgcaucgggacuucaaggaacacacuggggcuuccauacgcucauguuucugaaagagugaucccugcccuaggcccggagaagguagagauguugggaaugucaggaaaugggaccugggcauagacguucaugugaucggggugaugggcaccagcaucaaaaggcauggaggggaguccucacuugucauugugagcagaggagcaagcaggaaggccccaugcaagagaagcugagggcagaaaccaugaguuacuaaagcacaguuuccuacaaacucucaagaggcaccucuuggggaacccagaaguacugagugguguucugagaaggacagggucauagauccacagguagggugaaaggcaagguugguagugaccccagagcaucuggaaaaaaaugagacacauacuaaaauuuacuauuucuugagcacucauguuacccuaagggacuaugcugaaugccuuagagacggugguucuaauccuuacagcaauccugcaaaguaaauauuguagccuucauuuuguaggugaaaaaauuaacaugggcugggugggguggcucaugccuguaaucccagcacuuugggaggcugaggcuggaggauggcuugagaggccaggaguuugagaccagccugggcaacacagcaagucucugucucuacagaaacuaaaauuaaaaauagccaggugugguagugcacaacuguaguccuacuuggcaggcugaugugggaggaaugcuugagcccaugaguuccaggcugcaaugaaaucugauuguacacugcacuauggccuaggcaaaagauugagcucugucuacaaaacaaaacaaaaacaaaaaccuacaucaugugccaagagccacccgcaccugcagagaaaaggcugggccccagaugccugacucugaggccuacgccacgcugccugccguaagagaugggcccuccuucauaggaugacccaucaaauguauggacacaaagagcuugucuaccuucaaguuuuaccuccuuuagaaaucaacauccaagucacuuugccauccuucacaaaccuucaagggcccuugcaauugcuuuucauucuuguccauuuacaccucuuuguuagaaucacucuugggaaacagugcucuccaaagaauaccuccucacugugcuguaagcaaauucuggcccaaaggaguagguaauacaaguuuccucauuuccaucucaaucuaccaacacuaaagaauccuaaaggauaugccaggugcacaccaggauccaacuugcuugagaagucuuaagucuucagccaaugccuauugaaucuucuugaccccaucugugggcuaggcuguauggcuguucuguucuuugcuacccuuccuauagcucauuggcuucuggcuuguauacaugauuugcuucagccaauggaaugagagaagcaaugccacgccccuuccaaaguagaaacuuuaagauccuuuggucucaccacuguucuuuuuccuuuccuugacaacaauacguuccuugacugaagcugauacuggagugagaucagagcagcagccaaccaucagcgacaugcaccauaagugagaaauauaugaguugcugaaagcacugauauuuggaacuguuuguucugcguaaaaaaucaugcagaggcuggcuaacgcagcaucuaacuaucauuuucccaaauauguugccaaaauaacucucugaaauugagacuaagcuucuuggucuugcuuagggcaguacuggccauacagagcuggccaguaccucccauaagugucugugggaaggaggagggcagggaggccuccagggaggcagggcagucauaugaccaggcucauuucacacaauaaaaugcaccaaagaauucccuuaggauagacaauuuauucauuucaaaccaaguaaucuccuuggcccccagccccauccucaaccuccuguaguuuuguuauuuuuguauuaucuaauugcguugacaggggauuuaaaauaaaaggcuagguugaugucaucaacgcuugccuaaacauaugagaaggagaugucuuucaccaaaagucucacgaaaugaacguagcaaaucacaaauuacucccuuguccaagggcaaaauuucaacuaccuauuucagucguuucaauaagcaaaucucuaauuaaaugaugaacaacuugucauuaugcuuuggugaccacacacacugggauauacauuuacuuguuaaacucaauuaaacaacauaugauugaaauuguucuucauauugcaacucugccugcuuccuacuugguuuuuuguuguuguuguuguuuuuguuguuuuuaauguuaagaaacaugucucugaaauuccguucguucucacuguccugugcuuaaugagaaauuguaggcuuccugucauuaauugcaagaauacguuguucuacuuaaugccacauuuguaaauacaaacuauuaauaauaauaaugauaaugcccccagaguuugcugcauuccaaaccuccagauuuuauaauaucagagccaugccauuagccccgacgguuugauuaugauacaucccuaaguuagauuucuguuuuccacaucucagaccuaauauaaaaacuagcaccccauacccacauaucuggguucacuuuaggagaaggggcaacagauauaaacagacuuucagaacucacacagagagacuagucaauaaaugcacugagcaauuuuuucaagcaaaauuuaaaauuaauauguccagguaagacagcuuccuucccaccccaacacuauagcuuuaaaggaaugaguauuguaggugaccuuuuaucuuuuaaauaagaauugagcuccucguucaaagacagauuuguucuuccuuugauagaagaagaaauaguuaucuccuuuaguauaccaccuucaauauucuuacacaugaauaguaaugaaauugaaucuuuuuuucccccucuauggauagguuuuguggaaaaauuaaaugccacaucuaaccuucuaguguacuucauaucucugggaagaauuaugaaaaggaggguaaaagggaucuuuaucacaaacugaauuaacgcacaaaguacuccauuuggaagguauaucaagcgaauccauuaaaaacccuucaaaggcaccaagugaggacaccuugaaaaugaagcagggaccuugccacagaccagcaaagaaaccuugcugaagcagcagucuuuccagcgagaucgcaaucggacauucagcggauucgcagagcuaccuucugcuaaauaaaggucguuugcgucacuguuacuuaaaggggggugggggugggggcucugagccuguuuauucuaugcuacccccuacacacgcacaagcucuuaauagagaaaccugguaauuaaucacuaaagcaagaaaagguugaaauuagacagaaacuaaaaacacgcacauuuuuaaaucacagggauuagcagauagcuuuggaaaaaauauuuucauuugcaugguauagcuuccuguacuuuggacccaccucaccccuuuguuuuccaaacgaaacuauauuuuugauagcccagacugacaaggcaaggcagaaugcaaacuuggaguagauguccaaagacaggcugcauuuuaagagugacagggaccaggaagcccccaagagccugccuggugaagccagggaaucacugucuccuaggagggguaugaggagucugggaaaaagaaaaaaaaagaaaagaaagaaagaaaaaaaaaaaccucagaggcaugugacuugaccagaaaacauuuuuuuuuuucuuuuuuaagucacaugccuggacuuuuacuuagaaaauaggacuaucgcuuuaaaagcaagauucuuccacucuccugguggggaagcauauagcuauuucaguguuuccucucugagcaagaaaauaaaauacaucagugcuaagccuccccuugaaaaugagguuaucaaagaaaagcuuaaaaaacaaaaaccagaacaaaaaaauaacuuggcaguuuuacuuucaagaugcaaacaccaaaaaccugucaggaaacaaugauaucuaucaacacuuccuaguuuucaccaaauauauuuuagagaaaggauagaaagauuucaaauauaaccuuccccugccccucuguaauguuugucuuuaaaaauaaaucuggugggacagaaagguauuugacauacuguuuaauaacuaauuuuucuaucauuuuaauaaaacucagccuuuaaaaaagggucccaaauaugaagaaucaaauaugcuccccagacaugcuagauuauuugucauaaaaagaguagagauuuuauugcugcuaguuaaaucguuucgagcauauaggaaguuuccgaggucagaccauucaugugcccagauuuggaauuuaagaccaccugacccuuugucauuucuauaaaggcuagaaaaaauaaagggagggaacagauacuucaacccaggaaccccuggagggcaggcgaccccggcuuuaguuguccuggguccgcaguacuccaaaugagcagcugggaacuguaaaggucccgucaugucaguaaugccuguucccuuugaaaccaaggguggacgccaacugacaggaagauggaacggguuggugacccugcacuugacccuuccacaguaugggucugcagaagucugacgaacuuaccucacuuaacucuuucugggcauuucugcacagaguggcucuugaaccucccaacagcagggagaacuccgguuucccugcugaaagggaaaacacuguggccaagucgcagcuuuauaaggcaacuuccacucugccuggggcaagagcacagaguaaggagacaguuauguagcacaggcauuugggggauucaaacagacuugcaaucugguuucauaaaugguaagggcuuugaaagaaagcaaaacaggauagaccucauuauucugcaguagagaaacuggccuuuuaagcugaaccucaugacuguaucagcauccugguccugaguguauuuucacaguucuuuucuuuguucugucucaugcaugguguauuucugcuuagauuuaccaggaagggccccguggcauggucaacguacgaccucucuggguuucaggcacucucaggcuuggagaaagccacaucacaucauaucaaaugcacuaaaaugguuccaucucccacauucaauaucacugaaaucuaaugauauaagauuuguguugcgguugacuagugacauaauauuauguuuuguagguauuuaauuauacuuugauagauuuuaacuuugcgauuuucuuuccauaauucagagccagcaauauuuuuacaggucucaaacaugugugcagguccccgacaagcucuuguacccuaagcccugcagguaccuauuguacccgauagaaaauccagcccuuuuccguggcaccaaaagacacgcuccaaagagaaaugacaaauaugaaaaugcaaugaaacacccugacacagcacacucugcccuugaccaaaacaaacacacacacacccuacuccaguuuuucucuuaagggccccuauauccuccuucucuguagacagccaaaaaaaaaaaaaagaagaacaaaugagucacuccucuuacgccagcugaaugccucggauggucauucuuuggagacuucuccgggucuaagacaacaguucacacucuaagacccuuugguugguuucagguguaagacuuugcuaaauuacagcccuuagcaccaauaaaaaucuuuauaacaauuuuugaaagauuuuugaaacaauuugugcuuaauuaucauuggacaaauauaugcaaagauaagcugacaacuuuccaaacucuuccaucgucucuggacucacaaacaaaagggaagagaaguaaaugauguaagcguauuucauuuacguacucacaggagccccgauucuuacaacuauuuuguauauauuuuuaauauaguuuauuaaauauuguauuugaaaauauaaaccgcuuuauuaaaguaauuaauguuuuuauaauaaaauaugaaguauuuuauuaacuguguauuuauuguguuuucuguuuucucauuuuguauuuuaacuaauuaauaaaaucaacuuuucauccaaucugaaucauuccauuucuggcaacucuuccacagccccuuggccaccauuugcauuguucugagaaguggggaacucuauucaguucaccagguugugggcagacagacaaaaacaaaaacagagucugcccauuaguccugcacaaaaaugaucauuggacauaauuaaucagcgaugugaaccgcuguggacauaaaagacaauugucuuuucuccccaacaaucccugcccacucaaguguucagguacucaguuacauucaacacaggcuaauucacuuauccucaacaagugggcuauugauuuuugccuguuuucagaacagccuguggcuuucugaaugacaauagcguccccuauuuaaaaaaaaaaaaaaaaaaaaaaaacugcaauucuggggaaaugcccuuucagucguccuaaucgggcuggcuucacauuugucuggauguguucacauauucaacuucgugucacugauuuucgcaccauucuuuucuccuuauuccugcggaauguggcauauuucuugucuuuuuaagcugacaggucaacaggauuugcuuuuguucagaggggcucauaugaaggguacaagaaauucccggacauagcaggagcagggcaucaagcacccuuuuuuuuuucuuucuuucuucucuuggucaucaacuucugaaaagcauguagcccacauucuaauuuuccaaaagaauaaauccaaaguaaccguuuccuuuguacuucuacauuaauaguaaauagcauccuucuuauaaaagagaaacaauuuuaaaaugauguaaaauuuuaaaugugcuaaacuuuuuaagugauugcaccaaauuaaaaaagagacuacaaagagagccaguuuuuguugaaaagaaguauguguuuuuacauuaauuauauuaaguuuuaauaauagcccagugguaaauuuugacuguguuaacgaaaccaugaugauugguuguggacuaguaguuugauagccauaaauguuaagcguaaacugaacagugucuuuaauuugggagggcaucccucguagcagaaugugucuccuaacuaguauauauuuugacaauaggcauucgagaagcugcaguacuacuccagccaaagcugcccauucaauucagaugcugagucuauuacaaaugcgcauguuucagcuucuugcuccaugcaagagguauuugaacuugcauauuaauuauagggccaaauauggugcuggaaaaaaagaacaacacacacacacacuccacuuaaccaggggaaagguucaauuuaaccaugagugccccaacauugcuucaucagagcuucuuccuauccuuuccaugaagggcaaagauaacuggcuauuuucaucaucuguagacacucaggaauaugacaaagaacuaugccuccaagcacgagaggcggaguuguaauucuggauagcugaguuucuaaauaaagaaauuuuaacauuuggguuguuaauuagguugcucuagaaagggcaggcauugguugauuuuuuuuaaacucugggcauauuuuccauucuucaguuagcacaaugguaacagaaaacuggcuacccuuuugacaagggccaagggaaagaaaaaaaaaauaggcuggaguggucuugccuuucuuucacugagaguagaagagcgagguucccucccuugacaugagcccugucuuuguguuuugcaccuggauuuuuuuuuuuuuaaggacuuaagaagucaaaucacuaaauauugauuauauaagacaugccugagcaagacacaccaugagggagacagaggaagaggaagcaggaggcuggagagacaacgcuaacaaugaaaaaauuauggggaaacaaugacauaucaaauaucaugaaguggcaaacucacaggauacagauacaucaggcauuccuagacuuugaaggucuaguagagaaaaaaaaagcuagccaggcuaacacagacuuaacaacuuuuaaguuugccaacugagggcuuuaaaaagaaaacaaaaucagcauuuaaaaaggaaagaaaagaagggaggaagggagagagggagggaaaaagggaaggagggagugagggagggaggaaggaaagaaaggaaggaaagaaaggaaggaaagaagggagggagggagggaagaagacagggagggagggagggaggaagggaaggagggagggaggaagggaaggagggagggaggaagggaaggagggagggaggggggaaggagggagggaggaagggaaggagggagggaggaaggagggaggggggaaggagggaggggggaaggagggaggggggaaggagggaggggggaaggagggaggggggaaggagggaggggggaaggagggaggggggaaggagggaggggggaaggagggaggggggaaggaaggaaggaaucuuuuuuaaaucuuuauuaaaggaaaugguauuuaacauugaagaaaaaggguaaauaauagaauccuaaaagaaauacuuuaaaauugauacaacguagcucaugaaaaacucacuauuuuguauuuuucuaauuuuuacaaaagaauggugaaaguuuugucacagacggaccucugggauuuaacagaugacaauucucuuuugcucacccucacagcaucacucagcaccgugcuugguacaagggcuccaugaauauuugcugaauaaacgagggcccauguacaguaacaucugccacacuaaagcauucaugagggcuagagaagucaggguuaagaggacaagauguaagaccaugaaggcauuggugugguagagaaaauaaggaagggugccccaggaguuacauuuggaguacauguaaacaaaguauuuugggcccauccacaugcaucugaauuugugucuucaaaauucagauucuaauuuuauuuauuuauuuauuuuuuagacaaggucucggucacccaggcuagaauucaguggcgugaucacagcucacugcagccuccaccucccgggcucaagcgauccuaccgccucagccuccuuaguagcugggacuauaggugugugccaccauggccaacuaauuuucuucuaugucuuguaguagaaggguuucccuauguuacccaggcugaucuugaacuccuaggcucaagcaauccucccacgucagccuccugaagugcugggauuacaggugugagccacuaugucagccagcuucuaauuuuugagagagucuacugacacugagucagauggagaguggucagucacuugucuguccccaccccacuuguuccaacuagauaagaaacaaaguguucucuuucaauuucauuacaggacauauuuuuuauuuuauuuuauauuuauuuacuuauuuugagagugucucacucuguugcccagguuggagugcaguggcacaaucuuaguucacugcaaccuccuccuccuggguucaagcgauucuccugccucagucuccugaguagcugggacuacagguggcugccaccacgcccagcuaauuuuuuauuuuuaggugagaugggguuucaccauguuggccaggcuggucucgaacuccuggccucaaguaauccguccuccucaaccucccaaaaugcugggauugcaggcaugaggcacugcacccagcaggauauaguuuuuuaaaaugcauguaguuugccugaucacccagugggggcguucaucccugauacucagaaugagaucuuuuuggugcaguugaugcuggugagaggacaggcccaaagggaccuucuggcuccuccagucaccaccugaugacuuaaacuaugagcauccaaugccuuaucugugccaugaaaaugauauuggcacuucuccagguguggcagagaagcuguuagaagaugaugugcauaaaacagcauagcacagagccuugcccaagagugggggcuuaagagcaacgcaagaaggaaaaauaaauaaacaaauaaaacaucugauugcaguuaguacuccaccuccaccccguucacaauuucugaaaacacgcuagauacuggcaagguggaguauuacauuuuguugaaucuaagaacgcagaaugguucugaucagggagauggaaagagaaagcuaaucagcaaugacaaguaaaaaguguaugcagaagacagagcggagauucaagucucaggauuggcaaaaauuacucaauuucucuaagccucaauuuucuuaucuguaaaauggagagaaugauagcaucuacucuuagcagacuuaaauggaacgcuacaagauaaaccauguaaaccauuuugugcagugcccagcauacaguaaauggaucguuaaagaaaaaugauuuauuguuauuuucacuauuccugucaugacaaugaucagaacagaguaaccacuugaaaaaccuggccggaaggauauggcuacuuuagauuucaguuuaucuuuugcauggaaagggaugaugcuaccagcacaacagcuuucguugucagccaaauaagaucuaucgagaagaggccgggugugguggcuagcaccuguaaucccagcacuuugagaggccgagguggguggaucacaagggcaggaguucgagaucagccuggccaauauagugaaaccccgucuccacuaaaaauauaaaaaauuagccaggagugguggcacgugccuuuagucccagcuacucaggaggcugaggcaggagaaucgcuggaaccuaggaggugaagguugcaguaagccgagauuacaccacugcacuccagucuggcugucagaucgagacucugucuaaaaaaaaucuauccagaucuauccagaagagaacaggagaauaaaauacgaaugggaaaauacugaaguaagagguaacucucacaguccucuaugcucugacuaaagagagauucuacuagugugauuaguucaaaagcguguaauaagcccaacagaaucauuuuaaaauaagacucuaauuucaggaaccuaaggaagucugcauuuuaauaagauauuucauuauaucccuaauacgaaaccauuguuugccugacucuauaauuuauuguuagacagacacugcacuauuaccaaagcaaaaugaaacagaugaugauuucgcuaauaaaacaauuggaucaugaggcaaaacccagcucggcacuuaaaacagggcugaaaaacuccgaguagggaucugcagagucgaauauucccaguuggaaugucaccuuucccuacucuuccgcagagaaaaucauugaaauagccugcuaacaauaccauuacugucucccuaacuuaauccuuuguuccuuccagagaaaagacuucugcugauuaugaauauuccacucuacaauuuccaucaauuaauauacuaccacauucuuauuaugguauucauagcuucuugauuuacauuagaaaguauauauuuuacaccacggguaaagcuauuucuuccccuuuaacggaaagugcuuauauaaaaagaccuuacaauuuggaaaauggcggugggguaugugugugugaauaauggcuuggagauaauagauucuauucuccuuucugguuuuuuuccuuucuuuuuuuuuuuucucucugcuggggaauucccaugcaccagucaaggaaggcaacacaguugcccugaaccuccucugucuuacccguuucuuucuagagcuaagccugagugucucuccagaaucugucuccaacaguuuauagaauucagaguuugcaacuugcuuuucacaaacacccaaaggggcaaagagggacccggcuuccuucugggugaguaaaauaaggcagguggcacugaagaagaaaggaaucuuggugauaaaggaguucuauaugaguggcagagaggccaaccuggguuugccucuccaucccugcugugcgaggagccaugucacuuauacacccugaguccugaaggccugacacauaaaaucaggguauuuacaucccugccccagguauuauguggaaacugaacgagguugagggugcaggcaaugcuuuaaauagugacagagggauggcagaagcucuaguaggaaaggcagucucuugcccagguaccuccaaagcuacagaugcccugcagagacugagauggccacagggucacacaggcuucucccugucacgauaggcagaggauucuaggcgugagucaccugcacagugacaucugaguccauucuagacauccgauucaaaggguugagcacucccaagauggcuguacagagaagucaagccuagaauucucucaguguccagacuucagggcuuaugcuuucauggcccuauugucuugcugucguucuagggcaguuucaucagcuaccaggguuuccugaagaauccagaagauuauagucucagucaugccacaggguagcugugcagucacaagauggguccuucaccucucuggacuauagccccacaaaaugaugaugaucccuaggagaagugguauccugcccucaucuuucauucuguaaacauggaugcuuuaacccacggaggguuggggggaaagaaaagaauacuuaaaauggagaugacuucacauaaaaauccgaguccuugauucuguuggaaacaacccaguaacaaauggcuggagcuggggggcuguuuccgucaucuggggcccccccuccagcuaugcugagucucuacuuggucuguuucucuuauuuacgguaaccuacaggugacccugugauaugguuuggcugugucccuauccaaaucucaucuugaacugucgcucccacaauucccauguguugugggagggccccgguggaacguaacugaaucaugagggcaagucuuuccugugcuuuacucgugauagugaacaagucucacgagaucugaugguuuuauaagggggaguuucccugcacaagcucacucuuugccugcugccaaccauguaagauaugacuuugcuccuccuugccuuccaccaugguugugaggccuccccagccauguggagcugugaguccacuaagccucuuuccugcauaaauuaugcagccucagguauguguuuaucaacagcaaggaaacagacuaauacacccccacggcaucuuugaguccuagaaaugcggugguugacccacugucauuuagagagcucacugucccuuccucaacauggacaccacacccaaucccagagguuuuggcaagacccagagugcagagacugagacucuucuucagcacccccagucucccggggguaacaauucucccucuguugcccacaccccacuuccuaaacacaaggcaucuguggaugucccuugguccaaccugucucuucaggggccgcucugagacucgggagcaaauguugauuggcaggccuggguuuugcugcauuucuccccaaacugugucaggaacaauuaaguggggaggccuggaaaugagaggaauguggcccuccugaggccaugucuacacaugaccagggccauccauggggccagcuuagugaaaaacaccagucagaggggcugccugauugaacugacaggccaauuccccagccauggccacagccuuaggcuauggcgggggcagggcagcaggcccuuugguuuccuucccauuuaaugcacuuugcagagucucaagcccaagguggagauucaguucaaugucuguggauugauuaauuaauuuaaagccccugagagaucccggagguucacagacaaagcuagaccagcugagaauuuuccucuuucucaaaaggaaaaugugcaagacgcagacccauucuuggaggugauuuacauuucugucuugaucccgggacuggaggaggggaugaagucuccaucagcaaccccuggaguuuagcugagagcagcuugagcuggcauucagguucugaucggacaccuuccugacaugaaacaaacugugagccccaaaguccaguuugauuguucaaacuuagggguccaaccagucuugaccucaaugccgacccugccacuuacugguugccuaagugcaucacugaaacuuccugugcuucaguuucccuguugagaggcgggaaucugagugagcuauuggugucauguguuuagaacagugccaggcagaguagcugcucacuaaaagcuaucuauuuguaugaaggggacaaugaagaggccagauaaggucucaccaagcacaaaagccaagacuccaggggcugccccagacaaaaaugccuccagugaccuuuccaggcacacuguagucacuggcauauuaacuccuuuugcauuuaaggggagagaugcuccugcuucaaccagugcugugauuuuugaaaggagauuucuuuucaaaacguuugccugccaaaugccacaaaacacaccaagccaggagguguguuggcgucaccgauggcaccgaccugagagccugccuggucaaaaucucucccccaacuaagcucucgccauggcaagaaauaucuggcuauuugcugaauuguaucagagcaaaaugaaccaaaaugcacaggggccagggcggggggaaagaggaagaaguuaauaauaccuuauaaauucaauuugcauuccccucucgauuuuaacccagucuacaugagcuuuccaaaauaagcagucauuugaaauccucccacgugacagacagucuuacacaucuuaaaacacaauccguuuauuaaaccuaacagcacaaugugguuuuaacugguucuagaaaauucugauagugaaauauuuucuguuucugggccagaaguggucauuucuucuugagaauaugauguuugaaaaucaguuccuccuauuauagauuucucccucagcuuguagaaaauccaugauucccuaaacauuggucuuugaaagcacauugacuaaaaucuucaugcuuaauucaugaagcgcagucuggagauuaguggagcuggacauagaccaggaauacuuuaucauauucuaauaagcagaggcugaaaauugcauuucuaaagcuacacuauuaaagggcauaccgcaaaacaugacccaaacauaacucaguaguuuuacagugucugaaaaggcucugauaugauaaaguaugcugacgaggggaauaaacacaacuagaaauuucugaauuuaaaaaagaaaaaaaaaguggggagggcuuagcauucaguauauucauggaaauauauuuuauauauauauauauauauacacauauaaauaaacucauauuuaugauucccauuaagcaauuauugacuaucaacuuauguuauagaagaucacugaggcaccacaauuuagggguuuggaaagcauaaaagcaagagagaugaacgagaaaaaaacaauuuuaaacuuaaugagguuaauuugaagguuuccagaaaaaucuaaguccuggcuuuucagcuuuucuuaaaacaggucaccaguauuguuucugaaagcagaaagcaaagcauauuguggggugggcggccacaaaugcuuaaugguggaccaaagacauugcucagaaaauggugcaacauaaaacgcccacugaugcgggcacucacugccuacaaaaugauggcaauggguaaagagccaccguagaauccaaaugaaugaaucagcagugcauauggccccaaguacagugcccggcacacaguaggugcuaauaguauccguuuaauugauugacugacuccuugauuaauauaugaaggaaugaaaaagcaauggaaacagcaccuauggacuucccaacagcuccuggggacuuuggaucuaccuacuaaaugcuugcuaagcuguuuucccucuacaaaggcaccggcuaaaauaaacaaagcaauaggucaggagcaguuuucacaaagauacuagcacccaggucguaagcaccuggcuccagcgcuucuacgcagaagaggguaggggagcagcaaugagauugggaggggaucgcaugcuggaggcucaaaggauuugucuuuaaacugcaucugcauagcuagaacaugguuacuguuuagaccgcauguuuauugaggauagcaucaagagaguguggggcuugcuuuggagagcuggcugauugugugugugugaucuccaacccucaaagccagccccaucacugcugagaucacaguagaaagaugagggcagcugaaaccgugcugauuuauaucauuuuauuuucauggcuguguacucaccaugcacccuucguucacuuaaugaaagggcuucgcuuacuuucuacuaggcccggcuuaccucucaacugauucucccugcuggcuuccaaugacacaguccguguucuccccacaaauggaccuugaaaucagcauguuccauaggucuagguuuccucuaccucagcuggcugguccuugcacaccuguccuguccccagucuuggaacaccccaucuugcacaccugucacgaucucgccaaccucaaucuuggaagucaccuuagcaccccugauacgcccugcuggggcaggacuggcuauuccugcuguggguugccacagcagccugugucaucccaccgugaccuggauuaccucuucacugauguacaccuuccccaccacacuacaugcucuugaagggccaagaccuugacagcaaacugcuguagacccaggccuagcagaacccagccagacaggaucucaaaacguuucuauugcaugaaacaaaugaacaaaagaaaagauggcaaacccaaaguauccaaccauacagggugacuuuggauaucauguuuuguuuuguugauaucacucaaaagauaauaucguauuuuguuuuauauucuuucacauuaaaaaaauaaguccuaccauguauaauacauauauagucacacaugauuagaaauuuugaauauaaaaaaugagcagaaacaacaaagaguaaaaaacuucucaucuuccuaccauuuaguauuuuucccacucugaguauaugucuuauccccuuugaauguugaaguucuuuuccacucuccugaguucagguuucuuuuuaguuuuauuguauuuuuaauugauauuuuagauagcaaaaauaaauucuggugcccuguugcacagaaaggugaauacaguuaacaacaagguauugcauauuucagaacaguucaaaaagcggguuuugaaucuucucaucacaaauaauaaagguuugagaugauggcuaugcuaauuaucuugagucaaucauuacaccauguauagauguacugagugcagguuucugccagcagcuaucugaggagccauccuagggccacucugaguauggcucaucaucaagacauccacacuggucagcuggggggcagguggcccugccugcccuaucuuaaggacaccguauaucucugauagcuaacugugguggggagggagagauugaggaccucaccauugagagauguggucuuguacauagccacgugaagucaugagugaguauguuaguugcaaagacauggcggaucuuuggucaauguaugaucccaacgaauauuacguuccacaggcugcagggaggcaggagucuuguggcugucagcggggaggguugaagcaaggagaagacucacaugugagcaagaaaaacacaggcuuugguuccauauucaggaaaaaggaggaaaaaaaaaaagacauuuccaguugcuccugccauugccacuucccuagucccacgacugcuaaaccugcuggcaggaauaugacaucugacuccaaaucuauuucagcagcagcugccugcaaugaaguauaugucuacccauccucagagguugcuuuugcagguuugcaaugucuucuucugccacugccucugcuaacacagccucaugcgcauggcagcuuccacccugggguccccaagccucuugacaaagugcuuucccaaaccacucugguucccugggccaugucccuuuuccacaagucuucaacaguaaggauaggguuauugugaaaggaaaucacugcuuuccugagagacaggcccuucugguucucuuaauuauaauucuuuacuugcaauaugcauaggcugcuauuuaaauaaacaaugagggauuugaaacagagaaacuaugaaaaugaaauugcuuuaauuuacaucccgagagacugaggcuauagaguuuucugaaugcuaaauaaaauaaauaaaaacuuaaauaagugucaaguuggagguagccuaugaguuauaaaaagggacaaaggagaaaggugugguccaugacaaacccugaggucccacgcugcccugagaaauacagagccacugcacuggggcuaucaucccuuucuggaaacaaccaggaaaggaggugaaaaugccauggcuuaugccaccugaaaacuaugaguuugagccaggugauugagacuuuucaugugggauuuguaccuagcaggguggucagaggaagcugugugccagcuggcaagaccagccaagagacaacgggacaauuuggcggggggggggggggggccuuuccucagucuucuucgucaagacucagguaacacaaagagaggucagguuuugcugcagcaaaugcaagaauaugagcggauuggguuuugcugcuggagaguauugcugaaaacaaaaaaaacagucuacggaaaugucaggaaucgacuuugcaaggcugcagaggaccauaugaauugaugcacacacaaacacauacacauagguuugcuucguauaugggguuaaaaaggcccuaaggauuccaagagauaaagcagaggacagguuaaaggaugggcauuaauaagccaggaggaggaguugagaaggaguugagaagugacuuuaucauccucuugccgcagacuuuauaaacgugaucacaucucacaucuccgccucacgauauuuucccaauugacaggagacgaaacugagacuuaaauaguguuucuaauuacacaaguuggauauaaugauagugggacaaagacgcaaacuaaggucauccuccuccaacuccaauugcuaaagaaggaacccaaagaucauuuuuguuugucuacagcuuacaaauguauggcccagcugacccagggacuccucguauguccucagcuugcaaucaugcuagcucuaucuuuguuucaucucuacuccuuucugauucucuuuguguaucagucucucucucucucucucucuuuuuuuuuuuaacuacaacaggcaguuuuccucuguuguacgcugggaagaugcugccaagcagcaggaucaccagcuuagcuguguguggugaaguuaugcaaauaccucccccugucaacuguggcagcaaaguccccggaaggacuuggacuguccugguuugauauaugcucauucccccaucaugcacuguggccgggaaucaggaacugugacuggucugaccugggucaugugcccaccucuggcugguaggaaugguuuugauuuugugaucaauccugaagaggaagacaggugcauggcaaaggaaaaugggauaguacaagggugaugggggaaaaugcugggcagacaaaacugucaguuaggacaauaaaauaucaguaucaaggccagggauggugguucaagccuauaaucccagcacuuugggaggccgagguggcuggauugcuugaggccaggaguuuaagaccagucugggcaauauaaugaaaucccaucuauacacauaaaaaaaaaaucaggaucaagugauccucaaaagaaucaggauacacuccaggggagcaagguaggguggggagggcaaugacaccugguuuggcacaaacucccagugggucccaaauauucguugucauuucuuccuuggcuaaagagcuuuuguauuugccuagacacauuggugcuaggacugaaggcuguacuuuccagccucccuggcagcuaucugugcucaagcaacuaaaucaccaccacugggagagaagcaguaguguuggguggggcuucuuagaaagcucuucaaaagggaagaaguuaguucccucuccaccuuuucguuuucaugcugccuggucauucugggcagcgaguuaucaugaagauagaagcaaugucacaaagcagaaagagaaaaggagcccggaucaucgaugacgguggaguggccaccccagcccagggccagaaaacaacuuauuuucuguuguuuuauguggaagaauuuaccaccauguuuggguccuuguuagcagcagcgaaaugcaauuccuaauuuacacaccuaggcucugauccaggccugccaaaauaugccaggccuugucuuccagcucuggcucuaagaaauaaaaagaagcaaccccacugaggcuucuuccuccuucucuuugccuccugauucuugucuucuuccucuugcuucauacaccugauucucugcgaguccaggggcuugaggaauaacucugcguccuauggaauguuuccauucucaucacacuuacaaucugcaugcuuguguauguucuuaugguuguaauuuaauacaggaacuucugagaaaugguguucaauucaauaucauuaagugacugcuugaauguuuauuuguuaucaugcuagccuugccaaaauuccacaucuuggcagaagacacauauguccuauuuagugaaauagaaucugaccucuaaaaagugacacaguaaaaacaaacaaacaaaaaauaaaacaaaaacacauccgcuuugcaaaaagcuucuuugccuagcagaccuuuuuuguaccaugcuguucuuuauuuucacauaugcacaucauauauuguaauacgaaauggauauugacugcagcugaggugaauauccacacguauugaccucagagguaaauauugacugagacaaagguaaaaucgaugcuuaccuugagggauaaucaaucuggauaucuauugaaauaagaagucaauaggcgcauuguuaggaacacuggugguuauggucgcuugagcgcaucuguacagagaguggucaguggugguuuucuggaaaacuagaggcaguggugguagcucacagaggcugcacugaguaccuuuucucuaguuacaucuucuuugaguuuugucaccagcuaccacugcacuagaauaaccccaggccacccuguccagugaagcaguccagccuccaccuucagagagcaguuacucaaucagguacuuuaguuaucucagucuuuucucccuguaacaggaaacacaaacugauaugguuaugcucauuuuagagcuuggucagcugagacucagagaacucaagcaacucgucuaagguuacagagaagauaaaugaugguaaccuaaauccaaaacccauuugccugauguuaacauuguuaucugucuaccaccccacagucucuuaaugaggacuauaaagugaggcuccauguaauagagauacaugagagggaagaggggaugcagagaguggaaagugugagggaaggucuacgugcuggccacuggagacaguuguguacugggcuguuacucuuccauggccuaaacacccaauccugguggucccagaugcuucauuugaggcuauguaaauuugauacaguucuggucaaggagaugucagccuaaguguguugaggggcuuuggggaaagguucccuuguucccaagagguacauauaggaagagaaggugcuuuguucucuagcaauaggcuaucugguuauaaugucuggaagugcuaaaaccaucuugaaaaagggagaaaggggggugaaacugagggaaaagcugacagacaaucucagagaagcagaaccacaucauggcaugucaccucucaccaccugacuucuguacuucagacuagggcagauaacacauuuucauacugguggagccaccgugaguugagcgccuuguacguguaccccagagcaucucaaccaaaugaggaggugccauauuacuccuccauacgugugcagaaacucagauuuagaaaugcacaguguccuuuguagcagcugguguugucuaaacgcuggagucugagcucuuaacaacuccucugcaaccaucccaggcacaccucccauuugaggcuuacaccaugaucugcuagaaauuaggucuugcaaaugaagcccauuagaccuggcacugaucccaucuacccgaccuugcaacuccuucacgucaacaacguagagaugugccuucucaauacuuacucucuccaaaggcuuuaaauuucuaaacuguuuuacugaguuacaagacauuuccaucugccuuaacacacaaacugcaggagaacuugguuaugucuccucaacaccuaguguuaacaaguaucaagaaauacacuuuguguuuucaauguuucuugucuaaucugcucccuaaaaaccuuucccucuuccccaacugggaaaauccuauuuauuuaucagugagcagcucaaauaauauuagaguugaaggguucuucccgcacccuucuugaccauugccaccaucuuggaucugucuuccuuaauacuauaacacuuucagauuccucuuagaauauucaacacacuugcuuccaccaaauaaggacacagcaacguggugccuuuuugaaggauagaaagcagcccucaccagacaccaagccugucugcaucuugaucuugaauuuuccagccucuagaaccacgagaaauaaauuucuauuuauaauuuuuuuauuucuaucuauaauaaacagagagagagagagagacugaaugccuaauaucuaucagacauggcaagcuauuuuccuauccuauauguguuucucuccuuaaggauaggcaucauagcuuauugacuucuauaauccuaggacuuaucacagugcgugacacguaagaagcaacacaaaauuuguugagugaccauagccuucagguaaacuagaagauaaccugucacuaaucaugaaauguucuugggaaauuccaacaaaugccaacucccuaaguaaagacccucuuccccuggaguuuuccauuuuuccccccuugcagcuaagaaguagcaucauaguuaaugguccacauguuauucuacagaagggagaaaaaagggggaaaaagccagcagagagaugaccaaccuauuaaaugagaagaaaccaaaagaagguaaacagucgcacacuguaagcuacaguuuuaccuucacaagucuuuauuuuuagaugcaauccagguauuuuaucacccaauuaugggcuaucuuuaugccuuuaccggaaacuacuugcuuaagcaaccacuucucuacuguaacuuaaccaagggcccuugcaaggaguucauuagggaggcgcugaagaguugcagguucugccaagguggacucuugagugccaugggcagggaggcugagaugaugaggaaaagaguggcaggacagaacugccagccacauaaagcuagugaaagaaggcaucagcccccuucaagacaaccucugcggauaccaacaagguagaaaugacugucaauaaaaucacaacuagaugaaucagguaaccuggcuggcauguguccccccaucaaggaggacuaauacagaauggacuaaauauucuucauuugugcuuuucuauuuuguuuugcuuugcuuuuccucuauccuucucccucuguucccuccugagcacuuaccgcaauaagaaacucuaaaaaauaacaaacaacacuccauaugcuccccggaucccaacagaaauacuagacucaacccugccaaaacuugagagcuaaaauacaauugguugagggagaaacaaguacaacagugggagaaucuacagguaacugauaaggucuuaauaaggagguuggugcagaugaaagagaugucucauuuacuucuaugauggccacauucccagcaagaggcuuuggagaguggcugcuaaacaguagagauaagaaacaaaggagggaacugccacuucuuccugagaaguuccuccuccuccucuucuucuaucaacacuaucacuaccaccccaucaccacuaccaccacccuggguaaaccugcaccucuccacagagaccacucuggguucagcuccuaaugccaaaaagcauaugcuaaguguuugguacauaguagcugcucaauaaagugaugcuacgucaauaagugacauacucuuagcagauguuaaaggcauuaagaggcaccuaggacaccucagcaggaaagaacacucaacaagaacucaagugacucaaugaccucacuuucucugagccucaguauccucauguacaaaaaauagacuaacugguccuccaggcagcuucugcaagcucugugauuauaguauuucauuccucuucaugaccugcuacaagaaacuugugaggccacuacaaaaauaacuuucagagcccaaacagggcagauuuuugcugcugaacaagaacuuccugagagcaagccucaucugaguacagaguagccccauccuggccccccaagauauaaaucaauauuucaccaaaggcagccucaauaaaucaggcugggaauuaaaugcaauagccagauuauccauuauccgcacccaaaaccuaugagucuggucuccuucuguuugccaacugcaagaaccuguucaaguuugaggcuauugucaucuacagaguauuucaagagcuucaccuggagcaauggagccacccaggggaaacuucaccauuuauccaauuagcuugccaauacuaacccccucucugcaccugugcaaggcccgccagcaggaaggcaaggguuagggccacaaagcagggcugugaccaccacccagggagcagauacagcuucauaaugcugaacugaauugcaggucacauuuguaucuuaucuauuugccacaacuacaaaagaccaggugaagucccuuguaaccacugccaucauuuccaauggggaggcccgcuugauuuacauaaccauaaguaaacaugcagaaaaaggaugucacuuaggaaacuuaauguuuccugacagcaaggaauuggcauucacugggacauuuugcacaauuaccaggaaaaaguccuggccuaaggaucauauaacagaucaagacaguauuagcuggccaacaaaugucuauauccagcuccacaaaaagcaaggugaaggccacagucaagccaucaagcaccucccuaucugggucacuucacucccuccacuccccacacccaauuccucaaaauguccuauggauccaacaccaaagaaagugacauuucuucucaucaacaucucuguuuacgguaaucaggggagggcagugagcgaaucucaggacaccaagugaucgcuuguuuucaggauaaucaauaagacacuuaucuugaaagauucaugcacguuuggaaucaauuaugaaugggaugaugauaaaaaucuguaagagaguugcugaauuguuucuuuuuauuauucuuaucagaguuaugcucccuuugguugcuuucucugaaauuuuauuuuaaaaauguaaagaauacuaacugggccucacgcaguggcucacaccuguaaucccaauacugugggaggccaagaugggaggauugcuugagcccaguacaagacaagccugggcaacauagagagacucuguuucuacaaaaaaaaaaaaaaaaaaaaaaaguuagccaggcaugguggcaucugcuugugguuccagccacucaagaggcugagguaagaggauagguugagccugggaggucaaggcuacagugggcugugaucacgccacugcacuccagccugggcaacagggugaggcuuuaucucuaaaaaaggaacacuaacuaaaucaugccauuaucaaauagauugccucaugaauuaguagagguuuucaaauucagaugcuauagaaucuuggcauaucuuguaggguuaagaaaagugggagaagggauuuuuccauuggggauaugaaggcaugcaacaugguacacagucauaauggcaugauuuuuggacuuaaacaaaccugagucugaaauuauagacccaucaauuauacauagaugauacugggcacauuacuuaaccuuccugaaucaaaauuccucuaugucaaagaauaauggcauuuucaccauaagggcuaugauaaagaugaaaugagauuaugugaaagauuuagcaaaauccuacacauucaacaggcacuuaauaaaugcucauuauuuuuaauauuaaaauugugacuugguuacauugagcaaguuucuuaaucugagucaccauuuucucguuucuaaaauggagauaacaagcguauugcaagguuguuggagaauucaauuagacaaugaguaaaacagcaucuaauacagcaacuggcaggugguagguacagaggaugacaaauagaauucaaguagaaaaacaaaacuaaaggagaagaaaucuggccuuaccuccccauuuugccaggaaggaaacugagacauggagagguuugucuagccucagguuaccuagaguaauuauuucauggcguccuggcaccaaaccucuuucuuuuuaaaggcagaaucuugcucugucacccaggcugaaaugcaguggcaugaucuuggcucaaugcaacuuccaauucugaauuuuuaauuaaauguuucuuuuuucuuaagaaacagggucucgcuauguugcccaggcuagucuugaacuccggggcucaaacaauccucccaccucagccucccaaaguguugggauuacagguauaagccaucacaccuggccuaauuuuguuugucuguuuguuuguuguuguuguuuuuugguagagaugacaucuugcuauauugcccaggcuggucucuaaccuccugggcucaagggauccccgagucucggccuccaaaacugcugggauuauagaaacgagccaccacgcugaucaccaaaccucugaagggaaggaagaugcgcagcuuggaagagagaacaagacaauaaaagauuccagaaggugaguucuaauauaaaggccacagaaucaggccaaggagcaccaugauacgggaaucugcccccugccuugggguugcaggggaagggaccagaaccaggccucuguggagaagccaagcacaaauuaggcaaaaaaacaaaaaaaacaaaaaaaaacaaaaaaaaaaacccaaaacaaaacaaaagaaaaaacaacagcaacaacaaacggauugugcugcgaagugacuugagaaggagugcuggcugagucaagagguccugguggagccacuauaagguggaagcgaggagaaaaccacaauaccgagggacccucuggggauccugggguuugcuaaauuaaccccaaguacuuuggccagugaaaguugaguugggggcccaucagugaauccagcuuuugggagguggucaaaggcuguaagagucaaccccacaaguaaguggccgauccccaaagauaaagaaugcuaacgaauuuccagccuccuggggcuggcagccagggugauggucuccauucgaccuaagauccuaccucagggagaacugcugccaaggccuggucuucucuuggcccuaaauagaucaacauucagccugaguuugcagauuacauuuuaugggccacaccauuuaagcuguccuguggucagaaauagcccggggguggucagaaccacagccuuguacaucugacgcugaauuuaguucacacggacauggcuaaagaauuucuuuuuagguucagguuuugaguaaaagauccguaacugccuuugaacaggccagggguggaggccucagcugaauagggaauuaggucaagcggucaucucggccuuucugccucuuuggcacccaacccucaggcaccucaguuguugggaaaacccacugugugcuuugaccgaggcgggagaaaaauucugucaaugaaugggaaauucucucaaauguuuugagauauugcuuacacgcaccgacgugcacaaauauuaagcauauagcuugaacuuuuacacgugcacacggccaagugaucacaucaccagaugaauggaaaauuuccagcauaccacaaggcuccuuccugccccuuuaagaucaccacccccugguaagcuaacugcuauucugacuucucucacauggaaaauuccugccugcuuuucacguuuacacaagugguaucauagaacagaauauguccucugguaacagucugucuucuuucacucaacagcaugccuaacacucaaacuuuaaaagguauauauuaaaauaacaccucaguucacuuauaaugggcucccguuauaugccgggcuuagaacaguccuugucuuuaauccucacagcaaacucagcacaugggaauuacuguuucaguuuuacucaugacaaaauguaagcuaagagauuaagcgacguguugcgaaaucccaagccuggaaagucacaucuugggguuauggauucaagugcuuggucuccaaaaugcaaacaccuucaucuuggccaauuugaccaucuuugacucaugacuccaugguugggaauaacugauguaaagcacuucuuacaauguuuuacauaacuguauauggcaauaaauacuagcuauggugauggugaugacaaugauuaugccaggccuuguguuagucuuagagaaggagaaaugaucaagacagacgugguccuagaucucauggaucuuacaguccaguguggaagacauaaaccaaacacacaaauaacuuuauaauuacacacugugaucacaaaaagaagggacagguugaucugggccacacugaaugguaaagcuuagacaacauuucugcaacagcauuuuccuucuugaaguguuugggagcaaggaggcuggggaccuucagcaaugucacauagcaguuuugugaggaugccuaaaauauucccccaaacagguaugcaacacuaaccagcuuugcucgaauaaagcucuucaccugagaggcucaauuacaucugcaguggacucuuucagaaagagcauuuaaaaggcagcuucgcccuuggcuccugauuuuccaugucaaaagcacuuaacucaaaacccucuagauuaccaacuccacaucagggcacggguuccugggccaagcaacccccccaacccgcugccugauggcuugacauugaaagcagcugcauuaucauuauguuaucacugggucaaucccagcuugggaagaugaaugggggacccugacauuucaaggccuccucucaaggaauugcugccaagugcaucuucccacaaaaccuacaaucccacauuacauuuuaugaccugggaugcuuuucagagaaaagagaaaaagaauucuucuuaauggagccauuaagacaugauucuaaauuccuuugaagauaccacaguggcaucucaucuuacacuugaguagguaagguucuagaauggguacaugaagcaaaucugaguacugucagaauuacucuggaagugccaacauuuccuuuggagccaguuguacccucacucuaaggagggccaagagaaucaguuguuccuucagcacugcuuuggcccugguucuuugguugaaccaugggauagagcagccuccugaguuucaggaacacacaucuuuaaagacuuugcauuacaagacaccccaauuaagagacucacaaggacaaaggcuucgaaaacaaaagauucacuucuccuaacucccaucuucuucaagagcucugcucggagaagggaauggagaaaucaucuucacucugugaauuccuaggucucuugcaugaaguugagcuuaagaagauuaaacgcgcauuugacaacaugcacucugucaugagacugugaugccccaagaacaaggcacuucuuuucaucauuucuuguccccaaaauuagcagagcucugguucccauaggagguucccgguacaucacuagaagggccucuuguaacugacauaagacauaccaggucuucagggcauuuugcaaucaaaggguggaauaaggaccccugauggaaguagcugggagccacaguuuggcucaaauugaugaagacuuuucuaacaacccuaugcauaacaaguuuacuguuaagcaggggucaucagucacccaccaggaaugacuaagcggagauagagguaucgggcuaagguuggaccaaucaaccaccaauagacugaugacaguuuuguaaaggugucauugaucaacauauaauuagaaacacaaggauugcacauaacgucuuaauucugugcaaaaugcauccgaauuuuuaaacugucaucauacaccaaaagagaauguaggcaagccaaucaacgucaggucauauaaaaaauauaauuuuugaaaaacuaaaucucuacauuuaagaaaaauugauacucccacuuuguaagaaauacucauugaagccacauucuugucuaaauuaauacaauuaacauuuuuaucuauauucaacaguaaccucagaugacaagcguaacauaauccaacagcaauugcuaucaaaaguauagaucuuacuugauuuuuaccuucaccugacacacuuuggccauguauugaccacuuaggaacauucuucuggccguaaauccaaucaauaauucacuugugcugaacauauaacuguacauuuucugcucguauaaacccauagauaaugagugccgauuauagagcagagaaaccaaagaugcuucugcacccagcguuccuucucagaggacuaaccugaaaaugaucuuugccuugucuacaaacgaaauauuuaaaacaauguuuugaugccccaaguuauaccugacauauuugucaauuuucacagaugcuaggagugauuagauuugggggucagauacuuuaaggucaucucgagaccacacauuuuaauuucaaauagaggaugacaaacccgauaagcaaaacuuuaugaaauaaaaggauaugaaaucaacuuacacuacuaguugguauggggaaaacuuuuguauuaaguccugucaucuaaagguagggaaccugguguuacaagagauaauuuuccugacaaauaaccuugguaaguuaaggcaccuaaaaaauguacugguauaaacuacuucaaucuauggguagcauuuauucccaaugaaaaggggcccacgggaaagagacuuugauuccauguuucagugcauuuacugguuaaaaaaaacauuccuagagguucacaauaaaucuaaaaagaucauuaccauuaacguguaagacgacaagacuagcacguuggcagucacaacuucaaaggguuaaacuauaaagacaaugagauggccuagaagugcuuuaaaacucaauuaaaauaaaaccaguuccuguuaguuuuuccaacccagauuuaaggcucauucuguauuaucuauucauaugaaaaaggguacagcaauugaauuuugaauuaugcuaacccauuuucucagcuauagaaaagguuggcuuccagcccaaugaauacaauagccacaugcucaagacccuuaauuaucuaauuaauguagugucauuuuagcaauuaguucaaaggaccauauguaacuuuuuccuuuauaagaucagaauuguaaauauuuuuaaaacacuuguuauacggugucauguccugcgcauuaaggauauacaacaaugauuaagaacagaaaauaaccaagaaagcucuuagauuaaaaaaaaaaucaaccacucuaauaaggcugauggcugauuuucauaugauuaaagucauuuaauaaguucacagauauacuuuuuuguuguuccuuuucaauagauuacucuuugcgaaggguucacagauauccuuuagcuggcuacuaaauuagacuuaugaccagaaauuaccaccugggugggcagacacuaccaaagaaaauuagaaggcaugucugaggugaaagaggcauagguguugagaagaauucauucuaaugaaggccaucauacauggcauuauuaaaugaagaauaauuagcagacuucucacagaagacuaaucuuugucgccauuuucucaccacugcaguauucguggagcugaauuuuaacuucaaauuuuucauauacucugcaaacaagauaguguuacaaaaguuguuucuauaauuuacuaauaccagaguuguuggauuguaaagguaauguagagaagugugcuuacgauaaagaaauccuuucugugucuuuuguucaggccuugcauuuggcaauuuguucgugaugggacugcuuauaaaugccucugggcaucugccaggaguccuuguuuuugaugaaagacucagcuccacaacaagguuauuuaccuggaaucacagaggcaaucaaucuguaauuggugcucagcauugacugaaauccucuguuggaggccaggugcaguggcucacaccggauauuccaauacuuugggaggccgaggaaggugcaauacuguacugcaggaguuugaggucagccugggcaacauagugagaccccaucucuacuaaaaauacaaaagcuagccgggcaugcuggcacacaccuauagucccaccuacucaagaggcugaggcaggagaaucacuugaacuugggagguggagguugcagugagccgagauugcaccacugcacuccagccugggugacagagcaagacucggucucaaaaaaaaaaaaaaaauuuccucugucaaagaaaacagcaaacauggcccuugcuuucaauaggcuuugagaaaagcaggaaugugcacaaagaagagcaagcgccuuaaacgcuggcaugacucagaagacucccucacagccaccugcauuuuaacauucagaacagaagucgauggcucggagugaaaugcagagacacuuugcuuggguuccagugagucuucgaggcagccucauuucagaagaagagacauuucccaagcaccaucauguuccagguaucaccguaggagauuuaaagauauuaucuccucauuucucacaacuaccuagcaaggcagaugauauuuguuuucucuaaagaaagaagaagugaaaacacacauaguucuuaucccacuucuccgucgguaaugugauagagacagagaugaucucuuacauuuccucaacuuucccacuccaaaaccuugaaguacaggaguuuccuggcuucuguuucuuaauuagaaagccacuuccgcagucucuggcgcaccacagcaccucaccuagcauccuucucucucgccagccucaucucauguuguuuccuacccccugguuuauauucacuuaagaggaacucacgcuccuccccucccaugauccuucagccugaguacccuuccucaguuugccuggugaacucaguuuacccuucaauuuggcucagacaucucuucgccuuuggagccugcccugccucccugucucacucuuauuccauaucacucacaccgucgacauaugcugucacacucuacugcaauuuaaguacuuaucuccuugacgaaacugugacguaauaacaaagcaaaaccugccuuuucaucccugguaguuaguaaaguaacacccacaaauagggacuuccuaauuauugcugaaucauuaaagugauuuuuaacacccacaauaacuagaaacagaaaaacacagccaaagacgagagaccaaacaugaugaaguggcugacaagaaaaaacaaacaaacaaaaaccuacgaaaagggcaaaggaaaaaaaugccuaagauguauaauguaauacuaauguuacugccucuuuugugguggugguuucugaaaagcaagaaaguucauaaguaauaucaacaaucaacaaagcuacaacagcauuacagguaauauuuguuuguagagaugcaccuuucccauuaaccuguucacagacagauguucuguagcauguaacacauguuccaaaugucagggaugcaauucuggaagccgcgcaggaaaccgugcuuucagaaaaccaugcgguuguauucauuuccauuuacuuguuauguugaugcaucauauugaucuuuuuccaaaugacccauagcuggcaauaaauuuauuucaaacacugcauaacaacugccuauguaucugucuuuuuaaauuuggugugugcguguguguauguuuguguguauaauauauaauuuucgccagccgcgguggcucacgccuguaaucccagcacuuugggaggccaaggcaggugaaucacgaggccaggagauugagaccauccugauaacauggugaaacccugucucuauuaaaaauacauaaaauuagccaggcaugguggugggcgccuauagugccagcuacucaggaggcugaggcaggagaauggcgugaacccgggaggcggagcuugcagugagccgagauugcgccacugcacuccagccugggugaaagggugagacuccgaccaaaaaaaaaaaaaaaaaaaaaaaauauauauauauauauauauauauauauauaaaauuugguaugcacauauauuuguauauaaacauaaaauugaaaggcaagagacuaauccagugguaugagauuauuuuuaauugucaaaaaggcaaaaaagcaucaacaacagcuuaauuagugcauagugucuuguauuaagaugacacaguaucuaaguacuuucggaagcagguggcuagugauguuccccaaauauuuuauaaaguuuauacaagaacaauggcgguauacuuuuuuccucugaaaucuggaccuaggugacaaauguucuugugaaaauauuagugagucuugguuaucuggaaaaacuguggccacaaggguacaacugauagcaagaaaccacccuugaauauauucugucaaacggaaauccugaaacugaauuaccaacggcacaagcccaaacaaggucaucuguacaugugcuaaacugaaagucaugucauugacauuaccuagcaacagaucguucgcaaaguggcaccuuccgcaagacugcuaggaagauguggucaaauagagugucaacacacugucucccagagcuaugaauuggggaauuguccagaaggucuuugagaaggugaaaaugaugaauguauguaaucauccccauuuaaauaauuuaggaaccaaagcccagaaagcauaaguaaauuguucaucgucccaaagcuaggaaguggaaugguuuggacuugaacucuagcuggcuuggcucaaaauuagggcaucauacccagggcugcaugaacuuccuuccuggugaauucaagguugcaugaaaggugagccagcuaaaugauuugcucguggucagggcacccuuuacucauggccgcagugcuggaauuuaggggacaaaugcucaguuuuaaaagcucuguucugaagaaagcuaaaaaucugaacaagguuuuaaacauauauuugcccugcaccaccaccaaauacaacaaacuggacagaaagucuguucagcaaauauucauuuuccauccucucaccuccuuguaaggcauacaauuucccuucugaagcugggcuugguuauguaacugacuuuagccaaucaaagugaugggauguguuaaguuucagcccaacccuaugagacacuggugacuaauuuacaccaagagaagaauguuccccaauucaugacucaacuuucaaccugagcuauagaaugagaugggugaaauggggcuaccuauaaacuaaucacugaauuuuggggugauuuguucugcagcaauagcuaacuaauuacauggagugaagaugggaugaaaaauaaaauggucaagauauauaaaagugagcagaugguaguguggggauggcaaagaaauguuagccuuagaaggaaucuugagaaaggauuaagauacccaaggcagcauuuauuuuaagggacagggucuuguuguguugccuaggcugaagugcaguggcacaaucauagcucauugcagucugaaucuucugggcuuaagaaauaucccccuuuagccucuugaguagcugggacuacaccuaugagccaucaugcccagcuaauauuuuuaugugaguagagacagggucucacuauagugcccaggcuggucacaaacuucuggccucaagugaugcuccugccugggccauccaaugugcuaggauuauaggcaugagguaccaggccucaaagcagcauuuuuauguggucacugcuuucaugguugugcagcuucaccacuuaaggaaaccgaaauggaaaaacaucagccucaugaagaaugaaggauccaagcccaacgccuccagacaaggaaagugugcaaaaggaacaaagagaaaacacaucauagcucuaugcuaaaccaagcuaugucuuuugggaggugaacuucaauuaugaaguauaaauuuugaauaaaagaaagaaagcuggacauuuugugaguucugaaaaaucacagaugcauuauuuguuguagaaaaguuggugaaacauagaagaacuggaaggaagccuauuuaaaagauaccucaagauuauggugauuacuucuucccuuucaaaugcauagcauauugaaguuucuuuuaaaaauucauacaggagagucauucuaugcaacgguaagagggaaacugucagacaacauucccaauucaauauuauauugugcuucaagaaaagauuuccauauauucuagauuaaaaaaagccucauaaauaaaugauaauccaguacaugcucugaaaaaugaaaaaaauaauuuuguguuugcauuuuacuccacaggguaaaauuuaaucucucuuuuaauauagcauguuuuauauaaagagguaaaaagauguaaccuuacgaaaauugauuuuuuuacauguuuaaaaaugucccaugcaguauuuaucuaggcauuuuccaucugaaaguauagacaggcauuauauguugauaacuucaccauguuggguuaaaaguaaauagaguugugauuuaaugaaauuuuucuucauagugcuaaaaauaaucaagaccaaaucguggcuuuaggagggugucauccauuauucaggcuaggcuuucaaaacuguaucauggucucuaauggcacacaguaggugcuuauuaaauaugcgucaaaugcacgacuuaagagagggcaugugggagauccaaugccccaguccaaaacaaagcugaagucacaagaucuuaggauggggugaaaucagacgauuugugccuucuuguccuccaugcagacauccuuuuugguuuccugagcaucccucaggaguuuuauagacuaauggguagguguaagauuaacaccacauccucaucgcaucagacaaccuggagauagggcuauuucaggcuaguauccucuaaacaaauacguucuaaauacuaacuaggaacaguauuagggagaucugaaucuuagauagucuuaacaacuuugaaaaaaaauaaaaagucaguuuugauguguugucuggcccucaccuccagggacagaacuaacccagagaugguuucucaucccagcugaaggaggauuccagacagcaauuaaaauaugcaaaguuuuucucaaaaaucuucguauuuuaacuuuaaggcuuuccaugacagcuuuaaauauauauauauauauauauauauauauauauauauauauauauauauauauauauauauauauauauauauauuuauauauauauauauauauauaauugaaaaauaaauauugaauauauucagggucuauaaaguaaugauuugauuacuauauacauuguguaaugauuaucacaaucgaauuaauuaacacauccaucaccacucaugcuguacauuagaucuccagaacugguuuauuauuaacgagaaguuugaacccuuagaucaacaccuccccacuucacugacccccuagccccagcaaccaccauucucacucucuguuucuauucuaugagcuugguuuuuucagauuccacauuguuagucagaucauaugucuuugucugucugugucuggcuuauuugacuuaacauaauguccuucagguucagaaaugcauuuuuaaaaaugugguucacauauacagugaaauauuauucagccauaaaaaggaugaaaucuugccauuugugacaacacagguaguagucuuugaaggcagaucuucaggccauaagacauucaugggcuucuuguugcuuucaggaaggaagcaaccaccgacaacuuuagauaggauucaggucuuacagucuucagagacauuauuuggcagcaaagaggagagaagauacuucaaguuguggcugauagacuguaagguggccccacauaaucccuaccaccugguauucacaccauugugcaguguccucccuuugaaugugugcaggacuucugacuugguauuaaucagcagaaaucuggcaaaugugaugagguauacauggcuuccaugauuacauugggcauguaagacaccaucuuguugaccaacuugccccagaaacucuuguugcuggcuugaugaaggaagcugcuuugugggaaaagcccagauauucaggaacuguugaugccucuaggagcugagggguaccuccagccaacagccaacagucagcaagaagccaggccgagucaaaaagcuacaaggaaauaaagucugcuaguaaucugggugauuugggaagccaauucuuccccagucaagcuaccaaauuagaacacacccuggccaauauaugauugcaacuuugugaaacccuaggcagaggacccagcuaagucugauacucagauuccugauccacagaaaccaugaaauaauaaaugugugcuguuuuaagcugcaaaauuuguguuaauuuauguagcaagaauagugaaugauacacaaguggagaaugugaaguguguucaaguggagaucgagaaugagcagaugguguggcaaggacaggaagcaagugaaccugaugaaagcuuuggauuaugguucagugcagcauuccugcuacccaucuuauggcugucuacagaaguguauucaagaaaaugcauuaaaauaaugaacaaauuagugagacagagaguacacugggcaaaggaaugacaagcugagcauuauaaacuuagucccagagggcccagggagccacugaauguuuuugagcagaggagugaugugacaaagguguguuuuaggaagaugcaucugacauauagaauggaauggaguauggaaaauucaaaucacaggguguaauaccacauucuuauguuuucaucacauaaaaucucacaggucaaaauggcuaagaagaaaaaacaaaacagccaaguaucugauaccuauuuugguuucaagguacuagaacauuucuuaaaccuuuuuuguuuuguuuuguuuguuuguuuugagauggagucacgcuguguugcccaggcuggagugcaguggcacgaucucggcucacugcaagcucugccuccuggguucacgccauucuccugccucagccuccugagcagcugggacuacaggcaccccgccaccaugccuggcuaauuuuuuguauuuuugguacagacgggguuucaucauguuagccaggguggucucucuccugaccucgugauccgccugccuuggccucccaaagugcugggauuacaggcgugagccaccgugcccggcuauaauuuuuuuaauuuuuacuacaggaagcagauucuuucagauuaugugauaugugccacauauaacaagacuucacauaagcaauguguguacacuuuaauaacauauagaaugacuaccuagguaccugucacucauuuuaagaaacagaacuuuccaauaccuccccuguguaucucucgccauggcaccauucuguuuuccucccaaccaugccccgucccucacaccugggaaaacacuagcucauauuuugcauucuucauucccuugguuuucuuuauaguuuuaucaaauauccugaauguuuagcuuugccuauacuuuaagcuuucuauaaauugaaucauacuguauauauucuccuauguaaaugcuuuuuuuuuuuuuuuuuuuuuuuugagacagagucuuacucuguagcccaggcuggagugcagugguacaaucauggcucacugcagccucgaccuucccggcucaagagguccucccuccucagucucccaaguaccugagaccccugagaccacagacacaugauaccacacuggcuaauuuuuguauuuuuaguagagauggggucucaguauguugcccggguuggaaucaaacuccugggcucaagccaucugccgacuguggccuuccaaagugcuggcauuacaggugugggccacugugcccagcuguaaacgcuguuuuaauccugaauuauguugcugagauucuucuguguugaugcacguucugguauccacccauuaucacugcuaucuccuaugcaggaaugugccaccauuaauuuccccauuucauuguagacggcuuuuggaggacuuucagguucuugcuaucacaaauuaugcaccagaaacauuccugagcuuuuccuaguucucaacaguuucucuaaggcaucuuuauaggaaccaaauugcauaaguugcuaaguacuacuuuauuacguaauaccaaaauauuuuccaaaauggcuguuucaguucaguaaugcauaaaauucccuauuucuccacauccuuccagugcuuguuaugaccuuaguacuuaacguuuugccaaucuggugagugugaaauaacuuaucauuguuguauuaacagcaaugccuuuuuuugagauggaaucuagcucuguugcccaggcuagaguauaguggcgacaucucagcucacuacaaccugucucccggguuccagcgauucuccugcuucacccucccgaguagcugggauugcagucacauaccaccacgccuggcuaauuuucuauuuuuaguagagaagggguuucaccauguuggccaggcuggucuggagcuucugaccucaaguaauccaccugccuuggacuccuuaagugcggagauaacaggugugagccacugcacccagccaacugcaacgccucuaacugaugaguuugaacauccuuucgauaauaugguauucuuuauaggacaguuuguauucuaaggcacuugcccuuuaaaauccacaugucaaguuggcaaaacaagaccuaugcccacaaaaacuuauuaauaaaguuaaaacauaaugugucaaaugaaugugugucuguuaagcuguaaugcacacuauauauauauauacacauuuaaugggacauuucacaaagucaucuaugaugaauuuuggcucccaaguguacuggguguaugaccuugggcaagucauuuaccuuucuaaaccauuacuggcucauaaaaaucuauuuaagcaacacauuuacaaaaauugauacauaaagcaaaggcugucugcauuauuaacauuuagaaucaucacugccccuuucuuccucaguggauuuucagaaauguacauuucucuucuacuguaaguaacuacaguaagcuuucccauugcagauaaagaaaggagcaauacuucccuucaaaccucaauucuaaauuuaaaaaucacagauuacaugaacaagucaucugggcaacauagucucuucagcaaugaauaaucuuugccuugccagggcaccguuucacuuucuguuccuucuacccaaaacacuuuuccccuggcuauucacacugccagcuccuucucaccuuugaaacccuguccuuaccugcccgugcuuuccaaagcuugccccgcccgccuucuccccugccauucauuuccagcccagugccauguuuguuuguuucugaaaauguaucgccacuggaauauauuuuaucuugguguuuacugauuuuuuggcuggcucccccacugaaaugcacacucuguaaaccuggcuugucugggguucaccuuugugucuucagaagcuugagaaacgccuggcuucuaguaggaagcugguugaguaacugcagcagcugggcuucguggcucacaccuauaaucccuguacuuugagaggcagaggcgggaggaucacuugaguccaggcauaugagaccagccugagcaacaagcgauacugcaucucuauaaaagaaaaauuaaaaaaaauuaggcaggcauggugguguaugccuguaaucccagcuacucgggagacuaaggcaugaggaucgcuucagcccaggagaccgaggcugcagugaguuaugauugcaccaccacacuccagauccugucucaaagaaaaauaaauuguugcauuaguucaucuacuaccaauguuucagaaaggauuugguggugaaacuggacauuuauacgcaaguuuuuauauuaauaaaacacuugggccccagacccguagucuagcauucuuuauuuccaccucacuaguuuccccugaguuuguuugcaaaguuaaauuucuaaaaaaggcaaacaaggccacaaggauuuccuguauucucaccugucucccuuuuaccaauaaagaaguuauaugaacauaaaucaacaaaauacuguauuuucuuuauauuuauauccaccuguuaguuuuagaguuuuaaucuuuccgauaaccaucccacugcaagcucuucaggauggaaaccaucucuuaucacaugugaaauucaaagaggaagcucuaagagcaccaugugacaagagguaccgauggguauuuaugaucaaggaagaugaugagcuagaagcagcagccugucgaugaggucacaucauauuacgaauaugguuuauuagcagcucccaaagauaugcccucucuuuggucaauaagaagaggauaaaagguucaagauaaggaagaagcacuuuauaaaugaaaacguucacuaaugaaauuaguaucguuauugcaggaagugcuaauuuuccugcucacugagaguuuaauaaaaauguuaugucuacucuauaacugugauuaaucaguguaguauugagaaguacagcgauucuuuuucaacaaggcaauuuucaaaauuugaaaagguguaaauuucaugcaaauugcuucauaaucauauauguacaaaaaggagccgauaaaauugcaguuacgaaaagaaucauuaacauuuaacuuuuucccccuuuucuccaacugcuccuuaaaugguuuaugauaaauuaaaugacuugaccaacugaaauguauaauacaggugaaugucaacaaaacagugauauuuuaaaccaacucaaauguggaugucaaguuugaacagugauaugaaauaggacauuuuauaaaggaaaacugccuugauucaaugaaaaugcaucuacuuguuuuaauaacaauauagagagacaaggaagcacuuuucuauuuuugauucuucucagugggaaacaguacaucuuugcuacagaaagucacauuucugcccauaggguucuucccucccaccccaacaggucccuagguauccuguaauuuuaagaaacgguuugcaaaccugaguguuccucagacagaguggccuguaaugagccagcccaagaggcugacacccaggugccuccaaucucaucguguguggugccuaacagcacuaucuggguaaauccagaguagguuacucaucuguuuacauagcuaagguagaaguggacaauaagaccucaaguauaaggaugacaguguuaggauuauuagaugcaucuacugauagcccguaaaacguguaagacagaagcagaaaacaaacuuacuugcacacacuaguauuaauauugugacagcuaacagccaguuguuucuggcuuuuaagaaguuggggcuggacgcuguggcucaugccugcaaucccagcacuuugggaggccgaggcagguagaucacucaaggucaggaaaucgacaccagccuggccaacauggcgaaaccccaccucuacuaaaauacaaaaaucagcuggguguggcggcgggugccuguaaucccagcuacucgggaggcuaaggcaggaaacucgcuugaauccaggaggcagagguugcagugacccaggaucgggccacugcacuccagccugggugaaagagugcgacuccaacucaaaaaaaaaaaaaaaaaaaguuggaagcuuuuuuuuaaaaaaaagaaaaauuuaauauauaacuuggaaagcagugguuagcaauuucuugguaauaacucaaagugauucuaaauggucugaguacugccacgguucuugcacuggguggauuuuucuucccgcaugcaggcuuuuggagggacaaaguaaugauaaguaggaaccauuuuccucccucaucuucaucccguaccucauauauuuucuaaaauggccccacucaaggcaguuacuaugcacagccgauguuguucagaagaguuuuucagaggaugauuuuuggugaaaguggcauauuuuagaaccaucuggucacaugcauuaaugcacacuuucaaauuccgcacggauuuuuacgacggcguucuucugcccuaagagucucucgcaggcacuguguguaaaugagacaaagacuccugccgccuucaauucgcggaguagugaacagaggcucuagauuucacauggcaacacauuuuccauuauacgcuaagauuaauaaaccucgcagagccccggugagccacuggaaaacaagggcagcagggugcuuguuucuguuccauuagacacgggacgagcugcaggcuugacacacucugucacuccagccgguaaugggccuccucgagaccaccccggcuggaggcucugcugguuugguggcccaguugcgggagaaaaacuuuguccuuuucuccccgacucagccacagaggcaggguggaugagcuggaacucuccacagccaguggggaacagccaguugguucuucuuugcccuaguuacgcagcaaagggcacccuuuaaauacaauagcaggcugcggcgagcuugggaaccuuucagaauacacaaaaaaaacucacuucuuuuuuuuuuuuuuuuuuuuuuugagacggagucuccuucugucgcccaggcuggagugcagugcugcaaucucugcucacugcaagcuccgccucccggguucaugacauucuccugucucagccuccggaguagcugggacuacaggcacccgccaccacgccgggcuaauuuuuuuuuuuuuuguauuuuuaguagagacgggguuuuacgguguuaaccaggauggucucgaucuccugaccucgugauccacccaccucggccucccaaagugcugggauuacaggcgugagccaccgcgcccaaccaaaaccuuacuucuuggcaguggaagagcaaagacccuggcaggcagcucagcuuugggaaagcgucaggacaugaugggggcuuaaauugggcuucugccaaucacgcccuucaccaggguugggcuugugaucuuuacugggucauucugaaccucaguuucuucuucugauacugagaaugaugaauacaccuaucacuuagggugggauuaacaaauaaugaauguaugacuucagccucaugccuggcacauagaaagcacacacaugugaguuucugcuaugauuacacuggugguugcuuccauuuuaauuacuaugauugcuaucgauacugcugcuauuacuaauacuauucacagagacgugaccccuuugaucuucaauucuuucaacucugaacugaugacagccaugccccacucugauugaugaaucaaacaaugugcaaaaagcauguucuugguacucuaucggugcucaguuuauugcacaucuccaccuuucuggcaggaauucuaggaggaggaaguaaagcccacuuuggugucacuaaaauuuccaaucuccugacugcacuguugugagcccuguccugagagacuucucccuacagaagaaggaagcucugcacagucuugggagguaaaaaccacagcuuccggcugccucugagcacuuacacccucccagccucagcacagacagccucaguugguccuuggaaccauccugugccucacauggaugccucacaauuuacagcaaggccagcgacaaucagggaggagaagccacaggcccaaggcagcaaaacuugguuuuuggcagaacucagaaagccagaggacccucuccugguucugauaccauguucucccacuacuauacuugcuauuuucugaaucacuuaguagagagguaagugagauaguuguuauggacuaaauguauguguuccucuccccagcucccccaaauucauaugcugaagcccuaugccccagugugacaguacuuggagguggggcuuugggaggugacuaauuucaaaugagaucaugggggacgggguacgaugggauuaguauccuuauaagagaaagguuccagaccccuuccucucucugccaugagaggacacacaaaggcauccaucugggaaccagaaagagagccucaggcaggcacagaaugugcccauggcuucaccuuggacuucccagccucuagacugugaggaauagaggucugcuguuuaaccugcccagucuaugguauuauguuaaagccauccaggcagacaaaacaaucgccauuguaugaauaucugcccagucaauguugggggcggggggcgggggaugaaaaaugugauggucuuacccacauuucaguccugagagauggagcugggacagcuucauaaggaagacucccaucacugaguggcccccuggauaaagcuuauauucucuacuuccgcggauagccuggaggauauuguuaucccugcucuauggaugagggaacgugaaguccagaauuagugguugugguagaguaauaaugacucccuacaagagaagucuacacacuaauuccccaaauuugugacucugucaucagccauggcaaaggggacucugaagaugugauuaaggacccugagauggagugauuauccaagauuaucuggguauucccaaugaaaucaaaaggguccuuauaagagaguggccagagggccagaugaggagaaugugaugggacaacggaagaggaaucaguaaaggagaugugaugauauuaaacugcugguuugaagccagaggaaggggccaagagccaaggaaugcaggaggccucuagaagaugaaaaacgcaaggaaacagauucuccccuagagccuccagaaggaacaagcccuacugacaucuugaccaggugagacugauuuugaacuugugacuccccagaacugcaacaugauaagcauguguuguuuaaagccaguacguuuuugguaauuuguuuauaacaaaucagcuaucagcaagaggaaagaaacacagugauggaguuagacuucaaacuuagaggcaccaaugccaaagucagaguuccuucuacucugcuaugcugcucugaugaaugaaugaauggacaaacugagguuccuuccaguuauaguugcuggggagagaacaguucaagaaccugcuuguacucuucucucgguuccuagggcuccaacaauuguguaguguauccuuugauguuguuuucguuuucuacuugucuuguuaaaaaggaaggaggauuucagauggcauggauaaauacaaacugcauauaaaaacuagagaagagucaagaguggggagaaaagggagcaaaagaaaaagaggaaagaaaagaaaaaauaaaacugaugauccguaaauagaucuugaggggaaaaaauuuaaguuaaaauuuuuaaacaaauaaggaaauaggugaaauuaguugccagagagguaccauaugguuguaugacuuuacuggagccaggaagaagggugccagaaauuuauuuuugagcucccgaguggccagauaaaagaagggaauauucucagauaugagguucagauuuaaaaagaaauugauugcuuaggagaaaugaucuuuucuugauaugagaccucugagaaaggucuccuggguucucuguguguuaacacucacucucuaccccucccauuagauccugccaccugauccuugugagggagacuagauuuucaaggaucuucaauuucuugaauaucccuguagcauauaacccuggaugaaauguucaugcuuccugagacagaaaacacuagccagggcaucagcgaggguucacucaccaaauaacugaauacuucugcauaccaggccuacagcugaggaaaagggcaaacacuacacauuuuacuucuuuacaacagcucccgaagagucaauuucaaaaguauugucuccauucaauuuugcugugcaaugaaccaucacaaauauuaguggcuauaaacaacagcuacuuauuuuuagcucaagauugcaugagucagcaauuugggcugggcucagcugggcaggugucugcugucagcaaggcaguugcgucuguagguuggcucuuggcuggggcaauauggaaacauggucuugugucucucaucgcccagaaggcuagccugggcuuguucgcacccagaaguaaaaggguucguagcacagcaagugggcaagcaccaacauaaaagcacguuucaagccuuugcuugugccguguuuccaaaugccucauuggucaaaucaaguuucaugccauccugguucaaggaguggacaaacgaacuucaccuuuggagggcgagaucuacaauuucacagugcaaggauguacauaugcaggggacagggaagaauugguggccauuuuuacaaucaaccauagauauuaauuauugguaucuguggacuuaauaucugccaaccaggacacaaauacagacaguucuuaauaacaagggauauuaaugaaucagaucacuaaucauuccuccuggauaauuuaauauaguuuauucaacacaaaggcagcaggguggaagagagguagcuuccuaaaaggcauuugguucuaaaaaucuaccuuuacguucuauugcaauaggagaaaaaaaaaaagaaaaaaaaaaaaaagcguguguguguguguguguguguguguucacccacacgagugcccguauccugaacacauacuaucuuuggauucucccuccuacguuguuauuguucaauuuuuggcuucaauaccugucaguucuguuccugaaccaccccauacugcccugaaucugcagcugcuccagugauauucagaguauugaaaagaaauaaauaaauaaaauaaaaggaaaguugcagaagggcaacacuuaccccauacacaggaaaauagacugaaaggaaaguauugucaaaguguuuugcaaaugacauuuucagcaauauaaauuaugauuuauuuucccauguaaucaucuugauugcagacauccuuuuggagaaaucgcacugcucuuggcuagcuuuuuaaagccucacaagacaacuuucaaaccugauuaguauguaugcuguaaaaucagauacauuauauuuagcuugaagugcagagcaucgugggugcaaagaaagaaagauagggggagggauuaaaaaaaaaaaagaacaucuguaaagcuuuucagagggaucugcacagcauauggcagaguaagaguuugcucaaguucucuuuauguaauuaacugacuaugugucaccuccccaucguggagcuccgacgucgcucagcuaugggaugugaugacuccguaccagggaggggcucaugcuuuucugugaugacacugaagagcucagcacuuccauagacagggucuucccugaguuaaagaucuuaacuccuagcuugcaugcuuucaccuccauucaggggagcgaucagauugucagugagugcagauggccucaaaggaaggcaaguauugaccgagugugagcaacugacaaagagcuauguauggaaacaggccucuccaaugggaguaagugacaggcccagcagggucagcccagagggaggcacgugcaaugccaagggcagacauuuauggaguccucaagcucaaggucaacaagugcagaauggguaccuccaugaaccugggagguuaggggccuugcuugccucccuuaacucugguaugcucagcaucaggggaugugggaacagauacauuccuggagugugaaucuaacuuguaagcaacgaaaacacuagaucguauaguaacacacaacacugcggaauucagaguagaugcagaauaugcauggguuuuugagauaaagugagcucucagaguaggaauucugcaugcagugugagagcuagaggcagcauucccaaaccucgcgaggcucuuauuuccuucuccugugcccaaaaggcacuccaccacgaaacaguuugagaagcuagagauuuccagagagcuuggaucaaauccagaguugagcauccaauuuguuuggauaacucuaucugagaaaagggcaggggaagugauguuuguugagugcccagcauaugccuccacggggcuaaaaacaaagacuccauuugccauugcuucaucauuauagcaauccugaaugucaacccauuguuagguuggugcaaaagucauugcgcuuuuuccuguuacuuuuaaugggaaauuagauagagacguuaaggcacagagaagauaaugaguugcaucaggucacucaagagaccaacuauuuucaauucacuuccacugcugguaacugaagauccugagccauagaaggaacccugcguucuucucugcaggcaaaaucacuugcucggcucacaggugaagccgugucugccuguaauaaaaccucugauucccuauaaggcgcucuaccuaacauccuuucuuugcaguuuauaucuucuucaauuacccccuuucuuuuauauuaaacuuucugcuuuugaaaaagucucuccaaauaucaggucucuuuuuuuuuucuguuauucaaaaaaaaauggggcuuugauacauaaaauucuaaauuggccucccggauucccgguccaugguguacgcaugcauucuuccaguuacugagucaauucauacucuagguacugucaugaagggauuuugccaguguuaauuaagacuccacaucaguugcccuuaagauaaagaaacuauccucaucacgugagcccuugaaauccagaccuagacaucaaaaucaaggaaagucagagagauucaaagcaggagggaacuacaugcaugagagaguuucugagcccuugaaauccagaccuagacaucaaagucaaggaaagucagagagauucaaagcaggaggggacuccaugcacaagagaguuucuguugcuggcuuugagaugcagggggccaaaagucaaggaauguggguugccucugggagcugagggcagccaccagcagaagucaguaggaaacaggggcccuagucuuacaacuucaaggaucugaauccugccagcauccugaaugagcuuggcaguggauucuuccacagagcaugcaggaaaggauguuccuccagcggacaccuuuauuuuguccccaagagacccugagcagagaagccagucacauugugucuaggcuucugaucuagagaauuguaguuaauaaacaagaugugaaugugaacugcuaaguguguggucauuuguuacacagcaauagcaaaagaaaaaaaaauucugcagcaugcaacaaucccagcuuucaaauaaaauuuucuccuguucauuucuuuggcauucacaaugaccaugccuucagaguauaaaauucauaacacaaaaacucaaucaccauagcugcuuuuuuuuaauugcuuaagaacugguuucaaaaugauauguaucacuaacauuauuauuauuguaacauuauuaucauuaauuuuuuugagacagaguuucacucuuguugccuagacuggaguauaauggcgugaucucagcucacugcaaccuccaccucccagguucaagggauucuccugccucagccucccaaguagcugggauuacaggcaugcaccgccacacccggcuaauuuuuguauuuuuaguagagacggggguuucaccauguuggccaggcugguuuugaacuccugaccucaggugauccacccaccucggccucccaaagugcugggauuacaggcgugagccaccgcaccuggccacuaauguuauucuugaugguaauaauauucuauucuaaccaguaaauacagaccagcagcuaguguaauuguuuuucucugccguaucuuacucaaaggcaagaaagaaagauuucagauccaaacagauuucagaaucaauuccacaaaagguaccuguuucaguaguacugacuuauucugagcuacuagcuggagaaaagcccuacuaugcauauuuuuuguauagaauauuuucuaauauaaucuccugaacugcagagacgggagaaaaaaauggccuuguaaauuucuccuaacaaccaaaaguacacuaaaaaagacaacagccuuucaaugucacuaauuucucugaagcaauauaacagcaaacuccagagaccuuggcuaguucagacaaaauagaaaaacguagauucaggagaagcuggggagcuaggcuuucugcaacggauuguaagccaagucauaaauugagguaaaguaugagauagaggggggaaggaggguggagccuguuguuuugugccuguucacuugaggucuguaagaugaaugggcugagaauuguccuguccauuucugcaauacauucacacgauuaaagucauuaguuagaacuuucuaccaggaagcuauugugagaagaauguuucccuugaggaggaggauuaaaaagaaaaagaaaagaaaauccucccggaauacacaaaaauauaugcacaggaaaaaugaagccaguggccauuugcuaauaguguugcuuuaaaagcauacgcacuuagagccucuuuuuuccagcacguuuaauaagaaaccauauuaacaaggugauccaggcaaugcuugggaggaaagggaaaaaguucauucauuucauaaauccauuggcuggagaacaucucuuucucccagucucaugcuagaauuugaucuacuugcuccucgacacucagucuacaggcaugucuuagucuauauccaucccuggcucuggccuccaugaucucuugccgggacuauucuaggagcccaccugcuaccaguccugacccucacaaauccaucguucuucccugaagccagagggcucuuucuaaaauacaugcaugguccccuuauuaugugagauaccacaacauucauaaacgcucccagugcuuucugugacugucaggguaagaucuagaaucuugcuguaacugcugaagcaccugggaaggucagcucuaucuccaagcucacccuuccccacuacugucccucucccaagcuaggcuccaagccagacggaacuauguguccuuccacguagcggccagaucuuguguggaugccguggauaugauugugagcaacaaaguccuuguagucagggagcugacagccuggaauagccagcagagaauuaaacagauaaccacaaaaugaccaugguuguagggguuaguaugggaacaaaggaggaugcaagguacccaacucagacugaagguuguagagagaaggggucuaggauucaggcaagucuuccgaaagagccacuugguuuggugaaggaaaaggcauacucuaggcagaagaaugugacaacacaaaggccaggccuuuccaagcuugaucaaagccaagacuggggagaagugacacuggcagaggccagcucagugaauuggaggcuggaaucagggagaccuaugagaaccaacacaacagcuagguguaagcaggcaagcucaugaaugagcauaacagaaaucuccaaugccuaggaggccaggccauuucuacaaugagugaagcaggccugauggguacuauggcaaaccacagggcacaugccccagcuaaagaggggcagccgcugcucaaguccagccaacuguagccaaauguaaaaugcaggcaaaggaugccagaucugcuuugucgagauaagcaggaaaucccaauuuugaugggaugucucccaaguuuuaaauguucacagcuaauuuauuucauuaaaaaauccaaaacaaacuucagcaggccaaaccaaagacauccacaagccagcaauuugcagcuucuaggauaugacugggaaacgaggauggagacuccaggcacuagaaauuuucuuacuucuuacccagggaucggaagggcaaaaacacugaaaauaaagcugaccuccgggaaggcggugguggcagcagccagggcagcugcugcccaggagugaaagcaaaccucucugaaagccaagaaugagccggggccuucagaaucacagccccacaucugugaccuaaguuagucaacaaaugcucacugagggccgacuaugugcuuggcacuguuccaggcucugaaaaagcagcaguguagaaauccaaugaaauuccugcucugcacuuugggaggccaaggugggcagaucaccugaggucaggaguucgagagcagccuggccaaccuggugaaacacuguuucuacuaaaaaauacaaaaauuagcuggguauggugguaggugacuauaaucccagcuacucaggaggcugacguaggagaauuguuugaacccaggaggcggagguugcagugagcugacaucgcgccacugcacuccagcuuggacaacagagugagacuccugucucaaaaaaaaaaaaaaaaaaaaaaauccuucccuagaggaaugcacuuaugugucgcauuuccgggcaaaaugaaaaauaagacaguuuucagugguuuuagcaaaggcugugauagagggucauccucuucagcuauagugccacucccuucuuggaaacucaaagacgacaaaaacguguaagugaaacgggcuccaugggcccagugcuccggcauuccagaaaugaagagaaugggguuuuccugcuuguuuuuggauguauccccaacaccuagaauggugccugcacgugcuaacaucugcugaaugaaugugacaauugagggcuaagagauauucccaagagcccggugcggggggcggagaaauaauaucacugaaguugguauugguuuuucccacaugaaaagcauuucucuuugcuuccaaaugucuaugugaucauagauagguagaaucaggucuuaagguaaauaauaauaaucaugauaauuggucuuucccuguguuagcaagcuuggguauucagaaacaagcagaggcaaaaucuaauagcccacuacaaaaaggaaguccaaauggagcaauguggacuucucacaaucauccuuccacauuuucaucucugcuucucacuuaggacaaucccuuuucuuuuuauuuuauugcaauguguuuuaaaguaaguuugccggcugggcucgguggcucacgccuuaaucccugcacuuugggaggcugaggugggugaaucaccugaggucaagaguucaagaccagccugaccaauauggcaaaaccucaucucuauugaaaauagaaaacuuagccgggcuugguggugggcaccuguaaucccaguuacuugggaggcugaggugcgagaauugcuugaacccgggggcggggguaguuugcagugagccgagaucaugccacuucacuccaggcugggcaaaaaagcgaaaguccaucucgaaaaauaaaaauaaaauaaauaaaaaauguguuugccggucucagggaaaacaaauacaaagcaguguugugcaaaaucacacaccgguacguuugguugaacucuguccuaaacacagacagcagucguggugggcacggcaacucaccgcacgccgguccagcugcgauugauuucaagacccauuuccauuguagauacuuuauaauuguacucuaauuguaguuaagauggcacucaagauaaaugaaucaucucagauaugggaacagggugcuccaucauacaaauucccugaccguuccccgugcucugagaccagaagaacucugcuccucucaagucccaguuggugauaaaauucccuuugccuuccuugaaccagauccugacagccagcaagccaagcguucccaaucgccgacugucuccaugucucuguguuggauuuuuucuuuuuuuuuuuuuuuagaggaggagggaaaguacccuguuuauuuccaaacucccuugcaucugaugcacgauaggcuggcauuugcuguuaaagcagaaaauuauaaggagggccuaauugacccucuugcgucuuugaaaaagccugucuguggucucuaauugacccucuagguaccuauggaacaaugaaugaaucuucaggaaauaauggagggcgaugauuaauagcccgggccuggcuggaccuccaucucucacaguucuucucccuguuacuucccuuccuccccuccaugacacucgauuccuugcauuucauaagcagcgauuuauuauuaucacagaauaauaaauacccugcaguagacacuuuuaagaaucggagacaucacgauucugcagagauugugauaacauuuauuuaagcuggcauucucauuuuucuuauuggcauggcucagaagaguccuccucuggcauuugugggcaaagucaaacaagaggcuucuuuugcacuccuugugaaaucauuccaaauguggagucauuuggaacugcaggggcuucuuacuuccaguccaaagggugaacauugucccuuuugccuugcucauaagaggacuaaagcccuucagacguacagcaacaacaacaacaauaaugcaaguaguaaaaaaaaaaaaaaaaguggcacuccuuuaguggggaaugugguacuggccugcauauauuaccuugaugaauacucacagaagccccgagacaucgauguugcuacuguccccauuagucagaagaauacacugaggugcaaagagaauaaguaauuuaccuaaagccacaaaguccaaagcugcagcucuguaugcuauacacaucgccuuccaaguauucaacaauaacugugccaaauguacaauauuaaggauauguuuugggaaaugugaguauuagaauaaaaaagaguaccuuucccuuucaguuugguugaaaaaugcuuccuuuccccggacaguauaggagaauacauuuaaauuuagaaauauacacaugccuccaaugaggauucugagaaacuagaauuuuuuuuuuuuuuuuuuuuuuacaaaaucauagcauuaacuaugagagaaagagaaaaagacagagagaaagagagauagagacaaagaggaaaaaauccguccuuccaaacccacccuggcccccaccaaugucuccacauuccucgggaccuuaaauggcaagggagccagaaguugucugccaggcccugcugguuuauccgggccccuuuucuucuuacucagugcuuugugggagaacaggccgccuaugcagcaaaauuaaugcuuggguaaggcuuacagucuuugugaaaggaauggauugucuccagcaccaggucccaccucugucuucagaaagcacugggccaccauucagagucaggggcucugggugggcagugggcuucugacagauaggugcagcccacgugacucagaaauagagaagaagggagcugaggaaccaaaucugcgugcccugaauggaaggcugccuuaggccaccucuacgguccuauucaacugcagcauuuuaaaagccaaaugagacuguccuggggauuuuuucuuguccaaaggcacauauauauuuguguguaccuguguguguacacccacguauaugcauggauauguaucauacaauauauguacauauaucaaggucuuuaccuauaucuauuacugugcauauauguguauguauguaucuauaucuaucacuucuaccaacccaucagccagaacuguuuucauaugcuagguuuuacuguauggagcuuaaaacccauuuaugccucagguugcaauuuuuugaauuuucacgaucagaccuuggugauggcuuugagcgguaggauauaaauaauucccacauacuuaguguuccaauaauggaacacuaggcauauuacuacggggcuuauaccacugauagugaaaaucuugacaguucuucucuucccuuuccaucauguccacaugcaucuggccaccaaguccuccccaucccugcucuagugcuacugccuuagggcaggccaccuucagcacuuuucugcaugguagcaagaagcugauaagagggaaggggugccacaugguuuagccuguuacccauuaccaacuuguacugcacucaaaguaucuguggaacaacucagauuuguugccucccugcuugacggcguguuugaugcccucagaaaaacacuuccacuccucaguagagcaucacagcccucugcuguaugacacccgaccuuucuacacuuuucucucugcaccaagcugugggaguuugcucucuuaaacucccacguuccaaccucagccaagcucuccgggcagccacacuucccuuugccagcugugaccaccaauacugccaccaggggggucugcaggaccugcagggccacacucauuggcaccucggugacuucacuuacucuggucacccugcugucucucccaggccuccucccucacagaccuucuagggaaagguucucuaucauggucaacuuugagccguguauauuggccacaggcaucccuccuucuauuagggcgccauacugcucacuuauuauugccuaaaaccugcucccuuguaggcuuucuuuacagggcucuagcggauucuuagagauaguagacagcucacugguaaccacaguucaaaugcaaaccaaccaauucacagccacacccucaccacuggcuuuauugggcucgaacuccaggccacacccaccuacccuaaucaccccauagccaugggucagacaccuaaagacaaccccugugucccagagcccauggaaaugacccaagccagccaauccuaagccugcuuacccugccuggccccuucuuuccugugaaaaucacaauaaaaacauuuuuuaaaaaaauuuaaguuccaggguacaugugcaggaugugcagguuuguuacauagguaaaccugugccauggugguuugcugcaccuaucaacccaucgccuagguauuaagcccaacauccauuagcuauucuuccugaugcucucccucccccaaccccacuccucacaagccccaguguguguuguuucccucccuguguccauguguucucauuguucagcucccacuuacaagugacaccaugcgguauuugguuuucuguuccuguguuaguuugcugaggauaauagcuuccagcucaaaacucuugacaguucucccccucucccucugccuccugcccaacccuggggcuuucccagguaacucccuguggcauguggaguccccauggaucugugaguaacaaaccaucuuugcaauagcagucauuuccucaucuuggccuuaccauaccacaauaagaauaaaaccuguuaaaacagagagaacagagggagaaaggaaggagaaaaggaaaaugaaugaagaaggaauaaagaaugaguaauuaaaugaacaaaugauaaguuacuuaaaaucugcuuuuucuuaggaggagaaagaacuaacagagaugcagaaguccucuucuacucgggcuggggauaugcaugagaaagacacgcguggaugccguaugagcucucguucugaaugcggaaaucugaccucccaccggauacucaguucagggggcuccuggacccuccagcugcuccucuacucaucgcucccucacucagaaaaccagcagagaagugaacuuccucaaaugacugacgguaaauauccagcauggagcuggauuacaaaacuguauaaacuguaaauagcaucacgcuauucccuuuuaaagaagugucagugcuuuuauucauuaagauucagaugcuauggagggggcagaugcgccuucuccccuccuggaucccaaauaaaacaccccguauggaagcagauggcuuuguguaaaucagaugacaguuuacggagugagacggccucaucggaacggcauuacaaguaucaucuuuugaggggaaaugggguuaaucaaguccagcuuuaauuggaggucacauuugcaugugaaauucugggucccuguaaggacugccugggucccugggucaucaggccaguaaccucuccaccauuuucuuuccagagggagccccagguaaugcaugagaaaggaaguguuauaagaagccaagaaugggugccccccaccccccaaccaagagccaguucuguuaacacagcagagagcccuccccaggucucaaagucucccugccuuugcugccacagguaagagggggugguuuugcucacugcaaaccacauaacagaaacaacaccugcuugggcacuuaacccuggaacgggaaagcugaaagugguuucuguuuauuuugaucucgagcguaaaaugaagagcaaucaugucccuggagucucggcagaggacaaacaaagcugauggaggaagacaaagucugcuuuuucaggaugcuucaugggaggcugggguguuaagcgcuccucagccugccugugugaucugagaaacggggcgggggcagguggggcgggggcaguggcaucaggugccugccucccgccgaggguauucaccauucaaagcacaggcgcgaagagcaaacagcuaccagacagaauccuuuaggucuaggcuauuccuuuccuuugaaccagagacaggaacagaacaccuuagcccagccucccugcaacauuccaacacuugaauuguaggaugggagucccaauuucccagacaucagggcaauauucucccauuuccuuacaacacugggucaauguaaagguuaaaaauuuaaauaaauauaaauaaauaggagaucaacauccuccuuucuugggaaaauucagacaaugcuacacaaaaguuuggaagacgagauaucuaaagaucacccagaaaaaagauauaggagcaugcuguuuucauuagguuucuucaaaaaucagugguaugauuucacaguauuuuguuucauggaauauauucacgauauuuguuucauggaauaaauucaugauauuuguuucauggaauauacuggauaucuguuucauggaauauauucacgauauuuguuucacacaauauauucaugauauuuguuucauggaauauauucacgauacuuguuucauggaauauauuagguauuuguuucacugaauauauugacuguuacucagaauccuaacaugcaaugucuuucuucaaaagacagugucaugcauuccuuacaguggauuuaucaauuaaugcugaguccccagccaagugauaagucauaccaucucucuuacuccuuuuuucuuaauccuuaaaaaaaaaauuagguccgcccucagccuuuauauuccaauucuucauuccacacuccugacuuuuucccaaguuauucaaggauggaaaagcguaucaucuccaagcuagcucuuucccgccuucccauccaaccaccccacucugcugccauccccagcacagcccaggaguaagauauuugacaagaauugucaggguuaacaagaacucccaaagcaagcacuuugaguuaugucagacaaaaaugaaaauucaaaagaggagcauucauccauaguagaaaauaucauguucuaaaaccaugaaaaucaaaaaagaaaaugauuuuugaaauuaugucucccagacaaacaagugcucuugaccagaggccagcaaacuacaacccacaagcuaaauccagucuaccaccuguuuuucuaaauaaaguuuuauugucacacaaccaugcccauuggcuuauagauuaucuaugugcuuucacuaaugcaugauagcuuaguaguugugauagguaccuuguaggccacaaagcagaaaauauuuaucaugugaaccuuugcaaaguuugcagaugcuguucuagacucaaaauucauuucagugucucucaaauaauuggguuugcuuuguuacucugaguauaaauggaaugauccagugagaacuuuuaaugacaauaguaaggaauuauuaauuuggguuuagugaagaagagaauguuaaagaaccaaagaaauuuuuaaagauucacagccacucuuuuugaaauaaagauuaaaucccuaccagguaacuucauucaaccaugaacauuuauugaauguguauugcguguuuucaaccuaggcauuucccuucauuguugcgggggugggaugggaauuuucaguccuccucuccugacuuuucuuuuuuuucuuucuuuuuucucagucaacucuguccuuguuuauuuuaucuggcuaaauaaaaaauccuuuaaagauuccccaauucugaugggguuccugcccuacauacaccauacaaauguuuguuacagguauuuggauaucucagaucaucuaagacguucaucuuacccuuaggcuucauaucuaaacuguaggauuaagccguucagaauguacuugauuccuauaauauguagugauuuugcuaauguuguucaguuuuguuuccuugcccagaaugauuuccauuagcucgcuugcagauuagcagccuaaucuccuaacaagagcucuucgaucaaauggucuggaguggccacaugucuugcugcugccaagugacugauuuaagagauggacaaaaaggagacacacagaagucgagauagcaugauuaauggucgauccaacuuucucugaaccgcauaucaugacugaaugggaaacccugaagagauuaaaggggggaauuacauuaccaugaauaauauaaaaaagugauauucugucuaaaaaccuuuugagugcaagugacucgaacaaauauauuaacagagcuuacagcagauucaaucagguugaacgcuccccagaauuuauuuugaaauaagcuuuauauaucugagacgugaagaaugaaucuauucguggcuggcaggaaagcuauuaacaugcagauuuuaauucugccuuugauucuacagagguucuauugucccuccuuuacgaccggcaaucucucccaauuacggauguaguacaccuccacaaaucucaauaccacagugacacucuagagagcugagauuuauuuuccucacuuuauucuaacuucuaaaaauaaguucaaauauuuauuaucaaggcaccgauaaaaguaugauguuuaaaagcaugaauuauauuacaccaacccauccaucuguuggaaaugccaguuuggggcuauauuuggggggcaaaacuuggcaguuaagauagaaaccuucuuuacaaaaacuaggugcacauuaacuuacaauuaagccuugauguuaaugagguuacagcaugugaccaguuaacgggcugcagccaaaaggcaaauauugaaaugaaggcguuuauuuucaaaccaacaaaccugaacuaaaccauuacacuaagucccauuagcauucuaguuauugggcaaaauaauuucaucuccaaaauuaauuaaauaaauuggaaugaccuggaaucacuucuguggcaggcggauggaacaauacugcaugaaaggcaaaaucauuuagagucaaccggcccaucaguuccuugagagaugauguuuaaauugaugggaagugaaaguuaaaaauaugauucauccaaugaggcagugauguacuguuaaaauguuugcaaaacaauuuuaaaaauaaaccuuacuuaaaaaaaugucucccccuaaauucagggauaggaugucuuuagauuaaaauaauauguuaacauguucaucacuuagaaaauucggauucugcucugcgugagucacauuuauuuucuaagcaaucuggauuuuuuuuuucuuuaggaacaaaaauuaauaaaauacaugacuguugaaugcaauuaaugggauccaagggcuacugccaaguuuuugaagagaaucaacagcagagucuuagcucaaaucauauccacaucaguacuacggauuaaauguuugcguccucgcaaaauucguaauuuuuuuuuuuuuuuuuuuuuuuuuugagacagucuugcucugucacccaggcuggagugcaguggugugaucucagcucacugcaaccuccaccuccuggguucaagugauucuccugccucagccucuggaguaccugagauuacaggcauucaccaccacacccggcuaauuuuuaaaauguuuuuagaaaagacgggguuucaccacauuggccaggcuggucucgaacuccugaccucaagugaucugcccaucucagccucccaaagugcugggauuacaggugugagccaccacgcccagccauauguugaaauuuaaucaccaauauaauauauuaggagguagggccuuugggaggugauuaggucauugaggcaaagccuucaugaauggguuaagggcuuaaaagaggccagauagagagacccuuugccccucccacgauaugaggacauagcaaggaggugaacaucuaggaaccagaaagugggccguugccaaacacucaaucugccagcagcuugaucuuggacuucccagccucaagaacuaugagaaauagauuucagguguuuauaagccaccuaguuuaugauauuuuguuauaguagccaggacagacuaaagcacaaggcuuucuggauggccuaaugaaugagaaguagaaucacuuguaacuaauacagugucuagagcacagucaacacuaggcaaaugccagcaaucacacuucaccacagggucauugaaaccuggcauuugggugcaugcugugucguuugugagcuaugugaccuuagauacacaucuaaccucucugucccucauuuuuuucaucuguaaauuggggauacuaauagugcccccucuaguagaauuguauuaauuugaaagagcugauguacgcaaagcauuuguuauagugucuccaauguaaaggcucaaucaauguucaucucacccuauccccguggguugaaacuggcagacauuccaacaggccugguaguuguuuuuuuuuuuuuuuuuuuuuuuuuuuuuuuucugagacaaggucucacacucucccaggcuggagugcaguggcaugaucuuggcucacugcagcuuugaccucccaggcucaagcaacccucgaaccucagccucccaaguagcugggaccacaggcaugcacuaccaugcccagcuaauuuuuucuauuuuuuguagagguaggguuucaccauguugcccagacugaucugaaaccccugggcucaagugauccacccgccucagccucccaaagugcuaagauuacgggcaugagccaccgggccuggcccaggucugguaguucuuaacaacuacuguugugcccagguuuucuaggcucucucugguaacacacgucaguaacuuaucucuuuagauggagcuuucucaaagugugguucauggacaaucaguaccagaagaaccugaugcacuucuuaaacacacugauuccuagaccccauccugaauguacuaacucagaaucuuuagggagugggacuaggaauuuauauuuuaaaaauaaguuccuagcugagucucagguauccagaaguuuugagaauuaauuauuucaacaaacaauauaaacaauggaaucguaaauaaucuuuucuugggcaagguaauugcaaucccacaauaugagauguaauuaacaaagugaugaaacucuggguccaguauucuuuugaacaaucucuugcccucacuuucuaguuacacucaaugugggcugccuuucaagucccgaaaccuguuguauacagaaccgggccuuaaaguucugaucacacuacuguuuucucuaccuccuggucccaagccuucuccugccugacccccuucuguucccuuucaugcuucaguuccaaccucaccuccucagagaagccuucucuagcuccuacacaagguuagagucaucuguucuaagcuguauuaguaacuuacauucuuugucauaguauuagcuuuuugugauuaauuauguaaauuucuuuaaagaccgucuuucuucuuccauaaaaaacugacagaggguagggaccauuuuccccuuauccaccauaacauuccuugugcccagcauagagcauguuacagacuaaacugcgucccccucaaauuuauauccugaaguucuaacccuccaugugacuguauuucaagacaaagccuuugaaaggguaacuaaguuaaaugaugucauaagcguggugcccuaauccaagaggacugguguccuuauaagaggaggaagagacaccagggaugugcaccaagaaacagacggaaggccacgugaggacagagcaagaaggcggccgucugcaagccaaggagagaggccucagagagacccugccagcaacuuugucuugaauuuccagccuccagaacugugagacaguaaguuucuaauguuuaauauccccagugggugguauuuugucauguuagccauagcaaaugaacacggugccuguuucagaauagagacucaauggcuauuuaaucgccaaccaugacuauuccugggcaucacuguggucucuccacucucauuuuaucugaaggaaauaaaacauugaacuuguuuaaggauggauuuaagccagacaugguugcaggcaccugucgucccagcuacucaggagacuaagacaggagaagcucuucaucccaggacuuugaggccaaccugggcaacauaaugaaaucccaucucuuuaaaaagaauuuuuuuuuuaaaagaaauggauuaaaaggaaccaucucaauauaucccacgaggagcaggccacaaucgcccugcagguaaccauuuccucagaagcagagauuagaaccaauacaacaucccugaguuggggcuggacauucacuuaguccaaacagcuccccaacaaaaguuuugacccuugcagucacucccuggccacagugguaccagugggagggcaguuacugcuaaucagucaguccuaaagugcugagggaaucagaauguggguauguacuuagagaaucacuaaaaugagaaugaaaacuuaauucacguuugguuugcuuauucuagaaauaaucucucucucuuucuuucucucucucucuuuuguaaagcuggugucucacuaugugcccaggcuggucuuuaacuccugggcucaaaugauguucccaccuuggccucccaaagggcuaggauuauaggcaggagccaccaccccuggccauaaucucauuuuuucuuuuuugagauagucucacucugucacgcaugcuagagugcaguggagcgaucacagcucacugcagccuugaacuucugggcugaagugaucccccuaccgcagucuccugaguagcuggaaccacaggagugcacaaccauacccagcuaauuuuuaaauuuuuuguagagauggauggucuggcucuguugcccaggcuggucucaaacucccggacucaaguuauccucucaaagugcuggaauuagaggugugagccaccaugcccagccacaucucauuuucaaucaucucauuuuaacccacugugcauugcaaugaguuaaaaaauggcuuugaugccacacaguucugcaugggaauuacaacucugccacucagcagcucugugacuuuggcauucauuuaacucagucagccaguuuccucaucugcaaaugaggaacugacuacuuaauaagaugaagauaaugucuacuuaauaagguuguagggaagauuaaauaaagaaugcaaaauguucagaagagugcucucaauaaaugguaacuaugauuguauuauuaaggaguuggauuuuauuaauaauuaauauaauguuagcgcuuggugaaagacaucuacuguuuuacaauuauagucagagagaauauuagugucaguucucuauuuccuaccaaaauauuugcucucaaaacucaauuuuuuauucauugaauauuaagagauuaugcuagaucuuggccaauauaugcaaguaaauuaauucacaaauauccugaaagucaaaaacauggguuucugcuuggcuaggcuuuuccuacucuaggaaccucuaagcccuacuacuagaagcuuugaaacugagggauguaagucuaucuacaaauucucuuuaaucacaguauucuaaucauaaccucuuuuuuugacaagaaauuuauggcaggcuguugagauguuaguuuauugaugauuaaaguaccaaccguccuugauacaaauaaacaggguuucagagucauaagcaggaagacagggcaccuaucaggcccugcgggagaugcaauuuauggggcauucaauucucaucaguguauugucaguauauucaagggaucucacagguuucuguuuugaggauggauguucccuccacaagacaaggagcacaaaaguuaaggucuugggucuuauagucuugaugccuccauuacaacugaggguuuaauauugagaagugcccuuggccuuagguuuuugcauuccaagucuuucagcauaugguaugcucaauacagugcuucaaacagaauuuggccaguguugaaaaguuuccauguuagggcccaaacuucuguguaaggugcauggguggaagcugcaaugaccaagcaaugcccuuuugcucuguucacaaguuugacuuuaucaaccaacaauacaguaccucuuaauccuucucgcuguaugugaaagggcaucauuguaguaaaaauccauagugugcacagaccucugguuuucuucuaagcccacagggggaugagacauucccacccucuucagggccacgugacuggccuagccaguaggcagccaagaggaaacgacucgugacacuucagaccaaaccauuuaauugcuguugugacucgcccuaacuggagaucaagaaggccaucugugccagauguagcagcugugagaucacagacucuauaaguccgggucccucagggacugugcagaagaacaugccagcccacacuggacaugucguaugagcaagaaaugaaacacauguacucugcucaaauauguguacuaugcccuuccccaaccacauccccuucuggacauauacacagucacacagguagaccaugaaaggaaaaauuguuugcuauucugcuucuacucuccuccucucauuuuucuauugguucuggcuacagaaagacauuggggcuaacauccucagggaucacauugugacaacccccaggcccgucguuuggguuuuaacugagaaucccaucucaauuuucccugcauuaagaaagaaagaaaggaaacgaaagcacuuggagcuuauuaccuucacuucucacagaaaugcauucauugaauuaugauucaagguuaugccaguuuagagggcugauagaagaauugucuauuuaauauguguuucugugucuuuuauaaaaucacaguugagcacaacucugcugggugcauuacgcaaucccuccuguguggaucugugcgguaggaaccugcuuaaguucaauuccagcgaacacggucaccucugcacaucggcuucuguugcauaguuuucauucccugacaauaguaagcaaugugguuugcucucagcuuuaacuacuaaaaaacaaaaacaaaaaaaaucugggaccaaauucaaacgcaaacugggggacuaggcugacugcaggucccugcaacaccacucugucuucuucugauugccucucucuccuaauuuucagauucuacaugauguucuccagcuugcagaacacaggguacaucaugucaucuagagucaaagucuccuccuuacccaaguaucuacagucaggaaaauggcaccaggagaucauuacguagguucauccauccggcaguguuuacggagggcuggagauacaccugaugaacaauuucuguuagcuuaacauuucaaauccugagaugucuagugucgauagaaauuugggagguuucuccaagaaguauuacuuuacaaacaucaugaagauuaaguccagguccuaagcuggggucugugcaauuuacuuuuuuuuuuuuuuuuuuuuuuuuuuuugguauacucuguugaaagaaacccucugguaacugacuucaaacaugacaccaauccaugcaaauagucccaucuguccucaacugauucuuacaaacaaaacaaauuuaacuuuuauuuuuuauuuuucauauuacaaaagcaacguauguucacaacaggagacaaaaaucagaaaaccagaaacaguaaaaagcuaauacuucauaguaguccauuugcugaguuccuaggucugugccuaacccauugacauauaacccugggagguggguauuauuguaacugccaccuuacagauaaggaccuggaggggaacaaaggcuaaaucacuuuuucaaugucacaccucacagccaauucaugauagaggcgggauuugaucccaggucugucuggccaaguucauuaacuuaacuauaaacaauuaaauuauacccuauccuauccagagacaagcacuguagauaucucaguguauuucugucagaacauuugucuguguacgugucuuuuuuuuuuuuuuuuuuuuuuuuuuuuuuuuugagacggagucucgcucugucgcccaggcuggagugcaguggcgggcucucggcucacugcaagcuccgccucccggguucacgccauucuccugccucagccucccaaguagcugggacuacaggugcccgccacuacgcccggcuaauuuuuuguauuuuuaguagagacgggguuucaccguuuuagccgggauggucucgaucuccugaccucgugauccgcccgccucggccucccagagugcugggauuacaggcgugagccaccgcgcccggccguacgugucuauuuuuauaacagaaguguauuuauagaguaugugcaauuuuguaaauugcuuuucacguuuaaaauaaaugucaggucucaaaauauauuagguucuccgaauauucucaaaagccuuuuaaaaaaucuaaauuaauuguaucuacccacgccaccuccccaacucagcugacaaugaccuuauuaauagugggggaccuaauucucagagaaaucucuauuggucccagcgcuucgggagcucaaggcaggaggaucacuugaagccaggaguucuagaucagccuaggcagcaaagugaggcucuaccucuaagaaaaauuuuuaaacauuagccuggcauggugacacaugccuguagucccaucuacucaggcugaggugggaagaucgcuugggcucaugaauuugaggucaccaugaguuaugaucaugucacugcacugcagccggggcaacagaaugagaccccauuuuuuuuuuuuaacaaaauauccacuagauaaaauuugcaggagccuauagaaauccacagaaacucagagcucagguaggagcuaacaagcccaggguguaaccacuccaugcagauuucagagucagagacccacgggaaauaucagcauuaaugagcaauugguaaaaugacauguuguuuaucuguccaaaauaaaacuaauccuuuucucauuuuaccccacaucaaugauuuccugaguacuaguaaugcccaugagaagagacaaguauauuugcaaucagcaaaugugcuggacuaccacacgcaacaugcaaggggaaaaauccaggcccaggcaacaauucuaauguguagaaccaaagcucagaaucaagauggugauuuuaaagagauacaugauaacccugcacaauuaaccuauaaaaagcaccuggguucuugauuccauuuuuuuuuuuuucuguugcuccuugcugcaggagaucaaucccaucaagauucuauuguuaccauuuugcuuuuucuaacuauaccuaaauauaugaauauaucacucucucaggcagaaauugaacacagaucggagcuaaaaaaagugugaggguggaaaaagaauguuaacucuacaguuuauauuggugucugauuuggcugugugugugugugugugugugugugugagagagagagagagagagagagaaagagagagagagauguauuggaaaggggagcuagaaacacugugaaaugggaaaggccuguauuuaaauguaagugugguuuuauaaauauguacuggaucugauccuaucuaugaagagagaguaaauuucccaauagagguacaguaauggcaagauaaagaaaaugaacgcauucccagcaucaaagauaaaugcucugggcaucauugcugguguuagauuaucuauugcaucucaccccgacauuagcauuacuaauuaugagcugccucucuuuagagggaaaacaugcucuggcaaggugcagaaauuucauuucccaggcagccacugcaaguacaauuugcacacacacauaugugccaaucuguccacacguggaagagaaucgggaaauucuuaaaaaugcaugugugcacucuacaaugaaauauauguggaccugaaguccuacuucugucaacaagaauuaacuaaauauuuuuucacuuauucuuucuccacuuuuuaucgaugcagaauugcuuacuggaagagaaaugcacucuuuaaaauucuacucuaaccucucccccuaaaauaaugcuguauguuuucuaaggcuacaacaauggcuccuaugacaagagccccuagcagggaaacagagagcuggauauuuuugcgaguuauuucaauuaauccucacaagacuccuuuaccaguaggacaaggcucacgcagauuccugugauuuugucugugcaucuaauuacuaaccuaaccaccauaguucaguugaacacauauuuauugagcaauuacuaugugucaugcacugcaaagucuaggggaaaaccaaaauucaauaaaacaucauuaaaggccuacagacaggcaggcacaaguuaucaggguugcaaguuccugaaauauuacgcaacacaaaauugugacugcugccaugagaugcuuccauguucucugaauugcuuccuuaccaagacuucuuuccccauucaucccacagcugugaaagggcauugcuugguuugccguccaaagcagcuauuccagguaauggaagaaauugcaacagaagaaacauauaaacaagguaaguuuucaaaugcaucucauagguacuauucaggaccaaaugaacagaaauaaacaauccuccaauaucaggugacauauuuuauacauuuccacccaugcguuuuaggaagguagcagaaagaaaaugcuccuaaaucaggguuuuaaaaucagaugcugguauuagaaauaagauuaaccuggucccuuaacaaucaaauuuauuacuaguaaaggguuaugaaaaauucuaucucgaugucaaacauaggaaacacaaagucuuuggaggcauauaaugauaaacugcagcuugagcaauucucucagagaacagaaugagcaguucaggaguucagagcaugcucgucuggaagguguucaguuaaagaggagggcaggcuacagacaaaggcacggaaaggucauccauggagucauuccaucuucauuacagugggaaagcccguggccgaagugcauacaccaggccucaacuugcacaccacgcagagguuuaagacucauggggaaauuaaaauauuaaacaaacgucaauguauagagcgcuggcagccgugccuagauauugcuaucugagcuuccaggugcaaccccagacauccaaaauaaugugauaugaacauucuccaaccccuugccccgcuuuuuuuuuuuuuuuuuuuuuuuuuuuuggugugagugauagcuuaauuaaagauuacaaucuaucuucuucagaaggcuagagaauggacuggcaaucacuaaauuuucuuucagguaacugccaaacuuaaauuuguucuuccaaauaaaauaauuacccccuucugugccgcucaaaauaccaugcuggaaaaaagacaguguucaugauuugcccuauaauucaacccucaucuuuuccguuuucaagaaucggggaaaggugaauuucauuuacugauuaucagcaggccuccugagagauaggccggggcugcuguaaggugaaaagcagcucucacuggcaccgcggacaaccuuccggagaaggccgaggccagaggcuuuuccacugccggguggcaccaacacguggguggaucguucuggcccucccagcacaccccugauuaccucccuuucaaauccagacaaaaccagcugccaaauccagcuuccucaucacccaaaaggaagcacuggucuaccccuacaugaacuguggcagcugggacccuggcucuaacuccagcccccgagacaguugucacaacaacaacaucacaaccaagcucuuucuucgagccuaucuguaugacuuuucacagaugaauugguucccaguggcaaacaauaugguuuaguaugucagcaugaccaaucggauuauaagacacaagagaagagguaaaucauaugauaaugaugaaaacgauaaaacaaugagaacuuuuaaaauuaaaaggcaguagguaucacauuaaugggcucaacaucuauagucagugagaaaaucaguuccaccgcuuagaagacacgugauuuaggacaaguuacaucuuccuaacccuucaucuaucuaccuagaaaaugcauaucauguaucauuggguuauuucaaagauuaagucagauaacaaacagauggaaggaaggcagggagacagggaggcaggcagacaacucuaauacuugaaauacuugacucuggcuggguguggugggucaccccuguaaucccagcacuuugggaggcugaggcaggcagaucaccugaggucagguguucaagaccagccuggacaacauggcaaaaccccgccucuacuaaaaauacaaauauuagcugaguguggugguacaugccuguagucccagcuucucaggacguugaggccugauaauugcuugaaccugagaggugcacguugcagucaguugagauugugccacugcaauccagucugggugacagagugagacucucucucucaaaaaaggaggaaaaaaaaaaaaaaaaaaaagacuuggcucugcaaccagcacauacuaaguacucaauaaacgacuuucauuguccuuaagcugagaucuaugaugaagcuacacagacauggaaauuaaaaaagagaaauaauccacaucagcuagaggcaagucaccuuuuccuccuccuccuccuucgucaucauucuccuccauuuucccuuuucauagucaugaucagcaucagagaccacacuuuagcuggcuaaaccggcacaaucccaugcucagcuuucuuugcaugggauugcauugauucaauguugacacuuaaugggggaggcucaaacaguacuguccuuggcuaccauauacacugggauauguaaggguggugcgaaguugcaccaagagaaaaacaaucagcggacuucccucuucaccuccagagaggaccuaaagcagagagaacccagcucagugggcaaggcugcauucagccugccuugucggccagucccucacaggaccccggggcagauuacauuaucuuggaugccccacagcucgcagcuucuuucucauggaacugaucacacccuucaggagggauacaguccucaugccuucauuuagcugagaaacucagacccuccaaucaaccuuugguuaaaaucuacaugacauuuacacuaaaaacuucauuuuggugggggcaaaagggaggagaauggcaccaaauuacacccaugcauguguacucugggggugguuuauguuguggugccuguaucuuaaaccuaaggauauaauaggagggaacacuuaaugaaugcuuacuguauacaaggccccauggcaagcaauuuauaaacacuagcuguaaacuucugaacaacuccauuauggcucccacagccaagacuaaggcuggaaauacccgaaacuaaccuugccugaaagcuuuguguguaucaggugcuaugcaacgaauuuugugcgcagaaccucacgguccacugucaauaaauuauccccacuucaccaccgaggaaaaugaguccaagaaagccuaaaccccuugcucuaggucauaccucugagcagcacuggagauggauucccuccaacuugugucugguucucucuuccuucucucuuccccugaucccauggccaacgggaacaguguucuaggaauucgugaacauacauuguaacaaagaccacaacauacauuguaacaaagaagacgagauuaaugauuacagggaagagauuguuuaaacuuccuuuauucacuaacagucagaagguaucagccaagggaggccuucuuuucaaaaaaauauuucaaagguccguggcaucagagacagaaaaagucuuacuucuaaggguucuucugucguccccuuucccucuacuucaagguaaugggagggggaaggcgccaaagggcugcagggaugguggacacugcauuccucucuugccuucucuuuacagaaauagaauccuacaauuagcugccacacaauaaaagucaguaguuggagcugcuguaaggagauggagagaagauaaagcagcaagucauuacccauaucauccaucucccggacucagacagagggcguuuccagagaccuaaccuagcucugguccccaucacugaucauucagacucugauggagaaagcagaauuagcaggugaucuuaucucccugagcagauccuguguccaucugcagccucuguucgaagaguacaaggaucuccaugcaaugcuaucucaaugcagggaaaagacaacacuggaagaggaagagaaggagacauaaaaccagcuuugugaauucuaccagcggacaggaacuugggugcucggggauaucaguguauagucuuaaaauauaaagcaauacgcugcgugcgguggcucaugccugucaucccagcacuuugggaggcugagacgaacagaucaugagguaaggacaucgagaccaucccggccaccaugguggaacccagucucuacuaaaauacaaaaaauuagccaggcaugauagcgcgcaccuguagucccagcuacucaggaagcugaucagggcaguggaaucgcuugaacccgggagguggagguugcagugagcugagauugugccacugcacuccagccuggagacagagacucugucucaaaaaaaauaaaaugaaauaaaaaaauaaaaagauguaaagcaauauugcaggacauucccccaaaacauguaguuuuaagaaagucauuauuuagaauaaggugggggacaaugaaccuccauaggggccaucuucccuauauuucaccuuccaagauuuccagaauguuugucauaccuucuccaccugugaguccagucaugccaaaaugucacucuugaaauuuuuuaaaggcagaaaugagaugcuguggacgucugaaucaaaauugaguuuccagggaaauuacacugucugucuucuuucaccaugagccucucaaugguuuucaguugguuguuucagugauacaugaggauuuuaaaauacaaaggggauuuauaauaacaaagaaugccuaauauuucuugagcagcuauaugccaagcacugggcaagcugauucacucugacuggaugauauauucuucacaacauucucaggaagauauuguuuuccuguguuugguauuugacaagacucagaguggguaagccuccuauccacagaugcauagcuaauacaucgaggauguccacacuuuaaaaaguagccagauagcgcuauuaauaaauuuuucuauaacucagggauucaaugauucuaauauuuauuuuccaaauaugauuuacaauauuguuuauauccauuuuucugagaacucucuuacccaucacucauucauccucuaguuuuggcaaauacuagaauauuugccuacgcuagaauguaggguuacuacucuguaucuggcacuguacugguuacuggggagccaacuguuaacaagauggacacacauccauccucaaagggcucacagagaugauagagauggaaacaaacaaugagcaaguaugcugagggcgaggacgagaaccagcgaguucugaggacgcauucgggaggggccuacaacuucaucccucaacauccagggaaggcuuucuggagggaauaacauuucugcucagaccuggagcacaaaucgagguuaggucuggggaaaaugggugcagaaggacaacuuucaaagagcaaaauaaucacaggucugccucucaggccagcccaggauuuucuaguuguaccuugugaucucucccacuagaagucuuucaaaugcucaagccccucuugaagaaccuguagacuaagcuuguccaaaccauagcuggugggccacaugcggcccaggacaacuuugaaucuggcccaacacaaauucauaaacuuucuuaaaacauuaugagauuuuuuggggauuuuuuuuuuuuuuagcucaucaacaauuguauauuaugugcagccaaagacaauucuuuuucuuccaauguggcccagggaagccaaaaguuuggacaccccuauguuagacucaacugacccaaaagugcugggauuacaggcaugagccaccaugcccggccaaaaguuuucuaauuuuccuuccaaaucuagucaccuccuguccccucuccgucaacucuguucccaacuggcugaccuguaaagauagccucaggagcuuccuugagcuccaaccuuugguugguuuagccauugagaggcacugggaggaguucugaggauggaaaggaacugaggcuaggauacucccaucugucuggcucccacccucccaggucaucaggaccucuacugacgguggcagcucccaucagccugugacucaccugcccuauccaagcaucuguucccuccuacucuugcuucaucaggccuuggucccuuggugguuuccuuuaaggcugcuuagaguuuuauaaaugguuuuugauaugguuuggcuguguacccacccaaaucucuucuugaauucccacauguugcaggagggaccaggugggagguaacugaaucauggaggcaggucuuucccaagguguucucacaauagcaaauaagucucaaggaaucugacgguaucauaagggagaguuucccuacacaaguucuuucuugccugcugccaugugagaugugccuuucaccuucugccaucacugugucgccuccccagccacaaggaacuguaaguccaauaaaccuuuuucuuuuguaaaugaccuaguauuggguaugccuuuaucaguagcaugaaaacagacuaauacagucuuuuguuaaacucuucucaaucacccaguaacuaugccugcuguuucuuaucaacacccuagcuaguaucaauccuuaaaaaaaauuacaaagcauguucaugcauuucagcuucaggggagagccuaggcaggaacuuacuauggucauuucaaagaugaggauuucaaggcucugaguggguggcuggucuaaagccacaaagcaaguaagagacagagagaggacuugaaccgaagucaucuguugccaaaauggcauccccccaccaccacccaacuccuucaaaaauacauuuugcaaguacucauuuucauuuuaaagugauaccaauauuaaaauguaauucaauaaaaacaugauuuuauaacagaaagggaaaggcagacugcugaaugucucuagcauuauaaaucuaacuaaauucagaaucugacagcucuuccacucccaaaugcauaagggaaaaagaaaaaaaaaaaaaacucccuacucccccaaauaccacuucugaccuacagauccugucucuaacuaaucucccgcccaacccaaaacuuauuuguuuauuacuuuacuuuaaaaauuucccacccuuuugggaaggugggaaagggagaaagagacugaaaaaguuauuguaguuggcagguuuaaacaauuuuuauuuauuuauuuguuuguuuauuuugagacagagucuuccucugucgcccaggcuggaguucaguugugcaaguuuggcucacuacaaccucugccucuggaguucaagugauucuccugucucagccucccaaguagcugggauuacagacacacaucaccuaaaccgaaucccaaaauacaaaaaaauuuuuguauuuuuaguagagacaggguuucaccauguuggccaggcuagucucgaacuccugaccucaagugauucaccugccucagacucccaaagugcugggauuacagucaugagccaccacgcccagcccauuuauuuucaucucauucuaacuauccaacuucauacauguaagagaaacuaaaagaacugguagcaaaauacaaaagauaauuuuugguaugacauaauaaaguauuagagagcaacaauaauagucacauccuuacuguccaauuguuucaaccaaacagggugcacaauucaaccaacagaaccauucuaaccuaaggaaaagggcuccacugccuucuuucucauccuaaggaaaaacaaaaaggaaauaaauacuaaugcaaccauccaucucggagaauggaaacccuuccucgcucucacugucccucaagaaagacucccagcacugaauguaagagucugcauucacgcugaaaaggcaaauugagaccucuguuuucugcuuaauuucuacauugugagaaccuagcaagguucucuaccaaaaagaugccaagacucaugaaaugcaaacaacuccaaagaaccaaaccaaaucaaaaaguaaucagcauuaauaaaacaaggacaguuaauggagaagugauaaagaccauagauugcuuugaaauuccaauuccauauuugcagaguaauaucaauucucagagccuaacuuuuuucaucccucaacuaagugaaaacuacuuuauggaguugugaaauuaagugagauaauguguuguaaaacguuuagcacagcuccuggauuauuauccacacucaaucaauguuaaaaauuauuaugagcacuaucucuagcagcagcuagaugccaaucucaccauauuaaauuucauauguacaaagaauugcagguaucaaugauagggacaggaggcagggaaauucugggcagaagagggcagguccguggugagggccccauccucaagccuggaacuguggcccaaagugagaacauauaucccuguuuuuccacucaaauauugccuuuuccacaaccacccauggcccggccugcccccaauccuguacccauaaaaaccccaggcuccgcuggcacauugaagaaaagaggagaagcagcuggaaauuagagaccacaguuggagagaagcggcuggacuucagaagaacagcuugauggcauagcuccaggggaaaauuaccuuccugcuuugucuucuuuuuagcuuaucuucccagugaaagccacuuucaucagcaauaaaaucccccacaucugccauccuuaaaauuugcucaugagaccucguuccuccuggacacuggacaagaacccagaugugggugcaaaaggcugucacgcugacccuccacugaacuguuaacacuuaagccguccguggauggcaaaacuaaaagagcacugacuguaacacuccuuuuaggguuucaggggucacgggcauccccugccagaugcuaucccagggccaguacagaguucauuccugccagugcccaaaagcauuuacccuggcuccugcaccugcucaccugcaugcuuccucccagaagggguggagugcaggggguucaagugagugcaguucaccucuacuggcaccaaagcagccagcuaguuccagcauccgcacuccacuuccugccugcaaaggggucagggaaauuuccugcuucaucaacacggaaaccaacaagacucuucaggagauuuguaaaacuuuaugauuagcauuaccuguuauuuuugcuucagugcauucuacagggucacagagagaacuauauguaaguauagcuggcucccuuuauaauccuagguauuuaauaguaugcauuuuaaaacacucugagggcugggcaugguggcucacaccuauaaucccagcacuuugggaggccgagguggguggaucacgaggucaggagaucgagaccauccugccuaacacggugaaaccccaucucuacuaaaaauaaaaaaaaaauugccaggugugauggcaugcaccuguaaucccagcuacucaggaggcugaggcagaagaaucgcuugaacucgagaggcggagguugcagugagcagggaucuugccauugcauuccagcccaggacacagugcaagacuccaucucaaaaaauaaaaaaaacgaaaaacauucugagaagagguccagaaagagcccacgggacccgacagaaagaaaaccaccaaccagaaaauagaacaaaacauacccaagaaccccagccacauaauucaguaagagggcucacuucuaugagguuaugugagaaugcauuugauaaagaggccacucaacaggacuguuuuuaauuaaaaucuauauaauagaaaguucuuggucggguacaguagcucauacccauaaucucggcauuuugggaggcugaggugggaggauccuuugaggccaggaguucaagaccagccugggcaauacagucagacccuguaucuacaaaaaaugaacaaacuuagcugggcaugguagugugcaccuguagucccagugacucaggaggcugaggugggaggaucacuggagccagagaggucaaggcuauaguaagccaagaucgugccacuguacuccggccugggcaauacagccagacccucccuaaaaaaaaaaaagaaagaaagaaagaaaagaaaagaaaaaggaaagaaaaaaaaaagaaaguuuuuuucuaaacaacugacucuccaucuaugaugugaguaagcugggaauccaagauggcugagguuacauagagguugccugauuucuaccaauccuuaaugcugaacacgaagaaccagccacugaaaaacaaauaggccuuuucauuuuccucaaaccccuaccuaaaguucauuuucaccggccaaauuuaaaaaucaauuaauaaauuacaacugccaaagaauguuaaaaagcccagaggcaccuaagaagugcuuagaagaaacaagaaagcauuaagccugagauaaauggguuuacuguguguuuauuauaacgaugacuuaguaccccaaagcaaaaacauucucuuaccuccacuuaccacuacuuuguaugauaacagcagcauuaauuuuaaagucaucaugaaucaaucaugaaaucugacucauguuuuuacuggcaacaaaacacccuaauuagcaccuugaauacgagccacuuucuggaugggcuuuggugagagcgaucuucugcuguuaauucuuugcuaauuacucauaguacaggagguuggacuaucacuagacuggguuagaauacccauguagggcgggugugguggcucaugucuguaaucccagcacuuugugaggccgaggugggcggauuacgagaucagcagaccgagaccauccuggcuaacacggugaaacccugucucgacuaaaaaugcaaaaaaaaaaaaaaaaaaaaaauuagccaggugugguggcgggcaccuguagucccagcuacucgggaggcugaggcaggagaauggcacgaacccaggaggcagaacuugcagugagccgagauuacgccacugcacuccagccugggcgacagagcaagacuccgucucaaaaaaaaaaaaaaaaaaaaaaaaaggacauguaccaguccugugacauagccaccuugaaucuuugcacaauggcacagagcuucccaaccugggcacugcugauauuuuguggugggcaugguccuuugcacugcaggauccuuagcacuaucccuggccuuugcccacuagaugccaguagcaccuuuuccccccuauccucuacccuccugaacugacaaccccagaugucuccagauauugacaugcauucccuggcaggcaauaucacuccugaucaagaaccuguucaugaggcuaccauaaagauuaaauguaacaacauacauuauuaaacaggguuagugagcuguaaggugcauaguaggacugacacauacaugguuaaauguaguuaaacucauuaagagauacaagucuggcugggcgcgauggcucaugccuguaaucccagcacuuuggcuggcugaggcagucucaucacuugaagucaggaauucaagaccagccuggccaacauggcgaaacuccaccucuacaaaaaauacaaaaauuagccaggugugaugguggaugccuauagucccagcuacucaggggcccaaggcaggaaaaucucuugauuacaggaggcagagguggcagugagcugagaucauaccacugcacucuagucuaggcaacagagugagacucugucuccaaaaaaaaaaaaaagaaagaaaaaaagagcgagauacaagucaaauggaaagguggcuucugcuaccagcuuagaagaauugauucaaagucguccuuagguugugugggguuguucaucuguucauuccuacaucauuuuuuuguuguuuuuuuaccccgcucuuuuugcccaggcuggagugcaauggcaugaucucggcucaccacaaccucaccuccuggguucaagcgauucuccugccucagcuuccuguguagcagggauuacaggugugcaucaccacacccagcuaauuuuguauuguuaguagagaugggguuucaccauguuggucaggcuggucuugaacuccugaccucaggugauccaccugccucggccucccaaagugcugggauuauaggcgugagccauugcaccugcccucgcuggcacacugggccaggccagaccaggccaggcuggcuccucccucccagaccccccucaagaucacugccacccucaacccaaauuuccuaagcaggagagacccacugccccuguugcccucaacuccuaguaggggccugggcauggacuuggagauggucacaggucagcaaaggcugcagucuugacacguccugggcuggcaagaccacaggguuuggggcuggugacugagagaaaagccucuugcccaacccgcucuaggacaagaauguguccuagagcagaggauccaaucugggggacaccuguuugcccuagauucagguguugggcccauggaaaagggagauuaaguucccugccccuggcuagaaccccauauuuucauuuugcaauggaucuucucuauuacauagacagccucaccugggccuuuucccuauuucaacauguaccuuuggggauucacuagaauuaggcccccacaugagggguccuucuuugucacagccaguggaaggggggcucagcaccacauuuccucuuggaagaaaaggucgcaaggauccaggaccagcagcgccuccaaggucaucagcacggcaacaacacaugaagcaauuaggaguggccuccggcguccugcacugacuuccugcggcuucugccccgcuacucccuagcuccacuacuggugaaacugaagcccuuccucgggaucucugaucucacuuucuuccgcuacaaugaagaccuggaagaaucuguucacugaugaccagggcuggugugugagcaugcacaccgaaauacuguuaggaaaccucuuucaucaaaauuauaaaagccagagcugcuuacugggugucagaagcagauaggaugauacaugugcucugcaaccauaaaauacaauguuccaaucaaaugauaaaucaugcuuauaugauuuuuauaucucccguuagaagaaaaagaauuauacuuucuucucacaccuccccuugcccuuuuuuuuuuuuuuuuuaaagcagugugcaucuuucugaaacuucuagugagucucaagucaugacaaccugggucagagucaguacaaaugggacaaaccugggggagaagaaaggggaagauguggcccuaguagcuuaugguagauucucggucauugaaugcucuguccagcccaccauuguccuugggugggagaggugaauaauguuggaaaagauagaagauauugcuggcaucuucuuuguuauuguccccuacaaaaugcaguggaugcuaccagacauuuugagacucaauccuuauggaaaaguaagaaccaaaagaacuauuuccugcaaacaaguaucucccauuugacuuuauaagaaaaucugggccgggugugguggcuaaugccuguaaucccagcacuuugggaggccaaggcugguggaucacgaggucaggagaucgagaccauccugguuagcauggugaaaccccgucucuacuaaaaauauaaaaaauuagccgggcgugguggcuggcgccugcagucccagcuacucaggaggcugagggaggacaauggcaugagccuaggaggcagagcuugcagugagccgagaucaugccacugcacaccagccugggggacagggcaagacuccauuucaaaaaaaaaaaaaaaaaaagaaaagaaaaacaaaauuuggcugggcauaguggcucaugccuauaaucccagcacuuggagagaccaaggcaggaggaccgcuugaagcuaggaauuugaggccaguuugggcaacauagugaggcccuaugucugcaaaaaauuaaacaaguagccaagugugguggcaugagcccguaauuccagcuacucaggaggcugaaacacgaagauugcuugagcccaggagguggaagcugcagugagccuugaucacgucacugcacuccagccugggugccagaccuaaggccugccucaaaaaaaaaaaaaaaaaagaaagaaaaacaaaaucaacgcauucuuuaaaaaaaaaaaaaaaacccauaaaaaaucaaaauaguucauacuuugaccucccuuacuauauauuaaauauuauuuaucacaaugcuaauacuuuguuacuuaaaaagauaaauacaggcugggcgcgguggcucacaccuuuaauccaaguacuuugggaggcugaggcggguggaucacgaggucaggaguuugagaccaguuuggccaacauggugaaaccccgucuuuacuaaaaauauaaaaauuagcagagccugguggugcacaacuguaaucccagcuacucgggaggcugagguagaagaaucacuuggacacgggaggcagaggcugcagugagccgagaucaugccacugcacuccagcuugggcaaaagagcaagacucaucucaaacaaacaaauaaauaaauaaauaaauaaacaaauaaauaaauaaauaaaugaaaucucuagucaacuaaacuuuaccaauuaaguugcauuuuaauggagagggagaagaaaguggcuuacagcaguaacaacaaaaauaaacaaaaaaagaguauugcucaucauggcugugucugcuucuaauauuagucacaccaugacaagugccuuuagaaacuaacaauagcaguaccuuugcaauaaaaauguuuacuuuauaaagagaaaaagagcagaaagaagggaaucaacccaaacacaucagagaauuacaaagugauguuugccgacuaaaacacacuucauguuauuugauguugacuugauaaccacucacauuggaaucaccacaauuuaaugaaagcucccaugugauccacacgaaacagaguccuaagugaauuguguauuuguauaguagcacauguuaauaaaauacugagggaaagaagaacaaggaaaaacagaaaucacugguauuucuuaaaauggggcuguguucuuaccuguaauuucuucauccuaaaacucuagcuccuagcugcacuaugggccuccccugagagccugggccuccuaaagggagugugugagcagcuguuccagaggcccccagggucaugcucucauaaaucagacguugugcuggacaucauguaugcgggaaaacggagcaucuuucaacagggaagcaugacugugaugugcugaaaccauuuccauuuacagaagcacacacuguaccacauuacgaaaagcgaaguuuuuucacccaagguggagaaaaauaaauauggaagaauaacucuucccccaccuccaucagacuguccacuggcaacuaaaacaccaucacccagauagagaguacaagcauuuaaaauucacaaggaaucaaacaucagacuagaauugcuacuaagcccgugaccuucagcuccccaaacauuuaugauucgguaauuaccggauggcauuguuacugauagcuguacuacuuccucucuuauagagccauuugaauacaagaggggaagcagggcucucagcauuugcuggguacagcaggggauccaguuuacagcugucuaccuuaccuugaauuuauauauacuggcacauauuaaacacuaugaaaaauuaauauuuuauuuagguccuuugguuuagauacgugccuuuaaaugaagaugguaauuauuacuauuacugccaccaccuuugauaaauuuaggucuguaagccacugcucaaagaaggauuuagagcauaauuucuucucguaccaguguuagguuuuuuaauuuuuauuuauuuauuuuuuugggggauggguuucacucugucacccagacuggagggcaguggcacgaucucagcucacugcaaccuccgccucccagcuucaaacaauucuccugccucagccucccagguagcugggauuacaggcacaugccaccaugccuggcuaauuuuuguauuuuuaguggagacgggauuuuaccauguuggccaggcuggucucaaacuccugaccucgagugauccaccugccuuggccucccaaagugccgugauuacaggcgugagccacugcgccuggcccacuguuagauuuuuaacccuaccagauauucgacuugacuuuaucaucccaagucucaucagagcuccucuguuguaaccuugccccgacuuuuuaccaaagcuagcaagagcaucucaucugcucaauuacuuauuaguguugcuauagaauaccauuuccucuugcggcugauaaaauauuaaucaaaaacaggaacugagcaauuucccaguguagaugucuucuaaugguaauacagggagucaaagagaaaucuggaggucauaugacagcuucugaagaagacagagaagagugacaucggagacagaggaagagacugcaggcagagcccgagagcaggaugagugacuacugugcaaacagaggagagcuuccagaaccguguacacagugccuugugggaaaaggcuuggccucagaaacacucaaagaauuagguuuuuguugugcuuuaauguuccgcaagccuucaauuaagcaaaauggugucuugauuucacuaguuuuuuuuuuuaauccuaacccuuauuuuucaacuccuucuagguuucaugagucuacaaccugccuuaguaaagaaaguacaccaaagaugaauaaaucucaaaucagcuucugaaguuuuuuuuuuuuuuuuuuaaagccuuccaucacuucccuucuccuccauauucccuuguauaugaaaagagcacaggcuguggauguagacagacguggguuugcaacagcucucccacuuacuacaaagugauucauggcaaaauacuuaaucucucugaauuucaguuuccugaaaacuugcaaaaugggccugcugugagcuucaaauacucacuguccccaucuccaguacccaaaaauauauacauaccaguaaaaauccagacgaauauccuccuucuccuaugagccaccccagucccacacacaagucauuuuucauaggcuuagggucaacuguguuuucacaugggcuucuuaugccaaaaaaaaaaacaaguuauguguuaaaguguugacuaaauacuaccuaauauuuugagagauacucuuuuggaacuagugaaauaaaaagacacuuagaaagguaaccaucuugauaacaccugugaacuagacugggaaccaauauugauguuccauuucuuugguuaauacuuacucagaauuuauauauauuagcguauuuaauucaucaacuugcaugacaacccuguaauauaaguagaacucuauuuaacgaaggaggaaaccuaaacacauaauuagcccagcuucacacagguggcagguacuggcguuggaauaugaacuugagccuugucuuugagcucucucugccuuccucaucucuguuucugauauucugcuggaauauccccaucaccacccacccacacacccccauuaaaaaauaauaucaaggcuaggcuugguggcucauaccuuauuuccagcacuuugggaggcugaggugggaggaucacuugaggccaggaguuagagaccagccugggcaacacagcaagaucccgucucuaauuacuuuaaauaaauuacuacaaauaauaucaaagagccaagaagauaaaaugacuuuugaggcugcuccaaaagccacuggaaugaagaauuaaguuauauaagacagcugucaaauguuuuaaagcaaggaagucauuucuucacugggcaguuaaacagaaucaacucaauucuacaaggcucagggaguguguuuccagaaggggccuggaggcaaucuccuugacccugcaaauucagcccuucacccauaacugcucgcccuggugaccagcaccccugaccccagcacgccacugucuauuuugagcucuuuugucuucuuuugcuuguuaacaccauggcaaaauguaaauucgucucuugccuauaagauacaaccaaggcuccccugagcucagaaaaacuggacuuccagaggccacgaacagaaaaucaguccucaucacagauguucuaauaucuggcccugggauuuagggagggugaaucauuggccgugguacagggguggccaaugcagggauucaugaagcucuccccacguacccuagacuucauaacaaacauuauuaaucagccagggccguccugcccugccccaccccaccccacucccagucuagagugagucccagcagccuucccaccagacaauccugacauccacugccaaucugugcugagcauccaagacgacauuuauucaagcuguguuucuuccacagaaccauuaguaaaagcaggcuaguuacuuucuaauacuugucugcaaaauauguguguaaaacugaugggcuuuccaccugccuuuccagccucgaaaacgaaaucagaagucuucgagacaugaaaaucaauuaauacugugaugggcuggucaaauuacuccuucuaaugugcguauccuuaaguaccauccacuuuuacaucuaaaaaauucacugcguugaguguuucuaucaagacuuuggcucucuucaccguaauccaucagaaugauaaaaauccauuuucaaaauuuagaguccagccuggcaauccuaugccugggaacucaucccauaggaauaaaagcuucagacuggacaugcgaacaaggauguuauugcaucacuaucuguggccgggaugggaguggagggagaaaccuuucgaaacuaagugaaugucccucaauaaguuccaucugggaaaugacugcauggucacaguauguucucaguguggaaaaccauacuacaauacagaacagcaugcguagaaugauuccauguuuuauuaggugaaacuacugaaaaaagaaucucaaaaaccuuuaguccauucacgcugcgaucccaaaauaguauaacuuagguggcuuaugaguaacaaauuuauuucucacaguucugggggcuggaaguucaagauaaaggggccaguagaugugguguuggguaaggguccacucuggcucauagauggcaccugcuugugggcuccucacaugguaaaauggauaacggucucucuugggucuguuuuauaaaggcacuaaacccauucauggggauuaguacccuccgcccccaggaccuuaucauguccuaaagguccugcuuuguaguaccgucacgaccuugaggauuaggauuuuaaccugugaauuuuggggggaugcaaacuuucuaaccauagcacacccuaaauaugcaucuguguaugucuauauauccauauguaauauauauauauauauuucauagauguauaauauaaaugaagaaaaaaauuagaaggaaacacauuagacuguuaacauguuuuaccuuccauggaaaggucugacgugggaagaggguagaggaagaaacuaagccaaaaugugaucaaaaugauggccgugaagaugacuauuaccagagcaacaugcuuacugccuucaggaaagcaaucggagcaagcucuguggcccucauuggguucuaggcacuccgcaaguccuuuaacacacaaaacccuuuuaaucuucacagcuggguaaggcagguaacaucaagagccucguuuuagagaugagaucccugaggccgggggccacaagucaccugcacaaaagccacacagcuaauagacggagccaacuggccccacuucaaagacuauacauccaucuauagcugucucauguauaagauuaaauuagaaaaacagcuaaacaaaaacuagaccuauccacuugccaguaggugagaaaucagcucagaagacaguaaacaagcaaguuuuuuucuguaagcugccuuuuccuauacuucagaagaccacagcuaugaaccauaacacccgugaguaccaaagaacacauguggaugucgcagguuaagggcugaaaggucauuuuaugcacagugaaaucacaggcaauccauuucucuaccacccagcuaaaggaaaucccugucuugaagccagacaccuccuaggaagcuggccuuguucuggugccauugggaccuucucuguguggcugcccacugguuccccaggaccuugcaugguggcugcugaacaaucggcauucaauaaaaaguucuuaaauaaaugaaaucuagaugcccaguaaauacauguugcuaaggcuaaaauuauaaguuuccauuguguagaaauggacaaaaguacuccuaagggagcugugaguauguuauauaaagauaacauuuaugggccaggcguggucacucacgucuguaaucccagcaauuugggaggccgaggcggacagaucacuugaggucaggaguucacgaccaaccuggccaacauggugaaaucccaucucuaauauaaaauacaaaaauuagccaggugccuauagucccagcuacucgggaggcugaggcaggagaaucacuugaucccaggaggcggaggcugcggugaguugagaucacgccacugcacuucagccugggugacagagcaagacuccaucucaaaaaacaaacaaacaaaaaauaacauuaauaauaauaauaacaaaaacagcaacaacuaccacauauuaagccccaacuuaaaaagcacagugauagacucuguagguacauauuucaugugacucuuaugaaaauacuggagagcacauacugccguucugauccaacagauggggaaacugaagcuccaagcaucuaauuaccaagcucaaagacauaggaaggugggggcuggaauacaaaccaaggacuguuacuucucuuuucaguccaucucugugguccacacauaucugccacucacuaguaaagaaaagacuaaaggaugagguguccugguucuucauuuaaaguuacacauucagaguaaaaaaaaaaaaaaaaaaaaaaaauagguuguguaacaucauucuuuuuuuuuuucacuucuuguuauauaaaacgacaucacucuuaauccagaaggaaauaaaccucaaagccaagguaaacagcuccauaacgugacauguguuuaguuuaagacccgucccaacaugaagucaacgcaugcccuuuccauccucaccaccucgcgcuuccaccagacauggauugcggggagcgcugaggacuuuugacagauguggcgacgcagagggauacuucaguuuccacccucuccggaccacaauaugacaguuacagaauucaaauccauuuguauccccuguugaaucccacauaauucaguagacauucauuaggaugccauaaugauaucacacagccauaaauacauaugcgaagcgucgaacaagacauucauauuuaaacauagcuggaaauaauuucaguucuggugauuuucaauugcucauucuauuacuuuucuguggaugcuucaaaugucaaaauauaggagagaaccaagaauaaaggggugggugggugggugugugugacaguuccuaguuuagcaagaaaaggcauuuggguaccaaguuacaucugacaaauauuuuguuucaggaaaagguaacuuaauaauagaugauaagcuccuugauaugucaauugcagaaaaaucauucacacuccuauaaaaugcacuguaagauuuuaguauucucagauaccugcuucauauuugaaggauggcugccccgauuucauaaauaaaaaacacauggaagacuuuuucauaaaacuuuaaaaacuauauaaagcaaacaaauaaugcaguuaaaauuaaaaccacuugaaauucacuauuuucaaggaggaggaaaaaugauuucucgggaaacagacccaagucuccaaaaagguacagacaugagguaacaccaauaauaauaauguuaaucuugaucuuuuucuuacaguucucaacugcagacagaaucacacaguuuggcuucagccucaaugauguguccauuaacaccucucuucucuuaguaguuuucagguaccuugccacggauuuuugaauuauuuaaauggaaggagcauuaggaaacccucgcguuuaaauuaugcuaaguaaggaucauuucagcuggacuuuugccugugcaaaaguauauacccugcaggcacgugugaaggguacagaggaauaggaggagacaauacacgugcaaaauggagaacgauggcuggggaacaaaauuguagaaacaggccaaguaugcaugauauuuuaaagauuccaacaucacagaggaaaucugaguucagauauuugaagagaugaugucaauuuucuaaaauguuuccaaaugucuggaaagcucugagcaugggaauuaaaaaugaauagaaaucuagcuaccauaaauaacagaauaucuguaguauggaauauuacacaacuauuagaagaaguggguucucucuuuaacuguugaccuggagguauguuugugaccguccagggaaaaccaagcaaagagcagcaggcauaacaggacaguguucuuguaaaagccaacagcaaacccucccugcauuuggcauagaugucuguuuaaggauggaagagcucagagaagagugugaaggacucccggggcgcugucagcuguggucuugggcagcagguacuucuggccugggcacugcggaaagaaaggggcacgccaagaacuauuuuucuugcuauucauuugcacgguuucaauaauugggaugagcacaugcuacucucuuaaucugugagaaaaccuuaaagagagggagcagggaaggggagagaagagaaaagggggacaaggggggauggaaggagagagacugauugauugacugauugacugagagacaaaugaaaccuaacaacacguaacaaaauuucacaugggccaaagauguucaccuucaggugucuuucuaccuugccagacugccaagauuggagaauguuauugcuuuuuuuaacugaaggugcugacuuauuggaagaagacccuguacccuccgcuaaguuaccuuugcagaagaaacuguugcagaagugcugaacacgcagaccuagggcaacgggcaacgcgcagucuggcaggugaaaaggcagguguggaagggagcggcugcgaggagaggccggcaagaaagcugacggaagcuuuccaucucaccuaggcauccggccuggcucugcacagagauagcuaugugaugcccggaugguuccaccagacguuucuaaaaacguucauagacaacaugcaagucaccuaccucuucuugcacacuuccggggaaaugaccaguacaccaagcaaaccauuagaaauaaauaaaaagagcuggugucucaucucagugugccucucaaacacagauaugccauuuaauuccuuaaguguuaguuaaguaacuacgaugagcuuagcuguacgcagagucugaaauuacaucuucaauucccuccacacacgagaucuauuuuuuucucauuagaaaaguaacaaaaucauuucagaaaauagucagcuauggaauaguauuuuuuuguuuguuuuauuuucuguuucugagacagggucucgcucugucgccuaggcuggagugcagugacacgaucucgguucacuguaaccuccgccucccggguucaagugauucuccugccucagccuccugaguagcugcaauuacaggcgugaaccaccagguucagcuaauuuuuuuuuguauuuuuaguagaggugggguuuugccacacuggccagacuggucuugauguccugacuucaggugauccaccugccucggccuccccaagugcugggauuauagccaugagccucaaaaacgccugugauucucaaaacacagaccauggccaucuugcuaccugauauaugaaacuucacuuuauggggcuguauucccagcacucaaauagugaguggcacauaauagauaauucauuggucuuuucugagagaagggaggcagacaaauuauaguaacauuauuuauguauaucuauuuucaaugccuguguguuuauauagccagaaaaccacccuguacauacuguuuuuaaacugcuuauuccacuuaauaauaaauugccagccuuuugccaacacuaaaugcauuuuuuaaaugcaucaagaaacucuugcuaucuugcccugggacagguaaggaaaucugguacacuuaucggucaaggaagcuguuaucagcaccaagagcucagaggaaaggcaaugaugccuaucuaaguguaccagggccgcagauuaggaccacuucaccuuugcuaacuuuuuagcucacugcacugcuuuuaccuccacacauggaaaauguaucuauccuuugucaagcaaacuaauagugaaaaccugccaaggagaaaaauuucauggaccuaauagugaacucacaagcuguuuucaagcaguuguacaugcacacacucaauggcagcuguugcacauaauuaaugugcuuauuauacauaauuaucuaauuacuaaaggagggagucaaagcaagugugggaggaaagauauuaaaaucugcucuuuuuagaauguucuauaacauagacuagguugcuguaucugaaagucacucucuaaguuuuuuucugacgucugaagccucuauagagaaagucuuucuaaaugcuugagcaguauuuaugggguuggcugauuuugagucauucuauuaacagaauagguuucucaauaaauacuauauaaagaaaauugugacauacaacuauucuuucgcaacacugugugaaccaggacuuguaacagacaccugcaagggaagaguuucccaauggauguucccaagaagacugucauacaaagugauacaaguggggggggggggagugggaacuguaauauaaauuuagaaaacacuguuuuucgaccaaguguucccuguaagguugauuccaagacguguaaaguaugcagguggaugguaaguggugacguaaguuuggaaaauacuauucgcuccccuucuuagagggguauaugagacauuuacauacaaaggcucugauaaguauuguauuucucaaauauuaauaguuuugacacagaauccuuuuacaccaccucuguauauuuguaaguaucagugggacucacaggcaauuuguauuggaggacaggcuaauauuuuacuauuuccccuggaucauuccuucaccaaaagguuaacuuucauguugaauugaacccaagguggaauucaacccaaaagcaaccaucauacaguaagauacaugaaaagcuaaagcaaacucuacccauugaaggagucucaaggaaugucauuuuccagugauuccuagccucacugauucccccaccagggcaguggauacccuaucucaaucauuauuuccuacgacccaauaauuacaucuuuuaucaaauguugcccauacccucucuugagaauauucaagcuccuacaaauuccacaucugaaaagagagccuccuacuuacauagaagagauaauuuagcaucuuugaaguauaauuuauuuuauuaauuugucaauucauauccugucuccuuccaaaaaugauuugaggcauuuguuuuaaugcuaucaucaaaauucaaugggccaugaccaacggagagaaugaaaauacaaaccaguuggaaucuccaaaggcacauguucauuacguuuacuacuuaacuuuaacuuuuaaucucgggccauaaaaauuguccuaaugaaagguccacaaauaucuccuaaaugugcaaagcagcagcugugaugacccacagcauaugcagggcucuuuucacuaaugggccuuccugccugggacugccugaaaaguaagacuggguaacacgcagauccagauucuuccaaagugauuccaaugggagggcugcauucggaagcaaagggacugcucuguuucuguuuuuaaauucaauuucaaagcaaugcaacaguaaccuucauugauuuacaagccagucaagcuuauuuuagcaucacuagugcaaguacuugugaaaaaauuaauuauuuaccacauauacauaauaacaugaaaaccugcgaaaugagucucauugaagucccacccagaaaucuuucucauccuuuaaggcuccgcacauaguaggggacucaaguccuauuugcugaaugaacaaaugaacucacuccacuugaguauugcuuuuuuaaaaauuccauuucuaaucaugcauucaaugcuaaguaaauacaauuaauugcccaauaauuuaaagugauaaaauggguuuuggugaacacguuuaauucuacucaacacauuuuuaaaaucagaaacacucaaaacucaguauuauuuuucccucaaaccucuuacaaauugaauucuggaaauaaauauacuuuuaaaaguauauuaucaucauagugcauuucugcaugaacaauccauaagaguaauugcuuuuauaaugugauccauaaaugcaaauuuacaggaaccagcaauugauaauauuaaauaucgggaguuucuucuccauguauauggcuuuuuccuuuucuguaauacaccauucugaggaaacaccacagggcugcuauacuugaucacacaaucuuuaucauuauuuuuccagcguuuuaaaauuaagugcaaguugcauugcuaaguuuagaaucuuggauggaauaacuuguguuugaagccagugucucuaaaacccuuuauuucugaugcccagcaaguuugauacaacuucuuuucauauguaaaguggaucuaugagaugcuaucuuacccauucaacgcagaagaauguguaaacagaaguagcuggguauuuuagcaguaaacggauaaugucauaaacagcauguuguauuuaauauucagaucaagacaucucugucucauuccagcagacccuucugacaaaagccaucccaugucugccagaaguaucgaguccagcugaggacaaauuucaagaugaaccugaaaucaauuugccaucaaauuuucaugccucucccagacuaucuguggcauuuuauuagcagcacccuaggcgggggguacuacagauauugacacuuagcuccuacaauaaacuuuauuggcaaccucugucugaaugcaguacucaacgagaauaacaagaaauauauugggagauguaagugaggacgugcuguaaucacucgaauccauuuuguucaaagggccugggcauuucuuaggcaacaggcuugggggcaacaggccugcccucugaaguacuacugaccuucacauucaacgugccugcaacgugcaugggauugcaaaaugucaucuuguucccuuuuuguuuucagcuggacguuucuggugugcauuauuucagaguucucaaaauauuucaaauccuucgucaacggucauagugucuggaccgaaggcaucccugugaacuccgcuaaaaggcuugacggaagggaaaagacauggugacuaauuguacuaggaggugaugugugcgcuggggagggggagguaaccagcugcuuuuacauuaaugacagccgucuucugccuuuucccgauuuuuguacaggcgguugcaagggcuguaaauaucagaaaggggaggaccugcaauuugcuaaucauaaaggacuuuugcucucugaaaacacccugggacuauaaacacgcaguaugaaccaggcacgcugagcagcccacuaugccagguggcuuugcugcuggacacgugggguaggcacaugucaucuugcuccccucaauggugauaucagauggaaacaacacauacaaccaacaagcaccaucuuuguggcuuugcgacucugugccaggcaccgaagcaggugcauugcacaggucaugcauccucaaacauccuugaaaguuagcagcugauggaagugaauccacugcugugguaaauguuuaacaaacacuccugccaaaaugaaagggugugugugaauauacacacauauguuuaucauacauuuuacugauacgaaggaucuguagcacacaauuuacaaauaaaaauaaacaacauucuuuauuguaaaucccacagagccaauugauucucacucaaugcuuucauggauuugugcccaacucuuguauccauagcuaaauuaugguugcaguugaugagaaagugcaguuacauguaaguauugcuugauacuuuucaguuaaucagaaagaugaaaguggccggcacgguggcucacgacuguaaucccagcacuuugggaggugaggcagguggaucacuugaggucaggaguuugagaccauacuggccaaccaaucaaaagggugaaacuccaucucuacuaaaaauacaaaaauuagcugugcaugguggugggugucuauaaucccagguacuugggaagcggaggcaggagaaucaguugaacucaggaggcggagcuugcggugaguggagaucgcgccaccucuagcauggucaacagagcaagacuccaucuccaaaaaaagaaggaugaaagugaaacaauaaagacagacauauuuugauacaucacucacucuucaagggcauaagugacuccuaaguaacuucuuuacuaauacacugaaggaauauuuccgagagagacagacagacagacagacagacagacagacagacuuggagacaggaucucucuuuguugcccaggccagagagcaguggcacaaucauggcucgcugcagcauccccagaagcugggacuacaggcaugugccaccaugccagcuaauuuuucuuucuuuuuuuuuuuuuuuuuaaagagaugaggucucacuauguugccugggcugguuuccaacucccaggcucaagugauccuccugccucggccucccaaagugcugaauuugugagccacacggcuuccucaauuuuuuauacuauucauaauguaaugguuuauaggcacuguacgcuucaauuuaaucugcauuauuaacauugcaaucacuuucuaagucaagacaauauaaacaaaacagugaaggcuugaucaguaguuuuugccuguuuccgugguguaaauaguccugccaucgcugcuuuucagcacccaaguugguaucccugaaugcagggcugggaagcauugcacacuggcagagcgucugcaaauacuccaccguauagacacaacagacguagauaaccgcaaaagcacagcuaauagucacaugcgguaaaauggcuacggaguauugaggugcgauuauuauuauuauuauauuauuuuuuuuuuuuugagacugagucucgcucugucaccaaugcuggaaugcaguggugcaaacucagcucacugcagccuccgccucccggguucaagcgaguuccugccucagcuaccuaaguagcuaggacuacaggugcuggccaucacgcucggcuaacuuuuguauuuuuuaguagagacaggguuuugccauguuggccaggcuggucuugaauuucugaccucaggugaucugccugccuuggccucccaaagggcugggauuacaggcgugaaccaccaugcccggcaagcuucaauuauuaauugaauaacuuugucauuguccuguccuguucuacacgaagggagggccucacugcacacuggaaacagugcccacugugcaagggcaggcaggugugcacgcacacacacauacgugucuacaaagccacacaugcacgccuuuaacgggagauccugcuggcgaaaucucguuauuugccuagagaggauacuuuugaacagccagccaauacaugaugcagauguaacagcagaagauaauuaaauaucugcauuccugaaaagaguugguagguuugacagagaccaaggagagagaggaaacaguaaucaccccuucugaccaggggcaccccagccaccagaucagcccuguggagagacaucggcugcaggcauagugcucagaucugcagaucccggcauucacgcucugcuucccaacucuuucuccaugaccaccagcguuucuucuguugcuuugaaauggagggcaccaucagcuuucaacuacuuaucaaaaaugagcaacaucauugugcucugaaucauuugcuguaauuucucaggcaaaaccugguuugagaaauaaaaccuaagaauagggacugggugugaggucuagagaacacuccgacaucaaggccaggcuggccaacccuguucugcagagcaauuagcuacgucuugcagcuagauggcuguguuguuuuuguuuacagguguccaaucuuuuagcuucccugggccacaguggaggaagaauugucuucggccacgcauaaacuacacuaacacuaacaauagcugaugagcguuaaaaaaaaaaaaaaaaaaaaaaaaaaaaaaggccgggcgcaguggcucacgccuauaaucccagcacuuuggguggcugaggcaggaggaucaccugagaucaggaguucaagaccagcccggccaacauggcgaaacccugucucuacuaaaaaaauacaaaaauuagcaaagcuugguggugggcaccuguaaucucaacuacuagggagauugagacacggagaauugcuugaaccugggaggcagaggaugcagugagcuaagaucaugccacuacacuccagccugagugacagagcaagacuccgucacacacacacacacacacacacacacacacgcacgcaaccaaaaaucaaaaaacaccacaguccaugcauaaaagguccgugcauaaaaauccugauguucuaagaaaguuuacaaauacguauggggccacauucaaagcuguccugggccacaugcgacccgggggccauggguuggacaagcuugucugaacaggugcgaauucggaggaucuuucacgccuuauuaaucaaggcaggaugcugagaauggcucugcgcucagcacacggcacaguaagacuguguuuccuccucuaccauauuauaauucaagcaaauccucaacagguaagaacgcaugccaagaggugcaaugcugaucuggcuggagacgggaccaaggcauuucucaaagaaugucgaguaugggggugauaugugugugacacugauguugcaugccugcuuacucaaggauaagaugccuaauaggacaugcagugggucucucugcguguauuuucaaaacauaaaaacacaggcagcuuuuuauggaccaaccggaguggaaguauucuaaaguguuacccagaaaugccagagcuguaaaaugacugagauauaaacuagaauauucuaucacuucucagcaacauuguuuguuuccuuuugacuuuuuauuuuuaucccaagggucaguugcuuaaaauaagcauugauguuuccuaggcacaauuuacauuuugaaugugaaguccaaucuaugguucuuggcuggggaaaaaaauucuuauuuacguuuauauauuacugcuaaucuugucuuuaaauauagucagcacacagaaaucacucauguucugucuccucaauagacuccugauucuuuucauuuguucucuguugguugaaugaauagaagaacacuaucaaagucuaucacuuuauuugggaugauguugcuccugcuagaaagaucuugcuucuccuccaggguuuaugacaacagcacagguuagaagggacccugaggucgugcacgguggcucacgccugugaucccagcacccugggcagcugaggugggaggaucacuugaggucaggaguucaagaccaauauggccaacauggugaaaucccgucucuacuaaaaauacaaaaaauuagccaggcguggugguaggugccuguaguuccagcuacuugggaggcugaggcaggagaaucacuuaaaccuggagccagagguugcagggagcauacagagauuguuccacugcacuacagccuggacaacagagcaagacucuguacaaaaaaaaaaaaaaaaaaaaaaaaaaaaaaaaacacacaaaaagguagagaucuugagccugaaaagaacucaaguauagcaaugaccagaccuuggguagguaauaauuaaucaccacagaacuuugaacagccuccacuccaaagcucuucccacuuaggggauucugugucccugcauccagaaaagggacagauauagaaagggaggaugcggucucaccgggccauaaacaugugagugggcggaggcagucuuggagacucugaauauaccuuccggggguggagggagucaaaggaaugcucaggcucucuuucguuuuucuucucugucuuggguaaaaaugacguguuauaagcacucgagcucugcucuucauuuuuauagaguggcuaagucacugaccagauucguuuccgaagcaaaagcgauauagagugucagcacgcgccaaaaacacgcuuggacucuuggccaggagaacacagccuguguguccacagggagaacgaagaggccaaguuauguuuggagggcugccuccgauuucuggugcagucuuuucacguccacagaagucacuacccaaaaaacucgaagccuguccuccccuucuccaggcagccccugcuggccaagcgaggagcucuuggacgcagaccaauccgauacucagcagaagauccaggggugcaagggucgggaaggggcugacggggaauggugugucuucuugccggaucauuucucuccucuggcguucagccaaggaaaugcgguuugcagagccaaccggguccuucucucuccaaaucacauugcucaugauuagggagagaaaggccgaaucuuccuccauggcccuggaguccucuccacccacucucucuacagaaucagaucaucuggguaauuuuuaaaguguaguaugugggccagcuggaacuaguugccucuuccuggccaaaugcuugggguuucuuccagccuuaagccugcaugcucccugugcuagggagagcagagaggcauggccaggacugggaaugaggguguugcuagccagacuucccagcaacuuccugaguuuggagcaagccagaagcgugauuuuuuggugaggcuggcuggccccaagagguagggcacugggcgcuguagcccagcacuucucuagagcccagcagagucuagguauccagugcuugaacagucucccugggcugcccaggccaaaucuagguacgaagcguuaaaaaaguaagaugauuuucagggagaaacagauuggcuuucuccagucucuuccaucucagaguguccugagccccacucagagggccugguggacccgaacuuuauucuagaaacuaggcuaguuaaagaaggcauugucaagccagaagcugccucggagucuuggcaaguguauuaacucaguaugaaauaauauaaacagaaaagaacaauauucuguuuucucacuccaggcauucuagaggcugacgauuagaauucauuugggaugggccacagcuuucaaaaguaaguucuguguauuuaaaagaucuuuagauuugaaguucugaagagugggggcugccuggugugaacgcucuaaacccuauugugcuucggcggcucagaaaaauucaggaacaauaauaucccuuagaggaggagaaggaacugugugaaauacaccauuuaucuccuuucgugcacaaaggcauauacauaagcauauacaaaaacacaucaauuuauacauucuuuuccggggaguccugcaacguuucccagucauuauuuauauuaauuaauguggguuugguuucgaaacugcucagauuaagaacucgagauauucuagaaaguaaauaauccagcuguugccuaccacagagagcccugagcacggaugcauaagcucuggauuuggcauguaaacggggaggcuucaugcguccguggcgugguuccaagccccaugaccagccucacuuuugcaauugagaaacuggaauuaauucucccauccuccccgaugcacagagauguguucaggauaaaccgagucauauuucauaaguucugggugcuaaaggggaaagaaagauaguauuacgaagacacuggcaucacgacgcccacuucuggaaugagccagucuguugagcauuuacauaacaaaauagcaauguacuuuccaugccauagcaacccuggaagaaaacugcgagguggaaacccuggacaauuuguaugaggauucuugaaaaucugagauagacaaacgcauucugagagaucaagcuugcuuauaaauguugguucauaacaauguaaucuacauaugugaaucucagaaaguaccuuucuccugggaauuucuuucagaaaaacaaucuucuuuaguuuacuguuuuuaaaccuuuucccccuucagggauacuuuacccucuagacuugccaaagagccauuuccuaauauauccuagagaauacaugauuucauuuuuccacagaugcauuucuauacaccugguauuucaguuauuuauuaaccaugccuaguuuuguaguuucuagcuuuguaucuuugaagucauuaaaacuuaauaggagaauuaaucauaaaagaaaucuaucaaacacaguugccaagcacuuuuuucccccugacugacaucuuuaagauguauuugaauguuauuuauuucaucacacccagggaauaaaaaaaacauaacuugcagcuuccaaguucagagaaagcauaaaaaugugauuuacuauuuauuguacacuuagucgcaugcauauuauauauugcauguuaaucuucaacuggcuaaguuuagcaaauuugacaacacuacuguuugcuagagaggaaaaagagucgacaucuguucucuuccagauaugaauccuucuuggaaggaaucagaaauacucgcaggccuucuaguuucuggguaaacugauagaacacaggcucuuuaacuggacagucaaaccacaaugcccccugguggugaaaucaugcauauacacauguaaguguuugcaccuugugaauauuuuuaagaagaaaucuuauuucuaaugguguggaaauguucuuucaguuuuaaaaaugcaaagacaaagaucauggcacaucaauuaugcuuuuagagagaaaauaaagaaucgcuuugcugugaguaaaauuaaagaugcauuuaguuuaucaaaaucaccuugaucaaaaaaaaauuuuuuuuuuuuacaauaaggaauuauauuuaaauuccacacugaagaucuggaguaugggggggauauaggaauuucagcauauguauuaucugaacuaaauuuacaaaaguggaacaguuggaagguacuuauagguagaccugagggucuguuaccuuauuuucaguucagugaaaaugaaaugagagcagauuccagauuuuaccagcggauggaagacuccaucuucccaucaugcucucagcaugcaccucugauaagcagcuuaaagggaauuuccuggggucagacauaaauagagauucucagguucucuuaauccagacacacaucgcuugcgaguuaggccucauaaaucucaaaaacagucagcaacauaugaaaggcaauguuguuagaaggcucaaauacauuaaaugggaacgucugaaacauggacucauuaaucauacaaacacugccgaggcuguguaguaaucaaagaucgcagcaccuuccuuucuuagacagcaucucauuucgcuccuugcuaucgcuggaagcagggaggcccagaauagaaaacgccauugccuuccuucuucaccuaaggaggagcucagccauuaacaguuacgagucauacuguaaguagagcaugaaaaaaaucaccaacguaucccagcccccuuuucgagaucugcuggccuuggcaaugaugacuuuuuucugaugcacaacauuuuaagacacuugcccagugucauagacaucacugccaagacaugucaucaaaggauauuggaaugaaaacagaaguccaugcugaaacuuguggacaacacagaugcucauggcagcauuauucauaauagacacaaaauccaugaacuaaugaauggauacacaaaaugugguauauccauacaauggcguauuacuuagccacaaaaagaaaugaugaacugguagaugcugucgcagggauaaacuuucaaaacaugaugcuaagaggaagaaaccagacacaagagacgacuaacauaucacucuauuuauaugagguacgcagaauagguaaauccauagaaacagcaaguagauugguuagugguugccaggaacuggagagaggagguauuuggggugaugacuaaggggucauuuucuuggguuaaugaaaauguucuaaaacugauugugaugguggaugcaaacucugaauacacuaaaagccauugaauuguacaccuuaagcagaugaauuauaugguaggcacauuauauaucaauaaaacuauuaaagaaaaugaaaaggauauuggagggcuaagggcagauaggcccugcaaagcuccaguggaugugugccugggaaggaagacaaguauaaagaagagaauagcauuagcauccagagaaguuggcuaaaacccugagucaggcuacgauacaauucuuacuuuugcaaaggggauaagacucagguccaugcccccagaaaccuucuacguuaacucugagaggaaccgaaaucugacgaugggcaggugggaccacagugguuuucaccuuucauugccaccccaaccccaccgcaacauccuuccccaccauggagccugauuucauuagcccagggcaucgcuaguuucacguaacuucucagauuccagcaguuugggaggcugagguggguggaucacuucaggucaggaguucgagaccagccuggccaacauggugaaacucugucucuaauaaaaguacaaaaauuacccaagcaugguggcggaugccuguaauccuaguuacucggaaggcugaggcaggagaauggcgugaagccaggagacagagguugcagugagccaagaucccaccacugcacuccagccugggugacagaggaagacuccaucucaaaaaaaaaaaagaaagaaaaagaacuucucaggugguucuaacguacagcccaaagugagcaguacaguuugaaagagagccagcaaaaagguuggaacuuuaaagaaaagcugggugagcuauuuugcaggcugucucaauuucuuacacauucacagauaccuagacacugcugcagccggcuagaggaggucaucuuaagcucuugaaaaucugaagauuuucauaaagaaugccaaaacauuuacacaaacaaagauaucugaaccaaggggucugcuuuuauuuauuuuuuuuuuauuuuguguuuuuacaacaugcaggugcugcuccaaaaaaguuuuucaaaaaaaaaaaaagagaaagaaagagagagaaagaaaaacauguauugcagugaggguauuuauguucaaaguucagaaauuugugggcauuaacugagaccuggaaucccugccauucagcugacccucugcccugcccaacauucuucacuguuaaaugccuaagaauaauagccuccuccaccugcaccccagcaaagugaaacauauuucccuggcuggguuuuaagucaagcuaaacaccagcagaccuaagcgugguaccugcaucacuuggccguccagagaaagagacacacuggcuuugaauucuuuuggaacuucuuugagccagaaaauaucgacuccuagcaggcccagcacaggcgcuguuguacaugcucucugggucuguacugaucaaugacaauuuugguaaacacugccugaauaauucaucauagaaaaaagcuuucgaauuaaaugauauuacuggggcuuccagcacaaacacacacguguucccgaaaagcuaguccagcuggaagacugcuuggaauaaccacgaugauacccaagcuaagccccccauuuuauaaauuguaaugagucaucuaccuacccuacccucagucauaggaaaaugcuguuggagccucagccagguguuccagcagcaugcaccuggcacaucuugcuauggcuucucaugguaaaaugcuaccaugguuaacccaacgcggcagcaugcagcgaucuaaaaaaaaacaaacaaaagcggaacaaagauagaugaagggaaaaaggaaggaaggaaggaaagaagaaaaggaggaaggaagaaagaaaugcaaaaauguuggcuguauuuugugcagaguaaaacugaauggcagcgggaauaauucaauuuaaucuuggcaagcggaauggagacuuaggaaccacagcaaaugccaagcaauucauaccuucuguuuuauuuuaaagccccaccuuuccccacugcacaaagucacacacacaauuaguacugcauugaccguaggacuggcaaaauucuacaccaaaaagcuauccuuggcucaaaaugagcucaugcauuagaauggcacaccaaaaaccucaaugugugcuuugaaccaugcuagucugcuuugcuguuguguuguuuuguauuuucccacaggcagaaaccagguuuugacccacuucuucuccaucccucuacugcuuucuuuaaagauucaaaaugagucucagugaggccucagaacgguaaggaccauuugguacuacuuaauccuauuuaggcaaggccaggaaugucuauuuauagcacauuaaagacggaauguaagggagggguccauggcaugaaauucaaggucucagcauccagagacaaugggacuuccagugccuuggccucgauuucuuacaaaugcguuccacggauguauuugacagaggcuggugucaaguccugggcuggauacuggagcuacagauuaaaaaaaauaagacaugguucuuauccuuaaggagucaaagccuaauagggaagagagucgcaggcacaaacaacuaccagaugguacaacuagugcucuacacuaagagccggcaaaggggcccugggccaggaggcaggaagcccguccaccgcccggcauuguggacucaaggagacagcugaugaguaaucugcagucgcugcuaguugccaaagaacggaaaaucuccaugagucccaccugaccacuuagaaagguuagcuaugguaaaaagugaacaggugggauacaagccaaaagacaaauaagacuaugagacuaucacaaaggggcugguggacagccagggggucucccgugggccaaacccauccagaaagacuacagagcaugugugccaccccaccaccagaagcaaggccacacacauaagaacaucguagcuugcugccuuuccaccaccuccgcccccucacccccccaaagcaaagccaucucacugagcuagggccagcguggacaccuucaaguguuagauacgcacuaucaccgugcaucacgaggaaagagaagggcccacaugguuuucauacuuaggaaaauucagcuuuaaucaaacucaguuaauuauugacucaacaaggaugaaacuacaauaaaaccauuuuugccagaggccaaacuauuaagaaaccucguguacuucauagacaaaaagccuucagaaguauuccuugagccuucauaauauuccaucuuaacaaucauuauugugcuuaucucucaaugccaauaaaggagagacaaucgaggaaguugccuauguauuuaaggaaaaaaaacagaccaguaacaguggcuccugccuguauuccuagcauuuugggaggccaaggcaggaagacuacuugaaaccaggaguucgagauuauagugaacuaugaucaugccaucaugccacugcacuccagccugggcaacagagcaagaucugucucuguuuaaaaacagaaagagagaauggggaaucggccuaaguaaaugccgcugcucuccuuuacagaauuagugaaacaacaaugucccuucugaauuuuucuugccaugaacaucucccaauccuuguguguugcucauuacccuuuaggccaaaggugugcagcacuuucucggucucugucaccuucaacuccucaucaauagccucacaccuugugcuucucaguggguagaguuuuaucauaagauuugugagcaggccaugugugguuuagaaaaggggcucuuccugaaaaccuugccccuagguggggaaggggugggaagagaugugccuggucuaucaacugugaaaucacuggccugagccccaugaauuacagccugcaauuuacagagcaauaaaauaaaccacaaaauacgcuuuaagaagucuaacagcauuauuuuucuccuccugcuucauggugacaacccugaugcuuuuuuuucuuuuuuuuuuuuuugagauggagucuugcucuguugcccaggcuggagugcaguggcacaaucucggcucacugcaagcuccaccucccauguucaugccauucuccugccucagccucccaaguagcugggacuacaggcgcccgccaccacgcacagcuaauuucuuuuuguauuuuuaguagagacagcauuucaccauguuagccaggauggucucgaucucccgaucuugugauccgcccaccucggccucccaaagugcugucauuacaggcgugagcuacugcucccagcccccugaugcuuuguuaaaaauaccaaauucccuuuaaaaugugggcuuuuuuaauuuuuuuauaauucucaguaacuccgguguauaaucuaccauuuauugauuuauuuaugauaaaacaaccucucauugugaaaaacagcuaagggugacaucuccagacccaaccacugucccuguaauguccugcugagaguccacauuuuggaaauccaaucaugaagagugauuagaccuaaucaaacaaguauuuauucaacacacaauaaugcuagauguuggaagggccauuuuuacaucagauucuuuucuugcauuuacgcuguguguacauuuugaauauuaaccccuuaucacaugugugguuugcaaauauucucuuucuguaggaugcugcuucacucuguucauugcuuccuuucuguaaagaaauuuuuuagauuguuguaaucccaguugucuauuuuugcuuuugcuaccuguuuuucgguucauauacaaaaacacucauugugcagaccagugucauggagcuuuccuccuuguuuucuucuacuaauuuuacacugucagaucuuauguuuaagucuccaauccacuuugaguugauuuuucuauauggugugagguaagaaaagaacaaauucugaauaaaauuggaggaaaagcuagaaucagagcaaaaaaaugaguaugugcuguggaaucauuuggucaacuuccucaugugcauaugcuauugagucuuuccaaacaccaccacucucaagcaugagcagacauacaccuaacagaaggucaucuguuguuuuaugccaaagcaaaaggcauacaauagacggcuugggccuuagcauccaacauccccaaaucucccugcagaauaauuucugacuuugccuuccuccaaaguuucccauuacuaacaucuuugccauaguuaacucccuugauuugagcauuucauucuccuucuggauggcuugagagggcgggaaaggagagaaucaaugagcaaggccaucuggcuucaacagucauucauuccucuccuuccaugcacauggcacagcaaaagggguuuccggaaaguuggagugacuucuccaugucuuggggccucuuccucaaugcacuucccauuucccugggcacagcaaaugcaaacacacaguaagaaagcuaauaauuuguuugguuuuacauagugaguugucagugauguugucuaaagggacaccugaaaccacgaguaaaccagaaacuuggggugcauagaaugcaucccucccuucaagaucuuaugcacuaaagaaagcaguguaaugggacaaauccauuucccaaaacauguccauggagauucaauggucauagaaugguacacacaccuuugauguuaucauaguggucaaguuaauugaaaacagccacgcaaugccaaccccgugcuaacacguuugauuccucccuuaaauuccauuuacaggucaucacagauaggaaauucuccaauaaggucaacacgacaaggacaucugcagugaucuuucuacaugcucugccaacuuggcacucaucuauaacuuuagaagaggaggcagaacaucagugaugacugcaaacauaugcuugauuuuuuuaagcaacgggaaaaugaaaaaugaacgggaggagggaacacugcugccuucugaggacagaagucguguuucaaguagucaggagugauggggaggugggacgagaaugaagauuuaggggaaucugaacaaaacaaggugguguauggggaaugagggcagucaguaaagccaaauaguaccagguggaaaaauagccuaaaagaaguacaagucuaaucauccaaaaauucuaaagcaaaacuaaaacuccauaguucagcaaaagacacccuuucagguguuuagaagacugugguuauccguuuaaagauguuccucucucaaggaaucucugagaacuauaaauguguuuauuaauuuuuauucuuuaccuaacuaguaaccgaaaauuauaaacguaauccacacucacugaaaaaaauaaaccaagcacagauugguucaaaguaaaacaugaccaucuuccuggccgggcacaguggcccacaccuauaaucccagcacuuugggagguggaggcagggaaucauuugaggucaggaguucgagaccacccuggccaacauggugaaaccccggcucuacuaaaaauacaaaaauuagccaggugccguggcguuggccuguagucccagcuacucgggagguugaggcaagagagucacuugaacccaggagguggagguugcagugagcugagaucacaccacugcacuccagccuaggugacaaagugagacuccaucuccaaaaaaaaaaaaaaagaccauuuucuaugacuuccuagccaaaucuacaccuugagaaaaaaaacccuaucaaaagucuacuacuggccaggugcaguggcucacgccuguaaucccagcacuuugggaggccaaggcgggcagaucaccugaggucaagaguucgagaccagccuggcuaacauggugaaaccccgucuauacuaaaaauacaaaaauuagcugggugugguggcgggcgccuguaaucccagcuacucagaaggcugaggcaggagaaucgcuugaaucuaggaggcaaaaguugcagugagccgagaucaugccaccgcacugcaaccugggcgacaggcaagagucuaucucaaaaaaaaaaaaaagaacacaacagucuacuacuaaucuuucuauaucuuuucuuauaagcacacagaugcagcuuaaauaauuauuuuuaauuuuaaaaauauaaaucaaugaaacauccucacuuugcaguacgucauguccgaggggcuugacccccuggguuucgccacagcauaagaaaccuccacucaucugauggcggugagcuggguugcaacaaaguaccgaaagaggaaauaacaagccucucuaaggacaggccuaaaacccuccgaaugggcugucacugugcgaugaacaucagccucuuacucaauugacaggccuuccuccggcuauaggaucuugacuguaauuacaggaaaagccauaccauaaagauggggggaggagcuaauugacaaaacgcucaaugugcugacucaaggaccgaugaccaagccuuaaauuuauuuuccucaaaaaaugacugauauguuguccauuaagccagaaccaugcaaaauccaggagaugcagucuuuccaagguaccugugugggguucacacagaagacuccuggacuuuaaaugaaaaagaucuuuggaauguugccugccaaaaacagaauuucaaaaagcacagaaguuuuauuuguugccguuuuuauuuccuuuuguuugcuuaaugcuuguguuuguaucaaucuuauuuauuaaaccauccaaaaugcaaaaggaaagacaucacuuugagauuugaaccuccucuaagccucugguugccaacuuuuuuaccuuccagugugguuuggcucuguguccccacccacgucucagguugaauuguaaucccuguguuggagaagggaccucacaaaggugugugcugcauagggggcuaaucuguucucugcaggaacuagacgggaucaugaggugcuuucuaaucaccaucccccuagugcugucuugugaaagaguucuccugagaucuguuuguuuaaaagcaucuagcaccucccuacuuucucucuuccuccacugccagccaugugaagacauuaccugcuuccccuucaccuucugccauaacuguaaguuuccugaggccucccgagaggcagaagccuauacagucugcagaaccacgagccaacuaaaccucccuucuuuauaaauuucccagucucaggaaugucuuuauagcagugugagaaucgacuaauacacuuuccaauuauuauaaacuucuggaaucauugcucuaccuaguagggaaguauuaccauucaucuauccaaauggaaagaaaauugacgaugaucagacaucaugcaguggguaagaacacggacucuacaggcucacacaacaauuccaccucuaugcucuuggccuaguuccaucucuucuguaugccucaguuuucucaucucuacaauggggguaagacuguugcgaggguuccauuuacguaacguauucagaaggagugcuguggauuauacgcuucuauacauauaagugcauagcaaguacuagauacauauuagcucauuauuuucauuuuugcggugucauuaaucagaacuuguaaaaagaauaauucuccuuaaacaccccaaagauauuuuauaaagaacucaguugauacuagaaugaccaaaugcaauugcucuucugugcuguuaaagaaaaucauaaauaaacacguuaguuacucacacagguggaccuagcuugaugugacugauauguucccaaagcuuugugugcauaaaucaagccacgccuaaaugaacuggguaagccugucgaucuugcagugaauccuuucuuuccagggaagcuucuggacccaaauaaugcuagccaccugucuuaaauaaagauucuuaacauaggacauuuguguaugugucuucugcuuaugguuaaagagugagugucagguccaggaagacaauggaagcaggaaacauguauuauuccauuaaguaacugacaugaaguuuuucgagccuucucccaggaagaaguccaggcuccaacagcaguaaaucaccaaaccuaaaauuccccgaguugugugcuguacagggggcuagucuguucucugcaggaagauccaugcuguuuucaucaaaacgucacuuuaccgggaugguaaagaguaucucccaugcugacuagagaugauuaguaaugacuacuuggaguaguaugcuaagcaugacugauugauuagugaugucugucgugaauaaaggacuuugggagugcaugcaugcacacuggguacuugccgucuccaggcucaagggacacaaguauucggccuagcaggcaugaggcccccagaaauuugucaaaaggcuacaaaugguggaaaacaaacacaccuugaugugauuaugcauauucucucagaaccaauuacucccugaaucauaacuuugaaagucauugagaauuauccagagcacauaagcaccaaaacagaauuucucaaagccaauauacgaagaaaguuucaucauaaauucagucuucuuugaaaaggaggagaaacagugauuccaugaauaucuccuaguggcagguccugggcuuaguccccagggucagggacugucuccugcucgcuguuaugguccuagauguagaugaaugaguguucuguacguuacaugcaaacaguccaauguggauuggaugcugaauauguuugacuccagcacacugggaggucaguuuuauccacagaugagaagggaggcuuaauugcuagagucacaaauguggucccuccaguggacgaugucaugggucaacuuacccacuuugcuagcagauagaaaagaagaaaaaaauuauacaguuugcacauacacacccgccuucggaaugagugucucguccaaccucuacugccuuguggcucagguuucccgcuucauccuccauaaacugugcacacacugucaccuaauggaacuaucugcuucccuguguguggaaacgccacucaucuuccagguugcucauuuacuugucaugugaaaccaguuggcugggaaucugagaaugcuaaguuucgaaaacccagagacuaaccccaaagcacacccccacacccccacucccuuuguccauugagaauggcaagugucaccuuccaugcuuaaaaugcaccuggaccagggagaaagucaggugaagauguccaucaacaagcagcacccugggcugcagaaucuugauaaggguaaugaaaagaggaguagaaggcaagggaacggcaauguguaaaggggagucuugggccacuggaggcaucugugccccccuccucugcaaaugauaguuauuuaaaaugacuuuauaugcuauuuucuccugggguuucaaauucagcucccaucucccagcuuacaaauaaacuccaguuuucagucagugauucccauuuugaugggauucuguaaucacucccacagguacacaaugcacccucuuauauacugcauugaaaacaagacacgguagccaggugugguagcgcacaacuguagucccagcuacucaggaggcugagguaggaggaucacuugaaccugggaggcggaggcugcagugcacagagacucugccacugcacuccagccugggugacagcaaaacccugucucaaaaaaaagaacaaagaaaacaacacaucgaguaccacuggagcuuaaauacccaucaguguggggaaagggagagaauuaaauucaagaacuguucacugagcaccuauuagguugucaggccaagguuaaacagggaauaaaacuugguccuuuccccaaggggcgucucauccaggggaaaagaugaccuuguaaccagacagucacgauacaaaagcacucaugguguagcagcugacugagagggaaggugauuaauggcccaggugaguaaaggucugggaaggcuuuguggaagauaugaggccaagagcuggauuuugaaggauggagagccuuuugccaauagacaagaaagcacgagcauggcaggcagccucggggagagggcacagcuggcacagaugacucagccuggugagcucaguucacuuuggcugaagcaugaaguuggccaagagggagagguggaaggaaagaaggcuggagcggucacucgggggcagcucaggggcuggugagccaagccgaguugcccgugaugccucuuccauaugagcucacugccaguuucauuuuaugagcuccugcuaaugaguccuguuuugcaguagagcaaauggugaugggugagcuucucggagccauuuccuagucuaaguaacggacugcucugccuggggaagagaagccacguuugcuggguaaggggugcuugguaagguguagcugaagaccacuguguagaaaacaggagucaaugcaguuugcugcaggacggagaacugagggccaaaugguucaacauucacgugggugcuuuccaagucaaagaggacaucugagcaaucagaggaucguuuguuucauuuggucucugggccacaucaaaaugcccugucuucuuucuccuccgucccacaacaagccagaagucugaaacuagcccagcauugaaaacaacgcauguucgugaccuccuugugaaaaccguaaauagauuugcgggaacuacaacaaugaucacaagagaauuucaccaauuacgagcaccaaaggaguccaaaucaaugaagacaaagguaacugcauaaacacaugugcacauacaugaauaacacaugaggucccuuuaaaauagacugauuguaccugaaaguuacuaaacgcugaguuauuuguguguuaaacaauacugugcacuuccaaaaggcuuccguuggugcuugguugaugaucaugggaccauauauuaucacccagcuauucaccuuguacguccuugauaaggaaaggucaaccccaaguaaaagccaacgccaccacaaccaaaaaaaaaaaaaaaauuuuuuccccaaucugaacaaaucguuuaguguuaaaaauaaacagaacuagaaauugucucuaauaaacuaauauuagucuccccagaggguuaauuaugucgcuccguauuuuaagaagaauguaaauugccaguuucaacagauguucuuuuaaaagaauugguuaucugggaaaugaugggucuuuguuagagcuuaccccaguggaauauaaacauuaaaaucauccggcuaucugucagaccccuccuccucccacaacuguuacccauaccagugauacacccuuugcuuaucagcagcuuuagugacaaguguuccagccggaacuguggucccagauuucagaugacauguuaggaggguuuccaaacuccccuugagccaucccagugaacccagaacggcaucuugccaucaugccagggcccagcucaggcgccccacagccauuuccauccucuucuuuuacccuggagagcaagacuaucaggucacaaagaaauagaguuagaagguucuggaaauagaagcccuguccaaauucaguuuaaaugcucaaacauguaacauuuguguuacguacauauuugaaagcugcuaaggggagaaugaaaacugaagucucacugggaaagugguuagaaaaaaaaaagagcucacgaaugucccugcuguuuucucucaaaagacauuuuguagacacugaaauguauguuagcagguucacagugagagcuuccacacucggauauuuggccaaguaaagagaggaaaaaaauccucaauguggcaguucauuauuccaagcagagcgaccucagcugaccugggggucuggagagaacaucuguucuuauguuacagcugguggugggugucuggcugccaaccucacuugaccuaacucuucauuaucauccugguuagacucacuucacagauagggaaacugaggcugagggagauuaaugacuccuauaaaaaacuuaacagaaccugcuuucacuauugaucugcuaguaacaagcauaaaaucucaucucagcuagaaagguaagcagauaacuauugaucuccugaaguguuucugaaagggcuggcccagagcaggauuuagacacucugcagagacugcgaaguucuguguucuacaugcaggaggcaacaaggcagccuagugccauuaucagaaagcacaucccaaauggcagaaagaacaaaauaauagugacaacagauguggcccacugaaagccuacucugagaaacaggcauugggcauguuauuugacucaaucgucccacugaucugccauaaugauaucauuagaccuauucaacagguaaggaaacuaagacucagaaaggugaagucagaugccccagcgucacacaguuccuaauggcccauaaagaaaauuccaggucugcuugacucagagccuaccuccccuccccuacagccacugucucagaugacgccuaaugagcucagagcacugacauuguauaucacaagcagcuccacggucucucgggucagcuaccugaggacccaggcuccagguagggccaaaaagcagucagucugcucaugugcagaugccacaaugguaaauccaguugaaaaaucagaaagucuuauccuuaaagagggaaucucaggaagagccaaucucagcacucuuggguccuaaaaaagggcucagguguaccacugugcagguuuuacacaauucaauuacaggaggugcccuuuaccuagacuagaaaaugaacucagccaccuagacauaagcuacacugagccuauuucacugcugagacaggacuuggaagacucacagaauaauccugaaauucacaucuggacuaacugcuaagacuaugccaacuuccagcguaccaggauaaagagcuuccucuaaacaaagacccaucuuccauguucccuccauccccagccaaagguagcaggaaccuuucaaguccuccaaaaucuacauuaccaaguuuccugugagaucccucccugcuccacagcucagaaaauaggcuggaaccacaacaaguaacagccugagagagaagaggucccaguuccacuuauuuuagaagccccauuucugaggacuccuguaccucuuucgaagcuuggggaaggugggauaaugauccuaggguagaaauacugcuuuucuuucugcaguccagcuugccuaggcggacauuaauuuggugacauaagguugccuuaugcccuauccuaguguugggggauuggugguuccuggaagccagagaaaaggagggcuaaaaacaaugaugcaguaagcagcuaagaauguagcucuggaacacuaguuuccaaccaggggccauuuuacuccccagaaggccagacauuugccaacaucuggagacauguuuuuauuaucccuacugggagagaugguaucuaauggcuagaggucagggauguuacuaaacaucuccaagauacaggacagaugcccaguacaaaugacccaccuuccaauauuaacagcacgaagccucaacacccugaaccagaggaagcaucugcaguaagucccaaauacauaacaggggagccaugccucucgcaaacccucaguguaaaauggucccgcuguuguaacaccaugcaaagacggaacauuaguaagagacucccuucaaacuuguggacucauccuuaauagaucucauuaguuuguauuaguagaugggauacggaauuggggaaauaaugcccaggggcucaacucugcugaugcaucuacuuuuucugggaggaaaauaaccaaaucucugcuuuagucauucagggaaaccuagcaccugucuacagcaacauguucaagauggggagaaaaaaaaagaaaagggaaaaaaaacugagaaaaaagauaaauuauuuauccagcauaaauauuaaagaaaauugcaaaacauagucugaugucaccaugcuguuguuauagaaucaucucguuauagcuucuggcaaaauacuguuguccuuaauaucacuacaacagaaucaucuggcauguaccaagcaggguacaugugucugcucgcugucgaggacacuuagcaggaugcgaagcagcucaucacaccccagcggaaaauugugcagggaugcccuguuaggaaugagccugcauuaggaauagaucaucaacuucacccgaacccaaggugcaauuuaaaccugacagacaauggucgggggcgguggcucaugccuguaaucccagcacuuugggaggccgaggcgaguggaucacgaagucaggaguucaagaccagccuggccaagacaguaaacccuuaucucaacugaaaauacaaaaaucagcugggcaugguggcaugcaccuguaaucccagcuacgcgggaggcuaaggcagagaauuccuuaaacccaggaggcagaggcugcagugagcggagaucacaccacuacacuccagccugggcgacagagugagacuguuucaaaacaaaacaaaacaaaacaaaacaaaacaaaacuggaagucaauuaaacacacccaguaguguacaacaaccagguccgacuggcuuaagagagcacacugcuaaacuaucaggaacuuuaagaccuaguuguugggcacacucauuauuaaguauuaaaguagauaaauguaugauucaauaagcuauauuaaaaagguaaaacauacucaaagcucaauacuucugaauaaucuuaguagaugugacuauuaucuaugcucaugagguuauuuaugucuauuagucggcauagugcaaauacuuuacauacauaaaaugguaugggacuacacaucucuuucuaacuccaaguuccaagcugcaacuugaaaucagccaaggugugaguauuuacaccacaguaaucagcaaauacuacaaaacaggguuuguuuccccuaguucccgccaacagagcagguuguucaacacuuaccggcauaccaccacacacccccucacauagacaccaggaauaugguaacagcauucacaaggaaauuuuguuuucagauaaaacaucuacgauucaaaguuagcaaacucuuuucagcaacuacauggacuccuagguaacagagucauuuaauaaaucuguacaauaauaauuaaacaccauaaauaacguauccauggaagcuuccuggcuugcccuuuaggccuuugucgccaagugauccaugcugacauucugaauaaggcucgcaaaauaagugcauccaggaguggcgguggaaaguagguuugcucucaauaauguaugaagccccaugcuggggagagggauccuuggaaaagcggcuccgcggcaaucuguucuuucaucuggagccagcguucaagcaaaggugcugccccaaaucagaagcacaauugcucacuugugagcagauguccuucacgcggcgggcagugcucuuucaacacagagcugaacaaaugcgugcugugagacaggcuccccuccccauuacccaaagaacacaguauacauuaauuuaguauguuguggaauaacguuugaaaggggaguuggugcaguagaaaaaucacgcagugaggcaaaauaacuuuccaaccaaacgggaggaagaaagagaguuugguuccuauggaaguugagggggaaagagucugaaauaucuucaaccucaaaagaaacccaaaacaggguuccuuagggagucaaaaggaccucacugggcaggcccaacacagagccaaaaucgaacaucaaccacccaaaagaucauuuucaaugaacauguaguuucauugaaaaugugcauagcuggaggaggcugugcaugugugaggacagggaguauaugaaacucuacacuucccacucaguuuugcugugaacuuaaaauuacuguaaaaauaaacuuuauuaauuuuuuuuuuuaaaguacauguaaaccuaaacccuguagucagaugaacuguuuccuuuccggcugggaaucccaguuggaaggacuuccaacauucauccuagggaguuucauggggcaucuuugguucuaagggaaccucaucuauaagguguuagucagcucaucagaaggcagggcagagcagagcgugccuugccagguacacaggcuguguaguacacaaacagcccggaaaaccaguggaaagaccuccucccagccuugauguaacugggacagaaauggagacaaaugcaauggcacuucacauucgcuuccccccaccccacccaucuuccagaaccucgacuucaggacagcuuccgcaaacucaaucacuucuuucaggcugacacaauuugguccacuuccuguauuucauuuugggagagagaauuauuuuaucuaggaaaaguaaaauuagcaaccugcuuagagacuccugccuuuaaagccccacauccacucaacuucuacacacaaauacuaccguuugccaccuugauaauuauuaaauuguaacguaaaacccaacuucugcuuaaguauacgugauuauuagacuauaagucaauuguggauaacacgcagauauaaaugcagcuaauaagucuuacuguaaugauuaaucaauuuaugaauacauuauuuaaacuaauagcucagguaggguaucuuaaacaaguuacagaguauaucgaccaauucaaauaccagcugcuggaucaauagcaaacuguaaguaaacucuggggaauagguauacuuggaaaaaaaaaucugugaacaaaagggucuuagaugaaaauaaucuacaauuucaauuuuuaagacaaauguauaguacuuuaauauaugccaaggccuaaagagaaagguacaaaaguauuacugcaaauuuugcuucuauuccagccuaugcaguaauaaucauuaagagcagcuccuacaaauucauauguuuauacaaagcacuacauacauaugcaaaaagacaauguauucaaguuaauuuugauuccuucaaaauugauaaaguggguucauuucauugcaagggagcauacuuaucuauaacugacccuuuaacagaaaacaaaaauuaugucuaaaaaguaagguaagccauuuuccugaaaggggcccaucuuucaacagacacacuaggggccacguguucugucacagccacaaaaccugcccccuaagccccacuguugaccacaagauguuuuugugagcaaagucaaugcuugcaucaugaugcuggcucuucucauuuuuuuuaaauuaaggcuaauuaaugugaguuaaauaaauaaacaagaagagccuugauuuccaaaggugugauauuuuaucacagcuucaagcgaugcugcauuugaaaaaaagaauuaguaucuugugagauuggccacacauuauugaguaaguaacagcagcuaagugaaacagaugaaauauugguaagcgaugcagcccacaguauaaguaugugaagggggucaaagguuaaucccuauugauuuuccgagucugcguacagcaccacugggaaaggccgguucuguuggcaaucagcuagcacaaauacauuauaaaucuuacugucugccuucaccgaucagugucacuuacuuccuuugcuaaagaccauuaagaaacuaccaaaaaaaaaaaaaaaaauucuacgcagaugccggcaaaaagaaaaguauuaaaaaaaaaaaaaaucuuccaugucagccaaugcuucugcagacgggagacuuuucaugaaagcggaggcacaccucacugagacccgucucuuccaaguaaagugacaugcaacuuucuugagaguaaauccauuucaaagaauaaagacagaguauuuuucaaaugaccuucaacaucaaaucaaaaagguaaaaguaucuuuuacauuugggugcauuuuuaaaaaauagaagaaaagcagucuaacacacucaugcauaucgagagccaucuccaacuugacuuugcaaaauauggcauaaccuugaagccaacaaaagguagguugaagaggcccuucaugucuagggaccccuuccaguauuccacacuaaauguuugacuccuuuucuuaaagugggcccacaacaugcauagaucucagugccccaaaaucuugacgcccacuucuacgaacagauaugaaugacuguuucuuuuucaugccuuuuaacagauuguaccauguguauuuuaugugccuggcccucuugcuagacacaggaaggcagaugagugagauagauccuucccaagaaaaaugaaacauacguucugcgucuuaucguugacucucguacaacaagguccugagaaacagucuuagcgccaauaagugcucugccacuuaccagcuuuuuaacacccaguugauuacuucaacucucuaagccucaguuucucugccugggaaaucaggauaauuauaguagccacuucauagaauggucaggaaauuagaaaucacaugcaaagcacuuagcacagggcccaguaaguauucaauaaauacugguuaauuuuucuuaaauaauggaguuauuuggcuaggcaaggcagcucacgccugucaucccagcacuuucggaggccaaggcagucagaucaccugaagugaggaguucgaggccagcauggcuaacauggugaaaccuggugucuaacuaaaaauacaaaaauuagccagcuaugguggugcaugccuguaguccugacuacuacggaggccgaggaaggagaaucgacagagguugcagugagccaagaucgcgccacugcacucuagccuggccaaaagagcaagacucugucucaaaaaauaauaaaaaaaauuauggaguuauuugacauugggauaaaaagcaagugaccuccuucaaccucugcuucacuaaugagggcuguggaacugugauguaaaaagacaugaagccaucugacccaccauuccaccuaaauaaauguauaauauccaccuauuccccagaauaggugggaccauaacaagcacauucuaaguuauucuuuagaaacagauuucuuaaguccuugaaauguguaugaaagcaaaaccuaucagaaaugcagacagcuaggcagcucagccuuaaccaaggaugugagaaaguuacgaaaucuuuggguaaggaaagguucucucucugcagaaaaguuauuuauuuuauuuuaaagcuccagccccaagaagauuaauagaaaagguucauagauauguguuaugucuucacaguuuucacaaacacagcucuuaucacauccacaguacacaugcaggcgcgcgcacacacacacacacacacacacacacacacacacacacacuucccuugcccugagcaaaagucauagcauucuugaaacaguucuggcaaauacagccaaauuguugggaaaacauucuuuuuuuuuuucacaauuccaucaacuaggcucaguguaccacgugcugauaucaggauguacuugaaaauauuuuaaaucccuuuaaauuaagggguggugggaggugagggaugacucucccagggcuaaugauaaacaaacgaacauccugcaaaguucccaucaaaacuucagcaucuaugccaugacucuuucaaucaaugacuuuuuuccccauuuaugaaaccuuuuauuucaggauuuucaccucuauugaaaggauauccuucuaguaggcagaggauaaacagaguagaccucagcugagcacugaaaaccaagagagacagaggccacagagucuuuuuaaaauccaagaggcuccaagcugcuuugaacugucuugaguugauggaaguacgcuuucaucaguuagaaaaauuaagggcauacgccucaaaagaugucuacuuauuuacaaauuauaaacuuggaucauucuauuagcuacuaccuccaggaaugguauagguuaaagcaauguucaucuuuaaaaauaaugcaugcaauuucaaauuucucuuugcuaauuuagauuuuuguuuuuccauugaccacuucugaucaaacugugauuguguuuacuuugcacaagaugaagggcuuuuauuaggaguaggugaaguaccaauccugcucuuuucuuacuauuugcuauucuaagaacuauauccaaacacugaucuuuuugcacaaauguuuguaagucucuuguucauucugugacgguugcuuuaguucagaccacauaaucugaugucucaauccauccaacuaagcacacaugcaaaacuacaauacauuucaaagcuaaaguccacaaggagcaaagguuccaacauggacccucucccuggggaaauggccagccugacuuuggaauguacugcauacugcacacaauuccugaccaucagaggacuggagaggguaccugugucagugcaucuguguacuaucuguaaaaaauaacauuuuuaaauugagagccaauaugcuuacauugaaaaguacgggacccugaaaguggcuacugagcuggaaucccuacucugccaccucuuuucuuagcacaucucuuuccucaucugugaaauauggacaacaauaguccuauuucaaagaauauuugaaaggacaguacauguaaauauaugcaaaacacuuaaaacaguaccugccacccaauaaauguguugagauguuuaauaauaaaugaaagaguuuaauggauaaacagaaguuauaauguuuccucucggaacccaagugguucauccuucacacuuuggggacuaaugcuuuaaagcagauguauccaaaagagcauucuacuaugguagaaauguucuauaucggugcuacccaauaugguagccaauaaccacaucuggcuacugaagauuugaaauguggcugcuauuucagagcaauugaacuuuuaauuuuaauuaauuuacauuuuaauagucacacguggcuaccauauuggacagugaagcuccagaagcuucacuauuucugacacuccauaggacccagcacaauucuguaauccaccuaguugccuucgagaagguaugacugcuucagugagaacaagcuagccugaguuucuggaguguaaagccauggaauccucaccuuuacacucccuuucucuugucucuuagaugcuccauugucauugguuccuccuucccaggagggggcagugaacaaugcagccccgcugggucaacauuauuggaggccucuacuuggugccagccucagccuggcuuucauucauaguuugggucuugaaucuuaucuuggaaaacuccaugaauccugccuuugaccacugucuagacucccaggccagaggcugucacuauauuucguguccuggcccuuguucccaauuuguagagggcuguccauauucuacagaugaaccuccaugucaaucauuccuauaacaguuuccuccuuggaggcaacgagagcagugacagucuauucuagggaaugggacaugucuuaucuccauuuucacuaugaaaauaucuuauucuauaccaucaugccacaaagugacuucauucaaaaaccauaaucuucacaguacuaccauauuugcaucuaaaguuacuugguaaaucauaaaguccaaauaaacuauaguuauaaauaaaaagcuuuaaaacauuacaaugaaagcauucucuaaacccaaccuccucucaggcugaguuaggucuuugcuucuaucaaaauuauuugcauauguuuuaaucuuucucucuagauaauaagauccuggaaggcuugacugauacaaauucauauccauauccuuacugucugaaguggugccagacacauaguagguauucaauacguauuggaugaaguuacacagugauggagaauauguuaauccaaacagaaagaaaacaaaacaccuuucucugcuuuccaagauguauguuuauuuuuuuuuccuuuuccaaauacuccuacauucaggaaaacaguaaugcuaaaucugacuuacuuauauuuuaggaagccuggauaucuaaauuggugauuccuacagucauggcaauaugccuuguugaucauaauacagauuaucaacuucuacagaaugacaaaaucaaaggagaaaaggggccaugauggaaauaucaaaaccaaauuaaauacuggaaaugaguuaaugaaauuauacuacagauucagcuuauucagaaagggcuuguccaaggaaaggggagagaaaaaauaaauaaauaaaaaauaaauuuaaaaaacccucaccaccagaaccagcugucuaguuugaacugcuagauugcugagcacauacuguaugcauauucauaaggaccacaggaaauuaagcaccuuuggagccugcauuaaaacucuuuccugccagccagugcagugaaccaguaacucaacggcacccuuguggccuggaauaauuaaugcagcuuccaaaggugggaaggcuuuccuugggguggggggugcaacagcaaggugggcauggagcuucgagagaggagaguaggcugccaagccauuuguucuuaguguguuacaccuggcccuguuuuguggaagggagggaaauacgucauuaucaucgcuuuuucuuuccggagucugaaaaggaaccccggggugguaaauauggccauucaugcuaacauuggcuuaaggaagaaccagaucaaaugagcucaguuauuuacauuuaaaaacaucauuuaagggaauuuuaaaccgucugagaagauggauacacuguguuuguuuucuacauuaaugagcuauaaaaagaauggaauaggccauaaauacaguauuuuguaacagccuuuacuaaaaaugcuacuacuuguauuuaucauuuauauccuuguauacaaccucaaaauugauuacacuuuaaaccguacauaccuugcuguguuuuucauucugugcuauacuacaaacauuuuuauaacucaguuaauauauuccauauuuuguguucuuauugauuacgaauauuucuuuaggggauuuuauugcuuuuaaaauaacaaauguuagguauuaaaaaauagaaaaaccuauugcagcuuuuauauuuuucuuuccccugguaauucuaauacacacauuuuagcacgaacauaaccagaauaucuuuuuccauaucuuuuauacuuccucccacuaauauuauaaauccacuaauacaguacauaguaaaagaaucagauuuuuuggaugaaacccaccauuuaauguguuugacuugaauucauaauucucuccuucuacaauuaaaaaauuaaagugcuaaaagauuauccgcacguaacaugguuuuacaucaaguauauauuaucuuuccuaauugccauuucaguuuauaggcuaaaauaugauuuauauauaugauaugauuucacuauuaauuaucaaauugaaaaaaaauaaaaucucacauuagaaauucuccccuggaaauuaguuuuauuauuuuuuccauaauccuaucacacaagcuauaagugcauugcggcaugaacacuuuaauuuuuccaguuaguuuuaagcaagcccagaggugagguuuaauaaggaucaauggcacuuuaucugggacagggccucuucacagcaugcaaauuacacaguaacacuuaaaaaaagaaauagauuuaauuaaaaaaaaaguagaaccacaggcucuggaaauucaauuaaaggauuuaugcaaagguuugcuagguuuuuauaugcgguuacugcuuacauaaugagcuuuucauauuaaaaaucaauagguaaucuagacuagaagaucauccccuuaaauacauuuuugaaaucaauuugaaaaauaguccaucaacugcugugacuacucuugcugcuucgauuacacuaaaagcaauauuuagauuguaagacgugcuauggaauaucuaugcuuagauauugcuuucaagggcucuuaugcuuuugagugccuaagaugaucaccugguaauucaagauuguguuaaauguauaaauaauuuauuuaauuaccaacaaaagcgcagacacaaucccaucguauuuauaauguuaaauaaaagggugaaaaagaggaaagagggaacugaaggaggaaggacggaaaggagaagggggagaggggagagaagagggaggaagaagaugggaaaucaggaagggagggaaggaaaaagaaaaacgaacaaaacaaccuuuucuaaauuagucuuuccuaucucaauugccuauuguguuggcuacuuagcccuuagagauaugcauuucacuuuaaaacucauuuaggucuucaacugaagaagcaauuagcuagcuuauaauuuaagcagacuuuucauccucugugaucaugggggacgggucuugaaaugaaaacgaaagucgaugcuccaguucuuuuuuuuuuuaauauguauuuuuuauuauauuuucaguucuaggguacaugugcacaacgugcagguuuguuacauauguagacaugugcuguguuggugugcugcacccauuaacucgucauuuacauuagguauaucuccuaaugcuaucccucuccccuccccgcaccccacaacaggccccggugugugauguuccccuuccuguguccaacuguucucauuguucaauucccaccuaugagugagaacaugcgguguuugguuuuuuguccuugcaacaguuugcugagaaugaugguuuccagcuucauccacccaagugggcgaaggauaugaucagacacuucucaaaagaagacauuuaugcagccaacagacacaugaaacaaugcucaucaucacuggccaucagagaaaugcaaaucaaaaccacaaugagauaccaucucacaccaguuagaugcuccaguucuauccaguagcuucaccaccuguaucacaggcaagauuugccuggauuugguaacaauuagaacaccagaugggauuccaggggcaauuccugucaaacuggggagugaucauuuuacagaggaagcaugaguaaggaguugggguggcggagcuggaggaaagaaaaaccuagguagguccaaauccaaacucuucucauuaccauaauaaauuaauaagagacacauucuuuaauaccucuuuguccagguucuaauuuuuaaaagguagaguuuuaaaauguaaucgcagcauuuugggagguugaggugggcagaucauuugaauucaggaguucaagaccagccuggcuaacauggugaaacgcgucucuacuaaaaaugcauaaaauuagccggugugguggcacaugccuguaaucccagcuacuggggaggcugagacaucagaaucacuugaacccagaagguguagguugcagugagccgagaucaugucacugcacuccagccuggguaacagacgcugucuuaaaugaaaugaacuaaaauaaaaauauaaacuaaaaaaguagagugaguacucauuguccaucaagaugaaagucauggcucuaguuaucuucaacccaagucagccuuauuaaaauaggucuaaacuuuauaaaggaccaccuuauaacaaaccaacaccuuauucucuucugcaaaacucugggaaaaaaacuaagcaaaauauuuacaaaucccaguuuauccaucuaccaaaagcuccuaucucagcaacacuaauauuuuaagaaggugcugaugcagccaaucugggugaacaaggagagcccaaaacagcacaaggaggucccugcucucaauacacagggaggagaagauaaagaugaagaagcagcagcagcuuccagcaucagagaaaucaaugauguccacauuaugauuucuaaagcagaacucuagacauauccuauuaaugagccagccuuuguuuugcaugucccuacagcuauauugagggagaguuuaagaaccaaguaaugagcagugguuuuaucagucacagauuuaugcaccugacaaacacauuuagaaugccuggcuauguuagcacuguuaguggcucuugguggcuacaaagaugaaucucauaaaccuggcgugccuaaauaaauuaaauauuuuuguacauauguuuacucauuuugaaaaauguauuuguaagaaaaaacaaggaacugaaaaauuaggugcaguaucuugaaaacaugaugcaugcaaagugaaaggaccacucacaaagaaccacauaucgugugagcccauuaaugagaaauguccagaauauacaaacgcauggagaugaagagcagacuagcgguucgcagaggcuggggaagaguugaaguggagaaugggagguaaaaaauauggggugcaggcuuucuccuucagguaagaaaacugacuguggcaaugguugcacaacucugaauagacugagccauugaauuguacacuuuaaaugcaugaauuguauagcauguaaauuaucucucaauaaagcuguuauaaaaaauaaagugcaguuuacggacugucguuugaguaacagcagcuuuaaagaaaagcaaacaagaaaaucuaaaagggaaccacgaugaggggguggaaauccuuauuuucuaccuaaaccaaucugacaaaugagacauuuaagcuuucuucaucacuacaaaauaucuucugugaugaucgguuuagagagugcaucgggguaagaugugcaaacauaagcuauuggcguccuacagaaaggugcugaaaucaaaauaagcaggggauuccuaaggcaugaaaugagaacuuuagcauaaaaugucccagguuaguaugaucaaaaugucaaacauaaaacuguuuucuaacaaugugagagguguuaguaaugaaaauuugaacaauguuaacacuuaaaauuucagcagaaccauuucaauccauaaacguguaacagucauuuuacagcgugcuuaacaggcaagaccuagagcuguuauaaaagaagacguccucaaugucacuucauuuucuuuuauucuuauuaucacauuuaaaucucuguaaaagugguccugauagguaacuuuaugacauauuucaagacuauucauuucgaacagaaguuccuccaaggaauuaacagggaaagggaggccacuuucucaucaucccuaaauuaauacgguaacaacggcgaagaagaauggcagcgugugugcugcaaggacuaggcaugcuacaccaugcaacagcuggaucaucuuagaggugacucuuguuggcauucaggggaccacuggugggcugccguaucuucagcuaacaccugacagcuuaccuugcaaagaccugggaguaaagaguaggguacacaggcaaagucaagguugggacuuguuuaagacaauuccaaaaaaaacgcuccauaucagcacugguggcaacauucucaucuuuccacauuuucuuaggaaaggagggacaacaaucuccccugaaucacgucugcucacagauaaguguaucugcucaccuggguguuggcaaacuuugucugagagggccagucggucaauauugucagcucuucaugcugugcucuaaccugcugcaaucaguuaacucuucccuugucauacuguaucaacaauacauaaaaaggucggcucaugucuguaauccuagcacuuugggaggcugaggugggucuaucaguugaggucaggaguucaagacuagccuggccaacauggugaaauccugucuccacuaaaacuacaaaaauuacccaggcguggugccacgugucuauacuccaagccacuugggaggcugaggcaggacaaucgcuugaacgugggagaugcaggccgcagugagcagagaacgcaccacugcacucuagccugggugacagagugagacucggucucaaagcaaacaaacauuacauaaaagauaagcaacacuguguuccuauaaaacuuuacuuaaggacacucaaguuuaaacuucauguaguuuucacacaccuugaaauauuuuuccuuucauauuuuuucagcaauuuaaaaauguucuccugcaggcggcacaaaaacaggcugcagaucagauuuggcccaagggcccuaguuugcuuuuucccgugcuaaaccacagacugggaagaagggaguggcgcaguaaucccaucuugaucuaagauuuauucugcugacgcugugacaacgaaaugacauaauuuuuuuuuuuuuuuuuuuuuuuuuuugagauggaguuucacucuugucgcccaggcuggagaacaauggcaagaucucggcucacugcaaccuccacuucccggguucaagcgauucuccugccucagccucccaaguagcugggacuacagcuguguaccaccauuccuggcuaauuuuuguauuuucaguagagaaacgguuucaacauguuggucaggcuggucucaaacuccugaccucaggugauccacccgccuuggccuuccaaagugcugggauuacaggcgugagccacugugcccggcucaucauuuuuuucaacauagcaaaacuucagggcacauauuucaaaucaaguauacuuuagagaaaagcaagagaaauuaguuucuacuaacagaaauuuauauucuaaauuuucuaaaugucuuccuuuagaaacaaugaacaaggccccaaaguuuuucauuauuuaaaaaugaacaagggcuuucagaauugacaggcuuggaauaugcagcauuuggcuuaugagauaagaggcugaccacauucccucugauccucguuagucauuccaucauuaagacagcaggucacaggaaugcaauaugcagccaguuccuuguauuggugcuucuaggugguugggguuuuaauuugaauuaugcacaaaaauagguauuuacuguguuacuuuuuccuguuuuaaccuugagcuuuccucaacucucugucuacugcaagcauaggcgccuaagaaaaaaugugugggcaaauuggcaucauaacaccuaaccagaauaaucaaaggaaugucuucgcugaauaaagugaaacauuggaauuagguaacauuucuaaagaaggauuuugcauuaauaguauuugaaguauguguagaaucaaaaacugauaaccguuaucuggaauauuuuggugaauagaaaaaaaaauugcaaauugguacauuaaaauguaaaaguuuauuuaauguguacauaaaucuacuucaugauaugacaccacuccuuggcauggaaaaaucaucguuauuauuuugauuaagagaaacucuagccuaguucaggccaaaugauguucagggacuauugcuuauauauuuuuaucuuccaaccaauguggcccaaauaaagauuuucaaauagcaugaggccauuacccuaauauaaaugugucucaguacaaagucacagaagaaaaagggcaauaauagaaaaggcaagacauucaacuaucgcugcagagauuucauggaggauguaaaguucugagaucaucacaucccaaaccaccacaaucaaaaggugcuggugaaaaagauccaaacgauggagaacgucuuccuaugaugaagcugguaacuuccuagaaacacugcacaggacuguuccccauuugaagcaaaacuuaauuagcauuuguaaacauuccaccagacaaaugaggugagagaugccuguuacauucgcaaagcauccucaucuccgagggcuacccagaaucccucugaaaucuguauuccauguuugcaucagaauguuuauuagcagcucaagaauuggcaggacagggaaaagcagauccuggaugaagaaucacgccugauugucuuguaguugccaacauuggucaguguucugcaacgugaggaccuucugucauucuuuugacuuuucccucuucccuguucaguccuagaagcaagaaaaccgcuaaggcuggaagcaucaaaucagcauccaggguaggaaggaagagugaaaauaccagcaaugccacaccauuuuauagaaagcaaaagguauucaaggaaacgugcuguugguuucugauuuuacuugauggcuagaaucugucauacagccauccucaguugcuaggaaggcugugaaguaggcacaauaucaccuguuccagccuguagaguagaagguaggcaaagguaccuaccacacuggacaauagcaguggggucuugcuggucgggcauggugacucaugacuguaaucccagcacuuugggaggccgagguaggucaaucaccugaggucaggaguucaagaccagccuggcccacauggugaaacccccaucucuacuaaaaauacaaaaauuagccaggugugguggcgugccuguaaucccagcuacuugggaggcugaggcaggagaauggcuugaauccaggaggaggagguuucaguaagucaagauggugccauugcacuccagccugggcgacagagcaagauucugucucaaacauacauacauacaugcauacauacauauauacauacaugaaaauaaaagaguggggucuugcuuccccaugaggaugaaaucguagagggaaggaagcaugcuuaguuauuucugguuaucuccaaagucaaaaacaaagaucuugagggggaaaagguaaaugagaauccaaagugauuuuaaacaaacaauacaucaggugaggcaaagauguacuaugccccgcaucuuccugggcacaagguuaugcucuguuuccuagccuccuggaguucaaagauuugugccacucccaggccucauccuuaaaaugcuccacacaugguccugcaaauuccuacuucuuccaccagcuuugugcagacaacagcagggcagugcuggaagccacaugugucagacggcugagccacaagaugaaaagagcuugagucccuggguuaccacuuggaagagagcagccugcuaauuggcaagagucauuauggaucuuacauaaacaagaaauaaacuucuacuaucuuugagcaacugugcacaggcgugcuuauuuguuauagcagcuagcaucaccuucaauaacguaccaacauacaauguagaugucuuagaaucccugagaauuucaguuacaucuuauuggcucuaucuaaucccagguuacagauaucgguuugucuuagaucuguuuagcaaauaaccaaaggaucaccucuaggugucacuuggcccuguggcuggcuagcacugagaggaagcucuucuuagggaaacagggaaaauaugccugguaacauuucuauaaaaugagaggaaaaaaaacacaacccauggcccagccugguuguccaugguguaagcagaauccauagacuauuccccacuaucugcgcgguacucagacauguccuggcagccugcuaugcuuuucaaguuuguuuuuuuaacaucucuuaacuagaccccuuuuauccaaaagcccuucugcacaccccaugacaugcuuccagggaaugucuaguuuaaacugaauggguaauucguaacaccaucaucacccucacugcggagccugucaucucuguuucagaacacuagucuccuuguugcucacuuuugguuugccuucagcccuucuccaagugcuccugugaagagauguauuuuguagcuuaagagucugccuuuguaacuuauagucagcuauauuuuccuuguucugcucuuagauggaaaacaaauugcauaagggaaaugucuucauaguaccaguucuuaaauauuuuacagguggauaucuugaugggugguuuggaggcucaauuaugcuucucaggagagggaauaaauaucccugacgauuuccauaacaagcauguggugacuucuugcaacuucaaaccugagguaucaccauuugccucugaaaucugacucaauggcauuugaguauuugaaaacgaguaaggccagcaaaacugaacagguguuacaacaaaaucaaucuauccauccaucugucuuuugagagacucaagaaagauagcuaagucaagucauucagaacuacugauguaagacaucgucauaccaaaaguuucgcucuugaauauacuuuugggguagaggggguuacagguuacaaagggaaaccuuuuaaaauguuagcuucccccaaagaaagacccacagaagaugugguguaauauaauauggaauuacacugcacaguguugcugaaaucagaauauagauuguugcuguaucccacuccaacucauuugauccaacuacaauucuuugagguaaguaccaucaucccuccuuugcagacaggaaaacugaggcucaaacaggugcaguaacguaggcuagguccaugaacuaguuaguauaaaucagacaugggauguguacuaagucuuuauuccaagucaugugcuuuuuccacuuacccuagcacucccuguaacuaucaagcuacaagggaaggccugaaaucucuucuaagagggccgacaauggaccaugagaugacccuuccaagaacagcauuccaugggauggcuggaagcaaaaggaugaaucugcaaacucagugugaacucugauaggugguguuccucugugcaauucucuuuuuugccguugcaacaauacgugggguuaaggugagaaggaagcugguaugagaagccagcaggcugcacagguggggccucacagucuggaguacaguguucugcucaccaugaaguuuaaaaaaaaaaaaaaaaaagaaaggcagccuagaacagcaugcuaagcuaacaaagcauaucaggucuccagaaaagagaagcugagcagagaacugguagaaagccacacaauaguaaaagcagugaagauccaguguaaagguaguucuuggacucccagaggccaugaacauucccagagggcaaugaggacacuuagaaaaugucaguuuugauugguggcuuggaaaagagcagagagaauuuugagcuuucuuaaacaguaaagaaaauauaccaguggaaccccccauccccaagauugcccauuugucaacagaugucagaaacacacaaaaagacaaugaagugagaaagguggaaaagaagccaggcugaucaguaucacugaguuuggagucauuuuauauccaggaagacagggcaccuaaaaucuuccaauaugcuucauagcuuuguaugaaguauguucuuccaaauucuaaguaaggaagaaaaagaaguuucagugcuauaaugucuaauucaagcuuuuaucagcacuaauuucaguccccuuuuuccuuauacuucugaacagagggaaaacagacauuaauuaagcaaagcuuuaucucuuucuacucuaaugaaagccaaguuacaguuauauuuuccccaagauuuuucuccacuuaaugaagacauuauccccgaguuuucaaagucauuuuacaaaagaccauucaagagacauuacagucaguuuaaacuaaaaagucuuuuuugaagucaauaaacaauaaaagaacaaugaaaagagguccuuugauccugccuuagucuacagucuuuaauuucuguuuuaaucuacuagauaagacuuguauucaaauauuccucaccucuagcauauaguaagcuugaauugaucauuuuauaauucuuuccuuaaaauauguguaugugcgcauacauguauauauagacuguguguauauggguauauacaucauacauacacauacaugcauaucuaauuaacauggguggugaucagaaaaaagcccucugccagaaaggggaaaauuuuuaaauuuacuuccagccuaccucuuugaaaaauuuuuuuuaaaaagaaggaaaauggaaucuuuggcuuugaaauucaugacaagaucaaagacuauaaugcacauagauuuuucaauguauacauuauuaauaacacaggcaaacacauaacuaaucaauagcauggucaagagauaagguacguuuaguguccccauggcucugugaauaaccccaugcaggguagggaucggugucccucucuaagaucuguuuacuuuacugggcauuacauacaacccaauuauuuccugcccaugcuacaacguugcaacugugugauacagauggaagaaaaaaauuuuuugugcuuuuuuuuuugagacggagucucgcucuguugcccacgcuggagugcagaggugagauaucggcucacugcaaccucugccucucggguucaagugauucuccugucucagccuccuaaguagcugggauuacagaaacccagcgccaagccuggcuaauuuuuguauuuauaguagagacggaguuuauaguagagacaggguuucaccauguuggccaggcugaucucgaacuccugaccucaagugauccacccaccucagccucccaaagugcugggauuacaggugugagccacugcacgcagcuggaauauuuaaaaaacaacaacagcagcuuaauaugccacauguaucaaaauaugucuccuuauguguuagccucuuuuugcugagaugaaauucacauaacauaaauuauuucaaaguguacaauuuagugucauuuaguacauugacaguguuguagagcuaucaccucuaguuccaaaacaguuucaccaccccaaaggaaacuuguacccaauagccgggugcaauggcucacgccuguaaucccagcacuuugggaggccaaggcaggcugaucaaaaggucaggagaucgagaccauccuggguaacacgaugaaaccccgucucuacuaaaaacacaaaaaauuagccaagcaugguggcgggcaccuauagucccagcuacuaggaaggcugaggcaggagaauggcauuaaccugggaggcggagcuugcagugagcagagauggugccacugcacuccagccugggcaacagagcaagacuccgucucaaaaaaaaaacaaaaaaccaaaaaaaacuaaagaaacuuguacucauuaacaggcuuuccauacuccccgccgccccagaaaccaccgaugcguauucugucuuuaugaauuugccuacucugcauauuuuauauaaauggaauauccuaugugaccucuuaguguuuaauguguuagucucuuuuaauuuaaaaauaagucaagcccaacagaaugcaauucagacuguaaagaucaguuauucagaaaaaaucaugaaacacagaauacauuuuaaaaaauaaggugauuacacuacuggugcccucugaugguggguauuauuuaccugggcaauuaaaaggaaauaugcuaaauuuacauaccaaggaacauuuacaagggaguaaauuacuaaaacagguuuuauagguggaaaauaugaacacauuccugaaaagcauguuaaauucagagauuauggguccaugugaguuacuaaugaaaagguaucauucagggacauugcccaacauuuuaacuuguggucaugugauaaaacagacaguucuuuaacaaacccucccccaggcugggugugguggcucacaccuguaaucccagcacuucgggaggccgaugcaggcggacugcuugagcuuaggaguuggagaguggccugggcaacacaacaagaccccaucucuuaaaaaaagaaaauagcaaaagacaaauccucccucagggccacauucagaaaugguaaagaaggcugaaugguuuuaagucuaaaucaguaugauuuccaaccaggauuauucaucugccuuagaaauagcaauuuuuaugauucuaugauacaauuugucuguguccccacccaaaucucaucuugaacuguaguucccagaacucccaugugucaugguagggacccagugggagguaacugagucaaagccaugggaucugccugugcuguucccuugauagugaauaaaucucaugagaucuggugauuuuauaaagggcaguuccccugcacacgcuuucuugucugcugccauguaagaugugccuuugcuccuccuuugccuucugccauaauuuugaggccuccccagccaggugaaacgacugaguucaguaaaucucuuuuucuuuauaaauuacccagucucggguauuucuucacagaaguaugggaauggaguaauauguuuuauuucuucuuucucugauucuccuuauugagggucuaacauuuccccccaggucagaacagagaguugcaguggccauuucuccaaaaaggagacugaauggggcccuuuaugaauaugaacaaugaggccucccaggaagaauugcugcacgggugggggcaacguaagaaaugaggcagcagcucuggauuuacagaggggcaaaagcagacagaucugccuucaaauccugacuugcuucugacauagccucuaaccugcaccuuuacccuuuagaaaacaaggaucccuugaaggaucgucaugaagauucaaggaaauauggcacaugguaagcacccaagaaauccuaguaguuugugauacgauuuguauucagucacuuggucaaggugcuuucuguggacuacuagaaacggagcauuaacuuuuggccaggaucuccauuaucucccugccucucuaccucugugccuccuucccucucuuccuccuucucucucuucuuuccuuccucccuuccccucuuuccucucuuuccuucucccuuuuucuuuuugccucccuccaucucccugucauccuccaucucccuccgucucucccucucuuccuuccauccuucccuuccauucugcuuaguacuagacaacccacagagucccuuguccacaauauuaagcaauaagcauuaggucucaguguuccucaugccacaucucucagaugaaugggucagagcccuucccagguccugaccgguugucacuggugugggugugcucugaucagcuucaucuccucuacaacagcccacugccuugccuguccuagguucugaccgccagaucaacaaccuaagacuucuguucccuuggagaaagacucacuuaauggaaaggcagcuccaccagcaguacaaauugaacauccucauccugagccccaaagguccauacuagaaaaggaggaaguuuagcucacccucuuaaauuaccaggugaucauuugcaaacaaaacucccucauaaaacacuucuuuaaacucuuuacuugaucauaaacccuaaccuaacacacaucagcccugggaugaaguaagcauuagaauuacccaaguuuuauggagcagagugagagccagaugacagaguaucagccaacagauucuaacagucacagaaucaaaaaagauuuauugagaaccuacuaugugccagauucguaagaugcuucaguguaugugaucucauuaccucaucucauuuuucucuacuaugcauccugauaagccauauccuacucaaaacaauacaaaugaccaguuacauguuuaucaauaaugacagcuacucagcacaacuggacaaugcuggauagcugcugcuucugugaauuuaaagaaaaauuuugcugcgaggcauggaaauaucuccagucuauauaaauuagcaguuggacacccuagguuucaaggguuauccuuuuuaaccagccuggcaauucauuaagcaucggguaagaauuucuucuauugcuuuuuaccacggauggacaaugccuaccuauaccugcaagggcaccuccaacaugcgcagugcaccuaaaauagcccugcguuaagaaaaaugccaagcucaaguguauaauuccucagugcugccuguuuauuuucuuucgcguuuucacucuggcaugccaaccccaaaucuccuacaguaacacagaauugcagugggauacggaucugacaugaaacaaagaccugccccugccucagcaaaggcaaauaaaacaaaagaucaaugagccucaaagccagugugcauaaaugucacugcgccugcaaagaggagagaucagaggacauuuacaaaaucacaguccucccacgguggugggaaaagguuacuguaguauguccuaaggggugaacagcgugcccaagggaaacaguaaggacagggcaagacccaggaaagcaacaaaaauuuagauguugucuauguggcugccccagugcccgcugccucguuucucagagcuaaucaagggaagcguaacuaguccaggcggcaggacgaguuuacaacaacugacaguaacuauaacauacgccaguuuguauuaagauguuauugcaccuuuccaguucuaaucaccaauuaugacucuauuacuccuacuuggcaguucaucugcuccugccuccgcuaagggcgacuuggagacggaccucugaucucccgguuccacuucagugagcgcucagcacggcggcugucauuugcagacacugaagagguaaggcauugcuuuugcucagauaacuguaccugaccuuacaacaauuuacuaaggaaauaccugcuuaauagcagugugagugcaguuuccuuuaugcuggcaagugcgcugcaaauuagcgacaacaggauaaaucuauggccggcucacuagacacuucauuaaaucacuguucucuugccuuguagugcgcuaauagaaucacagcccucguuagcuacugaauaaaagaucaaucacagacuuugaaagcuccugcuaccagcuuccagaggaaacaagaaaaaaaaaaaagagcgugagcaagagagaaagauauuuaggaucaucgcugagauucugaauggccucgcugcaaguugcuuaaauuaccuuuuccacaacugacuccaacuguaauacucagaggaacuuguuaagccugccuucaagagcagcauucuaauauaugacugcuagacccuggucaaaaguucauaaugugcauauguaaaaagguacuaaauugccugagggcuaaaaccagaggaguuuaauuguagcaaaaugcugaaaauggucuguugaggguccuuccauugggauacugcuggcucuagcugauugaaguacagaacauaaaagucuuacaacaauauuuccuuaaaugcuggggaaacugccagcaguugguauugcaugaauguugugguuaaagaaaaacauuuuccuccccuaaaauaaauagaguauuaaaaacugcuccagcccauaauucuaaagcaugacgggaaaagggagggcucgacgaucauaaauaagguauaauucauagggcauguccaaucgacuugcaguguauuuuuacauggggcacauugaagguauucaggcgugaccugugaggguuuuugagcugugcaugucugugauugugaaaacagcuuugcacugaaauaacagcagcuccuggcugccuuaccugucacuggguuagacauacacacauggggauccuugcgaaaggaucuguuugacuugccuuuauuucuuucauaaaacaagaucagcagucccaccuaugcacacauuccacuuguuuggcuggguuucucaugcccagaauucucuaccaucuauaaauacgcucuuucuuuuuuuccuauuuuuuguuuguuuguuuguuuguuuuuucucccuuuccuuucuggccuuaccgaugaguuccucauuuggaaaacggacagugcaagagcagcagacgaugacucagaaugcugggaggggcugugucaaauacaggaugcccaggagaagcuagaauuggacaggugggcucucugauuuaaaguaaguacaugagaaaguuaaggccacaauucauggauagugaaaucuguauccacaauucauuuucaucaagucagaaaguuaucaaacauggaauucugcacuuuuguuauggcaucaagcuuccaaagcaacacaguaauagucauacacuucaacaaccaccaacacugugucagauguccacucuucaaguaugaaacuugugcaguagcauggcuucuaccuguggcaagaacuuaguaaucaacauuacugauaccccugucacuacugauaucuggagggccuauuucuucagaauuauucuccagagaaaacacuuucaaacucacacugaggugcaagugauguguccucacguaacagagcaaacuaaaaacucaacugaaauagaguauucauuuaguauuuauggucaggaggauggcguaaagaucacuccaucuuguggaucccauccuugcuaugccacguggaucgaaugucauguuuaaaaaguggucaagucuacucuuuaguucuucaaaagcaaggacacagcaggucauuggacacgucugccacaggccacaucaguucucccucuuucaagcuccaagucugagucauucaggccaguguucugcaaaacaaacaggcaucuguggaagagcuaguaugguguugguaucagucacauucaggguuggagaaaucugugcacuggaagcuugaguauucagggaggaaaggagagaaaaggacaaagaguagacugaagacagguuauuacacugaaaacaacuaaggaaaguaucagccaggcgggguaccuauaaucccagcacuuugcaaggccgaggagaggucaguaguuugagaacaaccuggccaacuuggugaaacuccgccucuacuaaaaauagaaaaacuagcugggugugguggugcaugccugcaaaaccagcuacuuggaaggcugaggcacaagaaucucuugaauccgggaggcacagguugcagugagcccagauagugccacugcacuccagccuggggaaaagagcgagacucuuuaggguggggaagggagggaaggggaggggaaggcauaguggaguccagguacaguggcucaugccuguaaucccagcacuuugggaggccgaggugggcggauugcuugagcccaggaguucaacacuagccugaacaacauggugaaaaacccaacucuauaaauaauacaaaaaauuagcugggugugcuggcgugugccuguagcccuaacuacccgggaggcugaggugggaggaucaccugagccaggguggucaagacugcagugagccaugauugcaccacugcacuccagcagccugggugacagacuaagacccugucucaaaaagaauuaaaauaaaauaaaaucuagucuaacaauuuuucaguugcagcaucaaguaggccuucaggcugaauguaaaugcaaacaugucacugguauuauuuuuaaauacuuaacugcauuuaaaccagaagacgacuuccaagaauauccauuggcaaacaucagcaaucuauaauaauggcacacgcaaaugcagaaaguagauuuugccucauaaaaagccauugaugccugaucgcuuacaauuaagccauauaccacaaauauucaugugcacagaguuuaaggaaaacaugaagcaaagcaagaauaugcaaaauggcagauaccgcaugaccuugauaguuagaaaaggaagaaaacggauacaagaggaggaaaagcugcuucucuugaugaaagaugaaaucacgcuccacuuguaggccacucggaaauauccaguuacuuaugcaagaaaagggcauuuauuaaaaaugcuggggauaccauguccguuaaaacauaaaauaggcaaauuucuuggagccuggugaaaagggcauuacaccacucucuuucagugugaacuuacgacagucuuucaaccuuucuggguuuggcuucuuaaucucuaaauuaauagccuuggccuagauaaucucuaagguuaugggaaacuguggccaccugagaaggcuaaaggaagcuucauuuaaucuucacacagaaggcccuugcggaucaguccuuccaaagucaucugcuggcuuccauuuagguacuguaauccauuaguuuacuaauagaaucccucuagguuguaauuaauaggaccaacuagccugggacaacuucaaguaguuuugugacggaaguaaauuaaaugcugaggugacacagagaaugaauauuguuggaaaugaaagauuuuuuuucccucccaggccaaauaagaauauacuaaucaucccacagucuccuguccccuuugccaaccucuacaugcuaauuccacccccaacacacacagauaaaaaguggcgccaccuauuagcagacacuaguacugguauuuauauauauacuucuauguauguauacacauauagacauguauuuuuaaaugucagauuaucuucccuaauauuaaugcuaaaaaauuaauuuauauucuuuuuacuuuuauaugcuauaaaauaauuuuaaaugaccacauaugcuguaaauauaagaaaauaaauaaauguuuaagaaaaacaaugguauaccaauggccugacaugguggcuuguaccuguaaucccagcacuuugugagacugaggugggaggauggcuugagcacaggaguuccagaccagccugggcaacauagggaaaccuugucucuauaaaaaauuaaaaacauuagccgaacaugguggcauugccaauagucccagcuacuugggaggcugaggccagaggauugcuugagccugggaggucaagacugcagugagcugugaucacgccacuguacucuagccugaauaacacaguaagacccuguaucaaaaaaaaaaaaaaaaaaaacuauaccaaugaaacaauuaauuaauuggcagggaauagaagugggcagaauauauaauaaaacaguauguagggcaaguucgacaaaaucauggaacacaccuucacaucugagggauuucucuucuagaaacaaggggauacgaacuccaggaugagaagucaggcaacuuacuaagcccagguaaaguuuuuuuuuugucacccaggcuggagugcaguggcaccaucuuggcucacugcaaccuccgccucccagguucaggcaguucuggugccucagccucuggauagcugugauuacaggcaccugccacuacgcccagcuaauuuuuuuuuuuuuuuuuuugagucagagucucacgcucaggcuggagugcaguagggcgaucuuggcucacugaaagcuccgccucccgggaucaggccauucuccugccucagccucccaaguagcugggacuacaggcgcccgccaccacgcccagcuauaauuuuuguauuuuuaguagagaugagguuucaccauguuggccaagcuggucucgaacuccugaccucaggugauccaccugccucggccucccaaagugcugggauuacaggcaugagccaccguacauggccaguucauguuauuuucaugugcguccucugcagcccccacaaauguuguaaaugcagagucuuauaaaaacggcuguuaagauuuccccaaauaaagcuuagcauuuggggaaaaaaaagauuggugaaugaaaaaaagaaucaacaguuuuucuauuuccaccuaccaauuggugaaauucaccuucgcuuucucaggacguacguggaagacacgaagcaauaccugguuggugcagcucucuaucuaaagaccuguacuuagucauuacuuugaaggaaccaagagaacaaguagcaaaucugaacugaaugaaaagacuucuugcugcuuuauuuaaagucgugcaauggaauauuugcaggagagcuuuugcuaccucuggauaauccuguuccagaagaacuguuaucugagaucccaggaagguuccugaaaggucuauuaaugaagacaacagaaacaaaacaaaaaagggugcagacacagacacgaucagagagaauguuaccauucugucugaacacugccaauucccuuaacggcacagaagauucaaaucguagggugggcacauauugugugacauuucaacaucaaauuaaccauccugccaguagcaucauuuaaggcaguguuagcaaaaaugcugccagcccacaaggggaugugcaucuucccucuucaaacaaugcaaguaacucuucauaagggugaucagccaacgccacgugaacuaauuugauaguuccaucaucugaugcauugcaaauuucauuacauauuuuaaaucauguuaacaugguuuguuaauguugguauucacuaaaaagccacagcacuuuaaauaaugaaugggcaugauaauuuuuacacauauuaugaaacugagacauguggauauucuaccuuuucucuucuuagaaucugucuuacauccuuuguuaagagucaucaacaaaaaauauaucaggauguuucagaaacaccacagauucagaauuuuuaaauuuuuuuauaaaaaugaacuacauacccaucagaagaaaaaaauacuucaaauuauguuaaaauauuguucuauauuagcucuaucagguaucccugggacaagaauuuaaggcuauugcuuaagacagcaaaccaaaaagagacaaaguauuuuguuaagugcucaaucuuaaauaucaaauauuuucuauugcuuuguuuaugcacacaugcauaaacaaaauuaaauuuuuuuuaacaaguuuguuuccauugcuacuuguacaacauuaggacuauuuucuucucuugccucucagcccccaacacuauucacagacacucgugacauuucuaaguggucaacucuuccagccucucuuuuggugucuauguuaaaaaugugucccucuucccaacuuacuguguugcugcuauaaaaacaaccucugaaucucagacacaaccuggggccaacagaggcuguggguggcagggauuuagagcuugggcacuucaguccguugcaaggggcuugaauccuccuccacccccuuuaguuacauagccuuguccacgucacugauucccucuaagcuccuucgguaguaacaaaaguagaaucagcaugagaaauagauaagcuacauagcacagguccuggccuauagccacugccggccuaugccagcucccuuaagugcacaggagauuaaaauaauguuaacacaaauacuaguuaaaauaauguaaaaauaaaaguuaguuuuuuaaaucucaucaucacugcucacuuccgucaucaucaacuuuaacaugagguccuugguggccuuuuuuuuuuuuuuaaccuucaccucccccaggcaucauuacaaauucauguucauuacuugaaccuuugcuauaauauugaauuugucuugauuuaaauuuugaaauguuaucauauuuuuugcaucaauuuugauuuuuuuuuuuuuuuuuuuuuuuuuuugagacagagucuugcucuguuaacccaggcuggagugcaguggcaugaucucagcuuacugcagccuccuacucccagguucaagcaauucucgugccucagcauccagaguagcugggacuacaggcacacacuaccacacacccagcuaauuuuuguguuuuuaguagagauggcauuucaccauuuuggccaggcuggucucaaacuccugaacucuggugauccguccaccuuggccucccaaaaugcuggaaucacaggcaugagccaccacaccuagccucgauuuuuuaaaauauuagauuagaauaucauuuaucuucauuacugagguuuuuagcacccccauaacuuuguccaucguccuugucccagcccagccacagcuacaaagagaaccuaaaauucucucguuugugucaacauguuugccuccgacacaucauucaagucucaguaaagacgucaucucuguucugcaacuuuaucugacuccucuucuaucuauccucaagacagaaaagccacacaucccagugcugcucaucucaccucccuuucacauucuucccaucuccauccuucuaagguaggcacccauagagccaagagaacaccuugcucauuuuugcauuugcuaugccuuaagucaguaccugacauguggggcacucaaugaacauuuaucagaggggagcacaucaaacaguauuggggcagugacugccaaagaacagacugugaucuagcgggguggugaaaccaauaguggguggugaaagcaacaguugguauugaaacugggucaucauuggcacauacacaaaaacaaaacaaaaaacacaggugggcacgguggcucaagccugcaaucccagcacuuugggaggcugaggaggauggaucaccugacguugagaguucgagaccagccugaucaacaaccuugcuaaaaauacaaaaaaaaauuccccagguaugguggcgcaugccuguaaucccagcuacucaagaggcugaggcaggagaaucgcuugauccugggaagcggagcuuggggucagcagagaucgugccauugcacugcagccugggcaacaaaagugaaauucugucucaaaaacaaacaaagaaacaaacaaacaaacaaaaacacaaaaacacaaccuaggggaaaaaaaacagcaggacacugcucagauaaaaguaucauuuuguaaaacuuuuauuucagacaaauacacacacaugcauauaauacacacacacacacacacacacacgaauauacauaaguauaaauguauuggguuuuaacagaaaaaacuuagauagugguccaaaaaaguuugagagaugcuguuuuagagcaacauagaacaucuugaucuguccaucagaauuuguccugcuacagccuacagaaaucaaggcuuccaaagucauccaaaacauugaaaguuugggaaacaauuagauuaggaguaugcccggagaccaauccucaagaaacgagaaacucuagaauacuggaagaggcuugcuggggaauuucuuggguauuaguuaauaaauaaauacugauuuuucaucaaauuaauggcauauauuucucacugaaaucaccccaucacaaaaacucaaugacaacaaaaaccagguguggugaaauccagaucugcccaaucuacaaguuggacuugguagaaauaauugaugcaaaagaaaacucaugauacaaaaagcuguaaaacuuggcauguacagaaaacagauacaugaaaucuucacuauaaaauaaaaaaaaaugguuuugguaaaaaggcuuucaauaaaagaagagcuuaacuaucuucgcacuguuuaaaaacuggaucuaaguauuuaauugacuuaauggaauucacccuguauuacacuuccaugaaaaaaauugaucaguguugauacagcacugauuaaaauguuuuauucauaaacagaguaaaaaaaaaaucuucaggauaaaaauagcagggcugaaguagcugguuuuaucucucccuacccuagacagauuuucuaacugcauaugccugucugcacaauauaacuugaacaaacccacguauugaguccuuacugucuacaagcguccauucgcauuucuaccgcuagcucauguugucuuuauaaaccaucuuaaaucaacugaauaagaaauuuuuuuuuuuuuuuugagacauagucucgcucaugcgcccaggcugaagugcuguggcgugaucuccacucacugccaccuccaccucucggguucaaacgauuuuccugccucagccucccaagcagcugggauuacaggcaccgcuaccaugcccaacuaauuucuguacuuuuaguacagacagggucucaccauauuggccaggcuauuaucaaacuccugaccuuagguaauccucccaccucagccucccaaagugcuaggauuacagaagugagcuaccacacagggcugaggaauaaauuuuuuacaaauacacauauaagauauaaauagcugcagccuggccaacaugaugaaacccgucuucacaaaaauacaaaaaauuauccaggcaugaaggcaggugccuguaaucccagcuacucgggaggcugagagaggaggaucacuuaggccaagaagguugaggcucaugaggcugcagugagccauaaucuugacaugguacuuuagccugggcaacagaguaagauucccucucaaaaauauguauauauauauauaaauagcucacuggaaaacaauagcagccauaggggaaacggaauguagaaaaacagaaaaagaucgaaagacauaaauacguauuuauuaaggcuaggcacagugguucaugccuguaaucccagcacuucgggaggccaaggcaggccgaucacauggaggucaggaauucgauaccagccuggccaacaugguaaaaccuagucucuauuaaaaacauaauaauuagccaggugugguagugcaugccuacagucccagcuacucgggaggcugaggcaagagagucccuugaaccugggagucagagguugcaaugagccaagauccgccacugcacuccagccugggcaacagaauaagacuccgucucaaaaaaaaaaaaaaaaaaagagagagagagaaaaaaguauuuauuagguccuugaugaacugugauuacauguacacacacaugcauacacacacaaacauaucuaauuaaaagaucugccaucuggucugcuggcagacugcaugauagcaaucaguaacuagcaugugaaucauaugacaguaaaaaaaaauugaaaaaaucuaaaucugaagacaggaugguucucaaauauccauuuguucaaaggguguuacgcaaucucuuuuuaugagugcggacaauccaagaaauauguccgaacuacagaucaagauaaaguuacuuuuggccugguauuaagagauucugugggauaugccuguacuucaacauaaaucauuuuauuaauucaaauuugaccugcuuccaaaaaagggaucuaacaugacuuaaagaaagaacaugcagagaacaaggugaauauaauguauuagagucacuaaaaacagaaggaaguugauaugcuaaccauugcauuaauaugaccugaaaaaagacaguguugaacuaagggcuccaacaauacauuacguuauaauuucauuccuucguggaaggaaugauggcggcuccccaaggauuuuccuuagaaucaagaguugaaggguauuucucaccugcugugauguaacuccauauguuuggggaucagauaaucaauaauaucuuugacaauaagugucuguauacccucagaaaccaguaagaugucagcaaaauucauucuaacugguagcacacgaagaagacuagcauugcuuuaguauccacuauacaccaaagguuucagcuguguccugcacaccucccaccaacagcccaaagaugugggagcuacuuuccccauuuuacagugaaaaagaaaauccaaagcccaaggagguaauguggcuggccagcaggucacuaaaaggaagggcugggauucauuccaggcugguuucuucaacuucaaaauccuguguucuuacagccccuucugcuaccucacauugcauccuucugcaaccaaacucagccaaauaugcucuucucagcuccuccccaucccaccauguugguaguggacuguggaaaauaaauuaguccuaagaaaugugaauuguuuuauuaucuuuaucuucuaguucugcagaauguauacucauucagugaaaaucacagugaaucuccuauuguaucaaauacauuucauaucuucacauuacagacuaacaugaggacccaucccuggucaggaggacuugccaaaggugaguuuaauuucuaauuuuaaaaaaaauggcuuuggaugaaaucggccuccacucuggguucaacuaagaacccaacagagccuuuagcuuggcaaugagauaaugugacaucggaagaugcaauaaacaagcuuaaguauaacgggaaagcaaaccacaguccaagaaagacucuuccggguuagggauaaaggaauccaauauauuauucuacuuuucauacauaagaaauaugccagcuccuucccagugcuuggaacaggaaggacaaaaagcagaagaaaauuguauuguuuucauuauuggguauauuucagaaccuaauucuuuugaaauauaauguuuucuuuuaagcaucuucuuaugaucuuucuuagaggaaaucugcucuggguuaauauucagaauucagccaugguaauuucauuacuugcucuuuuauauuuauagagaauuaacaaagagacaaaucauacacauagcacacacaauagccaacaagaaauguuauguucuaagaucaaaaaacagacuuauugcacucaccugccuagaaauauuaaaauaucaaaaaaaguuuaaguucccaaauuuuacagguuuucuuuuuucuuuuaaagagugagaauacuaagaaaacauuaugcaggucucaguaguugauacacaguauuuuuuuuggauccggcaaauauacuuuuuauaacuuuucucugaaagaaggaacuuucuagcucagauuacuuggacacucugacuguuuauuauucccuguuuugagcagucagaaaagauuucucucucaguacuucaaauaaauaagauauccagcugaacaaacaccauacauucucguggauuacuuuggcuucuuaaagaauauuucacuuucuuuuuucaaaauguaaaugauucaagagaucccaucauaugcaacucaaggaugcaauguuuaaagugguucaaauucuacacaaggugccaugugaagaagcauaaaaagagcuugauauuucauaggggaaauuugaauuuugcuaaauuagauacuuuauuauacauuuuuaacaugguuggcuuuauaacaugaaaacuauacuuuaguauucaaaaucaaucucaaaccuauuuucuaaaagcagcaaaguaacgggugguuauuuuuuuuagcuuccugcuuaaaaaaaaucauaacaaaacaacaacaaauccuaggauuacauauagucuagauauucuacacaggcuuugaaaugauuggcuagccuuaccaagcuuuauggcuuaaaaaaaaaaaaaguucacgcuuucuggcuaguuuuuguaacucaaauccaaauucugcaauacacauuucuugagaaagacaauuugggccaucgauuaacaagggccccuucuacuaaagcaacaugaaagcaaauacuugacuuuaggauacauuaucuaccaguuuguuuauucuuuucauaagcuuucuuauuaaaugacuaaaucuuaccucccaucagaaagcagaaaugcauauauguuuuaaaugggugcauuuggugccucucucaguccagaaagagggaagaaaaggaugacgaaaggaugcaaacagaaaaagaacgaagaaaagacaaacuuauccguaauaaaugcuauggcuucaggcaggucaagaaaaaucaucaaguccugugaguaaaucuaccacaauguagcaggguccccaaaaggcacugaaaucuaaaacaaaauucaaguuguagagugugguagcuggcccugaucaccccugccucucaggauucauaccacugugaaauccuuuccccuuuaacaacgaucagacucagugauuuccuucuaacaaaaagaauauggcaaaagcaguaagacgucacuuccgugguuacauuacaaagaacugugacuuucauuuuaccaauggauucuauuuccuucuuggcuuacaugcuucgauaaagccagcagccaugauggagaucccuacguggcaaggaaccaaacaccaggcaggaaaggaagccuucaauccacugggccauaaggaacugaguccuaccagcaagcacgugggcuugcaaguggauccuucccugcugagucuugagauuguuaccugguauaaugccuacuugacauaggugaauuucuacccuguaauaacacugcuuaucuuuaagaaacaggacaccugugauaaaaaguucccucuguaaccagaccagcugagauuuguuagaagcaagauagccgacccaaggacuucaaaaagaccucaggugucauuauaauccuauuuccaugcuaaacagcccccucaccagcgccaagacaguugacaaucaccaugacaaugaucagaagcagccauaaaaggauaaaaaggaaggcaacacucugguuccgggaaguucacugcccauuucaagagaagacaugauuauuccuccccuugauuuuaauguccagccucuucauuaaaacagcaacaacaacaaagucuauauuuuaacuuccucaccccucauuaguggagaagcugauuugugaauuugugagccaugcuccugcuucucaauuccauggccauugaauaaagccuguacugcuugacacuacuuucgguuuuguguguuggcuucaugacacccaacaggauaagaccccauucuuuuggggcaccagcuuugucgguaagaaguugaccccagcccaguggacaccuugaaugcagccugugagacucuaaagcagaugguccagcuaagcaauggcugguuccuaaucuacaaaggcuauaaaauaaugaaugugcauuguauuaaccugcuaaauauugagguaacuuguuaugcagugauagauaacuaauacauagaguuuuauuaauuucugccuuuuuugcucgucuugaggaauuuuacucccccguuaugcauuacugugcuccuuuggucagcuucagaaaaugagcugaagggaccacauacucacaggccaguauuucauugcauggauugggggcaaguaaugagagcagggccguugucccagaacuucuauuaauaauaguuucuaggccagaagcagugguucacaccuguaaucccaacacaucgggaggcugaggcaggcagaucacuugaggucaggaguucaagaccagcugggccaguauggugaaacccugucuccacuaaaaauacaaaagucagcuggauguaguggugggugccuguaaucccagcuacuugggaggcugaggcaggaggaucgauuaaacccaggagguggacguuguagaaagcagagacuaugccacugcacuucagccuggaugacacaaggagacuccaacucacauaauaauaauaaauaauaauaauaguuucuucugcuuuccuuggcugcuaaguagcuuagaacaaagucugccuuccuccaguaccccuccacugacuccccagcaacagcuguagagguuugugaaauggaauccugcaugguuucuuuauucuuucucgaguaaauguccacuuuugcauuuccuuccgccuccgacuaauuuuuguugucauuaccuuuuggaacaauggagucuaaggggaggcaugcauguaugcggauauuuaccuaaguguaguugaauaauuacacauauacuuucaccucugauaaauacagauucaauuccaucccugucacuugcuagcuaagugaucuaagacaguuuacuuagcacuucuaaacuucaguguccuugucuguaaaaggaagacaauuuucuuaaacuucugcaggauguagaaauucuacaugaugaugcaauaagcagcuuuacacagauuuacuaauuuauagcaaaugcauaagaaaaaauuuauuacaguauuaaaauauugccauuguuacuggcacaggaguaaauguacagaguuacagaucuaguuuccucuguaauuuuagaaaauccaucuguccaggguccguuccaaagcuacacagcuaacuugaacugagccagauuuuuguaagaucaaauacucugccugucugguucagaaaacaggaaauaacucaaaccuuucuaaaaaccuuacuucugaaaggcacuggacaggacagaguacagagaagcauaaauaagacauccugccaucaugaccuuccaguauaacaaagaaaagcacagggcacagcauaauacaccuaaaauaaguauauaauuggcaguggcucacaccugucaucccagcacuuugggaggccaagguagguggaucccuugaggucagaaguucauguccagccuggugaacauggcaaaacucugucucuacuaaaaauauaaaaguuugccggggguaguagcacaugccuguaaucccagccacugaggaggcugagacuggagaauggcuugaacuugggaggcggaggcugcagugagccgagaaaaugccacugcauuccagccugggagacaggagauuccaccucaaaaaaaaaaaaaaaaaaaaaaaaguauacacuugguacuauacucgauguucaccaaauaguaagaaaaacauaucauaaguaauuuuuauaagguaauaaugaacaauuauaauauuaauuauaauaucaauaauaggaguaguaaaaucaucacaauaaucuaacacuugcuggcauuuacggaguuccugggaugugacagaaaugcuuccaagucuuuccaggccuuccugauuuuaguccuugcaacaaccgccugaggcaggcaacaucucgugucaaagcaaaggcagacaaggaccugagacuucaggauguugaccaaggccauggagaaaguaaguggcaaaauucgaccuuuaaacccaagaccuccucagucaaaagcgcaugcucuuuccauacuuccucucuaagacuugaaaagagcgucacagguuacaaaauacucucuggaacauggucucaaguaugauguauguauuucuucaccauuguacauuaaacugauaguuuacuaacuaguuuuaugaaugaucccuacugauaccuuuuuaucacaccaaaggaagaaaaacacaucaauaccauuagcauuucuauuuugcgcuuagucuuuccagaucuaaaagaagcaaaauaagcccaguuaucaguccacauacagccagcuacgcauuugacuauuucagccaaauuccacagcccauuuuccaaagcacagcaaaggcuaggcucaucaaaaacguaaguaaagcuguuucucuucuuuccccccuccccugcccugccccccgccccaagacagagccuugcuccaucacccaggcuggaguacaguggcacgaucucugcucauggcaaccuccaccuccuggguucaagugauucucaugcuucagccucuagaguagcugggacuacaggaaagcuccaccacacccagauaauauuuuuguauuuuuaguagagaaggguuucaccguguuagcuaggcugguuucaaacucccggccucaagugauccagcccaccucagccuguaaaccuguuugccuauuuguuuuguuuacuaaccgaaggugaucauauuauuucuuucugugaagaugaauuagugaaaacaauuacucaaauuaaagcuccuuccugggcugaagucggagugguuugucucuucauuuccaugccuaucaucugucuucccaacauacgguccccaugaggacagggaccuuguacagcauucugucccuagcaaagcacccggcuuauguuagaugcucaauaauauuuguugaaugaaugaaugcaugcacaucaacaagaucuugugacaugauuuuuguggcccacccaucaauuuacugaggugagcgcccuucuucuagaacauauucccccuuuacucgcuaaugccccaaauccuuuguggaaauagaugggguaugguauuuacaaaaaggcacaggcugaaagaauggcuucuggauaaaaagaauccagacucuaggacagcuuauacccugauguacaccuguaucauuucuuucccuucaccccacgaggugguacguccagaaaggucugcauuucacagaugagcucaccuggcucacuacacgauuaggugagaugcagcaacaaguuuuagugcagguuuggaaccugggauccgaaacacacacagaagaacuauggagcuuaaaugguaccuguaggguuuucuaggccagucauuccaaguacaaccccaucacuuccaacaaagggaaaaacaguaacagcagcauuugagugaguucucccugaagucaaauauauuccauugaaagaacugcuccucauaggccgggugcgguggcucacgccuguaauuccagcacuuugggaggccgaggcggguggaucaugaggucaggagaucgagaccauccuggcuaacaccgugaaaccucgucucuacuaagaauacaaaaaauuagccgggugugguggcacgcgccuguaguccuagcuacucgggagucugaggcaggagaauugcuugaacccgggaggcagagguuugcagugagccgagaucgccccacugcacucuagccuggugacagagugagacuccaccucaaaaaaaaaaaaaaaagaauugcuccucaucccauaacuguauccuuccuauaauuucugacaugaaaauauccauucucuuaauaaaugaugguagguucaguuuucauccaaaauuuaugaaauacaaugucugugggcccauguuagucuccuuuuuuuauuuccuuucaaguuaaacuguucuauuaacccaagggauggcuauucuugguuaacugauucauuuuacagauaagaaaacugaggaccagagaggauaagugauuugcucagagacacacaauuaucuaaagagaacacacucuaaaauuacauuagaugaguaagacauaaagaaggaaacccaugaccacagagcccggcacggagcugggaacaugugcucagcugauuugcaaaguauuucuuuaucuugguguaaaaagaagagggagaggaguuccguuuccaaacgauucugagcaccagguuucagcccucuuuguuuuugcuaggaaaacauuaccuuacaccucacagggaaaaaucaacauguccagugaguuauacaaaaaucacuguucacagaagaaacauuccagaaacaucgucauggggcaauacaaacucuuggccucgguuuaaucacgcuggccuccaauaucuaaacugcguugcagccaaaaaucacuggaaauaaguaugaaauuggagaaaaggaaacugaaagaggggaggaucaaagaaggcaccacaaacuuaaaagaaaaaagaaaaguaauaaaagagcuacaaagaguuauaaagaggcagcacauuaccaaaaugccaacgggcacacagaagaaaaggaaaccgggaagauaaaacuaggggaauugcaaaucuugguuaaauguucauuaaauaauuuguuacacauacuaaggccagauagucacuuucuccccuucucgggugcucauucaggaacaaaggccgaggcggauuuaaaacacuauaaagcaaggcagaaaaaauacauugaugaggugcuccagccucacaaaggcagaucuaguuucccucucuuuguuuuuaacaagaaaguggccaauguuuccuccaagcuaagguguguucuuggugccaguaaaacaggcaacuggagggcuuaaaaucugcacuguggaagccugcugaguucugaugagcauuguguaaucugucuuagugguuccugaggcuugcacauauaguuuuggguuuuuuuuuguuuuuuuguuuuucagucucacucugucacccaggcuggagugcagugaugcgaugucagcucacugcaaccuccaccucccagguucaugugauuuucaugucucagccucccaaguagcugggacaauagacacgagucaccacacacagccuuuuuuuuuuuuuuuuuuuuuugagauggagucucgcucugucacgcaggcuggagugcaguggugcgaucuuggcucacugcaaccuccaccucccggguucacgccauucuccugccuuagccuccugaguagcugggacuacaggcacccacgaccgcgccccaccaccacgccuggcuaauuuuuuuguauuuuugguagagacaggguuucaccauguuagcuaggauggucucaaucuccugaccucgugauucgcccggcucggccucccaaagugcugggauuacaggcaugagccaccaugaccagccagccaauuuuuuuguaucuuuuuaguagagacagaauuucgcaauguugaccaggcuggucucgaacucccaaccucaggugauucauccgccucagccucccaaagugcugggauuucagguaugagccacugugccuggcccauaugagguuuuuauguucaauguuaacagggagaauuaggccuucuaugacagacacagugccaucauuacgagaauggguaucuauaaacaaugggaagagaagcaaucaauuuaucguaaaauaagccaggcgcagaaagacaaauacucuaugaucucacuuuuuguguggaauuuaaagcagucaaacucacagaagcagagaguagagggcaguucccaggaggggcugguaguggggaagugggagggggugauaaauggggagauaguggucaaaggauccuaaguuucaguuagacagaaugaauacauucuggagaucuauuguacagcauggugaauacaguuaacgauaguaauaauaauaacguauuauauacuugaaaauugcugagacuagacuuucaauguucuugccacacacaaaaaaugauagcuauguaaguugaccgauguguuaauuagcuugauugugguagucauuucacaaugcauaugaauaucaaaacaucacauuucacaccacgaauacauauaauuuuuuuuuuccuuuagagauagggucucacuaugucacccaggauggagugcaggggcaccaucauagcucacugcagccuccaacucccaggcucaagucauccucccagcuuggccuccucaacuguuaggauuauaggcaagagccaccaugcccagccacacacacacacacacacacacacacacacucaugcgcauauaugaaauuuuugucacucauaccucaguaaagcuggggaaaauaauguuaauaaugacagcaauaaugguuauugaguaucuaguauauucugaaugcugaacauucauaaucuuuaauuucuacugcaagccaauaacaauaguaguuaacauuucuuaagcaucuagcacacuguagaggccuuaaguucauaacgucuuuaauucucaagacaagcccaugagguaguucuaacaucucaguuuuaugcaugaaucuuaaucagguuuugaaccuugcccaagaguuagaaugggagagagcuagggcuggacccgagagcugucuaccucuaaagcucauccugucucuccugugccucaccucucucuccuuacauucauucccuccaaacauacccacaccgcuggauacgucccuuacaugucauuugaccaugagccugggggaccuugggggcuugcugugugacucucagcaggucuccuugccuuaucuuuuacguauuuacacauucuaaacuauaaucccuugccuaccucagagggauaaaugauaagaaguacauuaaggacucucacugauucagcaccuggucaucuuucauguauucauuuacaaacauuuacagaacauuuacgguauggaccagggauacaguagugugaaggcaaaaacaccacugucaagagaaggggggacagacauuaaauaagaaacuacaggcugggugcaguggcucacaucuguaaucccagcacuuugggaggcugaggcagguuugagacgagcuuggccaacauguugaaaucccgucucuacuaaaaauacaaacaucagccgugcgugguggugcacaccuguaaucucagcuacucaggaggcugacacaggagaaucgcuugaaccugggaggcggaggcugcagugagccaagauugcaccacugcauuccagccuaggugacagagcaagacuucaucucaaaaaaaagaaaagaaaagaaaaaagaaaaagaaacuacaggccaggcacaguggcucaugccuggaaucccaccacacuuuggaaggccaaggcagguggaucaccugaggucaggaguuugagaccagccuggccaacauguugaaaccccgcuucuacuaaaaauauauaaauuagcuggguuugguggccagugcuuguaaucccagcuacuugggaggcugaggcaggagaauugcuugaacuggggaggcgcggagguugcagugagccgggauugugccacuacacuccaauccgggcaacggagagacacuccgucucaaaaaaaaagaaaaaaaaaaaacuacagaaauuauguuuucaaacugcaguuguguucaauguuaugaagaagaaauuccagggacucuucauuuacucauucaacacauaaggagugcuacuacgagucaggcaguauucuaggcacuggcuguucugaaagaacauauuggagagcuucauauaaucugagagaccaaaacugcuuccuugacgugugcuguucagacugaguuuugcaggauggguagaaauuaagaguggaggaggaguauucuaggcugaagaacauguuucaaaacccuaaggaaagaaagagcauggagccagaaguggcuugagguauggugggucaaguggauggggaccggggaagacuagaugccuuucauuucaauucucacuucuucucacaacgauccuauaaaaucgauagcauuuccauuugauuaaugagaaaacuauuaaaauauguacauacguauucaacagugccugugucaacaccauuacccuauccuuuuuccucaaaaucagaguucgccugccacucuagaggcucaaaaagccaguuaugcacuuuucuagucuccuuuauaacuaggauacaaacagaugacucagucccaaccagugggaucugacgggaagucaacucaggaggacaguucugaagcagaaugcucugucucuugauaaaggaaaaaggcaugcaaugaggagccucaucccucccaucugugccuucagaccuuaucaaauaggaugcaauggcuggcaccacagaagccaucuuguaagcaugagggaaaaguaaagauuaucacaaaggagcuacucauauaguagccaaacacaacccuugcugccucagcaacucuggauacaugggaagcaaaaccucuauuauuucagccaccuuuaaguggguguuaauaacuugcggccuaaagcagcuaaacugauguagaaaauuaaccucagaaaugucaaaugauuucaaaauuauguaacuaaaagggaguagaggcugcaguuugaauacaacccucaugauucuaaauccuuugcccuuuuccaacuuacuuacauccauuggucacuggacuaagcaagcacuguaaacuuaaaagcuuuggacauaaugacguaagacuacuaaaaccaaugguaauguuaauccagggcaggaagaaguauguuucuuccugcaagaagguggccucagugguguaagaggacaagccagcuaccagguccuucuguugacagacaacugcaggaaagcgccagugugguccaaccacagagggguccugagaguccaguuuucuaacauaucuggacuggcaagagaaaggcaaccagaaaauucaaaccucacucaggagucucaaaauguuuagauucaugaagaauacaaugaaauuuccacuuugaaaaccauauuucccccucgcaacagaaagccuguuuuauacacccucugccuuguaugugauacaccaauguaccaauacacauucaaacagggggcuuugcccuugauaguaucuauaguguagucagcugcagguauuuaaagauggaaagggggagaaguauuuuucuaaaauacuaauuucaggaacaaaucaacaucuauuaucuccuucauuacguuuuaaauuguacaacuauaaaucacccugcagcggguuauucaagggcagaauuaccccguuuggcuuucacgaagguuagaagaaugacaucuugugcuuuuucuaguuauaauuuauaacuuugcaacaggaccagcauugccggcccauccauuagcaggguagcugcacauccguuaaaacucagcacgaugacuggcuuuacacgggcacaggaaacguaacccgaucgucgcagaaguuccauaaacguaagccauuuuuuaauguaaaaugauuugaaaaugcaguucccuaaaacaucugcuaagcucuugcuacccuaacacaugauauucuuucuacuguuaucugccaacacaaauaugugguugcacaaaacacuccuaagaggcaagugacagugcucaacuucaaaucugcauacugguccacaaaggaccggcuuggaccugggaacucuggcaaggauguauuuaccagaaaugaaagcuuauguggaaaaaaaaaaggugggguuggcggugguggcagcauucauuucagugaaggugcugucaaacauuuuaaaaaggaagcauaacugcauaacuagauauggaugccaggggcauuaccgugcauuggacaaagcaaaugcagcugcaauuagcaagugaaaguuuacaaggcugguauaucauuuucuugaacacgcugcaugagguuucugugcuuuucaauuacaaaauaaagauaauaauucuaagauuguagaacuuggaauuauuaauucuaacagaaauuaugagaaauuaaugaaaauauaugcugauacauaaagcaucgugguaucugggaaaauggucaaucugcaucucuauuuggaagugugguaggauucuaaagucaucacacaugguuacaacugcaaaaacccaagauuagccuugaaaaucccuuaugugcaccagauacaacaccugguuuugugaauuaaaacccauagacuaauauguauauauaaauauagauacuaaaauacaauacauuuuuucaccaacucgaaaguucuuaccaaacaauacacauuaaugcgugcaggugcaaaacauuuuagaguaauuuaacugcauaaaagaaugcucuagagucaagaaaauaaacauguaaugcacguaugaugugacuucauuauuagaaaguacucagcaaauguuaguuuccuuuaacauauuuuagaagcagcuauuugaaguauauugcaucuuuuuuagaacgacacuuaaaaauaacucacuuuccaaguuuaucugugauuuuuauuucaccauaaauugaagggaggaagaaacaaacacuucccucccaggacgccccaauacacuuguccaguucucuggaucugaagaagaagagggaggcagagacauggcuuuaccaguaggggccgcugugcugagaauugauuccugugaguuucucauuagugauuauuauauugcaggcagccaaaauggaaaaauuaauuaauuucaaagugauaaugcauuuacagcaacaauuagaaauguguaacuguaaaagggcaacauuuaaaagacagaucacauuuaauaaaguugcacaagaacauccaauuguaaaauuacugaucugcaacaauauuccuuaaagaggcacuuaaaauagcccgacuccaugaagagugaccuaauuacuguaacuaaaaucaccguagucacagcaagucacagcaaauaaaaaagggacguugauauuagaauacugcuguuuaauacuuaagggagccagcuacagagaagaaaugaaggcagggcuuccgagcgcaagucuggguuguauuucuugcuccccugaccucaugcaacagaauguguacuccagcaauacccgugucagaaggaagcacccucucuaagguaaaaggcagacaaggcagagcacacuagccaucuggugauagggacauugcaucuaugcuaagcuucucaaucacaauuagaaacccagccuuuaccuacggaagaaaugggaugcaacugcguggcuuauauccaaaaauaugucugcauucaaauagcagaaaugcacccuuuguccaagaaacugaugcauuauccugacggaagcaaugccgagccacauacgcaggauagcccaagagggugacuuuuccagucagucuggucuaucuuacuaggaaaaugaccaacccgaggucuacauucacagugauuccucuccuaaauacagaguccuaaauguuuaugaaagaaaagugaaugccugugaauuugacaagcaagcucagagcgccaauuccaccucugcaugaagugacguauuacuuucaauggcaaaaaccucaauaacuucuguaucaaccuaauauagagaacgcugauggcuaaaaaaguacuaccaaacgcuuaaauauauaaauacacuagagaggauuuuaguaagacucuuagcuacauauuccacagucuucgucaucuucaugcuuaucuaaaguccauuugugacauauaaaagcugcuauuuucuaaucacucaaggucagaaacaagaaaaguccacacccuacggcuuccucacaaaugagacgugcagguuggagaucacugaaccagggucccuucaccuggacgcccuuucuaccuggccaguaaaccucucccugagucuuuggggccagggacaaagcccuucucuucccuuuccagacucccaauuugcagacucuuguucugucagcagagauuacauuuuggagaaucaucaucgggaccaaggcacugcucacaacgacaagaguaacagccaucguggcaggaaguacugcauaccucccaugcgaaaggcacugagcuaggcaugucauuugaccacgcucuccaguauggcagccacuuggcacacgugguguuuuucaguucgaauuaacaaacauggaaucaaauugaaaauucacuuccucaguucuauuagccacauuuuuagaacucaauagccacauguggcccacgacuaccauacuggagagccagauuauaauaacugcagaaauucuauauccaucauuauugauguuauaugcauuauugucgguccuuacacuaaccuguaucacaauuuucaucguaaugagacaggcucagaaagcuggugacaugucuaaguuguuccaguggucaaggguaagagcugagcuuagccaucagcaccauuagcaggagagcugugagguccacugucccagguugccacuuucuugucuugccaccaccaggaagucaugucaaaucccaucucaacuacaagggaaaugcucacguccagugcccuuucuaugagugccccuccacagacaacuucaacaaaaccugggauuuuugcgaugucaccacuuuucuccaaacccucucaugagcuacacacucauuuucccacagcuuucucacucagggaucuaaagcucagugcgcaguuaaucuuuuacccaaggcugcucccagaggacauuuguuucucccaagccuugccuugcuauaggcauugaggccuguucacaaguagucucugagcucuccugccagggaaauaggagagacugcaguagggugcggcagaggcugcugcacacuggugggguaggcaaaggaguuaggcauggagguugggcaucugcuauuacuaagacacacuacagguacggugcucacugaguugcaaccuucguccaauucauugugcauccuccccgacaugguagucccucugccuccauuucuaaccccauacucugguuuuccacucagcccaaguccugagcacacguacucccaaaacagcuaacacuccgauaucaugauacagucaccgauccaacuuaauuugcugguauuuuuuagagauacucccguuagguccaaccagccaacuuucaagucugacuuuauuaagcauauuauauuaaauauuagauaauaaucaacucuucuccaauaaauaaaaauguuuacccugacuuuauauuuuagcagaacuugccuuccuucuuuucccacaugcccuggcacagagucccuaagcaaugggaucaggccacagaauaacaguuuccacuauuuucuaucaaugacuccucauccauucgagucuacaacaaauggcaggaugguuauaucaccccucaccaaauuccauagucacagacucaucucuaaagcuuucccaucccguuccucugauuagggaccuuauggaagaaggagaaaacgaacucucugaugccacugaaccgagcuccuuaaaacacaucaaugaucaaauacaagugagaugacucaagacccaaagauuacaaaugaugguugacugggcuuguuaaagcggaaggcacugggccagcagaaaauaaggaagaauccaccucucuccucuccccauuccuaaaugccucauuuaaauggcacuggcacccaguucagauccauauuccuucuuuucauguaaacugaaggacacaacaaaguaugaggcauaaccauggucaaagaaacuuucaugaagaggcugcgcuuaugcagucaucgggagcaaagugauggggagauuucaaaacccugugauccaccuacagguaaguuucauucauuuacuuccuagagaucaaucccacccugcggcauggaacaccauucuccguagguccuuucacuucacugccacugauccuaaguauucgacucuuggaauaugucuguuuacucugccuaaaaaccacuugggugauuagaauaaaagauauacuuacuuaccuccuccuaagcacuucaaaagacuuuugaugugguuuuaaaagucauccccaggccgggcgcgguggcucacgccuguaaucccagcacuuugggaggccgaggcgggcggaucacgaggucaggagauugagaccaucccggcuaaaacggugaaaccccgucucuacuaaaaauacaaaaaauuagccgggcauaguggugggcgccuguagucccagcuacuugggaggcugaggcaggagaauggcgugaacccgggaggcggagcuugcagugagccgagaucccgccacugcacuccagccugggcgacagagcgagacuccgucucaaaaaaaaaaaaaaaaaaaaaaaaaaaaaagucauccccaaauacgaagguuaaggguggcaggugggaaugaguguaagagaaggcagcagacaguuuccaaggucgugagaucagcuggaggauaauaggccugcaauaguucuucuuuuguuguuguuuugcuuuguuuuauuaauauccuagguccaacugugaaggccugugauaucgcuaaaaggcaaauguguuugggaaaagggugauuucugucaaguagauuuuaaguuuggguaacuggaauacugguguccacuaauaggaagacauuuuugaaguccuuugguuuugaaaaauaaucuaccaaauauauuguggaaaauacgcuuucuucauucaaaauacuuccuacuaaaaccauuucauagaagaagguucuuaauauggucgauaaaugaacaccaaacuauaaaaacaucuuaucaccuuuguaaacacuuccaaauguaaccacaguaccaugauucauccaaaauugucuuugggaaaguaaagaagaaaacacacuccuagcuaucaaaggacucuccaacagaggauuauacccauuagaagaaaaaaauuuagaacaaaagauacaguuuuucugugaaacaaaggaaucacaucugcugaaaauucaguagucaccaauguuuguuguuuaccuacugacacaaaacagcaguuuucaagugcuccauucaacaaaauagauuuucaaaguuucugaauaaaaaaccccaaaaaaaacaaaaccaaacaaacaaaaaaaucaccauuuccauaaggacuuucagccauacuuaacaugauacugaaacccacaucuucuacccagcccuccaagacgcauuuacccaaacagacuuaaccuaaaguugaugaaaauguguucaagagcccuuuaugaugggcuggacaauguuauuacugagaccagacucaugcccgcaagagguaaaaagguggagacacaagugugcagguuucucuaggacccaagguguuugcggcgccagaagcuguucucuuaccauggacuuggugaaaggccucgccaagguaaacagcaguguguacacccaccagcugcgaugaauguuggaguacaucauauuuccaggaugcacugcguucgacgugaccccgcguggggagaggcgacggugcagcucguuggagaagaggauguugcagagcuuggaccuguuauaagccagcaucgcccaauagucguuuuuuguuggagagaggcgacugaaguccaguuuucccaaggagucguuaauaucuguaaaucuuaaaaauaggaaauaugacaugaagcaaccaaguucugacuucccacacagcuuuuuauuuuuauuggaaaucuaaggaaugcugggugcaguggcucacaucuguaauccgagcacuuugggagucuuagacgaguggaucaccugaggucgggaguucaagaccagccuggccaacauggcaaaaugccaucucuacuaaaaauacaaaaauuagccaggugugguggcaugccuguacacgggaaucugaagcaagagaaucacugaaacaugggaggcagagguugcagugagcaaagauugugccacugcacuccagccugggugacagagcuagacucggucucaaaaaaaaaaaaaagcaaucugaggaaacuauguagagaugaguaaaaacucaaucuuacauacaucaaaacaaagucuccuuucaagauugacaauggugauuuaacaauauaaacacaggucaugucugguggcucaugccucuaaucccagcacuuuaggaagcugaggcgggaggauugcuugaguguaggaguucaagaccagcuuaggcaacauagggagacaccaugucuacaaaaaauaaacaauuaguugaguauuuuggcacaugccuguggucccagcuacuuggggggcugaggcaggaggaucgcuucagccugggaggucaacguugcagugagcuaugauugugccacugaacucuagccugggcaacagagugagacccccauaucuaaaaguaagaauuuaaaauuuaaaaauuaaaaaaaaaaaaaggauuggcuacaaagagagacuucaauaaagacccacacucauaaauguagcaguccugacauacugaacucucuccccacccucuaacauauauuuuucaaaaccuucaacaggaaguucaaagauaauuaaauuaaacagaaaagugucuugaauaaagggcugcugcuuuuggaaacagaaagauaucacauuccuaaccuuugacagggcuuuccuggauuauuuuagcuaaugcuugaguccuguauauuuucauuugagcauccaagaaauuauagaugagucuuguugucuccaagacucuuuucuagauuaaaaauuaaugauuauaaagggguuauaaccuuggugagguaccaucaauagucuuauacguuuaaaagaaaaauguaaacaaagccaagaugaguucuggcaaaaucuaauguuuuuaaguauacccauggcauggauguacacaaaucaacguaacuaguugaugcuuuauaauugggucugacggagucguuaaacaccagcuguuuguuucuuuccguuugucucuuucucuuaaauaacaacauuauagugacuucccuuacaaaauggaucacagcaaacaaaaggaauuuucuaaacagucucauguuugucaaaggaccccucauauucugcuucuauaaguucauucugggcaccggguaaugaagaagcauaaugggaauccucuagauaacugcuauggaaaacaaaaagcaaaagguaaaaugaaaauuauggaauuauccuauuauuccuuaauaucagcagcucagguugggcuaagaccaagaaaagcauggcaagggcagaaugaaauucauguuuuaauggaaauuaaauaucccuuccacaggacucggugacauccaauuucuaguguuaaaugacauagcugcucuaaagucaucaacaaagcugauggccagaaacgucaucaaggauacagaaaugagaccuugaaacgaauuguuggcugccuuuuuucuaguacccaaaccacaggaagagucugacuuccaagcuuaauugucuaaggcaauggaacucagcaggcaauuugaaaauauaugacggccuucuucugguugucgugaugacugcuggugaugguagcagggauggcagaugucuugcaaugcacaugauguauugcucaaugaagaaugccccaguggacacucauggagaugaaaagccuguggauaauuaucugagccuagaaacauccacugaauuuccagguggguagugcaacaacuauuuacauguagaaugaauaaaagcacuuucagauuuugugugauuuuuggagggugacugauacgguucggcuguguccccacccaaaucucacacugaauuguaauaacccccaugugucaagggcagagccagguggagauaagugaaucaugggggugcuuucucccauacuguucucaugguagugaauaagucucacgaaaucugaugguuuuauaaaugagaauuccccugcacauacucuguugccugaugucauguaagacaucccuuugcccuuccuucaucuuccgccaugauugugaggccuccccagccauguguaacugugagcccauuaaaccuguuuccuuuauaaauuacccggucucggguaugucuuucuuagcagcaugagaacagacuaauauagucaggcuucacucaagguugguggugcuggagucugcaauaccacacaccugguaauggugggcuuuuuuaugagaguccauucaaggugauucauccacggauacauacauccccaucuuuccuguagccuggcccaagcauuuacauguugaaacacacgccauuuuguuucaguuauuuuuucuuucauuacaguaaagcuaucauaucgaauugaaaauauauuugugcauguaaguuauguuauuugcuaacuuuauuucaacauaauaagguauuacagaagaggugucacacaaaggugcuacugaguugagaauccaaugauccaagguaugggacaugacuugaaaacucuaccuacauggcauagacaacagggacaaggauuuagagaguaucugaaagguauggaauaaauauagcaccacccccucccucucucuacucaucuuuugucaacugcuuccagaaacccuucuuggcauauuuguuuagcccaacccaguucagggacuacuucuuccaggaagcucuccauaaugaacucuuccacagcuggauaucauggugauuuuuuggguggaagucagggagagaaugaaagaagccaugcaaggcagauaaaaaugcaugccuccauggacauuaaguauccacucuucaggacccaggccaugacaccauuccuaguguucacugacauuacuggccuuccaagauuggugaaaaggcucacugugccauccuucuguucuaucuguacauugcuccucugucaucaccauaccagacuguaagucaauugaucaccugauuccaaaacuagacugugaauucuuggaaaguagacuguaagauucuugaguguugcuuacuacagugccugacacauaguaaggacucaauacagaauuagaugauuacaguuuggucauggguuuggaauuccaauccaaggaccaaguccuuaauaaaaaaaacaaaggaacacaaaucccaugaugagaauuugacaguuucccuuguuucaagcauugcucuaaagguaaaauuuaccacuagguucaacucuucuauguuuuccauuaauguuuacauguggaauuuccucauguuuagggcuuuugguuucugcuuauucuuuuagagacaaggucuugcuuuguugcccaugcuaaucucaacuccugagcucaagggauccuccugccucagcuuccugaguagcugguauuacagguauacacuaucaucauacacagugauuuucuacuguuaagaauaaggucccuguuucaguauuuaaggauaacacagaaguaugucaugacuagggaacacuaagugaauuaaaugucuaagaggagaaagucauuucuucuugaucccuaaucuagaaacaagucaaaagaaucccaugaugacaaauuagacaaaaccaggaaggacaguuucaagauggagaaguaccagcugcuacguaucaggcacucucucugcaaagagcccuucccuguaagggugaccccugauuuccuuccucacugucuccugggcagauaguccacuuuuacagucucauuagcuagcacugacaguccuccaggaaguggcaagggugggccagcuucuuaucugucugagccagaaacggcuuccugaaaaacgacuauguucaccucucagcuccagagguaguaaaacaacucuuuagaugcugcugacucuauuuucaaguugacaaacugacaaagccaaacaauuaugucuuaauagaauuuucccuuacuaguacauuaaaauauugacauuugcucuguggacaguaacacuugcuuuguagggggacccccgccccucacaaaucuuguauuucuauauauacuguggggguuuugcuuuuuggguuuuuguuuucugaaacagggucuugcucugucacccaggcuggagugcacuggugcaaucuccacucacugcaaucuccaccucccaaguucaagcaauucuccugccucagccucccaaauagcugggauuacaggcgugcaccaccacaccuggcuaauuuuuguauuuuuaguagagaugggguuucgccaugcuggcuaggcugaucucgaacucuugagugcugggauuacaggcgugagacacugugccuggccuauacugcauuuuuuuuaaacaauuuuuaauuuuuauuuuagagauggggucucacucugucacccaggcuggaaugcaguggcaugaucaacgcuuaccgcaaccucaaacuccugggcucaagccauccucccaccucagccucuuacuagauaggauuacaggcaugugcuaccaagcccaauuuuauugaggauuuuuaaaauucccgccuaaaauaauuaggcuggauucugucuacacagaagcugagaaacuccgugugugugugugugcgugcgugcguguaugugugauuuuguguguggggugggggagggcaauuuggcacuccaugcagcugcagccauugaggguuguucaaccagcacucugcucuuuucauucuacuuuaauuguuaucugaaauuuuuucacagcaaagaagucaacuucucauuucacuaugauguauuuuagguaugcagaaacucaauucaguugcucagauuccagauaaguaacuaaaacacagugaagacacaggaaggcuaauaaauauuuugccuuggagcagucuaguauaauauuuucugcaaacauaggacuuucuuuuuuccccuaacagggggucuuaacuccaacgaagagauucugccaagguugauggagguaauuagauaucagcacuugcauuuuacagcaugguuuagggcccugaguucuuggguagugagcaacugucuucacguaccaccuacgcaccaagucaccacgcucacucaugggagccaagggaugcaaugcgaagguaauacacaagccagccuggggaaauugccauuuuguuaaaacacccuuaaauaaugugcaaagaggccgggcgugguggcucacgccuguaaucacagcacugugagaagccaaggcaggcggaucacaaggucaagagaucgagaccauccuggccaacauggugaaaccccgucucuacuaaaaauacaaaaauuagccaggugugguggcaagcgccuguggucccagcuacuuggaaggcugaggcaggagaaucgcuuaacccugggagucugaaguuguggugagccgagaucaugccacugcacugcagccugguaacagaucaagacuccaugucaaauaauaauaacaguaauaauaaauaacgaugugcaaagaauaauuggaaagcauaaaaccagugccagccaucacacaggagcaagccugacaacacauuucaggaaggccucccuauaaacuaacauaggucuaauucaagagcccaagucccuuccuuucaaacuaaucuuuuaaaugaugcugagauuuggaucucugaaguaggcaugaauuacaccguaguuaagcaaagaacaaagacgucacacgaaauaccauuugagauacagauuuacaaggagagugagcagcugacaauucgacauaaucucccauuaaauaccagcucauuuaaacauaucccguggugcccuccacaucugguggaugacuggggcuggcagauuuauuucuggagcucucucugcugccugcccccacaguagccucccucgccccuuaacagggccacuccacuuuccuucacaaaccuggugugauuugcaaagauaaggcuguccagauuuuguuaccaccuaauuacuagauguuucaugucuuuuaacacgggggaggauuauuacuggcauuuaccuuucauuucagccaucauaaauuuaaaauggcaaaaguaaaucuaucugcagugugucacuuauaccauaagccccuguguuugggagugauaaaggguucaagcuaacccuuggcuggucucucucuuccaagucccagggguuacauuuuauggaaguaugauuaaaaaaauaagcuucauucugggucacuaaaacauuucaggacuuaagacggagaagaaggaggaaaaaauaggccccuugcacguuauuuuuuuuucuagcuacuuugcuaagaguguaaguuccccccgccaaacacacaccaagcaaacgugaaagagaaaucucccuaacauguauuaaauccagccucacccagcaaggccuuugucuuuucagaguacuucucucuagacaaauaguuguuucuccaacucuagaaacaaauaugcugaaaauacgaggaaauuuucaaauguccuuuucagucaauugaauauucuccuaauggcaauaggaaaaaagugccaucugauguuuuaauugaaauuuuaaccaaaagaggcacggccagauuucuaauaugcucuaacuacaguucuucccuuuccacaauuacacagcuaaugucugccucgaauucccuaauuucucauuauaaaacaauuugauuucaucucgcaggcucuaauugcauuguuucuccugcuagaauaacugcacauucuucuugguaagauguugaaguuguugaauuacaaaucaauaaaggucaugccauucagauuucaucaauuauuauuccaucucuaagcaaaaucaaugaggagcuugaaguauagucguaaaaacaaucuuccuugcucuagaaaguccuucuaaacagucccccacaaucacaggcgaacaaaaaagaccuggaaaaauuaagugagccaagcugaguccacccacaugucucaagcaggacuaaugaaaauuauuuucagaaugagagccuugggggaauauuagcugguaugagaaaggggauaagugaacaaauaugcaauucaaacccaccgaugggacucugaggagaccacaaugacacgggcaggagcugagcggcacaaaacauccuggaggagcuggacaagguagaagugccccagaugauucacuugaaagguggucuccaggccaucuuuggugagacuccaggguagagcaaaaguugcugcguugcacacaagcacaugaagaggccugaaaaauaaaauaucccaugugauguggacauaaacacuacaaccaaggauaauccaugcuccuucgggaauccacgugauguggacauaaacacuacaaccaaggauaauccaugcuccuucgggaaugagaaauucuuucuccgucuucuagauucccaccauguagaaauaggauacccuagaaugucacaaggcuuugagugggcaacuguccuccguugcugaggaugagaggcuuauuaggauacggaacuuucagugugaaaaccaggacagcagcaggcaaucugcgaagaguugucacccuaguuggaacucagguucaaccaccugauuaauucuuucuuaauucauccaagucucacuuugucuguaaaucaaaauagcccuuaaaguaguuaugacuaauaaaggaaaaauuaugcuguuaaaaaggcugacacagggccaggcgcgggggcucacgccuguaaucccagcacuuugggaggccaaggcagguggaccauuuuaggucaggaguuugagaccagccugaccaacauggugaaaccccaucucugucaaaacacaaaaaaaauuagccagguguggugguauaugucuguaaucccaguuacucaggaggcugaggccggagaaucacuugaacccaggaggcagagguugcagugagcuaagaucaugccacugcacuccagccugaccaacagagcaagacucuaucuccaaaaaaaaaaaaaacaaaaaaaaaaaagaaaagaaaagaaaagaaaaacaaagaaaaagaaaaaacaaaacaacugacacaggacccagcacuugcuagcuguuaauaaaacauagcaaggggguaaucgcucuguguaaagagaagggcacauguuguuuaaggauacagaauuucuuauagagaucagauuaaaugaacauuuuauaaagaagccuaaagauagguaaguggaagccugucauaguauucucccuuauuuuguauauauuuaauuuuuuuuuuuuuuuugacaagaucuuucucugucauccaggcuggagugcagugguguggucauaacucacugcagucucaaacucccaggcucagacgauccuuccaccuuagccucccgaguaacugggacuacaggggcacaccaccaugcauggcuauuuuauuucuuauuuuuuauuuuuguagagaugggcucccccuauguugcccaagguggucaagguggucuugaguuccuggucucaagcaauccuucugccuaggccucacaaacguaacaaaauuguuaacaauacaaguaaggcuuucacgugaaucaaaaagcuaaauucucagaaaguaauuguauacuugugaaaaaucauacuguaccaauaagaacuauacaacaaaauaaauauauacaaggcuauccacgguguuugugacaaacuaaagcagcaaauauaaaguaaacuaaauauaccauugaggaauuauuacauuuagaauauauccauaugauagaauacuaugcagccauuaaaaucauaaacaaaucuaccgaccuuauaaaacauuuauguuauaaaauaaaauuuaauguauuuuauuaucagacacagacacacacagaaacagagaaagagaaagaaagagauagaaagguuauggaagauauauaaaaauaagggcaggcauggcggcucacgccuguaaucucagcacuuugggaggcugaggcaggcaaaucacgaggucagaaguucaagaccagccugaccaacauggugaaacccccaucucuacuaaaaauacaaaaguuagcccagcgugguggcacacgccuguaaucccagcuacuugggaggcuaaggcaggagaaucacuugaacccaggaggcagagguuguagugagcagagaucaugucacugcaccccagccugggcaacagagagacacuccaucuaaaagaaaaaaaaaauauauguguguguguguguguguguguguguguguguguguguguauauguauauauauauauguguguguauauauauguguguguauauauauguguguguguauauauauauguguguauauauauguguauauauguguauauauauguguguguauauauauauguguguguguauauauauauguguguguguguguguauauauauauauauauauauacauguaaaaaaaacaggaggcugggcacaguggcucaccucugaaauuccagcacuuugggaggcuaaggcaggauaaucacuugagcccaguauucaaaaccagccugagcaacacagcaagaccccaucucaacaacaaccacccgaaagugagccagguguggugguguguggcuguagucccagcuacuucggaggcugagauaggaggauuacuugagcccaggaguucaagggcugcaaugagcuaugaucauaccacuacaggcaucagagcaagacucuguuuccaaaucaaaaaaaagacacuuuucacaucgcagccuaagacguacaaguuuuuaaaaaacaaacauuggcaugcaauaaagggaaacauaaaaaucuuuauagaaauuaaaaucuucugcucucuaaaacaguggaacaaaagugacgaauauaugcaaucauauagaagccccauauuuuuaguauauaaagaguucuuacaaaucuaugagacaaacacguaucuucuuaagagucuaacagaaacaguggcagacauuagaaauuuuauaaagguagauuacaaauaaccauugcaauauuuaacacguccaacuacacuaguaguaaauauuaaaauauuuucuaucaaauuagcauauuuauucauacuauuauauuuguauuaucuuguauaaaguuggugggaauauauauuccugcacccuggauauuaaguugaaaacauguaucaugagaauugaaagauucacauuauuucaccaaguaauccuguuuccaagcaauaaagcauguauguagcaggggcagcaaaaauugcacaguuaauaucaugagggagaaguauuuuaucauugauaauguuuagaauugucagcacaugacuguaaaaagcagaucaaguuuuagccagcuuuacuguuguuuuuccauucuauauaaaaugcuuccccauuuuaccugcaucuggggcagaccauucccauagcaaccucccauccuuuucauaugccacugcuuuauaguggguugaaugguaggaaucugugaguugaaugguaccucccaucccauugcuuccauagugaguugaaugguagggaucugugaaugcgaccuuauuuggaaaaagggucuucgcaaaugugauuaagucccacaucuuaaaaugagaucaucuuggauuaaggugggccuuaaauccaaugacaggccuauccuuacaaaacagaaggggagaaggaacacccacagagaaggagauggaaagacagaggcagagauuagacugacuaagauaaaagccaagaaauuccaaggguggcuggcagucaugggaagcuaggagaaaggcauggaacagaugcuccuuccagccuccagaaggagccaacgcugcaaaccacuugauuucagauguuuggucucugaaacuguaagagaguaaaauucuguuguuuugaggcacuccaucugugguaauuuguuauaauagcuuuagaaaacuaauauagcuuccaagauuauuuccuaauauucaaaauucauauaaacguuuaugcccaagaauccauaaugacaugucaacuaaaauuauaaaauuacauaugaacuagaagcaaucuaacauccaacaacagagaaguggauaaauaaugauuaagccagagguucccaaacuuucucaauuuaauugaaaaagcaggaaauuaaaauuaauaugugugauucauaccccauaccccacgaaaagauuuccagauauacagucaggauuacuuuuuuuccuauuuccuguuuaugguuuuugguauuuuccaacuuuucuacaauaagcauuagcuaauuuauuaaagaacuuuacugaaauauaaugcacauaccauaaaaucuaccuauguauacuguacagcuguuuuaguauacucaaauaauuguacaaccauaacuacauucuaauuuuauagcacuuuuuuaacucaaaaaaaaaaaaaaaaauuagcaaucacuagccacccucuaucuaccuacacucuuauucccaaaacaccaucaguguacuuucuguccuauagauucgccuauuccggacauuuuauauacuaaauggaaccauacaauacguagucuuuugugacuggcuucugucccuuggcaugauguuugcaggguucauccauguuguagcauauaucaguaauccauuucuuuuuaaugggcaaauaauauuccauuauaugaauauaccacgcuuuguuuauccauucaccaaugauggauauuuggauuguuuccauuuauuggcuauuaggaauaucacuacuauguacauucauuuguaagaugcuauggaaaugcauguuuucauuucucuucaagauacaucuaggagugggauuauugggucauaugguaauucaauguuuaacuuuuugaauaauggccaaacuguuuuccaguuuggccauacaauuuuacauuuccgccaggacuguauuugaacuuucaucucuccauguguuuguaaguauuuguuaucugacuuuuuuauuuuagccauccuagcaauaaguggaaucucauuguggcuuucauuugcauuucccuaaugagauugaacaucuuuuauguauucauuggcaauuuguguaucauauuuggaggaauaucuauuuagaucuuaugcucauuuuuuaaaugaguuuucauuauugaauuguaaaaguucuuuauucuagauacaaaucccuuauuuaauauuuaauuuguaaguauuucccccauucuguaggucaucuguacacuuucgugaugguaucauuugcagcacaaacacuuuucauucuggaucauucuggauaucuuuuuuucuuuugucacuugugcugucaggguuguauccaagaaaucauugucuaagccaaaaucagaaaaauauaccccuauguuugcuucuaagaguuguauaguuuuagcucuuacauuuaagucucugacccuuuuuuuuuuuuuuuuuuuuuuuuugcuauuuuuugcuguguaguuuaugcaagugugaucuaaucucauucuuuugcauggggcuauccagugguucuagcaucacuguugaaaagacuauuuugaauugucuuggcauccuugcugaaaaucaauucacaauaugcauggauucauuucuggacucucaagucuauuuuauuaucuauagaucuauucuuaugccaauaugacacugucuuuauuacuaaggauuuauagaaaguuuugaaauugagaaauggaagcccuccaacacucuucuuuuucaagcuuguuuugguuauucagguuccuuugcauucauauacaaaauguaggaucagcuuuucaauuucuguaaaaaagucaacugaaauuuuaauagagauugcacuaaauuuguacacaauuugcagaguuuggucagcuauacaauauuaaaucuucugauacaugaacaugggaugccuucauugcuaguauauagaaauacaauugacuuacgcauauuaaacuuuuauccuacuuuuauccuggcugaaccuguucauuuuaauauuuuuuaaguaccuuucuaggauuuucuacagauaaggugauuucauuugcaaauaaagauaguuuuacuucuuuucaaucuggaucuuuuuuuuccauucuuuugcuuuuuuguuuuuugcccaauuucccuagcuaggauuucuaguagaauauuaaagugaugagagugaauauccuugucuuauuucuugauccuaaggggacgguacucaaucuuucagcauuaauuaugaugucauuuguggguuuuuugcagaugcccuuuauugaguugagaaaaugccacuuuguuccaaguuuacuaaaaguuuucaucaagaaagcgugcuggaccuuuuuaaaacauguuuuuauguauguauugagaggaucuuuuauucuacuauuauguuauauuauauugacugauuuuuuaauauaaaaccaaccgugaauuguuuggauaaauuccacuuagucauaauauacaauucuuuguauauguggcugcauuuggcuugcuagcauuuuguacaaaauuguugcaucucuauuuauaagugaaagugaccuaaaguuuccuuuucuugugauaucuuugucugccucuguugucagaguaauaguggcuucacagugucagauggaaaguguuuccuccucuucuguuuuuuuaaaagaguuuguggaaaauugauauuaauucuuuuuuuuuuuuucugagauggagucuuacucugucuccugcccaggcuggagugcaguggugcaaucucggcucacugcaagcuccaccucccggguucacgccauucuccugccucagccucccaaguagcugggccuacaggugcccgccaccacgccccacuaaucuuguuuuuguauuuuuaguagagacgggguuucaccauguuagccaggauggucuugaccuccugaccucgugauccacccaccucagccucccaaaguguugggauuacaggcgugagccaccguucccggccaguauuaauucuuuaagcgcuugcuggaaagcacucauuaauuuuuuaacuagaaaaacguauuuaaucacuguuguuguuugaaguauucaugcaaaucuuauuaucacucgguaaucuggaucuuauuaaggaauaauucauucuguugccucaucuguuuucccacccauccccuaccuaaaaccugaaaagucauggugugguuggggucaguugcaguuauuugacaacaccuguuuuccacauagggugcccacuacaauugucaauacacagucccucaauagcccagcuacucugugaagagauaggcagaaauccuuugaagcaccgagccuaccuguaacacucauuagacucugcuucaaaucaaagcagaaucuacuaauuuguagcagggauaauucauauauuguaguaagacaggaccacugcuaaaaaccuugcggggaagagggaaagaugggcaaagugaagagagacuuacauuugaacuccuuucagguugcaucugaaauauuuugcucacuuuuccagggcuauuaauacuuuuuuuuccuuuuuugaguacuaacuauggguuaggcacuuuuuaagagcuuuuuguauuuaagaacccuacgugacauauauuaugauugccauuuacagacagaaaugaaguuucagaaauagcuaacauaggccagauaugguggcucaugccuguaaucucagcacagugggaggccaagacagcagcaucuuuuggacucagggguucaagaccaaccuggacaacauagcaagaccucaucucuacaaaaaauuaaaaacucaaaacuaaaaagaaaaaaauaaaaauagccaguggcaugcaccuguagucucagcuacuugggaagcugaggugggaggaucucuugaaccugggagguuguggcugcagugagcuguaaucaccccacugaucuccagccugggcaacugaggaagagcaacacccugucucaaaaugaaaaaaaagcuaauauaaagaagcaaacacacacacacccccaaagggucaccugacuucaaggcuacugcacaauaccuucugucuuacauaagcucccugaaauggacagaaccaacuucuuagagaaacuguagcucagccauguuauuuuccuuaccugacucauggccaguuaguucaccccugugaaucuguguccuccccuguaaacuaaauauacuccucccaugguugugagaaguaaagccccaguaucuugcuggccugccagcuuagauaauuguuauuucuccucuuuauccuucacuuuuauccacaagacaaaauuaaauuccucaaagauaguuucugcaguguuuaccuaauuuuaagacaggccuggacauugggaauuuuaacuucauacuucucaauaacaacaaugucucuucuaguuacuuuuauucuugccuguacauucucucaagaaaaugcaaaccucagcaaaccaaggaacuugcuaccaaagacaggccuggaggcaagaacccacagaggaccugggaaaacccuuuccucucucaccaaauuuuaauacccuucauuaauguuaauugcacaacuccagaggcaaaauauguauccuguaccuaaaacuugucaccucuauuaauuaaaaacaggcuuguggaauaugaaacuauaaagugcuugacuuuguuuuaauuguaaagacacuuaauuggcuuguacaaaaggaaaagaauuacuuuugccucacuuuaaugagguucuuauuauucaaauggcacauugcgcucaguuuugacuaaaagccauugcaauucaaaaggcucugagaugaugaauauuuacagacuaugaaaaggaaaaguucaaacuauaaagacagaauggaaacaaaaauaguauccuuccaaaaacugauguuacuagucagcauuuuaaggggcugauuuuuuuucuucuucuuggguggauucucaucugugagaggugauuaagggcagaaaagguuguccuccuuguuuagagccugagauuccaauggaaggcagcaugcagguucuacauggcucucaucuacccacagauaaagccccuccaccuuucugaugaguggccccauggcauucucugugucugcugacuguggggaugcuauuuacaaaccagcaaccccuucaacuagagccaaugcauuccuucugggccagaggacauccccucaguaguuaaggugguaguggugggggcggggguugucaucaaugagagugacaaugggccaagauuccuuaugacagagccaggcuuucuggcaagaguggagugagguggcacuuccuacugcaaagggaccagcuccuucccuuuuuuaaccccucaagaucccuaccacugacuaccccgucucuuucuagcauuuucuaucuuucugaaacccccuuugugaaauaauaacugaggaaauuaaaacuaaccuaacagacuccaucuuguccuuagucucagagguuugucagaagcauucaaaccagagugacuccauuuugaauaggggcuggguaaaauaagauugagaccuacugggcugcauucccacgaggucaggcauucuaaguuacaggauaacauaggaggucagcacaagauacaggucauaaagaccuugcugauaaaauagguugcaguaaagaagccggccaaaacccaccaaaacaaagauggcaacgacauuuggucauccuuacuacucauuauacccuaauaugaauccauuagcacgcuaagagacacucccaccagcaccaugacaguguacacaugccauggcaacaucaagaaguuacccuauauggucuaaaaaggggaagaacccucacuuccgggaacugccuaccccuuuccgugaaaacucaugaguaaucuaccccuuguuuauaguuacauaaaauauauauuauauauaauauuguauuauaauuauauauauuauauuaaaauauauuauagcuaaucaauaauuaacuauaaauauccuuaguccaacagccaaaguugcugcucugccuauggaguagccauucuuuuauucuuuuacuuucuuuauaaaguuacuuuaauuuuauagacucaccccaaauucuuucuugcccaagauccaacaacucucucuuggggucuagauugggacccguuuccgguaacugguuagcugucuuuggucauuccugggcaugggccaagcuaacuuugggagaaauuucguuuauaguuuaaauaacagcuuucccccaaaacuaaacuguuccuguaaaaugaaugaaaggccaccacguuaggaugagaggggcuugaguuuuaaauaauuaccagccguuauuccucaggucacaagauuugcaacuuucucaauuauucaugcagauaacaucacuguuguagaaccuaagauuggcuuuugagaugucuuuucagauuuuugcuuuuuguuuguuuguuuguuuuaagacaguuucacucugcauugcaggcuggagugcaguggcgcaauuggcucacugcaaucuccuccuccuggguuuaagugauccucgugccucaaccuccugaguagcugggauuacaggugcacagcaccaugcccagcuaauuuuuguauuuuuaguagaugcaggguuucaccacguuggccaggcuggucuugaacuccugaccucaagugaucugcccaccucuguuacacguguccaugugaagagaccaccaaacaggcuuugugugagcaauaaagcuuuuuaaucaccugagugcaggcagacggaguuugaaaaaggggucagcaaagggaaauagguguagggcaguuuuacaggauuuggguggguaguggaaaauuacaguuaaaggggguuuugucuugcaggcaggggcgggggucacaaggugcucggugggggagcuccugagacucacugccucaggaagaggaaugucacaaggucaacugaucaguuaggguggggcaggaacaaaucacacugauggaaugucaucaguuaaggcaagaacuggcuauuucacuucuuuuguaguucuucaguugcuucaggccaucuggauguauaugugcaggucacagggguuaugacggcucagcuugggcucagaggccugacaaccucagccucccaaaguacugggauuacagggguaagccauugcaccagccagauuuuugcauuucugacaacacgguggccccaugcagaccugccaaccaguccuuuggcccccacccaggaacugagucagcacaggagggcaccuuugauucccugugauuucaucuucaagccaacaaaucagugucaggccucugagcccaggcuaagccaucauauccccagugaccugcucguaugcauccagauggccugaagcaacugaagauccacaaaagaagugaaaauagccuuaacugaugacauucccccauugugauuugcuucugucccuaccuaacugaucaacguacuuuguaaucuccaccaccuuuaagaagguucuuuguaauucuccccacccuugagaauguacuuugugagauccacccgcugccccaaaaacauugcuccuaacucuaccgccuaugccaaaaccucuaagaacuaaugacaaucccaucacccuuugcugacuccuuuuucagacucagcccaccugcacccaggugaaauaaacagccuuguuguucacacaaacccuguuugguggucucuucacauggacacgugagacaaucagcacucccagaucacucacuggcucccuauccaccacauuucuccuuaaagacuccgaucccugaauucucggggagauugauuugaguaguacaacucugguuucccauacagcuggcucuguguggauuaaauucuuucucuauuugcaguacccccgucuugauaaaucagcucuguccagcuagcaggaaaggagaacccauuaggugguuacauuuuccucuccacuggcucauucuugcuacgcgucagcucaaucagaucuuucugaccaucagguaaggaaaaaucagaacagaaggaaagaaaugcagaaaacaaagaggguaaaaaagacaagggcugggaagagaaaaaaggacauucacuugaccuaggcagguugcacucgucucucucuucccauuuauggucuauaguuuugaaauauucaucuccauucagucuccuucccugacccaaaucuacuucucaucaucagcugaaugaauuccauucuaucaccauccagaaccucucaaaacugccuggcgaggaguggcuucucaaucaauaaauucagcaaccuccucucugcuaagacuagacugcccuguugcagaggauccugcuccucccucacuucuggcucacuuuccugucuuggcuucugugauaccauccacucuuggaccucccaaugccacuaccacuccauuuuuugucuccuccaacccuuccucuuuugcccauuguuccaucaccaaucucuuuucauuccaucucuaaaaucuucccugcagcaguuucuuccaaauccaugacuccgaacaaaaucgccaugaagacuucaaacccuuagcucuagccacuauauucuuuccaaguuccagaaucucauucccaccugucagucuuaucuuccuggauaccuucccacaaauucagggucaacaugccuaaaucuaaacucuucaucuucucuccucacaucuccuccccguccugauacccuuuauuucuguaauggcugauauuugcaaaccagucaccugauuacaaauacuuaggaaaacaaugugcuaucccaucuucuccuuuagucuccaugacuggucaaugucaguaucucuaggcucauuaggaaccccuaaaauaccgugccauccccuacuucuccacagagguaggcacuaccucuggagcaugaacuccuccagauaacuguccauugcuggagggcacccucacaucugggaagucaucacccccacacacaugcucuguugacaaggaggaccaacucggugauacaauuccuucuccagagcuccccauggaaucgggcggaaacagauuuccaguagaaaccaaagccugcuucccucuccgcucuccucugggaacaguccccuaaucgaucauaggaacaagaauccccaucccaggcucagcugcuaggaucaccaaccuaagacaaugacuucaugucacuccauguuucuagcucuguuccuuuuagguguagucacugcaauagcccacaccuggucuugucaccucuacauucucccacuugacuuuuuaugaauacugguuaaagccuaguuaaacuuauuaaaauacuauucuaaucuuaccuacccauucucaaaaacuuuuaaugguuccuaaaugucugcuaaauuaaacacaaaugcauccugacauucagguccuucugagcaacagccacaacuacacccccuucuccuuaagcuccaggcaggugaaucauccacugccccauggaugaguacgccccucacuugauuaagucugggucuuuauucgugccauucccucugucaaauuccuaauuguucuucaagguuuugcucaaauauuauuucacugaagaaaauuucccucuaaucaacacguugauuagcccucuuuaaaauccauuagcaauauauaaacacacaauggcauauuacucaacauuaaaaagaagcaaacuacuacuaauggauagaauaacauggaucucaaacgcacuguccuaggcaggguccaaaugacucccaaugcucccugcuuccugguuuucauacuuuuguguaauccccucaccucaagggugggugagaccuaggaauuuguuucuaacuaacagaauauagaaaaaaucauggacaauucuucugagauugguuuacaaaaagaugcuggcuucuguaucacuccuguucuugcucucuugcuuacucaauccaauggaagcuaacugcuguguuaucaacugccccaugaagaggcccacauggcagggaacugagguucgccucuggucaauagucaggaauuauagcuuucaguuuaaugcucaugaggaagugaccucugccaacagccaugcaugauguuagguccuuucauagucaagacuugagaugaccuuggccccagcuaacuuuuuuuuuuuuuuuuuuuuuuugagguggggccuugcucuuucacccaggcuggagugcaguggugugaucucaguugaccacaaccuccgccuccuguuuugaagcuguucuccagccuuagccccccaacuaacugggauuacaugcaugugccaccaugcccaacuaauuuuuguacuuuuaguauggcguuucaccauguuggccagguuggucucaaacuccuaaccucaaaugguccacucaccucgaccucccaaagugcugugauaacaggagugagccaccaugcccagcccccagcugacaucuugauugcagcccaagaaagacccugagccagaaacaaccagccaaacugucccuaaauuccugagucacaaaaauaguaacugggaaaaauaaaagucccccaaagaaguccacauccuaacccccacagccacugaacauauuaccuuacaugguaaaagacaugcugcagaccgugaucaaggguaagaccuuguguguuaagcuauucuugcacugcaauaaagaaguaacugaggcuggauaauuuauaaugaaaagagauuuaauuggcuccgauucugcagacucuacaagaagcaugugcuuggcuuccggugaggccucaggaggcuuacagucauggcggaaggcaaaaggggaguaggcagcuaacauggugagggcaagagcaacagaggaaggaaggugccagauaucaugugaacucacuuaucaccaaagggauggccguaagucaugcaugaggguuccacccccaugauccaaauaccucccagcacacccaccgccaacacuagggauuauguuucaacauggcaugugcaggagaaaaacaugcaaacucuaucaccuugagacagggagcucaugcuagauaaucuagguaagcacagugucaucacaacaguccugagauccuuucccgauuguggcuagagggaaaugggacuacagggcuaaggucagagaugcaacagugcugguuuugaagauguugugggugaccuuuagaagcuggaaaaggcaaggaaaaauauucucccuggagucucuagaaagcagcagagccauaccgacaccuuaauuuuagcccaaugagaaccaugacaaaucuuuaaccuacagagcugucagauaauagcuuuggguuuuaagcacauaaguuugugguaauuuauuacaacagcaauggaaaacuaacagagugagauaguguauguuugcuguuuuaagucgcuaggucuuggggguaauuuagcagaaacagacaaauacugcaugcauuaugcuaugggaaggaauccaaacuccaaaagcgacacccagaauauuucuguuuauguaacauugcagagaagacaaacaacuagggacagaaaaaagaucaaugguucccaggggcuaggugucaggagcagguaugacuacaguaaggcacagaggacauuuggggggugauggcacuguucuguaucuugacagugaugauggcagcucuaugacuguguuugucauaauucauagugaaauucacccuuuuauuguacagugcuagcuuuaaaacucaauucauuacaaaaaaaaauuuuuuuuaaaccaauaggacuuucuguauuucuaaaagcacugaucacauccuaccuggagugagccacuguguauacaucugugaauaaucuacacccagugggacuuuagcaacagggucucacucaucuguuuuuggagugacuucaagagcuauaagcagcagccuuauaacguggcauuaagaaaucagagguagguaagaugcuugagcuacagcccaucuccaagcuggcucucaucuguacaguagaaaaauuaacauauuuuaaaucacaguacuuucuguucccugcuuacacacuuauacccagggcuuacccaccuuccuugagugguccacugagauggggcucacagaaucccucacucguucccagaugcccagccuacaugucaaacccuuccuaccucccaaaggugacucaggaaacucuuccuuucuccaggaauucuucccuugcucuuuaucugcaaauuagcuguaucucccucuucaaaacuucuugcaugcuuacccaagaccuuuuacaaggucaagacgacaggcacaacggaaugacacaaguuccuucaacuucuuaccaauagauagcuacguaggacaggagaucaagcuguuacacaaguucccugugauacagucuuucugcuccuuagcucagcuagguccaacugcuugucucacaaccaggaagaauuaggcaugcagacaauggagagugaguggagccgaauuuauuaacuaaaaggaaaacucucaguggagagggaauguggugggggugguuccccuaccugaaggcaguaaaguugccccauguggcugggucuggggccuuauauuaacucagaauggaggguacaugcuaauuacuuugugagcaugcacagaagguuaaagugaaggcaacacucaaaggugggcaugacagcauaggaaaccaguuagggaagggcaggaauauguaaaauaggugaaagguggggaucaaucagaagagugcaccaaguaagaagacaaguucucaaucugguccgaggauuuaacuuguagcuuggcuuucagucuuuaaacugucuucaacuuggaagugggguuucaacagggaccggcuccuaucuaccuaggcauuuggcugccuccugccacucucaccuggacuuuaaguacccauuaaggcaccauacaccagucauaccaacuugagcagggacaggggacuuggcuuccaauuuugcuugggauauguccauuccuacauuacuuaacacuuucuaccaugugccauaaucuguaugugcaaauguuaucucuacaguagacaguaaucaauguccauaggaagugcguguuugcccagacucaagaugugguaagaaguaaaacuuuuuuagguaucuggauggauacguuugaaucaaugcuauuuuucuuauggcauuuggucuacaggacguugaauagccauguuucacaauauaucacugaagcuggagggaagaaguugaugugguucuaguugaucaagaaagagucauuuaugcuguggagacaagacaaacccauuacgacucaaggaacccaagaaugagacauaucauuucaaaccugagaugagaaaggugcuuuaaagagucuaggagcagcaguagacaccaccaugggguugaguuacacagaagauuuguaagugaaauuguuaacaugcuccccaaaagugaggcaagauuuugcagauuaaauaaacacucuucugaauguuaagauaauuguggcuuugggggauucaauuucagacacagcaaaggaaugagcugaguggaauguuauguaaaaggaaauacuuuccaaucccuccuggaagcagaaugucacaccaucuggggcauuucucaacuaagcugcaagacuucauaguauuuggaaauacucugaaauucaauagaaagggcccaaggacccacagucuucuaagaaacuucuuagucuuugcugguguucaacugucuuuccucccagaaaagggaaaaaaauaauguagaauucuaaguuugaccccugcuuaaauagcuagagcugguuucaugaaaucauggauggcaguauacacugaacacagcaauucccuucaacagcugccucaguccagguaaggucaaaucuacuucagcaauccaccaaggccacagcugcccaaaaugcagcaugugccacuagcaaaacaagaugauuuuagguagcauccaaggaguuuauaaaaauuauuucuauccggccgggcacaguggcugacgccuguaaucccagcacuuugggaggcugaagcgggcggaucacuugaggucaugaguuugagaccaccuuagccaacacagugaaacccaucucuacuaaaaauacaaaaacuaaccaggcgugguggcacacgacuguaaucccagcuacuggggaggcugaggcaggagaaucgcuugaaccccggaggaggagguugcagugagccgagauugcgccacuacacuccagccucggcaacagagugacacuccaucucucaaaaaaaaaaaaaaaauguauaucccagcacuuuggaaggccaaggcaggcggaucacgaggucaggagacugagaccauccucgccaacauggugaaaccaucucuacuaaaauacaaaaaauuagcugggugugguagcacaugccuguagucccagcuacucaggaggcuaaggcaggggaaucgcuugaacccgggcggcggagguuacagugagccgagauugcaccacugcacuccagccuggugacagagcaagacuccgucucaaaaaaaaauaauaaaauauauauauauauauauauauauauauauauauauauauauauauauauauuuauauuuauaugcuguaauguaauggaaauuauaucaucauccucacaaaaucaauuucacaaauaguccuauaaaggauuucuuaaaauugguagcaauaaacauuaaauaauaguaaacugacgcagugauuuugcaaaaaugacgauauaguuggcuuaaguuugagaaagcaagacugcaagauacacaauacgaagggcaucuuuuaaaaagaacaaacaugagcgauuuacuuucacgugagacacccucagaaaauguuagucauucuauugauggaaugagaaacaugauccccaguuaaagaauaucuuuugcaugauaugugcauaagagaauucuuuuguuuagugcaauuuuagcaugucagagagguaugugacagauaagauggcgugacagggaaaacucacuucgucaccugugucugccucucauuauguguguggcccucaggaaagugaauaaaccccucugagccacagcuguguccccuauaaagggaaugauaaugcccaccuuguuugacagccacaagaauuagagaaaauauauaaaaagcccagcaucagccuugacagagauggugccuaaaagaggauauuuccuguuuucucaaaugcucauucuacuuuggggauaugguacccaccaaucauugagagauaaaaaacacauauacauuguuuuccacauuuauaagauacuuauguauuguuucuguugcccuuacucaauaugucugguagagaauguccugaauaaauauucaaggaaagagcaaauaaaaugagaaacaucaacauauaaaaucaguaucagcuuggguggccagugaccaucagcuauuccuuuaaauuugaaaggaccgucacaugucgacaauuugacagacaccaucaaguauuaaaauaauaauuaacugggaauggauucugcugucaagauaaccuagccacauuuaauuaauuuuuuuuuauuucaguuggaauagagaaaauaauccaaaacaguuacccagaguggagcacagcaccggcuguguccccuggagaccaccaggaauuuuucauuucaugcaccauuugcaacuucuuauagugaauuccagaacaucaguacauacacuuaacugaaaauggaaauacucuuguuuuugucauuuccuuaaauuuuugccucauguccauuaccuugauuauauuuucccaucccaucaucagcagucccagcaacaaaaucucaaucucauugauuguaaauagggggaaauguaaaauagaaguacauccacaugcucuccaagaugguuuucuagggaaaaugcauccauuugauaauugugccccaauggcacuuagugcaaugggcaugauaucugacaugcaggucucauuccuugguguuacaguucugguuguuuccauuuuucuccugcccuuugcauucagcacuuuacugcccuguguucuggcuuccuggggacauuuaauaaaauggacaaucaacuuuaagugcaguaaggaugggggcuggucgggaaaguaagaaaaaguaacuucaaccacacucaugaccuacuagccucacuucaacauagugcccuuggauggaaaagacguaaauuaacccaagugucucuuggcaaauucccauuuguucgucugacaaaugaaccauagucccguccuuaagaaauuuaguugugauaugaaagaaauuugauaggccaaaguagaauuuagcgaacuccacaagagaaagugacuauuauucauacaaauagaagaagggaaagaccuggcagaugaggaggguugggguggcauuauuuaaagagggaauugguucuuucugugacccucagcuucucacgcccaaaauggauuaagucauaauaaugggccccaaaccccugaaggauagaggugguaucugaagucaccuugugcucucacaccuaggguuaugcuuggcauacaacagaauuuuguugaauuacaaaauccccgaaaaauaauaagauaccacuggugaaaucucccagcaucuuucaucacacuaagaucacaguuaucuguuuaaaacacugcauacaaucaguacuuuuuaaaaaacccccgagucccucccucuguuaccauuauccacaacacagucauuuagguaccauuugcuuaauuuaaggaccaucuguguuuauaaaauugcacuggaaacgaacucuucuauacuuuuuagccucgccucgcccuuugcaaaagacuucugcuagguggaguugcucuucugauuuucaguuuuaaaaaaugaauauauguuaagauaauacaauauuugucuuggugaacuuuggaaaacccugcucugugguccacagagcucaugcaauuaggcugaccugcagugcaaguaagugaagguccaugcagccuucaaacacauccauggcuaagaagucaaaaguauccaggaaacuugagugaagggcuagagcuggcaguaaauuacuugacaaugccuaggcagaacacauuuacucuuacaacugaaaacuuugucuuugacuaugcuuuccuugugggacaaucuggggagcccccaugcgaagcagugccucauccagggccuggcacaggggggaugacugguauuugucaauagugcuucuauuaaaauaauaccugggccuccugaauacauaaaaugcaacccucaaagcauuuuacccacuugguaaguggggaaaauaaaggcaauaaacaaagagccuuccugaaaacacauuagcauugcuacaaauuaacauuauauuucguaggcauaaagcaauacuaaagcagcaauacaagccauuauuuaugaacuucugcaguaucauggaugcauaaauucugcagaaaaaucaugggaagggaacauuaauuuuuuaauaacuuuauagaauaguuuuaaguaccagaugacgauuucauucacaucaugcaaagagaguuuauuuaaauacacuuuauacaguuuuaaugcagggagugggcuuuaauaggugguggcagaggugaauuuacaacuuacaacuuacaaacaauaagaaaaaaauuguuuggggaaugugcuuaagcacguggucaagucacucaaaaaauaaaacaucucaugcauuuuguacaucucccuugccaaugacgacucuuuccucuguuuugccuagagauauauggagcuguaauagaguucagaagccccugacagccgugugcugccauucagaccugaaagauuccauguuaugauaaaaauuaauguacucugacauccucugggacuuucugggcccugggaauagcuaaugaagaaauacaaccuugcuggagaauggcacuuggcucuggaguugaggauuaauucacaugugguaguggaguggucccccugucaccagcuguaaagcaaccagaccccagggccaaugggagccagcacugauugguuagaauuauuuccgaggucaggagaagucaaauaagcaaaacgcuuuaacaaaauaauugaacccaacuuagaaucagccugucacuucuuaaaccgaaaaugagucauguaacaccuugucucuuguuggcuuugaucguggacuuguaaguuucuccccaggaaaaaugcuuccugacugauuguaccaauaccaggcacgucccagggaacucuccuucaagaggggcucagaaaggggguugguguugagcuugggggaagugcugaagcccccaauuucuacggaccuccaacccuacuuuccaacauguuuacugcaaccccccacccaugauguuuacaaauaagguauaauaaucacaauaauguucauagcagcaucuuuuacaguagccaaaaaguaggaacaacagaaauauccgacugacaaccagauaaacaaauauggcacaucuacauaauggaauuuuuuucagccauaaaaagaaaugaaguacugauuuuugcaauaacauaaaugaaccucuagaacauuaugcuaagugaaagccagucacaaaaggccauguauuaucuaacuccacucauaugaaauguccagaauaggcaaacagguagagauagaaagcagacugcugauugccuugggacuggaggaaguagcgauggaaaauaacugcuaauuguuaugagauuucuuuuuggagugaugaaauuguucugcaauucaaaagugguaaugguaacguaacuuugugaacguaauaaaaaucacucaauuguacagcuuaaaauaaugaauuuuggcugggcauaggggcucacgccuguaaucccagcacuuugggauuacagaggcaggcggaucuagaggucaggaguuugagaccagcuuaaccaacauggugaaaccccgugucuacuaaaaauacaaaaauuagccaagcgugguggcgcacaccuguaaucccagcuacucaguaggcugaggcaggagaaucacuugaacccaggaggcagagguugcagugagccaagaucacaccaucacacuccagccugggcgacagagcaagacuccgucucaaaaaaaagaaaaaaggaauuguauuguauguaaauuaugucucaauuaaaaaaaaaaucccugggcucugagaaaucuuuacugacauucucaaaaugcguuaaguagccuucagugggguuccucacccuuucccuaaagcagacuuaaggucucuccagacucuuuccccuaaaucauauauacucccacaauaccaagacaggauacagguuacaagauacagcgaguuucaucaaaauagguuacucuuuuuuuagacaauugaugggcuacacaaagcuacauaguucuagaccaaaacauuauuucagccuauuagaauuuugccaugucaaguugaauuuauucucaauaucugaauuuuagcuacuuuaagaaauauuagguucaaaauuuuuaaacuuggcuuuucuuaaaauauucagucuuuuccacuuuguuaauuuacuaucuucacuaaauuauggaaaauguagaaaaaagugguauuagaaaaaauaucuugcaaaaauauuugaaaucuuuauuucugcacacacauauuuaacauuuuuccuauggaaggucuaucauucucuucaaagaaaaaaacaaggcagcuggacauggcucaugccuguaaucccaguauuuugggaggcaggggcaggaggaucacuugauuccagaaguuugagaccagccuggacaacacaaggagaccucgucucuacaaaaauaaaaauuagccaggcaugauggugcaggcauguagucccaacuacucaggaggcugaguggaaggaucacuugaacccugguggcugaggccauagugagcugugaucgugccacugcacaccagucugggugacagagccagcccuaucucagaaacaaguaacaaagugcuauucugauauaugaauuguaguguugauugagggguaacaguguauucauugauacaaauuuaaugaucucuuggauuugcuuuaaaaucaaaugcccaguguacacuccagaaugaucccugcuuuccuuccuccaguccucccuucccuguucccuuucuaccugcuuccuucccccuuuuccucccucccucccuccuuaggaugguaagaggagaaaaaccaagcuggauucaugggccaaguugggaaauaaaauuguaaaccacagaaacucaaagauuuuuuccaagucuuccuucuguccagccauucauccauccauccaucgauccacaaugcagaacaauuacauuagaauccugggggugacagccagacugcaguguucgauucccagcugauuccucacacagccaagcuggggaaccgcccugucagucucucaggaguuuucagaucugaggugggaaaucgaggcacugcuuuucuauuagccuggugcauuccauuaagacccauuucccaaagcuguguaauuugucaccuuaugcauaacuuguacuucugagacaaacagagaccuuuuccuccuguuuuugguuauaaauuauugcauaauaucagcucaaauaucuuuuugaugacgaguaagugaccgaacuauaacaggaguuuaagcuuaaaaguuaaacugacgaacuuuaccgcuaauugagaggucccguuuauguuuuucugaaugacaagguaugcaauagauucuucaaaaaugaagacaagaaaggacucacaauauuaaaaacacagugcagugacaaguagcucaacuaaaaauauaaucuuccuuggggauuuucagcaggcugccacgguguagcaccgcugauuuauucaaauguauauucaaguuuuuaggcugacaagaauuagcuucucaacaauuuacugggaaaagaugguucccauguuauuaaaaugugauuucagugugguuuuagcacagcuucucaacaugucaauuauguaaguguagauuccaaagugacaaugagggugguuaggaugcuaagaggagaaaaaccaagcuggauucaugggccaaguugggaaauauaauuguaaaccacagaaacucaaacccuuuuuccaagucuuauauaaaucgagaguucucugagaguaaccaaauguugaaacccugacgccggggauuugcugcauugaugucugcguggguggucucacugcaggucaaagagcaggcuugauagacugggcugagaggugucgcucccuguucaacccaacaaugccaagcuggcucagucccaugauccauguccacuccagggaagcccuuacucuuaacagaagcccucacucuuaagguucauagauuccuuguaagaaaaccuuuggguuaugugccuaaaauaacuauuguuguaacuacgauuacauacaacuaugauuacuuuagaaguuguuucccaagaucuacaaagguauaggcuccaugccacccaaggagguaucaacucaagauucuaucacugagaaucggcaccuuagaaguucaguucaccuaacaguacuauguguuuccauuuuuguucuucccucuucuuccguuccauccuuccugucuuccaaccuucuauccaucuagccagccagccacccauccccuuccuuguacuuaccucuugcauccccuuccaccccuuccauccaucuagccagccagccaccuauccccuuccuuauacuuaccuguuccaucuuucuauccaucuagccagccagccacucauccccuuccuuguacuuaccucuuccauccuucuauccaccuagccagccagccacccauccccuuccuuguacuagaaggcaguaaauguaauaauugcaaaggaugauaaagacgaugacaaugaugacacagguuaaaauucacuuuuuuauuaaguaucagguacuacgcuuuauaaauauucaguuauugaauccucucaacaacccagagugguguuaguauccuuucccaucuuugcugaugaaauuaagaauuagaaagauuaaggaauuugccagcgucaccaucuuaauaaguuguagcacagauauuacaagcuaagaccaagauguauuagccaaaguuucugcuccucuggagcucaguuuaaugaaguaaaaucaauauagaaaaaagcauccccgaaguauuccauguacaaugauuggguguguugcugaugguccaaaaaauaacucaucaacuguggugcccggguaagagcagguagaagggaggcucuguagaggacgugacacaagcaauccaugaauccagcuugguuuuucuccucuugccauccuaacuacccucauugucacuuuggaaucuaugcuuacauaacugacaugaugauggacaagugggagaggagccacacaagcaaaggcucagagucaggauccagaacauaagcagcggagcagagaagccuggguuggggaagacauggccacaggugacaugggagaagggaucagaucccagaggccugggugggccacagcaggaaguguagcuauuugcaggucagauagcaggacauugccaaacaggacagugucagggcuggguuugcacuugagagugaucacgccaucaauuuggagguauaaauagcaaaacgaccccuuggucuucuucugucuacuugauaagcaucaauuugaagacaaguagaaagaaaguggaaauggacagugacauucacaguaaauguauaaagaugaugcaaaugacagucaacagcugccgcuucagcuuaaacgaacuccaugaagcagcacccucuugauugguuggaaaauagucugaguaccuuaacugagcggacgagaaucucuucugacuuuaaccuccuuuacacauauuccagcaaaacgauuucccuuuggugauagaaaauuggcugaaaggccaggagcgguggcucacgccuauaaucccagcaguuugggagguugaggugggcggaucaccugaggugauccugagaaaaaggaaaauuggcugaaagaagcaucuccuccaaccuugaacugaccuuucuaauugucccacuaggcaguggcuguccaucaucuauuuuacucaugggacaaaucuccuuuagaaacaauguuuuuuacaugguauauuucccaaaugagacagaucuuucugauucuccaagcuacuaugcaagcugagcucaacagaagaagagauuuuggacgaaguucuagccuuacugcguaccagcuagcaugaacuugguugagguucuuaauuucuuagucuguaaaaugugguuaaucauugcaccaggcugaaccauuaaacacugccauucuucugccauuuuuuaacccacucuuagagucauuauaaggauaaaaugggaugguauguaagugcuuagcuguacaugacacaugauaaauagcugauaaauauuagcaauuauuaucaucauuauaugguuccauacuccaauuagcgcuucaguaucuucguuauugaaacagcacuuaguugucuuauugaccugcuucccuauaugguaauauuuccaaagcucagcaaagcacacuguuccacuuaaacucuuuccucuucucucagccgugaaauaucaugggggaguuucuucaaagaauugaaauuaacuaugcacacaacaucgacucucaacacuuauuuaccuugaccagaccuaacauaacccauuuucuaagaaaaacagaauauauuucucaugaugaaaaagggugcuaguaaaaugaauuucauuuaaagggucucugggccaccguccaaggaguaguaaaccacagcugccaggccagauaccaaauccaagccacuuccuguucuuuguaaauaaaguuuuauuaggacacagccacacccaguuauuuauguguugucccaggcuacuuuuauauuacaauagucucauguaacacucaacaauguauucaacaaugcuugaaugguugccgcagagacugucuggcugaugagagcaaaaauauuuacuaucugauucuuugcagaaaaacuuugccgacgaaugucuagucuagugcuuuacauaaucauuauuuaacaccaacaauaauuaacauuauuugcuauagcuaaaggaaggacaucaccuugcaugugcacuggugggauugugaggagugggaaaagacaacccugggguaauuguaucuacccuccaaagcgugguuuuuacucucuauggaagggaaaguuguguucaauuuacauauaugacuuugauuucaugaaagaugauagugauaguuaaaccuaggauucuguugggaaaucaaaaauguuuauuuugugaacauuggugugguuaauucgaacacauuuucauuuaugucuuggcagugaugacuuuuaauauggcaaaaaggcucacuaacuuuuuuuuuuccgacaaaugucaugcuaagugaccccuaauugauguaauaauuauucucuccaccaggggcagguuuuugaagguuggcaucauaaaaaguuaucaaaaaacugcuaagcaucacaacuacuguaagaaagaaauaagguacaggagauaugagagaaggcauaagcuuuauuuccaaucucuagccaaguucuuggcacuguugugacugcugaauaaaugaugaggugagggcaaaaaaaguuuuuaaggaggugagaaagaaagcagguagagugcucugggguuccacuguacuuaaggauuccuaguauuugcaguguguccugcuguaccucacuuauccagagcaggcugcuuuuauggcaacucaucugaaaaagaugccuaaaaucaagaggaacagacauagucaugucaaagaaaauggaaucuaagcauuuacuccgaaagaaaacugugaagcauccuuggguccauggcuuuccaucagcauaaaucaagaauaacaaaagaauagcaaaaaagaaaaagaaaaagaaaaagaaaaaacaaaacaaaaaaccauacucaguagaguaauaaaguacuuuaugauccucaguggaacaucacuacaguaacaauaauuucucuuggcucuugucacccuagagcuugcaggcaaugugaagcucauuucccuucuucucuugguugucaggcauuguaaagaucauuccugggcccaauuuuccuuucuuccuucccuucuuucuuucugcccuucucucucuuuuuccuuuucuuuacaagacagguucuggcucuguugcccaggcuggagugcaguagcaugaucauggcagccuccaccaugcuggcucaagugauccuuacucgucagccucccaagcagcugggacuacaggugugcaccaccacacccaacuaauuucuguaauuuuuguagagacaagguuuugccaaauuaccgaggcuggucucaaacuccggaacucaagcaaccugccugccuuggccucccaaagugcugggauaacaggcaugagacaucacacguguccucucaaacgauugugaaagcccuuaugagacccacacuuccucucugagcacaacauccccuuuuccuguuuaauuaauuaguugucuuauugcugucuuaaacucuauauauucucagaaaccuuucuaagaucauuuuacgaucaagaugagaaagaaaugcauauuaccaauagccccaggcuccauaaagugagaugugucugguaauuucaugcauuauggcuauuuucaauaaucaacaaccugcaaagcacugugaaaauacacauuacacacacuuggaaagugacgcugagagauuuucaguaguuugcccaaagccacacagccaguaagugguagagcuggaagcgucaguugacccccaacacccacguucuuuacacuacuccagggcauacagguuguugcccagggguagcauacuauggccccuggccaaucuggcccauugucuguuuuguaaaguuuuauugcaacacugccaugaucauccauuuccauacuaucuauggcugcuuucaggcuaccacggcaaaagcaagcaguugcaacagagaucuuaauagucugaaaauucucaaauauucacucucuggccccuuacaagaaguuuaccuaccucugcccuuuacggucauacuuugauguuuuugggaagagaguguaugaucuauuucagaaauauuuuucuaaguauuauauaaaaagacugaaugcugaaaaaguuucagaaggcaaaauuuugcuuaggagggaagcauucuucccugauguuucuagauacacuaaguauuucacagugugcuuuuucaaugccuuaggauggaaaauguaugggauagaaaaaaaaauuuaacuuguagacuuuucaaaauuuuccuuaaaaaaucauaauuaagagcuagauuuagagcauucauuagagcaaaaaacugccucuguuuuucuuuucuuuggguuuucauacuguguagagaagcaaagcaagaugaucuucuguuaggcaaaccaaaaauggauuucucauauugagccaagaguaaugcagauauguuggcuaaaacauuauucuuaaaaccgagcuagggagaaaaagaaagauuaauauguaauuuacacguuggucuucaggguaauucaucccacaaaauuuggaauuuauuuauaauuuauagcccacccacuucccuagauggauuugagacagcaaaauuuggaauaugaauccaagaauauuauaucugggauuaguagauucaaguucugaaaguaauuuagcagaaaaugaaaauaaauaaacuuguuaaagauuuuuuuuccucccauauguuuaagaaguaaagcaaggauacaaaaccguuauuuuaaccuuuuuuuuaauuaaaaaaacaccacuguucuauauuaucuucuaagugagacaaagcuuaaguauaauuucuuuaaauuauaccggugacagaaaguucagaagagacauaaaaauccaugaucaaaaaugcaguucuaaaaauguuuggacuuggguaauuauuuuaauaugaauuuccuaucaauuccaggaagaaucaaaacccuuggucaguauuauacaagcugaccaguaacugcaaucuaaguaauaaauaucucaggugucgucaccaacuuuuuaaguuccaggauugcaauucaguucucuauuuuaucagggacuuaaggaccuacaaaccguuuuuuaaaaaauuuuguaauauagagacagcgucucacuacguugcccaggcuggucucacguuucugggcuuaagcaauccucucaccuuggccucccaaaagcgcugggauuauaggcaugaaccauugcgcccagccauaaaccauuuuuugaagaagaaaaaguauuacagagcaccucucucuaggagcuguuaacucuucuaggcccuguucaaaauaugcacuuuucaguagacuaagcagcuacugcuaggaaggaaaaugugcaaagccucauaaaaacauacuguuauuucucaguccauuucagaaaaccccaauauuuggucugagugauuagaaagggucccagcucuucauacuccuauggacaccacugcugccaggcaguaggaagucuggcuccucuccaggaaugcaguuuaaacaaaaauaucccucacaagccaguuuggguggaacuuaccacaggcuuugguuuggaacuuuccaguaaugcccaaaauaauuugacccgagacacacuggccgacgaccgcugcuaccgcuaacucugaggagaacuaucuggaagcaggcugaggcuuccugggcugaccacccagaaaacuuaguggagaauaacagaaucaaugaaugaaaaugggagugaguaaacagagagugggcagaggagugaggaggucaggacgugcugggccugaagaaaacuggcuuuggcaaucaggccuguguguacucuuggacgauuacaccacugccucugaaguauucuuacgaaaacauuaaacacgaaguugauugagucucuugaguuaucuacccuuucacaggaaacucaggagacagaagaguauguuaaaagacaccacagagaugcaaucaccaaaguacagacugcagaaaucucuagagcagagguuuccaaauuuuuuuggcaccagcaagugguuuucuggaagacaauuuuuccauagacucaaaggaguggggguggcuuugggacgauucaagcagaugacauuuauugugcacuuuauuucuauuauuauuacguuguaauauauaaugaaauaguuauccaacucaccauaauguacaaucggugggagcccugagcuuguuuuccuagaacuagacaaucccaucuugaaggugaugggaggcagugacagaucaucaggcauuagauuuucguaaggagcaugcagccuagaucccuugcauguguggcucacaauagggaucacgguccuaugagacuaaugcuguugcugaucugacagggggaggaccugaggcacuaaugagagugacagagagcggcucuaagcacagacgcagcuuccuaugcuugcccaccacucacucccugccaugccacccaauuuauaacaggccacggcuccgcuauugguuuguggccuagaggucauggaccccugcucuagagaacacccuggucccuuaaaucuguugcauuaaaagaaauuuuuuuaaggaaaaaaaaaaaaaggagacaaaaccuauagauuaaaaaugcaucgaccuuauuugaauccugauucaaacaaauuaacuaugagaaagagggagggaggaaaagaggaggcacaaaagaaauguuucuuguuuuacguuguuuuuuagccacuaaauuuuggaguaauuuguuugagacagagucucacugucccccaggcaugaucucggcucacugcaaccucugcccaccccagagcucaagcaauucucaugccucagccuccugaguagcugggacuucagguaugcaucaccaugcccggcuaauuuuuguauuuuuaguacagacgggguuuugccauguuggccaggcuguucucaaacuccuggccucaagcaauccacccacugcggccuccccaggugcugggauuacaugugugagccaccgugccuggccagagucauuucuuacucggcaauacauaaccaauacagaaauccacacugaaauuccuaugacugaagugugcaaaguaacaaaaagucguuuuggauucagagagauuuggguucaaauucuggaucuccuacuugcucaaguugagaaagugucuuaggcucucugcacugcaaccuuguaauuugcaaaguagggauaaucaugguuaagugugcaggacucuuauaacaaacuacagacagaauacauguauguaagugcuuagcacacugccuugcauaaaacaaacaacaaguugccuagcagcuauuguuuacauaaucaugguuaggagggcucccucuacaacagccuccuuugcagccucaccucccagcacccgaauaaaaagaagagauccaggaagaggcugauccccaucucccacagaaggcagacggcgggugguuccacaguacaauaugcugcuuuucucaccaguguuuguacuaagaaucuguuucuaccuuuucugcucuaagacuacacaauaugcugccuaucccaguguggagaaacacuugagauggagcauggaccaagggaauacacacaggaacucagagccugauaauacucuggcuugaucacauacaggcuuugaaacggcauauuaaauaagagcauccacauggaauucaaauuuaagggauuuuuuccucuccucaaugcaacagcgugaaaagagauugguucugaacuggcagccuuucuuucauuugucauuauguuuuacacacaagaaaauuuuaaugucugaagauggggggugauaagaauagaguuacauguguuucucuggcagccuagucaccagcacuuaaauucacuucugacaguugucagaaucgaaagaccugcaaguacuaaacugucaucugccuauccaagagagauuucacuuuggcagcauuucaaaaguaaaaucucucgcuuuuuuaugcauauuuucaccaccacaguauuucucuaagccauguaaaauccuguacucucaugggacacauacaaagaggguugugcuacagaggucucuauauggaaaaucacccuuguuucucaaccuagaaguacuuucuaaaauuccaaaguccugugcuaaaaucugggauuagggcaaaaugggugagaguuuccuccaagguuuugagcuuggugauuacaaaaggcacuugaacuugaugauuucccaacuacuuaaugguuaaaaacuaaugguccaguuaagacguggaagaugauccuauuauguaacaguuggcucucuucagcaaagcugcucacuuccaacacauucugacagaggaacuggacaaaguuauucagcggcagugaauugugagaucucacaugcuaugaggaaaagaacaagaggcagacuggagugaaaccccaugcccgucaccaaccugcuaagugacccugcgaaagucacucacauucucugagucuguuucuaucacauuuaaaaugaaagggucgggcaggguggcucacgccuguaauuccagcaguuugggaggccaagguggagagaucacuugaggucaggaguugacuagccuggccaacauggugaaaccucaucucuacagaaaauacaaaaauuagcugugugugguaaccugcaccuguaaucccagcuacucuggaggaugaggcaugagaaucgcuugaacccaaggccagagguugcaaugaacagagauugcaccacugcacuucagccugggcaacacagcgagacccugucucaaaaaauaaauaaaaaauaaacuaaaaugaaacacaguauaguacgguggucaaguuggagccgugaagaggcuaaaucggccccucuacccacauuccacaugccuuggauaaauuauauauccucucuagccucacuuuccuuaucuguauaguagagauauuaauagcaucuacucccaaggacugcuuugagaauugaaucaaaacauacaugcaaaauauuuuccacguauggcccauaagcccucaguaaaugagcugcugacuccgcugcuguucuugucauuaucauucccucccaaacaaccacagacagaugaguuugaggagucagccauccauaauagcugacaacugaggugacagcuugugugcgguuacuguggcuuccagggccaccacucucuucucagagcccagaagaaugucuggggcuuuagaggugcuccugaaaugugugugaagugaaggaacggguggauaaaugaaugacgaagcaaaucagcgaacaaaugucuugaaugcuaguguugcagccuguugaggugccucuugauaguucuggcaaaggguggaagcuacuaacagccaagcgcugcaaaggacacacacaggagggcucucucagaucuggcuggcugggggauguuaucucacuguuccuacaagccagcuuggggucugcgcuuaggcgauguugcaacucucacuaagacugacucuaauguagaccucagugacuugggacacugacauacuccagcaagagccugagucaauuuuuuuuuuuuuuuuugagacagaguuuugcucuugucacccgggcuggagugcacugguucagucucagcucacugcaaccuccaccucccggguucaagccauucuccugccucagccucccaaguagcugggauuacaggcaugugccuccccgcccaguuaauuuugcauuuuuaguagagacgggguuuuaccuuguugcccaggcuggucucgaacuccugacuucaggugauccgcccaccucggccucacaaagugcugggauuacaggcgugagccaccacgccaggcugaguacaaacuuuuuuuuuuuuuuuuuuuuuuuuuuuuuuuugagacggagucucaaucugucgccaggcuggagugcaguggugccaucuuggcucacugcaaccucugccucccagguucaagcgauuuuccugccucagccucccaaguagcuaggacuagaggugugcaccacuacacccagcuaauuuuuuguaucuuuaguagagaugggguuucacaauguuggccaggauggucuugaucucuugaccucaugacccuccccgccuuggccucccaaacugcugggauuacaggcauaagccacugcacccagcugagagcaaacuuuuuaaaucuaauaaaguagagcggcugggcgcagugguucauguguguaaucccagcauuuucagaggcugaggcggguggaucaccugaggccaggaguuugagaccagucugaccaauauggugaaacccuaugucuacuaaaaauacaaaaauuagcaggccaugguggcaggcaucuguagucccagcuacucaggaggcugggacaggaaaaucacuugggcccacagugggacguugcauuaaggcgagauugugcacuacguuccaaccugggugacacagccaugcaaggagaauuggacacuagacagcaguguggugucagcuccccacagggccauuugaauaucugguuuaagaucccuucccucacauccuucaucugcuugcaacacugcagaacuaauguucccaacagagccuaacccaaaggcagcuugucauuuaugagagcucuccacauucagugguucuggugccucuuguguaauuaucuuauccuucgcacaaccugugcuauuauuaacuuaauccucauguuugaaucaagucacugaaaaaaaauaaaugaaguuauuuauuaaugaaauucaaaccucuauguucaacgagaaaccaggauugccugcccuaaauaugaguaaaaauaaacacuuggaaacaaaguauuguaauuaguguagcuugccaugaucacuuuccuuagcucaguguuucaggguuugaggccuccugucugucucucugucuccccacccccuuccgcuucucucccuuucuccuacaaccuucucuguuagaaagggaugcuagcauaugauaggaucaaaauaugcuaggcccuaacuaaggcuuucuccaacuggaauuuugaaagacugaaaaggaugaaaaaaaauaaauaaaaggaaugugaguccauguuuuuuggaaccacauccauguaccacaucaaaucaucgaaggcuuuagaaacuagaggucuuuugggugcuuggauugucaaccucccugccauacuggauaacugaguuuacuuguuccugaaugcaauuuaaauauacucuuacuccauucugaaaugcacuacaaaaaaucuuauaaucaggaugcaucuuacuauugccaagcuuuuauuagccacuuuuacuagugcuuuaauagugucuucucuuuugguaugugggaagcuguuauuagauugaugacacaucucauaaugaaggugacugugagucaagaaaauacgguucaccuuaacagggccaauauaaaugagccuccuguuuggacgccaagacaacacaacagccuugcauucucccaauuguguucaucugauaaagauauuacaauagcaagaaauuaugaucuauaacccuccacuggaacacucacacauucuuggccuugaaugcuucagcaaaaugcugcacgcuacggagcagagcgagguccagggucauugcuucuaccuuggcuuuaugcugcaaugagagaaaauaaaaagaaaugauaaauaacagcaaguguaguucaugguaucaaguuacaguaaauguguuauggaacaugucggaauuccccuguuuaauauaagacgcccagagagaauauaaaucaucggaaugaauggaagaacagggcuuuuacugccaaguucggggaggaugugaggcugggauucugcuaaaccuacaggcugggggguggggcggggggguggguugugcuguguuucagccgcgcaaaagaggcugcaaaggcgcuucgggcuaacguuaucuccucucaaucugcauccuaaaacgcuguaaggaggggaaugcacgacaacgccucgaucauggaaagaugcaauggacaauaucuuaauuucaaaagcugccauccagguucugaaauaucuccauuaaaccugcaucaaaaaucaaagacaacuccuuuauagaaaguacaaaagcagaaagacucguuuauaccaauggauucugacggaccucgaucccaaaggcaacacccuggcuuaguaaacccagaaaacucuaucaacagguggaauacaugcuggugauaggaauaauaaugguaauaauggcuacuguguacuuagggccugccacgggcuggacauuugcauaccaucucacucaaggcuccuaacaacucaaagacaauguuuucuccauuugacaaugcagcaucuuacaagagaucacagagauaggaaauugaguacaagaacugaccccagucacugauaaagaagcccaaguucccgccuagcaagaaaccaggagaacuggagaggucgggauuugaagcaaugguguuccauuggccauguucuucauggcaucauucugcaaggacaaaucuccggguugccccucccacuagccuucuguguaugggccacucccaacuuuuaaaucugggugcgcuucggagugcgagauuaaauacuaucacuucuuagaccuagcuccuugaaaggacaaaaaacccaagaacacagggccaccugccuauucaaauaagaagagucccguaaaacaaacgguugacuugggaauucuagucuagacugugaugcuuaaguaagauuaaggaggauaacaugauaccuguaaggcuaugaagggggaugcaaauggcacugcugagaacauccucuacccuaaguguccuguucagggauggacaggagcugggcugagacguucagcguaauugcagcugguuuaucuuggcugccaaguccugggcucuaauccaaguccuaagcuuugagcaguaaacaucaggcagugacagcuagaaaacacacucauucuggaccauuuaacacuguugagccucaguuuccuuaucuguaaaagaugaauauuagucaucuacucauagguuuguaacgauacauguucauaaguuccuaacauccugucuggaagacaaauuaucuaauuaauuuaacuagcagagaagauguuucuuguguaaaacucuugucccgaugccacuuggcaauaaaugguagucuggguggguuauaguccagcacaguggacagauggauggcaaugauguccaaagauccucccugaaggccacaucagaccagauuacugagggaaggauccuaaagaauccaagucaugccugcuaacaaagcccugugcuuuuguguguguguguguguguguguguguuuagauggagucucacucugucgcccaggcugaagugcaguggcaccaucuuggcucacugcaaccuccacuuccugggcucaagcgauucuccugccucagccucccgacuagcugggacuacaggugcgugccaacacacccagcuuauuuuuguauuuucaguacagacgggguuucaccauguuggccaggauggucucaaucucuugaccuugugauccacccaccccggccuccgaaagugcuaggauuacaggcgugagccaccgcaccuggcacaaagccuaguuuuaaggaaaggugguagaaagugaugaaauuauguccccaaaccccaacagcacaucagugguggaggcaaacuggcaaacacagauuuaaauuccuggucuuggguaacaguggcagaugccaaagugugcagauuuuggaacgaggaggagaaacaugaaccugaucuaggaaaaggggaaaacgcccacacguggguuguuaguuuccuacguucaggaaauaacagagcuagagggucugcuauaaggugacgccacauccccccuauaaagagggcaacugccaccaagaauauugaaggcauguggugaagucacaccccgugaaagguguguaccuccagaugaggagcagaacccucauaagcugucugaguaacugauauuuaucugaugauuaaaaauauuuucaaaguguaaauguuucaauaccccacagagacgcugaugccucauaaacacaacuaccugacauucagagucagcaaacaaagugaccuuucauccucauccuaaguccucuggucccugccucguuuuacuuggagcaugacacucacugccacgugcagaaucuuacagaaaugugaauguaucacaagaggaaaggcagccauucauuaugcuguggagggggugguaaagaaauugcucugcucagccaagcccccaguggaaaccccaagggauaugcaggcuacauauuauaaaaacgcauguauguauuucccccauaaaacaggaagaacauucccagauggcgaccccaaagcaguauuucaacaaaaaugauagcacagccaacuagcccagucuucucuguaaguaacuuacaacugcuaaguuuucuuuugguuccccugcuucccuucaaaauaaagcacagagcugccacuaucaauaagaagaaaaucagaacauauaacucuaagggaaaaaggggucacaagccaucaaguaguucaacagacuaauccacaagcuguggguuacuaggcuccuggggauagugauucaaguccacacacuguuauucaggcaauucucuugcccuagguaucagguuucccauuucugcuaccaauccugagaaauggagagaaacuggaggcaauacaguaaguccaggggauggaaaaugcagccuuuaaauuagggugugcauauguguuuauguguguguuggggguuugcaauucuaauugucuaacaaacuuaguaacuuuauagaaauguuuguagugggacaugcucuaaauaagaagguaguggcugacagauugcaaacggaaccccuuuucgagaggugaacugcugauuguuaggcgaggacaagagacucgaucugccaaggugagauuuccucccaggucuggcagugaaucugcaacugaccauaauucacuuuauugguuuagcucaugaucuucugguuguuaacuuuuauuugaaacuaauuauagauucacaaaacauggccaaacugguacagagaacacccuauacccaucauccagcuucccccauauauacaucuuacauacauacaauacaauggcaaaaccugaaaaucaacaucaacacaacacaauuuacuagaccacagucauuacugggaugucaccugaugugguuuggcucugugucccuacccaaaucucauauuaaauuguaauccccaauacuggagguggggccuggugggaggugauuggaucauggggcugguuaaaaacagcuuagugccaucccccuagugcugucucgugauccaguaugccuaagaucugcuuguuuacaagagcauaucaccucccccuauucguccuccugcuccugcuaagauuugccugcuuccucuucgccaugauuggaaguuuccuaaggccuauccagaagcagaacaugaacacagaacaaugagccaauuaaaccugcuuucuuuauaaauuacacagucucagguauguuuauauagcagugugagaaggaacuaacacaacuugagaugcguuuauuuucuuugcuguaccuuugugcauaauucuaagacauuuuaucauguguauguauucauauaaccaucaccacauucaagacauagaacuguuccaucaccaccaagcaaaccaugacuuucauuaagaaguguuagaauuagcacaugccaucuagaacaugaaaaguucaggccucguucagucagagccugcucucuucauuggcaaaaccaacccuuuaguacgucagaguggucaguaagacgugggcugaauuccuuagcauggcucacaagauccucugcaucaaucaggaugugcuucaguaaggaacaacccccaaaucuccauuaauuagaauaacccagaauuaugacuugcucacacuucacacucauuguaggucagugggcccagcucaccguggccacucagggaccagguggauggagccucuguugucuguaacacugccagccucuacggcauguggaaggcaauguggugaguuacacguggcaucucaaagacuuccacuuaauagugacugguguugcuucugcucacauuuccuugacaaagucauguggcugugccuagcuucuagaaggugcaacgugcuauguguccagaaagaggagaaauaaaaacagaaagugaggaacaacaacaacuaacucaguccaugacuuggucccugucuaccucucugggcuuguuucaggccaacuccuacuucacacucacauccauuauaaaaaaaagucacaaagacauaugaauaugggccauauaaaaaagcaucuaaaauauaacuggcugggcauagcagcaugcaccugcuacacaggaggcugcggcaggaagaucacuugaaccuggaaagucgaggcugccgugagacaugaucgugccacugcacuccagccugggcaacagaacaagacugucugaguaaaaaaggaaaagaaaaaaaucccaccaccguaaaauaaacugcuagccuuccauauaucccucauuccuuccuaccuauaugucuauccauuuaucuucccaccuaccuauccauucauccauccauccaaucauccauccucccaugcuuguuuaaccaaaagagguucugagaucacugaaucuugaaaugcuguaaaauggcucucaaaauuuuccuuccccaaaucuucauucuuccuucugaucacaccaguacaagcuuaucucaggcaaaacagaaauguuaauguauuuuaaauuauguauacagacucuaccuacccaucauuuuaaaacagagccacacagguggcaucccacaugugaagcaucaggcaacuucuauguagcucagaagcccacuugcucccaacauccagggcucagccagaaggucauaaucaaacaacccaggugcaugucucccauuucccuugaauauaguggcacucaucaguagcacaguucacugccaccuuaauacacuaagucuucuucaucuauucuuuauauauacugaaaccuguguuagugacucaagagucuguaaguguggaaucaaagggguuucuuguuguuaugcaacagugaucucuaguaucauuuuaugacuauaaauuagccauaugugacucugaugcgauacugccugaaaccaaagaaaccauauggggagugugugguauuuaaacagagaaauggggagauauugucauugcagcaaagacaccagagccaggcugcccuggaacuacagcccaguauguccaaugcacuggcaacuugacuucaggaaagcuacuggaaggaucugggcuucaauugccuuaauuaugaaugagcauaauaguauugccuucuaugguuagagugaagauuagauagagugaauauaagguacaagccacacaaugggcucucaauauaugcuauuaucauuauuuugaaggccacugcuaaaaugugaugaccauuguuuuccaauaauaaugcauauuaauaacugugggucucccuuguuuucuuuuuucagggggugguuuggggcugggcaaguuacugcuucuuguauauuuaguuugcuccucugugaagugggaguaauaacagcaccugcccuaucgggaagucaggcaauguaucuaaagcaguuggagcagaacaugauaccugaucaguaguucauaacucuagauccuuauauugugauuauguauuguuuuaucaucgugaucaucacaaugcauaagaugugguggucaccgcugaaugggugauaaaccauucagcccuauccuuaaagagugcagugcuucacucuucacugauacggcugaaugggucgucacuggcccaaugauaaaagccaucucaaaacaacaaccauuucaguccuugccccacagcaguuauuuaucccuauagcaucuucgcagggugcagucauuauccaccuauuucacagauggagaagcugagguucaaaaggcucaugcacagccgcaucaagauaauaacugcaaagccaugauucagcccaacgcaagauuucaauugcuauuccauauuccauuauguccacacuauguaccuguccucucaucccccaacccuccuugccccuuagaagcccucauggcagcugagacaaagaccaagaaaaaccaucagaucuguaacugccucaugcuguccugcucuugguaacccgguagcccaaguacacuucuccaguuucccucggauacaggggcacucauugguagcacaguuaacagacaccuucaauacaccaugucccaaauaagggagaaaacauuuacaggacuaaauucauguacucauuaacacugccucuaaagaugaaugcguuuuccagauucaaucuccguuuucuuuucuccucuccauccuuccgacacuucaaaggcaacgucucaugccuacauuaugcuuaccaauaaugggaggagaaaaaacaucucaaggcaacaggccuuuagaacauaggacaggaauaauuccagugaucaaaccuaguuuucaaaaccacaaauuauuacuuuacaaucauuguuaauugcagauugccuaggaauuagcugggaggguaucagugaguucgcucuccuaucccauuucucgccauagugaacccaaguaguuggucugcugcccacauguugggucuuacggagcaugcuucaaaauacucccaucuugugcaugugggccuugcguucuccacuuaccuccaacaaaagaaucccuggcacagacuuuuggcaaaucuagcagcacaaagcagcagcucuuuguuaugcuguguuggaagcaucaucacuaugugggugaaauaaaggaacacgucgguacaguggcuggagguggaagaagcccagguacacuagauggcuguguugaacguggccuccauuguaucuggaggaaauucucuuuuaacugggggacuacucaugugcaacugcagagagaaggguugcuguuuacagggaauuagcuauuuugugaucucacuucaagguacccauugaugcugauuggauggcaguguaucuaccccucccuuacacauacggaaaaacuuauuuccagaaucucauuuaaaaagcucuaauuugcauguauuuauugaucauaaaagcaacaaaaauaauaagcacugaugacaugcuuguuuucauuuaauagugauagcaaauaucuucugaagcaucuauaauuuuccccauuuuacagaugagaaaacagaggcugagugacgugacaguggccaagcuaguaagacacagauacguguugccaacugagauguggcugguuccaaugcucaugucgucacaugacugccacacugggcuguuccccugucgucauauucuugaagacguaacaccgggaagcucugaagaaauuaacaucaucuauauauucuuauuugugucuguuuuauaucauauuuauuuuacccaguuagaauuuacaagagaaguguuaccgcugaaggagaaaauguaagcacggcaauaaucuacacucagagcuuauugcuaauggcauccugcaaauucuaauccaaugggccuuaauugcauuaugcugaugucucucacccuuccgcuuuacauacucucaguccugauuuuauguucuaaaaccuuaaauaggagcugucacauuuacaacagcaagagacacuggcguugagcacaguauugacaugacauuauucacugaacuacaauagaaaucuaacucaacugguuuaauaauucaucaauaucauaugugggacuucauaacacuaauuccucuaauauuauuuaaguaaugguaacgguggcaaugggugaucgcaucuucacuggaaaaugcauggggacacaguugcuuucauugacuagugauucuuuucucucuuagucaaaccugaaacagcaccaugugccagucugauggggaguuugacccaucuuugccaagccuaaagaugaaaaguaugcccucauaaauguucuuucugauaggauucgcaggaaaggggaguuugagagucucuucacugacuugacacauuuuaucacuuugcuuuuaauaaacaaacacuuuuggagaugauuccacauuuuaaaacacagaaccacaccaaaaaugaucccuagcaaagcccuggauuuccuuuuuuuuaggcagggggcagggcggggggacgcagggggauucuugaagaacagaggcugaguuugccauuccuaaccuucaaaucaaccauccagcaucaaccuucacuccagggcccuccaucagguccccuuccuaccucccccugccaaaauacacaaacaucccuaauaagaaaaugaugacaacucuuccuucauuacauacaggccaaaauuuuugccuuguguugcuggaacucaauuuauaaaauaaccgugucaauaucuauagguaauucuaagucuauucaaggagaaauugcaccagauaacagcuuauuuaauuuaguauaugaguugcgugccauggaaagcaaaacuauuaaaaaugcuuagacaguaauuggcaauauuuugcaauccggauaaaaaaugcuuauccugccagaaacuaauaagagagcgaaaauaauccaaaaccuuccuauuucccucuaugcaauauauucacuuugcagcuuaaaaacaguuuaaggaaggacagugaaugacacaggagguuggcagucaacaugauugugcauuuaugccuugcuauugaaguaagagcuuuuuuucauagugaauuuuucauucuaauguaagugaugauuuacguuaacuauagguaaagcgugguuacauuuuccugaaggauugcaggcaaguaaagaggaguacaauaaguugaagcguaaaagcuuucucugucauaauauuuauuauaauggcauauaaaauagcugaaauaaauaauagaugacuaaagguaaauucauaugauaaagaauccuucagcagacaccauuacuuuugacugcucuaguuuuauacacaguugaagacucuuaauaaacaugcccuauaucuuaugcaaguacugcauacaucaaagaucugcuuaaaaggcaacguacuggacaucagcuaauuuacugcauaauuacauucucaacagcaacagucuguauauucugaauauuuaauagcuguguucuuaaugaaacuuguuaagcacuggaacuucccacuucggggaagucagugauaaaagaaaaaucagugccccaccuccucgauucagaaagacguguagcuccaaacacagagaucugggaucuggugauugccgcaagucgcaagucaauagugguuaaauucaauaaaaagacaaaaacaagauuugucuguucugguucaaaggauuuuacauuccacacgguggacuugggaaaucggaaugauccucaaauggagggagauggucucaguuccagcuguugggagggagagaacuauacccugauagcccagugugagcagagucugcucugauucucaaccagaggccauucuaacugcuagcagacaucugcuaaugucuacagacauuucugcuuguugcaacuuguuggaaagugaacuggcauccagggggcagaggucagggaugcuacucaauaucuuacaacgaacagaacagcccccauaacaaaggauuaucuggccucaauagucccgaggaugccugcgugugguuugucauaggcacuucgguucaccccaaguggucaucagcuauuuauacuuacuguuaguugcaaaaauaaaacugguucauuguauuacaaauaauacagaaguugauaacauauaaagugaaaacgugccccaaaguccuacugccccaagauaagaacagggacagccugguucaaauccuuccagaguauauuuucuacccauguaaaaacaucgugcaacuuuuccuaaaaacauaguauuguaguuccacuaaagaauguucaaucauucauuaaaaaccgcccccacauacuucacuagcuuugugaacuuuuuacuuacauucucuaagcgugagcuuccuuaucaguaaaaacagaaauuacagaacaaucucuuccuugaaguuacugugaaaauuccuggguaguaucuacgagaagcggcugggcgugguggcucaugccuguaaucccagcacuuugggaggcugaagcggguggaucacuugaggucaggaguucgagaacagccuggccaugauggugaaaccccaucucuacaaaaauacaaaaauuagccaggcauggugacaugcgcugguaguccccgcuaauuggaaggcugaggcagaagaaccacuugaaaccaggaugcggaguugcagugagccaacaucaugccacugcacucgagccugggcaacagagcaagacuccgucaaaaaaaaaaaaaaaaaaauccuauacauguuacucauuguuucuccgguaauauuauuuuauguuguuuccaauuuuguuuuguuuuguuuuguuggccacugaaagcaaugcugcaauacaaauacuuaggaaacuauaauuuuuuucuuuaagaugaauuccuggaaguagacucacuaggucaagagauacccacauuuuaaauuuugauagcuuuuuacugaggguccuccaaaaagguuauaccaauuuccauucccaagaagccuacggagacuaugaaagaaaagcaaaacaaccaauaauucacacugacauuuaucguaaauuaaaaaguacaguuucauaucugugucucuaauaccugaugcacagucaauagcacugagcacguuuucaggacaggcuuuaauuuagaaaaugaaugauugacuguuuaacauaccaucaaauauggggaaaagccauuaaauagaaaugcaaguaggcuacucauaguggcagcaacaacuuaccauaagccauuuggaaacucaggcauuucuccugguucuucaggcuguuuggcugaaugccggccucucggaaguuggccacacugcgugugacggauaugugcuugguaugcagaauaugcaguaaacguguaacaguaucgucacgcuugagaaaugacgacgacgguuauuuuuacuuuacagaugaaucgaaagagauaaaucuuucagaggaucuccagaagcaaaggaggauguuuaauagauaaacuggaaaauauuuuuaaaugugcuucggaaaaaaauaagguuuccugcuuaaaaugguaucugccucgcagugguuuauggguucccaccauaauaccaguaaagacagaaaauguagacaggcgcaguggcucacgccuguuaucccagcacuuugggaggccgagguaggcagaucaccuaaggucaacaguuugagaccaggcuggccaaccuggugaaaacccgucucuacuaaaaaugcaaaaacagggccgggugcggagacucgugccuguaaucuuagcacuuugggaggccgaggcagacggaccacaaggucaggagaucaagaccauccuggcuaacacggugaaaccccaucucuacuaauaauacaaaaaaaauuagccaggccugguggcgggcaccuguaguuccagcuacucgggaggcugaggcaggagaauggcaugaaccgaggaggcggagcuugcagugagccaagaucgcgccacugcacuccagccugggcgacagacagaaacucugccuuaaaaaaaaaaaaaaaaaaaaaaaaaaaaaaaaaaaaaaauucaagacagaaaaaguugaggacucaaaacaccauaaacacaaaaagagucaucaguuuagccaaauuuugugcgucauuuggaguagcuacaggaccaaauaaauuauacugaaaaugaauuuaagaagcaacuaaaacaacacuaacaagugaaguuuguuuuauggggggaaggauuucacugauccauuaaaucaugcauggucuggcuuuguugauuagaaugauagacauuaaauaacuugauacucuaagaaaaaauuuaaacauguacguaagacuuucaagacuaacagggagagaggaaaacagagaaagacagaaaggaagaaagggaggaaagaaucauuagcuuccaaaugagcaacagggagaaaaaaugauguauggaguaacucagauaaaaagaaauucuaucaauuccaaaauaugccugguggccaggcauaauggcucacgccuauaauccccacacugugggaggccaaggcgggcagaccacuugaggucaggaguucaagaccagccuggccaacauggugaaauuccaucucuacuaaaaauacaaaaauuggccgggccugguggcacacguauuuaaugcagcuacuugggaggcugaggugggaggauugcuugaacucaggaggcagaguuugcagugagccgagaucaagccacugcauuccagccugggugacacugagacucugucucaaaaaauauacauauauaugcucagaaaaguuuaaaaauaagaaaaacuugguagugaagaaaacacaaugaaauacagaaauuauuucaaauuuaucagucaucaaaagaaacaugaacuuaaauucacacauugaaaggcagaaaccaagacuagaauuaaaaaaaaaaaauaguucuaugcuguuuaaaaaagauacacugcagauagaacuagcugucccucagaauacuucuccucuuuccacagcauaggaaaaagagguugacuagacagaaagccacauuuccuaacccacacugcauugaggugagauauuuacauuuccacuaauggucacugagcagaagagaauguaacuccugggcuauuucucauaugaauuggguuccccauacuucaaccuuccaugagauaaacguuaaguuauaauaaguuccuaggggacaauacagccacuaaaugaaaugagcuuggauauccuacucaccaaauagacaaagccaacugucaaucagagacacccauguggaucugugucuuuacacugaaagacuuuugguaaaauugugcucugccauaacucauaagguagaucuaguaccuauugagucugaagcucuagggaagagcuaaaaugucauugugugcuggcugcuccacgcugcuuuuacaaagauauuacaagaaagagauguguuccugaaaaaaagcauuguccagugugcaagcagaaaugaaaguuaggacauuacagaguugaaaaagucaauugauucuggaguccaaaaagcauaaaauaagccugcaaaagucuuugagagacaauagcccauuaugaauucaaauaauucagcccaguagcauauaucagauuaaugaugcuacuuuucaaaccaagcucauuauuccaaauagccucauaguagcugcuacugugcugaaagagaggcaugaugauaacaaauuagaaaaauaaagcaacuugagauucaagucuaggaaagacugguguggccacuacucaugaauuaaugggaaacaaauacaucugaauccuauaagauuauuaagaaauuaaauaaagauuaaucugaccuuaaaagccuauaacugcuaaaaacaaaaaaacggagccucaaccaugcaccagcaggaagugggcugacagcugcuaauuccccuaaggagaguaacccuucucuagauccaguucagaugggaccauggaggauaauggacagggcacuucccuccagagagcagauuucagaccuggauaaagaaugcucucuuacuacaagguucuuuaccuccccagcgugauucuaucauugacugucauggagcaacauguuucucauucuuuucuuuugaaaauggagauuuugcuacugauauucugucucuacuccaccuucuauuauauagagcagcagggggguagacggcaugaaugggcugccuuucugaaacccacaggaccauaaggaaccauaucuaagcaugaaggacacccuagaauuugcacagaaucaaagaauuaaaugggauuuugagacucugccuuuggaagaaaagugaauauguucucugugugagaauaagggagcaaaagguacuuguuguccagaugugagaacuguaauggagacuaccagcuguucacaaaaaucccugugccuuaguuugcagggcacucaacuagauucauugcccagucuccuucacaauuaggcauagccgugagacuuagaguuggccaguggaauauaaaucuaagggagguacacuucuucaaggccuaguccauaaaacacucacaugucuauuuccagccucaacugagcgcccaauaagcacuguuacauaagcuggaaauaaauuaccauuguguuaagcuauuaaaacaucagaaaauauuuuguccuagcagcuauccuugccuaccuaacacacaugauuaaaagagagaaauauaaaaauguuaaagauaaaagauaaaugauaaagauaaagaaaaacaucaggaacauuuugaaagcagaauagcuaguauagcaaauauuaacauaaaaauaaaauuuuaggcaaaauaaaaauaaaaaacacuaaacacuaaagauaaaaauggaugaugcauaaagggaaaaauaauuaagcaagaauauauaacaaucaugaacuugcaugugccaaauaacacagccauaaacaaaaagauggauuuaacaaucuuaguagaagagauuaaccauuuauaauagaaauaaguaaaagacaaaauggaauauuuagauaaaauggucaacagaccauuaaaagaguauaaaccaacuaaaagagcuacagaacacuacacauaaaaauauggauucuuuucauacguuauugaaguuaaccaugagccagaucacaaaggcaguuucaacauacuucaaauuccugccaucacaaaaaguacacuuuuuuacugugaggcaguuaaacuagaaauugaaaauaaaugguuuucaucuuaaaaaaguuauauccaucuguagagagucauagcuaggaaguggaugcacaagaaaauuuuaguacagugaugucaccuucagcuaaaauuugcaaaacaaugacauucaugcugaggaacugugcguaucaacuuaacucauauacuuaaguaaaauuaccuagguaugucaaagaucauguuacacacucuaauaacgauuaguuugaaugcuaauuaaaggaugaagaacagcaaagaaaaaagugaggauaacagcaagagauaauaaaagaaaggacaaacaaguaaaaaaaaaaaaaaaagaaaucacaacacagucucagagcaaccugaccucuaaacguucucuaugucaggaaacaaaauuuuuagaaauguuggccaucuuccauuuuguaugcaucucaaugaaacagaaauagaaaacaaaaacaaacaagaauaggcugagaaaaacuggaaggggguuaagaaugcauugcccccccccccccaaaaaaaaaagaaaaaaaguuuaaaguuuaaaaguuuauagagaaacuaaaacucacauuggcagauggugaagaccagaauugaucccaagaaaaauaaucaguuauaaggaauggaaacuuagauguuucucccagaauauggagaaagacaaaagauagacacaauaagaagauuaaaaaauaaauaagacagaauccauaauuauauccuaauaauuacaggcauacuuuaagaacagaacagaagaauagaaacauuuaaaaugacauaaaaaaaucaaaaaaaaaaacaucguagauacccccagcauacgucucucauauauuucucuccuuuuucccuuucccaauguaaacgguauuuugaauuugauauuuauccaaugaauaauauuaaugauggccaauucuuacacaguacuuacuauguacugaacucugcucuaagaacacuuacauaugaauuuacccauuuaacaacucucugagguaagugguaauaucaucccaucuugcuaaggagcaaacugaagcagagauuagcuaacuugccccagauuguaaagagaguuuacaaucuuugcuuuuggagcaaagauaugcacccagauugucuggcaucuagauccaugcccuuuuuuuuuuuuuuuuuuuuggagacagucuugcucugucucccaggauagagagcaguggugugaucuuggcuggcugcaagcuccagcucccaagcugaagcgauucugaugcuucagccucccagguagcugggauuacagacaugcaccaggacaccuggcuauuuuuguaguuuuaguagagaugggguuucaccauguuggccaggcuggucucaaacuccuggccuuaugugauccucccgccucggccucccaaagugcugggauuacaggcaugagccauugugcgugcccuuaugguuuccauuacagcacugugcugccucuaucauuccuauaugauaggccaucaccauacacauuacuauacacaacuguauccacaagcaacguauuuguuggauuuuaacaauuggguuuaauuggauuucugaugguguuuauuaauccucccaccgagagagaccuuucuggagaaauuggucccacaauaggauggauaacaguauguaaugaaaauguuugccucuuugaguuuugcccagacauuaaugagaaaucaguccagccccucaauacuguggcaggugcacuuguguggccagcgcaggccgagugagcugccccuccuugguugcauguugugccugaggagacucgacccuaccaguugcugcauaccccuucauucuuaaacucuuuauuuugguucuucucuuuauaaucuggaauaagucuuccacuaacuuagucaagaaagcuaaauggaaagcauuuccugagucuuuuuuuuuccacguuuuuuucucuugcuucacacuuaaaagauaccccugaguaugaaauaugugaguuucaguguuuucacugcaauauucuucacuaucuuuuggaacuuacugugacagaggagaaaucugacaucacuguguaaacucagaauaaugucuagcacacaguaagcccugagcauacauuagcuaugaugcuccuaauuuuccacauuaaugaguuuuccuuuaauguguacaucacaaguucaaugagaaaacaaacucuaaagaagaauaguuaaaaaaaaaagggaaagaaaaaggauagaggaaggaagaguugagagaggaaggaaggggauuagauaagaaggggagauggggagacugagaaaugcagagaaaggcagacaggaagucuaugaggagcaguagagagcaacugacagucgcacacagacacagagcaguggugggauguaccauucugucagugcacacgugcagccugcugguuugggcaccggcacagggccacauucgaaucuggcucuguagucaccuaucccauggcccaaugggacaaaugaaucgcgauggguaauuuugcuaaaagccagcuaaguugcagacugcacguguugcaaagagcaacccaggcagcauuagaggggggaggggaagggaggggacaccaccuuacaaauguccauuagaagccacuucacgauggcaugcauguuaauacacccuggccucagugcaagcucucccugccucuucaauauuuaugaacagcagcuuccuuuuucuccuugguuugaggauauagauguucucuaugggaagagcuucuagcgcuugcagccuuaugggguggcccagagcuuuuaccacauugaaaagaggccuuacuacauuugguacaucaggaaaaccaaaggacagcagugacuuuaugaguccacacuccuuucugggauaucaggucuacaaagcaucccccagaagggcauguggggaaauuguggcuaagggccauauguuccaguuaacuuaaguaucaccugucaucacucauauaggaccuacaacuuucuccuccauauaaauuuagaaaauccauuccacucauguuaauugaaggcuuuugagaacauaaccucuguucacagaaggggagauuacagacauggccuuauucuacgcuacugagcccuuacaaaguugacauaauuacuucuaguuuauaaacacaacaaaggcagaaaaagcagcgaaaucugcucaaaaaucauaaugagaagcuggcagaagccgggcacagaggcucacaccuguaaucccagcacuuugggaggcugaggcaggcagaucaccuaagaucaggaguuugacaccagccugaccaacauggugaaaucccgucuccacuaaaaauacaaaaauuagcgggguguggugucacgcaccuguaaucacagcuacucaggaggcugagacagaagaauagcuugaacucgggaggcagagguugcagugagcugagauugcaccacugcacuccagccuggugacagagcgagacuccaucucgaaacaaaaagaaaaaaaaaaaagagguuggcccaaaugggaugguaguucuccguccauugugacaagucaauucuccuuccaaaacaguacugcugucuccaugacacaaccuucuccccagccuggaaauuaucccugagcccaggagauuacaaaggggccacauccguaaauacuuuacuuacaaaaauguuguucuguccaugaacucgaagccuuuuacaccuuuuuucuguuuuauucccaggguguccaaucuuuuggcuucccugggugacacuggacaaagaauuaucuugggcugugcauaaaauauuaauacacuaacccuaaugauagcugaugaguugaaaaaaaaauggcaaaaaauaucucaucauguuuuaagcaaguuuauacauuuguguugggcugcaaagcuguccugggccacaugugcccacaggcugcagguugaacaaauuugauuuagaccauuaaaauuauaacuuuucggcugggugcgguggcucacgccuguaaucccagcacuuugggagggcgaggcaguugaaucacgaggucaggagauugagaccaaaguggcuaacauggugaaacccugucucuacuaaaaauauaaaaaauuagccgggcgugguggcaggcaccuguaguaccagcuacuuaggaggcugaggcaggagaauggcguaaaccugggaggcagagcuugcugugagcugaaaucacaccacugcacuccagccugggcaacagagcaagacuacgucuuaaaaaaaaaaaaaaaaaaaaaaaaaaaauguaacuuuugugauacaaaaaaaaaaccccagcuaauuucaacuucucuccuacauccaccccccaggcuuuggauuaagcaaguuugaaaacugagucacguaugauaggaacaguuucuauauguguagaaagaaaauacuaauccaaccaccugcucauuuugucuuaacauacuuuucuuuccaaaugaccacgaauccucuagaacagagauuggaaaaccuuuucucuaaagggccagauaguaagcauuuuagauuuuucaaguaucucccaaauacucagcuuuaauagcaugaaagcaaaaguggcaacagacgagauauaaauuaacugguauuccucuguuccaguaaaacuuuaauuacaaagccaggugcugggcaggaauucugucugaagggcacaguuaguugaccacuauuuuagaauaagaguguaguccccugaagucuaacagucuuauaauuaauacuacauucagguuccaaugaaugcaggagaagaaaggagaaugucaugccauuccuuagagugucuguuguuuuaucacccacuauuugaugaaauauacaauaaaaaaacagccuaacagucucaaacaacgugaagaguuaaggauguguggauaggcauaggagggagcauaucuaaacacuuugccuuguaaaaugugucuucuauuaaauaaucuaaaaguuuaacaguauuucacuucguacauaacagcguuaaauguuuucuaucauuccacaagucuucuugaacaugaaagcuuuuugaaaugcauuuuggcaucucuaggaauuuaccaaaaauggucaguaaauugaaauagggguuucuagacauuucccaaguaugcuaauaccugggcauuuagggugcuaagaacagacauuuuccaaugggccgaaagauguauucccugauuaaccagugauacuuuccugaaucuaggaaaagaagcuucaaaucacaagccccaucuuggccaccuggcacaugggcauaauacuucuguccaguucauaugcauuuauacuucagaaacccaaaccaaaacaacaauaacaaaauaauguuucuguaaggaaaggagaacuauacacuuuccucuuuacuggagaaaagagaguugcaaaugaagacacagaaauuugguggggggagccauagaggaggggcacgcagaagcacacacaaaaaacaaaagaacaaaaaacaagaaauaaggagauugcuuacagaaaaguuacuaaugaggcuauuucuuccacaucuggcaaucuguuccuaaucuaaacgacagcaguagauacaaggugguaggcagucuauagagccacuucauaauguggaaagaauuacaagcaacacuaugauucagggaauuccagaauccuacuggggacagcacauauggaccuuccagcaggaaucugaaucuuuuugucauuauugaagucauguucauuguugcccagauucaguugcaagccuuguugggaaccacaguuuauuggugggaugcucugugugccaagaacccuagcaagcaccugauuuagacggauguaaauauuucucaauaaacagaacccacuauccagcaaguaaaaaagaaaaacaaaacaaaaacauaaccaacagcuggcucacggcauuagcuuccuccagcgguuucacuuccauggaugcguuggagacaaucacacugauaaugucagaaggugacacagacccaccaguuacucuuggcaggcacuaaacugggcacuuugcauuaacauuuauuucuucccucaaccucagcaucuucaagaaguagguauuagcaucuucauuuugcaagugaagaaauggaaaucacauaacuuaagcucauaaacuaguuggagaaagaauuugaacccaagucuaaccggccccaaagaauuacccacagcucaacccauaguacacagaaaauacuaugacuucagcugugacuaucacagacagaagaaagguuggggaccaggaacaucuuuguaaagaaugaaauuccagguaccuagacagaaugggauaaagacaagaaaaaucagaaaaaggccaaaacgacugcauguaggaaaaagcacagaaaacaccuuguucccuccugcucucccacgaucuguaaucagaugcuacacuguucccuggaagugcagacauacacaggguagcacauuaauccuucaaacacuaacagaugcuggcagggauuuagacuggaauguauuuacaaagugacaaauuauguucuguauuauagagaaagagcacccacaaacaggcugauaaaugucagcugcagucacgacaaacaguuuauuuuuauuauacuguaaccacaaauuuuuuuuuucuuucccauuuuuuuuucuuccggagucccaaagauuuauuuguugcagggagaaaacaaaauuauauaugacacaaaguaauaacuguaagaucagauauuccgggcacccugcccuccuggaaaagcuacaugcaggcucaacaguacuacuaaaaaugcugccuucuccaaagccaaguaaaugguuaauaaaucagaaccgauacaaugccuuguaauuagauacagccuuaguucagagaccaaccaauugauagacaauauccaauucccccuuuaguggcuaucaggagaguagaguaacuauuaaaauaaauuuaauggcugugacagguaagaaaauauaccagaagcuaaaauguaaucaguauauccaaacccaaaauaaaauuauagucuuugcugcaaacagggucgcuggaaaggaggguuacggauagagagcgacauccacaggccaggaagggcaaggucacuagcucugaaggaaccuucaaccuugaaaacaagacugaguggggggauguggcacggggccaagagaaaauguaagcauuuauuaaauuguuuugaagaauuccucuugcccacuuggucagucggaugucagcaagagugacaggcauucuuccggaagcaucacaacaagauggcggagagacggccuggggucuccaugcugggcuucccauccaggcccugccucgaacucugcacaugaccucgggcaaguuccugcucuccaaccucauccuacaggaccucacugucuccgcuguaagcuggagggguuugagcucaugauguugcuaacaucuacuccagagucccauuucuuguuucuaacagguugaggguuggcaaauauaggaagguuaauagaagaaccugaauggugguggucaaguauauuuagaagaaaggggaauaucuuaccuucugggacucucagauguggauuucuuaugaaaucauucugaguuaaaacuggccugggacaguggcucacaccuguauucccagcacuuugggaggccaagcugggaagaucaguugagcccaggaguucaaggacagccugggaaacacagcaagacacugucacuacaaaauuuuuuuuuaaauaaucagcuggaagugguggugugcaccuguggucccagcuacuuuggggucugagaaaggaaaaucacuggagcuugggaguuuggggcuggagugggcugucaucgcgccacugcacugcagccugggugacauauuaagaccccgucaaaaaaaaaagcccucaaaaaugccccaaacuugcacauacucuaaaagcaacauuuuaaaaauauauggaauugacaggaauacauuuaaagccacaauucacacagcacggugaacacacagacacauacacacacacacacacaaacacauacacacacagugaccacuggacggaaagauguuucuuuuuuccuaauacugaauaaaaaagauuuuaugguggaauacggguguggguaccacugucauuagggagcagaaggaaagucuucuccccuacacauggaacugaagacuugaauauugccuaaugcuggggaaggaaucagaggccuuccucuggacacugucccaugcaaccaucugagcaggauaacauucugacaccaccaccuccuuuacgcauuuagcaacuucggaaacucacuucccucaucuuugcaagcaaaauacuaguaucuccuucauaagauugugagaugauuaaagaagauaaugcuugugguauauuuaucuacuggacacauaguaaguucuucaugaacugugucuacuauuuuuagguugaggcuguuuccuggaaacccuccaagccccguccaguccuaaaagaaauaaaugccucuccuacaagcaccaggauuuuuuuuccuuucuuuucuuuuuuugcagggugggggguagauagagucuugcuccauugcccaggcuggagugcaguggugccaucucagcucacugcuaccuccaccucccgaguucaggcaauucugcugccucagccucccgaguaccuggaacaacagaugccugccaccacgccuguuaauuuuuguauuuuuaauagggauaggguuucaccauguuggugaggcuggucuugaacuccuaucaucaggugauccacccgcauuggccuuccaaagugcugggauuacaggcuuaagccuguaaugccuguccuguuuuuuucuuuauccugcuucacauacccaucaucaccuugcugugucucgucucuuguucuuccuacaagcaagacggacaaggcacacaucugauacuaacaugcucccacgaguucaguacaauucccuagauuagcacgucccuaacagcagaccuucaacuguucaaaaucaaguucucaccagccuauggccaccggacauaaaaaguggggagugaggaagaauguagugagaagaaaaaaaucaccccauuaaaauagcguccuucauagaagccaaccagaaaaagcuggaaugguuucagcaacagaauaaauggagguauuaauaaaucaaaaaaaaaaaaaggaaauaccugugaaucuacgcuaauauaaaguaauugaaucagaaauaaacgggggaggggccaggcgcuguagcucacaccuguaaucccagcacuuugggaguccgaggugggaggaucaccagagaagaggaguuugagaccagccuggucaaaguggugaaaccccaucucuacuaaaaauauaaaaauuagcugggcaugguggcauggaccuguaaucccagcuccuugggaggcugagacgggagaaucgccugaacacaggaggcagagguugcagggagccgauaucgcaccauuacacuccagccugggcgacaggagugaaacuuugucucaacaaaaagaaaagaaaagaaagaaaugggggagaagggauagcucuuucuucagaagaauuccaauuacugacuauaaaaagaguaagggaaauacauagucaccacuagccaagcaucaugguaaacacugcugcaggcaagauccaacaauagaaagucagcaugugaaaguuuaaggaaaacggggcugccagcaucaucucaaaacaucucccuucaaauaauuaugaauuucaaaggaaaaauuaauaacauuacauuggaaaaacucagcagacaucaccuuaaccaagugaucaagguuaacauuaccagggaugagacagaucaacauuauguucuaccugagauaauauacuaagaaagacaccacaucauuuuuauaauguucuugccaaaaaaugcuuacacucagcuaaugaugagaaaauacuggacaaaucaaggucucaagaucagaaagaaggaaauaaguaagcaacuaucaaagacugaaugcuccaagccaggugcaguggcucaugccuguaaucccagcacuuugggaagccgagguaagcagauuucuugagcccaggagcucaaaaccagccugugcaacaugaugaaacccugccuugauaaaacaaaugcaaaaauuagccaggcaugguggugcaugcguauagucccagauacucaggagacugaggugggaggaucgcuugagccuaggagguggaggcugcaguaacccaugaucguaccacugugcuccagccugggugacagagugagaccgugucucaaaaaaaaaaagcacuaaaggcaccaaggagauacaacaauuaaauauaauguggcauccuggacuagauccuggaauaaaaagaugacacugcuuuaguggugaaauuugaguaacaaguauaguuaauauuuagcaccauugucuauuuucuaguuuugauuauuauaccaugauuagguaaacugcuaaaauuacaagaaaguagagguacugugaaauauugcuauuucugcaacuuuuuuuuuuuuuugagacagagucucacucugucgcccagacuggagugcaguggcacuccgcuuggcucacugcagccuccagcucccagcuucaagugauucucaugucucagccucccaaguaucugggauuacaggugugcgcugccaugccaggcuaauuuuuguauuuuuaguagagacaggauuucacuauuugaccaggcuggucuugaacuccuggccucaagggaucagcccgcuucggccucccaaagugcugggauuacaggcaugagccacugugcccagccuacuucuccaacuucuaugugagucuaaaauuaguucaaaauaaaaauugacagaacaccagugaaauggcugucccuuagagcagguggauguccucacaauaucuggugucaaaacgcccuugcuuuuagaaaguaauauugauuguugaugggggaauaguguuaguuuuuguugauuuuugucguuguuuuuaauguguuuuucuuuugggggaaaaucuuuuugacaagcuuaaauugguauccuccuuuuuguuuuguuuuuaaaaaguuuguuuccugaaauccaaaauucugagaacugcuaagcucauuuaaaauuauuuucuaaugauugaauagugaaggcaaauuugcaagaugaguguuguucccuccacagaaaacuaacaaucuuccaagucacaaaauucauuccucauguuuuugcugugucaaaacaaaauuaaguccauagucaccucucccaggaagucuucccuguucaucccagaugggaauggcaucaugccuuguguguuucucacaccgaauuaugagcuucucaacaucagggcuucucaugcacaucacguugucucguaaaagguuguguuuuuguggcaguugauuuccacaaugaaaauuuauuuuuuuaaauguuacgguaucucuguagcuuuugaaauauuuaguauguuaaauguauuuuuuaaaucuugcuuuaacucauaagcuauaagaugcugaaaaacucauauucuaacucauuuuaagucuuuuuaucuuucagcucuaagauagauuaaaaaagaaaagguguuucaacgauuucuuaaguaccaacuaucgauccuuuauauguuuucuaaaugugcuccuuacagcaauuugggggcucucaugauuaguguguuaauaagaauuaagcacagcagaaaaaaacuuaauuuguauaugcuacauuacuaauuagccugagagcuuuagagguuuuuauguaaaaugcuaaaacuuuuuguucaaaacuuauuuaaaacugaaaagaauauuggaacaaauugccaagcaaacccaggccuucuuuguguuaucagaggagauaccagcucaccuagcaaguaauacaacucacuauaaaaugacaaauacaugauauggugaagguauaggaagguacagacacucagacacugcuacagaaagaguauauaugggaagaagcuuucucaagcauuaucuauuugcauuuaaacuucuuauuuagcccagguaaaccagcaacguugcucaugacugaaaaaauggaaaacagaaucugugcccagcaauaagggauuaauuuacuaaguuaugaagcuauaaugucaagucaguacaacuguacugccaaacaguauguauugacauagaaacauggccacuauaugucugguuaaaaaaaaaaaaaaaaaagaccacagugugauuucaacuuuaugaaauauauuugaauuuuaaaaagucagaaagagcuacacaaaauucacaguaauuguuccugacacaaggaacaauuuuucccucauuuguauauauucaacucauuuguauauuuucccucauuuguauauaauucauguacauacacacacacacacacacacacauauuauuuauuuuuugacacggagucuugcucuguugcucaggcuggagugcaguagaacuaucucggcucacugcaaacuccacuucccagguucaagcgauucucaguccucagcuuccugaguagcugggauuacaggcaugugccaccacacccagcuaauuuuuguauuuuuaguagagacaggguuucaccauguuggccaggcuggucucaaacuccugaccucaagugaucugcccaccucagccucccaaagugccgggauuacagguguaagccacugcacuuggcuauaauuauuauauuuacaacauugacuuuauuacugugcaaucaaggaaaguaauucauuagcagaguucuaauuuaaucaaauagauacguuuuguaugugaguguauaacauacaugaaugaauuuacugaugacagcacuuuuucuucuuuuuuuuguaaauacaagagguuaucuuucgauaggagaauuguugauuaauguguguugagaagauacuugacaauuagauuucucuguguuauuaaacauuuuaccuagugcaugaugcuuuuacaaaaacaaagaacuaguuccaaguguaugcagaaagaugaaaaaguucucgugcauaugguucauuauguguguucuacccagcccuaaugcacagcuccacaucuccggcaacagguccccaguuguaucagugacaaagaggaauaacuggccuucuccuacucaaugcguccaccgcuuaggcaagaaaacaggcacagaagucagccuaacugaguuugaaucccagcucugcuacugguuagcuauuuggaugcugggugauuaauucaccaaacucccagggaucgggugaaaugggaauaauuacacauacccagcaagagugcagcaagcuauaaauuagguaauaaauauguagcacccagcacugugccuggcauguggaagugaucaauaaucacagcuaguauugauaauaaccauccuaacaaugauaauccuaucuccaacaccacaaagcuguguugaacauuaaugauauggaaauguuuagcauagaauagcccacaaaugugucccagaccacguuuucucugauuaugcccaauucuaucccucaaaaaucaagguuaugauaacaucacaaagacaguguugcaggaagguuacagauugaagggaccaagugguugauucaaucaaucauucauugauugaaugaaccaaaauacaaacaccacuggaaagagaaguggcuaugcagggagaagcaagauggcacagugcagguuccuuugcauucuggaguguguuuguguggugcugagaaagguaaguaccuaugcuauucccaaagucaggucucaacagaaccuagcauguucuuugugcuaguggcucccauguuggcaugacaccaccauccagagaacccagcuagcaacucauaugacucccuucauaaggaguacucucaaacaucaggaacuuuacugcagugacucaaagauucaaacuaggggccacgaaggcucugagaaaggaaggucuaugccuggugucuccuggccagcaccccugccugggccuucuagaaauccaucccuguaucuugauaaauggaugucagcaaaugccaguaguacugaggcaaagguauacauggccauaaaaagguaggcaucauuuaggaauuggccauuuaauccuugauugggugaagaucucauauaacauauuguguauuggaacuuuuuuuuguuuguuuuuugagauggagucucacucugucugccaggcuggagugcaauggugccaucucagcucacuucaaccuccaccucccagguucaagaaauucuccugccucagccucccgagucgcugggauuacaggcucaugccacuaugcccggcuaauuuuuucuauuuuuaguagagacgggguuucaccaugcuggccaggcuggucuucaacugcugaccucgugauccacucgccuuggccucccaaagugcuuggauuacaggcgugagccaccgugcccagccggaacuuuuguuuccaugugauagucuuucaaagugcaccucucugucccacugcccugcaccuaccucuccacauucagagcacuggagaugaggucuaggguaggcgacuuacaacaaacuagagaugugucauaucuccuuccuuccugccuggggacugagauuuucccacggguccacaaauccacaggaaaguuaagcauuuuagaagaaggcuuugaaucuuuacuacuuaaauagguugugcucuuauuuuaaacaaguugaguauuuugaauaugugagacauaaaucaagguacacacacacuagaaaaagaaaugugauauauauguauaugauacauauauuuuauauauguguauaugauucacacaaauauacauauaugcauuuuuauuuauuuauuuugagacagagucucgcucugucgcccaagcuggagugcaguggcaugaccuuggcucacugcaaccuccaccucccggguucaaucgauucuucuuuuuuuuuuuuuuuuuuuuuuaggaaaaaaaaaucuugguggucauauuuauuggaagagcuugagaaaaacgaaaauaccauuuagcuuaagaaguugugaauuaucugcaaaucaacucauuucaggaguggaagaauccccagaauuauuucuuaauauccaaauguaugcggguuucucuuuugaauaucuugcacauuuagagaggccacuguacaaagucuccuguuuuccguacaggacaaauucuuuguuucagccaacucucaguggaggggcaaccaggaaaaugccaucuccccggagaaagaacacuggaauauucuguuuuguugauucauaugucucuucauauguuuccucaucaauuucuauaguagucacaguuucuuccacgucucccaagaucauauuuaaauguugaucauaaguauguaaucugccucgaagcucucggucguuucucauuuucacacaaauucgcuccucugggcugagccuaagauccaggggauccuccacaguguugguaguuugcugcuggucuacguugucugccauguuucaucaaguaauucuucggucucagccucccgaguagcugggacuacaggugcccgccaccacgccaggcuaauuuuuuguacuuuuaguagagacacgguuucaccguguuagccaggauggucucgaucuccugaccucgugauucgcccgccucagccucccaaagugcugggauuacaggcgugagccacugcgcccagcaccauacacgcauuuuuaucuauacacauacauauacguauauguauacauacuuuuuuuuuauauacagacacacacacacacaggagcaaugacuucagagaaaaaaagggguuuccuaauaguuacuauagagugacuggcagacaggaaccucauuauacuauccucucuacuuuucuuuucuuuugagacagagucucccucugugacccaggcuggagugcaguggcuccaucucagcucacugcaaccuccaccucccagguucaagcaguucgccugccucagccucccaaguagcugugacuacagacaugcaccaccacucccggcuaauuuuugcauuuuuaggauagacagagcuucaccauguugcccaguagucuugaauuccugaccucagguggucuccucaccuuggccuccaaaaguguugggauuauaggcaugcaccaccaccccuggcugucaucucuguuuuugaugauauaugaaaauuuaaucaaaaauaucaagaaguguuaaagacaggccaucuagaaaaacccaaaaacaugaaaaauagaaaacaaaauuuaacagaaugagagaacauaaugacaaacaaaacaguuuaccuaguuuaagaauauucuuacauugaaccaaaaaacaaaauccaacuauuuaucaggcaaaauauaauaaggaauucagaaagcuuaagaauaaaaugugauaaaaagccuuuaaaaguggcuugcuggauauuucuaagcauaugaaaaauaagggucucuucuaaacuagaaauguuuuccaguuguaauugccaguuuauacaaguuuucaauacaucaucaaaaaccagcaucaaaauuaaacugcaguaaugagcggauuaacgggcuucauuggcauuaauuaaauaaagugccugagucccucuggaaagucauuugacaauaugugcaaagucuauggguuucagucacauaccuacacaccugaccaaaaaaaaaaaaaaguuaagcacaucagcagacacugucuucucccuaugccaagcaaaaagagauuaaucccuuuauuucuggcaggggugggggggugcuggggugggcaccagcaaacguuuccaaacagauguuuacaaacagaagguaacugauaaaaaccaaaacacaaagcugcauugucuuuccugauucacagaugaacccacuggaacuacugcaaacagccuuucuggaaaacauccaggaauuaaaaggugcaaacaagcugccuaauacccuugcguagacugaauucuuaugaagaaaauaaaguuuauugucuggaaagagagaaagcaugaggaaagcacgaaagcgauggaggugaacaauuagacagauguucacuuaaggaaauaaagagaacagaagaagccaucacccaggaauuuuacgagaauccugacaacucggcaccacaucaagggcaaggguaaagcgaacgccacccaagcccaggcugugcaacuugacgcuaacugcugaccuugcagauccugccugcaggugauguggcucugagcaaaggcaggugagccugcucacuucaauaaguucuuaaguucuucuccaaggugagccacagacugcaguucuucaggacagaguuacaucucuaaucuucauaauauuacugcagguaauggcaaagauaauacuaauuauccccaagucuuugcauauugguaaauuccuuggugaauaccaagaauauagcuaaggauuauuucagaaagucuuuggcuugcuaauccugucccaacuggcuagaggagaagggacagaaaggugcuacguauugaacaucuuacaguggcacugcugcuggaugauuucuauuaaucgauagauuuggugaacugucuuucucuuggcuuacaccccuggaaggcucacagguaacucuucagcccagcuguggcaucuguucauagcuucuggccaauauuucugcacagugcuuuaccucucgauuuacuugauuuucccuuaauccuaauagccucaucugugucuuuuucucuugagguauuauacacgggccccuacauaaacaaucucaaauccucuuugcaaagcagcaaugaagaguugcuaagauagguguuaugaugaaaaggcagaaaaaggaaugcauaguuagcuggcuggcuggaccacaaauagaaagaucaaaggaaaacagacaguauuuuauuuauuccucauacaaaaaucugaguuacaaacugccauuauuuuacaaaagaagaaagacgaauaaauuacccauuccaguuaauuucuaagacugcuuuucaaguaagugagagaaauauuuuuaaaaaaucauuaaagaauaaaauaaacuauaagcuagugcuaugauugaucuuuucucuauacuccuauccaguuucuuuguacagccaauauucaaucaaccgccaauccagaaggaucuaucuaacucugcuauacacuccaaggacauaaaauaaauuuaagacucaugcauucuuuaagaagcauauacauuauagguacugcuguauguggaaugcccucuaccccaauauguucaugaacuaaucccugauaucuauaaauauguuacauagcaaaugguaauuaagguuguagauggcauuaagauugcuaauuggcugaccuucaaacaggcagauuaucccagauuaucaggguagacucccugaaguuacaagguuccuuaaaagcagaagcagaagagagagaaccaggaacagggcaguuugagaaggacuugagcagccaucccuggcuuugaagauagaggaaggggccaugagccaaaggauuugggcagucccuggaagcuggaaacagcaaggaaguggguucucuucuagaaccuacagaaagaaaugguguccugcugacacaucgauuuuagcccacugagaccuauuuuggaccacugaccuccaaaacuguaaaguguaacuuuugugugguucuaagucacuaacauugagaaaauuuauuacagcagagauaggaaacaaaauacaguuauguaacauguuuaauuugugagauuucacauugcacauccaaacuucuggcuccugugaaaaaugaagacagagaagccaaggucuggccugcauaugcucacauuuucacaaucgcauaggccgaggugcagcuguuccuugagauggggcacugacccucuugugcgccaccaucuccaccacucucuacugucucgcugacuccaaagcucuggaucaucaacugcucccaccaaacauuugaguguuugacucuugaucuagguuugaagaaaaacaaacauacugcugggcgugguggcucaugccuauaaucccagcacuuugggaggcugaggggcgcauaucaccuaaggucacgaguuugagaccagccuggccaacauggugaaacuacgucucgaguaaaaauauaaaaauuagcugggccuggugauacacgucuguaaucccagagacucgggaggcugggagaggagaaucgcuugaaccugggaggcaggguuugcagugagccaacaucgugccacugcauuccagccugggcaagagaccgagacucugucucaaaaacuaacaaaaaacacaugcauagccacgcagggcugauauucaggagcuaugugcaauauagagccagcaucugcuccgcuuagucaggauccaugccauccgugaauguuaaauauuuagaguagaaacagaggcagccugcuuccugaacauuccugccugcacaggggcagaccaccccucugccccaccuaaagcguauaugauauccccccucaccccaucccugggggccaggcaagguuucauggccauaguucuggcuaaaccaaugcagucgggcaucccaguuuucuaccugacacaacugcuggacaaucaguacuuuuuucugcggaauuauuauucugaaacucuuguagcacaaaaaaguaaagggauuuaaaggaaaagugauauggacuauaauuuagccucucuauauuguaaucggggagcaguguuuguuggggaugugaaucuuuccucugaaccagaaggaucucuguaagcucuugguaugugccuaaaagcacacacugcacuguaagaaaaugaggugggcaugauuacaggugugaccugauaaccgcugaaaaaaaucauccauccaauaaucauaugaagagauguucaauauccuaagccaucaagaaaauccaaaucaaaaucacaaugcaauaccgcuucauacccaauaaaaugacaagacuaaaaagaaaaaugacagcgagugcuggugaagauauggagaaaucggaaccuuccuacacugcugguuagaauguagauggguguggcugcuguggagaacaaucugguggcuccucaaaagguuaaacaaggaguuccacgugauccagaaauugcacucuuaggagcauaccccaaaaaagguaaaccuauauccacacaaaaauguguagacaaguguaccuggaagcauuaugcacaauagccaaaauguggaaacaaccuacauguccgugaacugaaugcauagaugaaauguggcauauccguaaauggaauauuacucagcccuaaaaaaagaaguacugauacaugcuacaacaugaaugacccuugaaaacaugaugcuaaguguaaggaucgagacacaaagggccacacaguaucugauuuauuuauaugaaaagucuagaauaggcaaaucuauauagagacagaaaguagaugagugguuaccuggagcugggagagagguugggaguggagagaaaaggaaguggggaaaaggaugccagucaaggguuucuuuuugggaaaaugaaaauauucuaaacuugacuguggugacagcugcaaaacucucugaauauacugaaagcacugaauuguacauuuugaaugggcaaaguuuauguaucuguguuauauaucaauaaaguagcuugagaaaauuuacaaacuucagcucgcuaagaauuucuaguaauaaaucacuugaaacauaccucacaacugauggagacauaucaggcaacuauugggacucugaugagauuguggauugagaaaaguaugguaaacccauaugacagaauauugccuagcuguuggagaucacgguaagaaacuuaagugacauggucaaauguuugccauuuaucauuaaguucaauaaaaagcaggcuacuagagaauaauacacaguacgauguuauuuggcuuaagaguguacaaaugcaggcauauguaugguaugggcauuagguaauucauagaagagagaacacuuccauaacacaaaccgaaauguuaacagggauuauuucuggggaaugagacugagucaaaagcugagcccagaaauacaaaaucaauauagcucaaaguugagucauuguuuuccaaucacugggcuugcuaaaauuauuucuacacugaauuugucaccgcaaggcauugcuguuucaucggugacaccugcacuccaagcauaauuucaaucacugaaacaauugcaaauuucaccuggcugaugaaacgucugggaaggaugaaggauugucggaagggugcaccauuagggcucauaccaauccauggauaaacgggaaaagguauggcaaggcugugaagguggccugcagcaccaggcaagacagucagggccauguaaucucacaucagcugacuaggaccuccuccuggcuucuucuaaaggguggggcaaggauuaagugagauaaggaugcagauggucucugaaaagcaugauauccccgugcaaacauuaggcagugguauucguuauagccucauccccaacuguuguuagcuggauucuguuuccccaaaauucauaugcugaagaccuaacccguacuaccucagaaugugacuguauuuggagguacggccuauaaagaggugauuauguaaaaaaugaggcuaucagggcagguccuauugcaaucugagugguguccuucaaagaagaggacaucugaacacaggaaaagaaaccagggaugcgugcacacagcggcuaggucacgugagaacacggugggaaggcggcugucugcaagcagacgagguagaccucagaagacaucaacugugccggaaccuugaccuuggaauucuaggcuccacaacuaugagaaaauguauuuuuguuguucaaguuauccagccugugguauuuuguuauggcagccugagcagaccaguacaccggccucuaucugcaauguggcccucguucagacuuccucuuuuccccucugcugggcuauuuuccacccugauuucugacccucuguugccuccauuaauguaucaccaccacaaaaacucacuaacaacagauacaagucuuucuuucucuuauauuucucuuguauuuugcuuauagcuaccugacccuccuucccaauuucugaauuuaagcaucacaucagggcauggcacuguggcugacaccuguaauccuagcacuuugggaggcagaggcggguggaucucuugagcucaggaguuagagaccagccugggcaacauggggaaagcccgucucuacagaaaauguaguaauuaacuggguguaguggcaugugccucuagucccagcuacugguggggcugaggcaggaggauugccugagcucaagaggcaaaagcuacagugagccaagauucacugcacucaauccagccugagcgacagagacccugucucaaaaaacuaaaauaaaauaaacaccgcaucaguauauguaucgagcucuuuggcucuaugaucuuuuuucuccuauuccauauuaucaacaaccuaucccccuucccacccucaagcuaucugcugggaugguucuuugccacucuuuccuggauauaagugacauuacagaggcagcuugacuuguacguaaccuuucaaauuccagcuucucuacuuacaacccucuuuauuacagucacaguacaugaagucucuucugggcuucugccuuguuaagaagaaacacagcuauggcccagaagcaaagguauuuucauguugacucuagaccuuaggagccucagcucuguucccauugcagggagcaauaauaaaagaacuauuuccaaguuugaauuaaacuagacuugagcuuuguggguuaggggauggaagcagaaagguauauuuuuaaagagaaaguuuuauauuccuuuaaaacuugggcaugauuuuaaaagaaucuuacucuuggccuuucaggcgagccuucauaccguuaaacagaauaagaccauaguccauauuguuuuaugaggaauccacuuuuaagauauguacaacauuuaaggaacauuaaggaaaguggaaaaugaauuccuuccagaaaagcuuuaaguagagauaagaaaaaaggccagagguuagaaauauuucuaaaauuauaaucagaaauugccagggcaacuauuuagcagucucaugaauagugagugauaugaauuauuuuucuugaccuuuaauaagauaguaaugcaauuaauuucuuaaaaagauaaaagugaagcauauuuucaaggaauauggagaacacaaguucauuuauuuauuagacgaauauuuaucaaguaucuccuugggcuucggacugggaaggucaggaagaugcaacacgccuaagaagcucaggaacaugcaagaggugugggugucgaggagggauagcaaugauauguggggggacauuguggggguaacagcgugacuuuaugagcugucaagagugcugugccaaagacauaugaggugcgaauaaccugggaccaacaccauggacagauacuuggaacuagacauauggauacaggagucauauuggaauggauuugaugacugaaaucuugggaauggguaugaucuacaggggaaggagcauuggccagagggagaaagggucaacaacagaauugugggggacacugacauuuaaaggauggaaagagaauggagggggcgggggaaggagauaauuagaaagagaaggaagacaaaguuuaaaagaagcuauggcuugauugugacgaugacugcacaccugucaauacacuaaaaaugaaacugugugguauaugaauuauaucucaauaaaccuauuaccccaacccccacaaaaacgcaagaaagagauaugaccaccgggcgcuguggcucacaccuguaaucccagcacuuugggaggccgaggcaggcagaucaccugaggucaggaguugaaaccagccuggucaacauggugaaacccugucucugcuaaaaaaauaaaauaaaaauaaaacaacacaaaaauuagccaggcaugguagcaggcuucuguaacaccagcuacucaagagacugaggcaggaaaaucgcuugaacccaguaggcagagguugcaguaaaccaagaucacaccacugcucuccagacugggcaacagagcgagacuccaucucaaaaaaaguaaauaauaaaauaacauagauaugagcaauaagcauaguuuucauguucaaaaucauuacucaucauacucacauauuucacaauuaaaaaaaaauauacaacaaaauaccacuauguacccaaacagaaaauuuagaagaccaauaauaucaaguauuauuaaggauguagaggaaguggauccuuaaacacuguuggcaagaauguaaaaugggaugaccacuuuagggaaguauuugccaaccucuuaaaaaguuauacauagcccuauacggaccacccugcccauuccacuccagaguauuaucccccaagauaaaacagauauauguccacacaaagacuagugcaucaauauucacgguggcuucguucacauuaguauccauuuacaacagcuaaaaacugggaagaacccaaaugucuaucagcagguaauuagguauuuuuaaaacaaugugauuucuccacacaauggaguacuacucaccaaugacaaugaguaagccacugauacaggcagcaguauggguacaucccaagguaauuauguggaaugaaagaaaccagaugcagaacaaguacuagaaaacuucacuuaucuaaaauucuagaaaaugcaaauucaucaauagugacagaaaacagaccaggguuuuccuggagcugaggcugucuggacucagagucauacaccacagaaguggcauuugaaaucuuuuugaggugauguaaauguucuauuuuuuuuauuuucguguugguuucaugggcaugugcaucugucaaaacucauugaauuguauauuuaaauggaugcaauuuauuuuacauaaauuagaccgcaacaaaguugaucaaaccaauccaagcaaguaagcaaaaggcaugugucaaugccucaaauuuuuccuuuaaaaaauaucaaagugagcauucaaauggcccacucugcuuucagaguuaagaacagcaguauuaauggccauuucacugaguguguacccauaucacaaacuguauaagggacuucccaugcuuuauuuuacuuuuuuuuuuuuuuuuuuuuuuuugagacagggucuugcucugccacccagacugagguguagagacaggaucacagcucacuguagccuugacuucccagguucaaacuucccaccucagccucccgaguagaugggacuacaggugugccauuacacccgacuaaaauuuuuuuuuuuuuuuuuuuuuuuuuuuuuuuuuuuugguagcgaugggguuuugccauggugcucaggcuggucuccaacaccugggcucaaguaaucugcccaccuuggccucgcaaagugcugggauuaaagguaugagccagcaugucuagccuuauuuuacuuaauucuauuacguugguacaaaaguaauugugacuuuugccauuaaauaagauugaagucucccuuuuauagaugaggaauacgauguccagagagguuagcuugcuggagauugugcagauguucugcaguucugaggccugcacucuguauacccccauguacugcuccucagccaccugaucgacuugacagucauacuaguaccaccaauagccauagucaacuuuaugagaaaacgacauccaggacaaucuccuagguacuuuagguccaugacgcacaauacuuuccacaaccaucuuaucaaguggggacuaggcuaaacucccguuuucaccuggaaaaauggaagcuugcucagagagguuaagugacuuuccagaguucccgcagcaaggaagugauaggaucaagaauggaacacaagcagucugacccugaagcccauguucaccaaacuaacuucuucagacaucuuaggaaggccugacagauuaacaagagcuugaugcacuuuucucuauuuuaaauaaggaacaagugagaaaguacagcuuuaucagggccaaauggcaacugacuugggaaguuggaauggagaauucuuuucagucaauuccuucccuucaaaugaaguauguguguaaaaaccagcuaagugcccagcacauagguacucauugaaacugggguucccuucuguacagccaguaucuaccgaaguaggggaauaauagccaagcucugcuaauucacacgauagagucacaggcaaagauucccauucaugguaaaggugaauggcauuuccuguguucauuuaaauaaacccugguauagacccagccaucuaagcagaaacauaagagaacagguuccucgugguaauuccaucuuccuugcuggaaaucauuugaaaauggacauugggagcuagauuuauauggccuauuuauuuaagcaaauaccuuucaaauaaaaaaauacaaaauugacaaaugcagauuuuagagaaauuaagcaaugggugcuaucacuuaccagaccacaaagaaaugcuuaucaccuggaguccucugggcccagcauauuuauucaucauccugucaaaacgcugccauucacucauaaauaccagccauucuccccugcaccugcccgaggaugaugcucagucuggugaaacacuaauuacgcaccuucacccucugcccuuaggaugauauaccugaccguggugacgaagaauaauggcauucuggaacauuucuugauggugaggagaaagaaaaaaaaauguggggugaugugggaggaaggagccggcaugaggggcagaaaaagagcaagggaggaaggcaaaggaagaaagaagaugaugcaaccacauuuagacuacauugcuccaaccaagggucaucgucauugucaucauugucaccaucaucauuucucagcagaaggaaaacuuuucaagcccaaaacgggugucauauuaauauuaaagcagcugaaugacaaagaacugagagcaagucacuccuuuaguccuugguauguccaccaguuuaggaaccaaaggucaucucccaaaugaaugaccauuaaagaggucccuagccgggugcauauccauacacaaaucugcuaucuagcacaugugcuauuuacagaaauauacuaaaauacuguccaugaagccacguuuccauauccugucccuuuaaagaguuaccgccucucagcaccugcacuagauuugccauaaugaagacucaaggggggcugugcccagaagcuuuaagacccagcucagagcaucaccuuacaugaugagaggcgaggaaucugaaaacaagggauauacaucuucaggucccaccaaaaauggugccuguugacagcuggccaucagugauugauugagaauauggaaauggaagcaugagaaaaaugaggaccugugcacugaccguuuaaugugccuagaagcaaguaggcgaggaacguggcgguggguuauggauuaguuugcucaaucagcacagcaucaugggugacaggcaacuuucaacagcagagggcacacacacagaauaagaagacccuccacaucggggacacugcugagagcccacagaggacacccagaaagcagagucauggugucauuguacaaucuugcauccugcuguugucucaugaggcuuauguugacaagaaaacaaaagaaaaacaagccaacauggcagugggaauguugcguggccuacuggauggccaugguucacgucaaaggaaauacaaauacaaggugugcugagcaguuuuuuuaugugccaaaauaccuuuauugucaucugcaagggccuaucccaaggugagcuuauaucuccaagaagaugcuucaguuucaugaaaugaacucagauccucuagcacaaaagggaucauucuggguccccucacuaagaaauauguggcucuccugcuacuccgacaccucgguguugauggcagaaugauaguggaaugggacaaucugguggcuuguuuuuagguacccuuucaaaccugcaauuuuugggaguaauggugcuaucccuggggugcaaaugucuaugcauaugguggaaagcaugccugggaaucagauucugaugccauaaguucugugacacauuuuucugggcuucccugucucacuuggcuggaagucaugcuucugggcuagagaccuuuagugcucucccaacacccaugugcuucucacaucucagccucccucauaauuacauaggggccagggacucacucucgccaguggaauguugauggaagcaacaaaugccacgugcaaaccugcccauaaaaaaugcugcuucauccuguuacagaguccuugacuuuggaggcuauuuguuuuagaguguagcuccaagacaguggaguccccuucaagucugccuucacgagugguuguguaggguggaccuuccagccaacucacacuggauauguaaugaaaggaacaaaucagcguuuguuguaugaagauaaugagacguugcaaguuguuugucguagcagcugacacuuauguacccugacuaaaagaccccagaaagguccccuccaaauacaguuuucugauaaagcauucagccuuccuuuuucaauaguuuguauuucuucuugaacauuuucuugagacauagucucauucugcugccuaaauuagagugcaguggcacaauugcagcucacuguagccuugaucucccaggcucaagccauucugcugccucagccuccgaaguaccugguacuauaggugagcaccaccaugcccagcuaauuuuuuuuuuccaaguagagaugaggucuugcuauguugccaaggcuagucuucaacuccuguaagacaagcaauccucucaccucagccucccaaugugcuagaauuacaggugugcaccaccaugcccuguuaaccuuccauaaauauuccucuagauuguggagaggcaaaacccaauagggacucaucuauuuggccucagacauguccacaucccucagcaacacugaccugccacccauggagguuuccacacucgaugcuaugucucaccugugugcucuugcucaccuuucccaggagguuucuccugcauguugcccaccuaucccaucuagacuuaucucagcaucacuuccuguccacucccucagugacaauagugauucagagcuccaaguacacagacaccaagaaacuuaugguuugcugcucaaauuuucccaaauuguucucccagcaaaauaaaacauaauacucacgucuaagacaagcuuaaaagaaugaguaacauaaaaauaaaaggaacaaagaugguggauuauacauauugauuuuuuaaaauuuucaucccaaaucacacuaaaacagcaguaacugcuauaaaacaacaugacaauacaaaucaaagauuauucaauauaaaaauuuaaaguugaggccaggcacagcgauucaugccuauaaucccagcaguuugggaggccaaggugagagguaacuugagcccaggaauuacagugagaccagccugggaaacaaaaugagacuucauuucucuuaaaaaaaaaaaaauuacaguuggaugcuggaaagcagauggacaacuaggaagugacuuaagagagcugagucuuaagcuagccauggggacagcugagaaguaacacaauuccuaucagagagccagcaaaggcucagaaaauguggaaccugguacuucugaaaaugggguugaaagacaaccuuuuagaaaccugugugucagcuauguacagcuugagaaucccuccccacucagcccagcaggauaccaucauuucauaacuccagaaaaaugacagaaguuuauuaucagaagagaacauaaacaggugagaacaguggcaugauacugaaaacacagacuuuguaaauguuuaccuacugaaugcagagacucagaacucucccccucacuuggcucuagaacucuagcagucagagcuacaccuuccccaagcagaagauaagaagauccuucugugggauauuuguucugccaacaggacacaugcaaacauucaaacacagugguuuucccaaaaaauaguccagccagaucauccuucagaggaguccacaguuaacuggccguggccaugugcuaagaguuggcagcaguaacuuugaauucuacuuagauagaaacagacauccacagaucagaacauuuggggaaagacuuuaucaagaggcuagguguggugguucaugccuguaauccuagcacauugggaggcugagaugggcagaucaccugaggucaggaguucaugaccagccuggccaacaggguaaacacuucaucucuacuaaaaauacaaaaaauaaaaauaaauuaguucggcuuggugacacgcacauguagucccagcgacuugggaggcuaaggcaggacagucacuugaaccugggagguggagguugcaguuaggcaggaucacaccacugcacuccagccuaggugacacaguaagacuccaucucaaaaaaaaaaaaagacuaucaucaaacacaauuaccaaaagaaaugaaaacaauuuugagaagauagaaacuaaacagaaaagaaaaauuaaaacaauuaucauuaacaucagagaguuaaaagaguaacaucauccaugaaacaagaauagaauguuaucaaacauaaaggaaauagaaacgucccccccccccccaccaaauccauggaaagacuagaagaacuaucccugaaaguaacacaaagacaaagauaaauagaggauaaaaauacuuaugaggccaucugggaggucuaggaucugaauaccuaaaauucucuugaaagggaacagucuccuauuuggauagcagcaagggguugaugauaugccucccauuguacucccaagagagaagcagauagaaaugaaagagaacagcggucacaaggguuuguacuucccgagaacaacacagaaagccacaaaauagaauuuaaaacucugaagcaaaauugauuuuaaaucuguaauucuaucccuaacaaugaauaaaaugaggauggaacagaaacauuuugaaaccugaaauacacacacacagacacacacacauauucuaucauccuuuuucagaaagcuacuacaagacaugcucccacaaaacaauaaccaaaccaauacaggaaaagauguggaagagaaguuccaacuccggguacagguaaaugaacuuuccaggauacaaugugagggcaguuuuaaaaagaacaucaccaaguauuccugugcaccaagcaaaaaggacaacaaccccaaacugcagaagguacaaaggcuccaggggaguuguuuuuuuuuuuuuuucuaauaaaaggaacugagauuuagacaaucacaugaaaguuugagguugaaugauagguacaucacaaacucagcaaauuucuaaaaaaagaugaguauuaacuccagggaaaaaauaaggugcaggaaagaaaaauaaucuugauaugcuacauggcauaguggugcauacacuuacuuauuuauaacaauuuaaacaaaaaaaacugucuucuuaaacaucauuauacaugauaucacuauauggauaugaugcagaaauaaaaaagaugcacaucaucauggggcaccaaaguagaaggaagcuaaauuuccuucuuauugaaaaaccuacagauaauaucuaagacuagaaaaugaagaaguaacaguuuacaugcaauuacuuaaagcuacauauauaaagaccaacugaauucacuaaaugaguuagaaaugaagaagaaguugaugcugagggcugcuuuaacuuuuuacguaaaaauuuaauagacauaccugacuaacuuuaaacucuguacaauuuuuacaaaaagaaaaagaaaugaaaagaauagaaugaaugaauggcauagcaaaacauaaaaauggaagaagaaaacagaaaaagagaagaaauaaaaaggcgguaacuuguaaacauguagacaaucacauauuaggcuuaaauuacgacagagcacaaccuggauuucucacuauuucuauuuuucaacugaauuuauagcagauuaugguauuuuccuaucucuaacuccgucagaaaauucaggagaaaauaggcauugaaaaaauaauucucugccuugaacaauucucugguuacuuguggaaacuacagaauuucucucuguaagaauauuuuaugugcccuuaacuccauaaagauaacaauaauaaaacaauuuaacauaaagacauuuugucccccaaaagggcaaaaaaaauaaacagacaauuuugcaaggauaauauugcacacuuuacaacuggggaaaacaacaauuuugucucuacagacuucacauacuauucaaacucucagcagcugggaauccaugaggguguuggugucuacauuuccaccugcucacuaggcaguaucaggcaagugauaaaauuuugguugcugaauacgauaguaaauuugcaugcugcuuuauuuaauucacaaaauuaauuuuuuuaaaaguuuguuuccaugugauaaauucauauuaauaguacuggguacaccaugugaaagcaaaagacacugccuaaauuaguuaccaucucuccuuuccagaaggcuuuugaucugucauguuugauaaaaauaauuuuauauauguuuuaaaagaacaaaagaaacugcuauccucaucagcuugguugccaagugaccugauaaagcaucuugugaggucucuuacugaugaagaccccagcaagagacacgagguuagcaggacaggcacugccaggaacagagagggcgcuucuacaucagcucuaccacugaggucacacggcucuccacuucuucaugguggaaacaaaagggaaauaggauagccaagaaacucuagcuucaagauucaauuauaauugcuggaggcaucuuggaguacagggauauuucauucugagcacugagauccucuagccuaaagcgccuaaauucucagaaggacuuugcuggggaaaugaggacauggccagauaguacuuuuaauaacacuuucaggggacuuuuagaggcgugaaacuacgcuguaugaaauuggaaugguuucacuccauaaugaaaugacagacaccugucauuaugcauugaacaaaccuauagaauguacaacacaagcagcagccccucauguaaacuauagacuaguuaauaauguaucgauauugguuuauuaauuguagcaaaugugccacacuaaugcaagauguuaauacccucauaccaggggcaggaccagggaucaguggguacacaggacagcauguacuauaugcucaauugcgaucgguggguacacaagaccuuauguacuauauacucaauuacuuuguaaaucuacaacuguacuuauaaaggaauaaaaaaacaaaccaccuucaaaagauucugucugcaggauuccuacccacucuuggucaacacauugagggauuugcuaauaacacagucuuacacagguuauaaacuggcuaccuaccacaaacauguuuucuuugaacugcagaguguuuaaaaauuuaugaguuaccagcuacuuaaaauuaagauuauccuagggucaggugcacuagcugacaccuguaaucccaacccuuuaggaggccaaggcggguggaucacgugaggucaggaguuugagaccagccuggccaacaugcugaaaccccgucuguacuaaaaaauacaaaaaauuagccgggcaugguggcgggcgccuguaaucccagcuacucaggaggcugaggcaggagaauggcuuaaacugggaggcggaggagauugcaccacugcacuccauccugggaaaugagagcgaaacuucgucucgaaaacaaacaaaaaccuaggaauaucuuaauacuauaauuguaaaaacucaggaaauaccauuuuuauaagccaaaacuuuuagccucuaauuuuuaaaaaaauuagaaaagauggcagcucugggucuauguucccccauggcaacaggcagcuggaacuaagaaguccuuaccucccaaaguacagauggggacuguguuguuugacagguccucaacacucccuauugucuuccacaagacuccuuugcucccucuguuaucugccugucaacuguaggcuuuuuuuuuuuuuuuuuuuugagacauagucucucucugaaguucaggcuagagugcaguggugagaucuuggcucacugcaacguucaccuccuggauucaagagauucuccugccucagccucccaaauagcugggacuauaggccacaucaccacaccuggcuaauuuguugugguuuuuuuuuuuuuuuuugguguuauuuuuguauuuuuaguagggaugggguuucaccauguuggucaggcugguuuugaauucuugacuucaggugaucugccugccucagccucccaaaguuguggaucacaggcaugagccaccaugccuggccuguaggcuuuucauuucauuggccaagacaaguagcaucaacaucaccuggguaccuuuuauacauuuagucuuuugguuuuuuuuguuuuucguuuuuugagacagacucuggcucugucacccagguuggagugcaguggccugaucucggcucacugcaacaucugccucccagguucaagcgauucuccugccccagccuuccaaauagcugggacuacaggugugcaccacuacacccggcaaauuuuuauauuuuuaguagagauggaguuucaccauguuggcaaggcuggucucaaacuccuggccucaagcgauccacccgccucggccucacaaaguggugggauuacaaaugugagucaucaugcucagcuaguaccuuuuagaaacgcaaguuuuggggcccaccucaguucugcagagccagaaccacacgaacaugagucugucucagaaucacauggaagacuuguuaaaauucggauugggugaauuccaugucuuuucuacugugaaaacugcugcagucaacauacaugugcauguaccuuuauaauacaaucauuucuauuccuuugguuacauacccaguaaugggauugcugggucaaaugguauuucacaauagcaaggacacggaaucacuccaaaugcucauaaaugauaggaugaagaaaauaugguacauauauaccauggaauauuauauaaucauaaaaaggaaagagaucauguccucugcagggacauggauggagcuggaagccguuauccuaggcaaacuuaugcagaaacugaaaaccaaacacugcaugcucucguuuauaagugggagcugcaugaugagaacacauggacacacgguggaggcggauaacacacacuggggcuugcagguggugggaagagcaucagcaacaacagcuaauggacgcugggcuucauauccaggugauaaguugaucucugcagcaaaccaccguggcagaugauuaccuauguaacaaacuugcacaucuuacacauguacccuggaacuuaaaguuuuagaaaaaauaaaccucagacugcaggccccaccccacaagcuucugauucauuauguguggaauaaagcccaagaauuucuaugucuaacaagcuaccaggugaugcugacacugcagguccaggggcuacuuggggaaccucuggucucugucuucguguaucucauaauaaacgcccaucucacauuuugcugccuuuuuuuuuuuuuuaaaaaaagaugguaucuccucaaugaguuuaauuuucuuccucuuguucaggugugauuuggugauuuuguguguguguguguguguguguaugugugugugugugugugugugugcguguguguguguguggaggggagacuuucccauuuuccuggugggugguuuuaauucuuuggaaauuucucccauauggguuagcauuuuguuuaguuagcuauuuaaaaacaauguggcuuuuucucuguggaaacugggucauuuaaauuaauucuuggauuuauaauacauauaauuaguucccaacaauacacaacucuauguucuguuugggaauaucuugauuacacaaaugugaaaauaauugaacagaaugauggcuggaaaaacagcauuaaaaaauaccccauuucugauauuuuugccauuaggcuaugaauuguguaacaccucaccgaaagugcuugcuguaucuuuaaugguucacucauagcucagaguaaagucugaacuauuuguuguucgcuguuguuauauucuguuccaagguucauaauuugaaaaucgacuuuggggacuuuuugcuuggucuauuaaaaugauucauguugcauucaacauaaauugugcauucacggaggagggugagagcccguauucacagcauaauaacuaaagugaauuuuguacgagccgcaguuuguggcagcgaugugguaucauuugucuuaauuuuucuuuggcauuacauuaggcgaaugcauuuacauuuccagguauggcuaaccacuuuaaaaacuuuguuuuuauagugugaguaaagggggaaucaaaucugcaucuuuaugcgauguaacaucaaauaaugccguuuuacugucuggaggacgaggggauuuacauuccauuuaccugacuucacaaaaggaacucaggcugauaugcaaaguacaugaaauauuuaccaucaguggaucacgcaagguuucuaaaagagaagaagagggggaggagaugauaccuuuucugcucucacuguguuguucuguguuuuuucuuuuuaacaguaccuuaaaugaaacuucuuaaauggauuaacuauuuaaaauucaaguaugucuucaagaaaacaaaacgccaaauaagccaaaacuuugggucacguuugcugaacagaggaaccauuugaaauuuuauuucauguguaucaagucuauguacauacauauauacaaacauauaugccuccugcuuaugaaguauguauucuggagacuuaaugaaguacuccuauaucucaauuaacaucaauuaagaugaauaucuguuuauguauauaugcauguuuuagcagaauucuauaaauaugauauacugauuauuucacauugacggacaaagcaaaaagaacuaaucuuaaauucugucaaaauauuuuuuaccaguuaaacuaaguauuacaucagaacagauuacacucacuaaauaccaugauuauaaugguugauaaggcaacuuuuucuauauaaacauuaaaauaaaauuuuaaaaaauguaacacacaccauagaaaauugaccagguuugguggcucaugucuguaaucccagcacuuuggcaggccaaggcaggcggaucaccugagcucagggguugagacaagccuggccaacacggugaaacgccgucucuaccaaaaaugaaaaauuaccugggugugggaguaugcuccuguagucccagcuacccaggaggcugaggcaggagaaucgccugaaccugggaggcgaagguugcagugugccgagaucacaccacugcacuccaggccugggugacagagcuagacucugucucaaaaaaaaaaaaaaaaaaaaaaaaguauaaugcucuuccaugcuacucagaauacccaagcgaagaaucuugguuaaaaagauuguuuuauauuauaaguacaaggguucugagcaacagaacaugguuuaugauuauuauaguuaagauuauaagcaacggaaacaucuuaguuugcauugcaacuuuacacugaacugugcgacaugaagcaauuuuaaauuucugagccucagccucuucauuugcaaaauggggcuaauauuuccuguggaacccauguuaguaaaguucugaaugcacacuuaacagagcaaaaggcacacucagugauccucagucaucaugacauuauuauaacuacaguaaaggcacuaauuugggcaacucucagauuaucauauccaaucacaaugacagagaggaaaaucaucagaucauuaaccacccaaaaaaucaguuuaccugcccgcuuaauugaacuauauaaauacuugggguggacaaauggauguuuguucuugagcaaauggaauaagccuuucaccuuauagcauguacccaaaagaucucggguuuucuuuaacauccuucuuuuaccuuguuagugcaggaauucaugcagcccauacaaaucacaggcuacuccgcuggaggagugucccgugcccucagauugcacagaggaaauacccauucuuggcuagaaggcacucauaauccacugggguguuucuuaagcuuuaacuagucaaauaauucucugggaaggauuuuagaaaugcggaagcagagauucuaaaauaguagauccaucugggaucugggauucugucucuuuaggcaaguuuccagucuuucugggaaaaagagauggcaaaaaaggcuugggguggggaaagacauaacccaggauguaggugggcacaaaacaagguacaaacacaggacacccaaaccuaaguugucuuucauggcccagggaaggcuugagcugagccucaacagagaaacaguaaucagacucccugagagcagcuaaauggcguuccaaacuugaccuuccucggcucugauguacugcuugaggacacagcuuuggagucagcuagccugguucaaauuccagcuccaacuucucccuguuggcacauugcauaaccucucuaaaucuuaguuucugugucuguaaaggggggaauaauuugaacagacaucugacacguuguuggaagaauuaaauaaagcaaugaaugccaaugcauaugccacaaagcaggcacacaacuggcacuucguaaaauacuauuaauauggacaaaccaaugucuacacagcuagaggcauuuaagaauguguguaucaggauaacaaaacucuuucccugucuccugugucauuuacagucaucacccaugaacccagugaaauaagcaaggauagggaggauuacucugauuuuacacaagggugguuacagggccacgucugugugcugccugguagacucuccuacuuacaccuuuguaccuauacaaggaagucaaagcaaaaugaauggacaaaaacuagcuauauuacgaagacggucuccaaagaaucucaccuacauauaaacuggaaaauaagacacugucaugaaguaaucuguauuagaauguaauugguuuauuaccugguugccuguuucauuuggaccugaagggguuauaaguugcaaaaauuacacagauaaaaauaaauaugccaauauuaccuucauccuuaacuaucauuuugaaaaucgacgugacuucuaaauauuuuauuuaguaacaaaugcaagaaacgcaagcaugaagaagcuaacacccucagugauaauuucugcaaaugaauauuuuaguugcaacaaaaagccguuccaaauuacagacacaaaccucaaucgaacauauucagggaccguagguguuaaaaaaacagacuuugaaaaaaaucuauauuuuaaucuuuuggggggcagaaacaaauuaucuuauuuacuacaugaaugguuuacucaauuuaacgccaaucuuuagcaucaacuuccaccugucugaauaaauagacugcuccagaaaagacuagauuauuuguauuaugagguuguguuuaaaaauaaaguggagagacuaacuguauugaaaauaagaacaugcauaucaucucagcuuacaaaaaucuaauuuuauuuucuucuguuuccaggaggaaguuugaaaguacaaaugaagucguaaauuaaauuccccuuugagggugacugaaagaagugagaugaauauuuaaacuucacugacauguucagaaaaauacacccacauauaguugcauagaaauguuacucccugccgggcacggugguucacgccuauaaucccagcacuaugggaggccaaggcgggcggaucacgaggucaaaagaucgagagcaucccggccaacacggugaaaccucgucuccacuaaaaauacaaaaauuagcuggcggugguggcaugcgccuguagucucaccuacucgggaggcugaggcaggagaauugcuugaacccaggaggcagagauuguagugagcugagaucacgccagugcacuauagccuggcaacagagcaagacuuucucaggggaaaaaaaaaaaaaauuaucacuggugaaauuuucucuuuaaacacauuaauuuaggacauuuacauagagcuuuggcuuguuggaaauauuaauuuucuuuaauuugugguaaaauauacguaacaaaauuuaucauuuuaaccacuuuaagugaacaauucaguggcauuaaggauauuuauaguuauugguuuuuauuaaguuaaaucagcaauuauaaaaaugaacacuuguuaguaugcuauaacuucaauuuuuaaggaauguuuucaaacguuuaggcauuuagguauuuuaaacauuuacgcguuaaggacaaccaucuauagcaaugguuauuagaaaaagacaaaaagaaagcaccaggcagugacucaugccuguaauccaguacuuugggaggacaaggcuggaggaucgcuugaggccaggaauuugagacuuacuauguuacugugggcaacauagcaagaacuugucucuacaaaaacuaaaagauuagcuggucauggugguacacgccuguagucccagcuacuugggagguugaggugggagaaucacuggagccaaagaguuugaggcugcagugagcuaugauucuaccacugcacuugagccagggugacaaagcaaggcccugucucaaaaaaaaaaaaaagaaagaaaaagaaaaaaccaucaaacauaaaacauaaaacagaccuccccauguauauguuggcuacauuggcaagaauaacagagcacgcuuccccacaacgguuucuucccuuaagcgugugcaggaaacugcuauauuuuacauagguugcacuggggacauugccagaugccacaaaguucauccaaagaccuugcaacuuggccucauaggccacagucacacaccuacccaagaacuacaaagguaggucacauuugccacgaagccucaagaacuauuuuugcuguuuauuccaggcuacuggcgacagggucagcaaauacagaaauuucacucugucuggaaccuucgugguggagguuguucuaagaaacaaaccacguuuuuugcaucccucaucauuucauauuucuaucagagagcccuuccccaaaugcccacagaggagaacuggcuggacaaaaguagccagaggaggaaacuaccaucucaaggaaaugagaaccaaacguucaguccaccgauaccaugggguugcaauuucacuuuaacuguuucuuaugauaauuaaaaauauaucagcaggcugggugcgguagcucacaccuguaaucccagcacuuugggaggccaagguuggugaaucaugugagaucaggaauccaagaccagccuggcgaacaugcugaaaccucguccuacgaaaaaaaagaaaaucagccugucauggugaugggagccuguagucccagguacucgggaggcugaggcaggagaaucgcuucaacccagggggcagaggcugcagugagcugagaucgcaccacugcacuccagccuggaagacagagcaagacuguuagaaaagaaaagaagagaagagaaaagaaaagaaaacaaaagaaaagaaaaaagaaaaacacaucggcaaaaggucaaccacccugagaccaaggccaggaaaaacuggaggugcugaggguguggaaaugauuuugcuuggcuucaagagcacuuuucagcagaagucccagacugcuugucaaaaguccagucacaucagcauuaucaagaguauuucuguucucucuuaguaacuuucauugcacuaacuccggauucaucuaauuuccacauucgaucuuauuuaucuuauucuccuuugaauacaggccuacaauaaauacuuguugcaagaauaaaguacuaacccuuugcagcauucuuacaggauuaucucuauuaucaucaucaucuuaccagcaacuugaaaugaaaauuaaacagcucauccaaagccacagaaauaaaaaucuaugauucuucaucuaaaauccaaguauguguugaaggauucuaaauuuuuuacgacuuacaucaaucauaugcuaugaaauaucccuagugagguguuaacauauacccaaacaucaaaucacaugacaagaaaaaugacgauuauaaacaagaccacgacaauuccaaaucaaguuuugcugccacuuguuguuuuuugaagguucgggaauuugaguuacagguaagggacugugaaauuuaagaaaucagaacucagguacagaggcucacaccuauaaucccaacacuuugggaggcugagguuggggcaaucacaugaggccaggaguucaagaccagccuggccaacauggcaaaaugucaucucuacuaaaaauacaaauuagccaggcaaggugguacaaacccauaauccaagcuacuaaguagcugagaugggcggcuggcuugagcccagaaguuugagguugccaugagccaagauuguacaacuguacuccagccugggcaacagaagaagaucaucucaaaaaaaaaaaaaaaaaaaaaaaaaaaucaggacucauucaggcuagcucauuccuaaugucuugcuuuccaaagccagcucugggugcucuaagagcuuugcagaagcacuuuguacaaagaaccacuguagacuaaauaauauagccauggucgggggucugaaggagaagacuaucuauaugcuugcuauucagaggaaagcaucuacugagaaaaccaaagaucacucuuuaaaaaaauuuuuaaauaaaaauagaagauuguggaaucucugugucauggcaaagagguuuuccagugggaguuggagugaagggaauccuaauaccccaaaugauuggaggagaugggcugugauuuguauuugcugagcgcuccauguucuacaagcaugauagagcuucauucucacagaagccuucuguguccugcccagugggucaugcuuucuccuuccacacugaggguacuggggcuuggagaguccagugaagaugccccagauucauaacuggggagguacagcacaaaauggagugacaacuggcuuugaaagcuggcacgcuucacacccccaucccaacuuuuagggacacuggugcaaagaaaucaagccagccugucauaugaugacagagugauuucuuucccgauaugacacauccauuuaucaucuuucauaagacagaccuggccuauaauuuggucccaucgcugccacuuaaaugaacucugggcuuggauggccuucaccagauucuucaguguggggucacuuagggacuugaaagucacaaggucaggauuugaggugcauggaugcuccuggggggcagugcccagcgcagugcugaggaucgaggaagccaaggaugacuauuaauugaugguauugaugaugaugagccucuggggaacuucagaaaaagcagcaagagaaauucaguuugcaaaguaaacauuuuauguguuugucaucuccauggugagaaacuucaguauucaagauucauauagaauacaaccgaaaaagccccagauacugagcuuuacuggagaaacacauuuccuaaaauaagcauguuuugacaauuaaaguuauaucugcauuuuaaguguauugcccacuuaaaugucuaaaugaaacaauuaaguccaugucaguggcaggcaagaauacagcaaucuguugcuuuuaaugauaaaaacaaaaauuauaaauuaaacauaugcuguaugccagaaaauaugcuuuauguucuuuuucaauaauguaacaacucugccacagauugaggcauugcggggggggggggcggggggagggcaggcagaaauaaagccagagagguuaaguaauacauccagagaaacacaguaaguaacagugaugcuggcauuuuaguauuuacauuccuuuacuaggcccagcuuccuuugcgcgauaacaacguucaaccccuuguuucucccagugaaugauuacaaccuggcauuuuccuaaguaugauagggguggcagaauauaaaaagacagaauaugccaaauuggcauaucauauacagccuugcaauuuagcaauuuagguuucugcaacugagcauaugcacacuuaacauaaagcaucaaaugacagcaaccguuguguuuugcccuuuugugagcauccccauaauucagguucccccacugugaucuagcugugugaucccaguuuccuugcuccucagcacaauggcaacaauuuaaugguugaguacaaaguuucuaagagcccuggacuucuggaggggagcucaagaguuuagaggcagacagagauucacuccuaccucccccuucugcuuaaggguacaaugcuagauaacucugagccugcauuuccucaucugcaaaagagcccuaucaugucacaagggcugugaaaaugaaaugauguuguaugugcugagcaccaggcacaggauccacagugggcaucauuucauagccuuuaauuugauuaacucuuaaaaucaucaucauuguugucauuauccaaagcucccaaugaguguguucaaguugcaaaagcaaacaaacccuuaacuccuaugccuuccauuccagggcaacggacuugcuuccuugccugcaaggcuaauauaucagcagucacucagguuacagucccaugaaaaacacagggugacaaaagccccuugcagcaaucuccaagaaggagaaauaaauuaaucaagcugccaaacggagaaggccggguugaccuccuucugaucucauuacuucucuauuagccuuuugaaaaacauucucuuacagagaucacuaacugaagauuauguggagggaaaucgcaccucuccaucacggugguaacuuugccucauuugucauucuaauaauucacuucuuuucuuuccugaagagacagagacacuaauggacuaucaccaguuaaaaaggcaauuuuuccauuuaauugcacucauuaaauacugcaauagaacaauuggaaaagcaauagucucaauauuuaaucauaguauaggaauaaugaaacauugcuucaaaauaaaucugaguauuuauaaagucauaaaagagcuguuuuaacaacaccugugaucagaggcaacauauuuaaaauuagacaugugauuuuucauuucuccugauuagagcuuguaaacauuugcauggugacggaaaaggauucaaaggaaccaguuccucugagcagugccuucuagcuuuaaaggcugccacagcccugugacgggaccaacacucccaggcuguuacagagacuugaggcucucacacaagccaggcuuccagcauggccaaggaaucugaggaauggguuuuugugcccaugagcagcucgggcccugagugguuuucucugggagcaaagauuaauugacacuuucagauuuuuuaacagcuuuauugagauauaauugacauaccauacgauucacccauuuaaaauuguauaauucaaugauuuuuaguacauuuagaguugugcaaccaacacagacaauugcaaaacauuuucaucaccuucaccucuaccccuccuaucccgcccacccccaacucccccagcccugagucaucacucaucuauuuucuaucucuaaauuucucuguucuggacauaucacagaacggaaucucaccauauguggacuuuuguaacuaacuucuuucacuuagccucauguuuaccagguucacucacauuauagaaugccucaggacuuuguccauuuuuaugaauauaaaauggaauauuccauuacacgcauuuaccacaacauauuuauccauuuguccauugauggacauuaggguuuuuuccaccuauuggcuauuaagaacaaugcagcuauuaacauucauguacaagucuugguccauguuuucauuucucuuugauacguaccuaggaguggaauugcuaggucauaugggaacucuugacuauuggaggaaccgccgacuguuuuccaaguuagcuguaccauuuuacauccccaccaauggugugugaggguuccaacuucuccacauucccagcaacaccugcugcugucugacuuuucacuucuacauuucaacugugaguugagcaguaucuaagaccagggaaacaagaagccaccaccucacugccaacagaaaaccucaguuccuugccuugaggaaagcagcaugaccugaaugacaaaggccacggucuuggaaucaagcagacagacguucaaaucccauccuugccacuucaagcuuacuguagccuugaacaagucacuuaaacuaccuguaaauugauuuuucuugucucuaacacagaggaaauaaucucauaggggaaagugaaguuggaggaggaaaaugcauccaaaaaugccuagcacagugcccagcacccagcugcugcucaguaaaggggcaucuaugcuuauuauucagaccauacugcacuuaaccuugagcaggccucugaguccuuaagagugcaugcacuggguuccuauccaguuuuaggcucaaaaagcucuacaauuagucaaguaugccggacaaaggaaaaagaaaauauauguuacaggagccaggaacaugcaaucuuauuuaucaaagaacauuuagaauagaaacauguuuuccugauuccaaagaggaagaggagauggggaauccacccuucccuguucuuucaaugccaugcgugaaaaguaaaguccacagccucacaaccaaauagugggcaugauucacuuagaggacagcucagugggguucccgccucuucccacugcauggcauguucaaacccaguaaccuauuaguuuaaauagagcucaaagaggaggguagaaaaagcagaaacugcugggucuccugauaacaauuuaucauuaacugagccuugcuugcuuacugucucccuacuauuaauacaagauccccggccgggcgcaguggcucacgccuguaaucccagcacuuuaggaggcugaggcugacagaucaugaggucaggagaucgagaccauccuggcuaacauggugaaaccccguuucuacuaaaaauaaaaaaauuagccgggcaugguggcgggggccuguagucccaccuacucaggaggcugaggcaggagaauggcgugaacccgggaggcagagauguagugagcugagaucgugccacuguacuccagccugggcaacagagcaagacuccgucucaaacaaacaaacaaaaaaaaauacaagaaccccaaaucauagcaggcuguagguaaggaacgccuguuuuauuuucuucuuuuugagacagagucucauucugucacccaggcuggagugcaauggcccaucauccaaaccuaacccaaugccaguguuuguagggcuuguaaacuaagaaugguuuucauauuuuuaaaugguugaaagagaucagaguaaguugugaucaugaaaaucauaaaaaguucaaguuuccauguccauacauaauuuuaauugaaacacucccauacucauuuucuuacguagcguccauggcugcuccugugcuguggugacaaaguggaacaguugcaaaagacuguacugcaaagcauaaaauacugucucucccuuacagaaaauguuugccugccccugcuccacagaguaacuuuguugauaaucauaaaaacaaaguaaucauuggagguagccacaccuggugaugaagaguugcuucagaagauuuaauucaggucuaccuggguuugaauuguaccucucacacucacugacuguacgaugcuaggggcaaguuacuucaucugugaauccccacuuuccccauccuuaaauugggcuaauaacaucuaucucacuggguuguugagaaguuuaaaaaggcacaagcgugaaaaccuuuggccugauccuggcgaucacgaacacucagugagugcuagucauuauuaucauauacuauuuccuuaagaaaaacuucagaaauacauaacaaugcauuacauuacaaagggagucaaagucaaaaugucauuuuuuccccuuaaugcuggcuaauacacagaaggcuuggaagacauuaaaaacaacagaagaaacuauauaaucagcauuaacaaaauccagauggauuuuggcucauuugcucuuucgaauuguuuguccuugucuuccccccaccaaccaucccccuggcagggcaagugagaaguaaauacacaaucaucugguuuauauaggaugaaauugaaaccauuuggcuuuuuguacaacuaggagccaaauauuuaggcaaaacauuugggucuguccacuuuagcugcuguucucaugcacugauuugaauuugcguuccauccacaaccugucucugcaggucugucacuuaugcagguguuaaacaaccacucacaacuaaaauccauuugcaucuguuugguugggaagagcgcaugucacuaaaugucaacagaaucauaugccucuccaucccccucuccccagccuccaagcgucgcucuuuagagcugugcuggaaacacuaacagacgacagccacugacagggagggccugugaugugugugcugacgccaggcaccaagccuguguucucacuccuacaucaucacccuuaacuaccacgcggcuuccaaucauuuacuuuuccaugcacucugguguaccacucaagaaaaugacagaguaauaagauaauacauaaauucaagccccacgucuuuauucacuguuaggacauccauuuaaggacuucaaauucaguccuacacacccacaaacaucagacaaggauucucguggcagacuacgaauccacuccaaguuucaauaagccuucccaugaugucauucuacucuagccuuaacauuauuuaaauauauuuuuauauauauauauacacacauauauauauacguauauauacguauauauauacgcauauauacguauauauauacgcauauauacguauauauauacgcauauauacguauauauauacgcauauauauacguauauauauacguauauauauauauuuaaaaaacuaagaaccuacguguugccuuaaacaaaagagaauuguggagcaagggagugggugguacucagcuucuaaaacuccuguuccagaaagauacauuuucaauuaaggccuauacauuccuuuuugcaacagaaauuuuauguacccaacuuuucuacgcuuuaaaagacacucugguguucaggcagcaggcuguuuuuagcagcacugaguaugaguauucucauaugccaucugugaggcuauugguuaaggugugaguacauuauaaauagaaucaagcuacaaacaaugcagacucuaauuguaaacaagacaauuaaccuaaaauccugugcagucuggcgcccaaagcaagacaacagcuucagaaacacaugaagcuauuuucauuuuugugaucaagucauggcuucaauuaaagacagaaauccuguguuaguacagaugagaugaugucaaaguuuucuaagaauguuacuucucucuucuguuaggcaagguauaccaucuucugcaaaacagcuggaucauuugucaauaaccaagagaaacagaugguuagaaacauccagauacuugaaaacaucuggauauuucauucuucauccagauguuuggcuuccccuaggugcagccugcugucuuugguugaauaauucuagaaagcauuuggccaagagguaaguugacuucuucaauaccuucuccagauaauuagguuuggcaaaggaagcccacuuuggggaauaaugcucuuacggggauuuauuuuaucaguaugaauuaaccaaacuauuucuggaaacagcuagggacuuaaaaacaaaugcacaauguguccacugugcaaguucagucauguucaaccgucuacuuggaguucacagaagucuaacuacccccagauacagaaucugaaccaauuuaguaugacaaccuacaccgaaggggauaaaaaacaaaagucuguugaguaaaugcagguaaaauugcuuauaaugcuuguguacucuuccacuuaaaaacccagagaaaauuucaguucuguaccuugaauacucucauuugcucguacaugcaaggaagguuuucucggcucagacucuguauacagucacguacaugaagcugagaaaacauugaguaaagcuaaguuuuugcccucaugcaguuuccagccuacuuagggagaaagagaaacaaauacucucacccaaauauaccauuauccauacagcaugauaagugcuaagaaauaaaguuaaaagauauaaugagaguuuacauuaggagggaauucugauugggauuagaugcucagagagggguugucagagaacuuaaaagaugacuauuucgccaggaaaacuggaaaaagugccucccaggcagaaaagacgcgugaggugaugccugaagaguaaaaguuuugcuuccucacaggcugaaagaaaggcuaagggcggaggguggcaagugugacuucaagggguagcacagagagaccucggugcagauggaacaguccuguauuuuaguaguggcggugguuaaaugaaccuacgcaugugauaaaaauggcauagaacguuuauuuuuccauugcuaugugacacauuaauaagaaauucacggcuugaaauaacacacauuuauucuuuuauagcucuggagucagaagaccaacugggaucugaaggggcuaagauuaagacaucagcaggguccuguaaucucagcagauugggaggccaaggagggaggaccgcuugagcccagggguuugagaccagccugggcaacaugaugaaaccccaccucuacuaaaaauacaaaaaaguuagccgggcgugaugguacacacuguagucccagcuacuuaggagguugaggugggaggaucgcagugagccaugauagcgccacugcacuccagcuugggcgagagcaaaacccugucucaaaaauaaauaagaaaauaguaaaacgacaucagcaagguguguucccuucugguagcucuacgguagaauccaucucauugccuuuuccaccuucuagaggcugccuacuuucuguggcucaugcccgccucccuccauuuucaaagccagcaauguguggcgguguccuucucaugcugccaucucacugccugacucauccgacucucucucccccuuuuaggaauccuggcaauuacacugugcccaaccagauaacccuggguaaucuccugauuuuaacuucgcaggaucaguaacuugaauuucaucugcaaucuuaauuuuccucuuccauguaacaaagcauauccauaguuuccgcggauuaggacgcagacauccuaauaagggccauuauuuuaccuaccuggaauuauacacucacauuguacccaggcauguuuccugguuuggauccuguacuguaguuauauaaggagucaugcuuguagaaaagugaguaaaaaucacagggauccccucugugcuauuuuuuaacuuccuauaucagaauaguguuaaaauaauuuuuaaaauagccaguacuuacagaaauuauguauguacaguacagcuaaaagcacuuaacauuuauuaucccacuuacuccccacagcaagccuauaagguggguacuauucccauucuacaacugagaaaauggaaggauuuuauuaauuuauccaaagcuacuggaauccaaguacugugugccuaaauguuguguucuuaacauuuguuuuaagaacuccaauuuaguuaaggaaccaaauauauggaccacaaaucaacaauuaggaaacaacagaauaauauuauuuuugacagaauugcgcucuugucgcccaggcugaagugcagugacgcaaucucggcucacagcaaccucuccuuuauacauuuucuccucauuccugucuccauugcccucaaaaccaacacuuuucuagaacuguaaacacagauauaccaaaaaaaaaaaaaaaaauuccucccagacggagggcuccuaagaguuucuguaggcugcuucuggguuuccacagccauuuaauuaugguccucugcccccgggaaguaaagaucaacuacaugucacccucuaacucugaauuugagggacgcagugccuuuaaaucaaagggaaagugacucacauccccuugguguucucuaaaaggauauuguuagaaccaauuucuacgccuggaucuuuugugcuccaggguagaagcaggcagcgguccaaauacuguggaaccuuuucagcagcuaucaggaaaaagucacuaccacuuugcuuucaaacccaggcugaaaaagaaauucgcaaagccagugcaugaggggauuagcaaugucuucuaaaacagaaacagaagauguuuacggggagugaaaaugaaugauaguagucucacuguccacucucauuuccucaugguuccaccaaguccuuggaugucauaaacacuguugggggaauaaaaugcucuaauaaaucaaggugaggacaccgugaagggggcccauggggaggcacaccugcugagucgcuuacucucuggacagagucaacagagagcaggaguccagagccuaaacgaggcagacuucgaaaaaacaccagauuuuucucacuuuacgcaagugugugcacacacacacacacucacagucacacacucucagguucuggaaggagguaagguacuuuucucugccauuauccaacccgaugcuuguccugugccuuaguacaugguuucucagccugaauacuguugacauuuggggacgggucauucuuugugugggcacgguccugcacauuguaggaugauugacagcaucuaucugcuagaugcaguauccagucuccaucacacuguaacaaacacaaucaccccuggggaagaaacacugcuuuaccuaaaaugugagugagagagacagaaacagagacagagagagacagacagagagagagagagaauucaccccaaaguaucacucaaguuccugcaguuguucaccccauuccucacuggccuaacuccuauucaccuuuccaaacacagccucaacacaacuucuuuccagaagccuucccuuacuccuccauucuuuggacgggugagaugguccuucuccaagucccuccaauuuccugggccaauggaucccuuaucccaccacuggccuacuuacugugcaggcuucaccuuuggauucuaauauccuuccaaaaagcaacuuuccuucaucuuugcacuuccagcauucagccaaauguccaggucuuauuagauguucaauaaaaguuuguuggaaaaacgaauaaugaauucacaaagauaaaugguaguuucagcaaggaggcaugucccagggugcaggguugguacugaaugguauacaucuaucacuuaaaaagcagcauugaaaaauacuagagcuagcagucuacccucugugauggaacauaagaaagcaauuacuuuaccaucaccauuuuccaguaacagaagcuuauagauugcaaaguuggauaaagcagcagaaaagacaauacagaaguuaacaagucccauuuuccagauuuaaaaaacagacuuggccaggcaccguggcucaggccuauaaucccagcacuuugggaggccgagacgggcagaacaccugaggccaggaguuuuagaacagccuggccaacaccgcaaaaccacaucucuauuaaaaauaccaaaauuacccaggcauaguggcaggcaccuguaaucccagcuacucaggagccugaggcaggagaaucgcuugaacccaggggggucggagguugcagugagccaagaucacgccauugcaccccagcccaggugacaagagcaaaacccuuuuuaaauucccuggccauuccacuucagggaaucuaaccuaacaaagccaucugagguacacaacagaacaauauucugugcacacauguggaugcuguuugcugcagugccaccuuuuuggagauguggcucuguugcccagacuggaguacacuagcauggucucgacugaaugcaaccuccaccucccagguucaaggcgauucuccugacccagccucccaaguagcugggaccacaggugcaugcuaacaugccugauuuuuuuuuuauuuucaguagagacaggguuucaccaugugggccaggcuaaucuuaaacuccugaccucaagugauccgcccaccucagccucccaaagugcugggauuacagguuugagugaccgcaacuggccugcagugccacuuacaacaaaaacaaaagaaaacgagaaaccugauaaauauucaacacgaggagaguaguuaaauacagauacaucuacuguggcugggaauuuuuggugauuuuucuuaucuucuauguauuuuuuuuuaaacuaauggaaucauauuucuaccugaguuacccaucugaaaauggcgauaacauggagucauuguaaggaugaaccagacaguguaagcaccugcugaguggcauuagcgcacaagaaaugauuguuuuccccucucuaaucacauaauuuuuauucauuuuuauucuuuuuugagacagucuugcucugucacccaggcuggaguacaguggcaugaucucagcucacuacaaccucugcuucccggguucaagcgauucgccugccucagccuccugagcagcugggauuacagcugcaccccaccaugcccagccaauuuuuauaucuguagcagagaugggggucucaccauguuggccgggcuggucucgaacuccuaaccucaagugauccgccggccuuggccuccccaagugcugggauuacaggcuugagccaccucacucagcauaaucauauaauuauuuuuaucauaucaaacuacagaguuauccucuaaagggcacaaugaagcuuuuacaaggaaaaaaaacaguuucacuucucaugucuacauuucuauuacuccucaccuagugauuuuagauauagaacaauuucaaggaaaagguagcuguuucagggaaaauucuacuuuggccucgcguucagaguuuucuuacauaagaaaauuugcuauuucuauagcagacagaagaaaaagugacaaaauuaaagccaaaaaagagaaaucgauagauagcuagaugauagaugauugauagaugguggauggagacagaaaggcuagaaugaaaugcugaggaaguaucaggacaugugagugaaggagaaguucuucuuuuacgaaggacauuggcaagaauucccaucccauguguuaacugaccuucuagcugaccacaaaggugagggaagguugcuggaaaaacugagauggcucaguacaucaaaaugacaccauucaccaggcgugauggcucaugccuguaaucccagcacuuugggaggccaaggcggguggcuugccuaaggucaggacauugagaccaaccaggccaacaugaagaaacccugucucuacugaaaauacagaaaaaaaaaaaaaaaaaaaacaaaaaaaaaaaaccccugcaggguggggugugccuguagucccagcuacucagggggcugaggcagaagaaucgcuugaacccaggagguagagguugcagugagccaguaucacgccauuacacuccagccugggcgacaagagcaaaacuccgacucaaaaaaaaaaaaaaaccccacaaauuggcaccauccugauagagguggacuuggugguugcuguaacguacuggcagcagggggauaaauguucagggguccuacguauguccuguacuuuuuuuuuuuuuuuuuugagacagagucucacucuguugcucaggcuggagugcaguggcucgaucucggcucacugcaaccucugcguccuggguucacaccauucuccugccucagccucccgaguagcugagacuacaggcccaccaccaugccuggcuaauuuuuuuuguauuuuuaguagagacgggguuucacuguguuagccaggauggucuccaucuccugaccucgugaucugccagccucugccucccaaagugcugggauuccaggcgucagccaucgugcccggccucuccuguacuuucuuagaagugcuuuguguuuuuuauuuuaauucucaccauaacugaaggagacagaugcccagcuccauuuuauagaugugugaggcacagaaagaugaagcagcuuguuagaaagcggaacagccaggauuucgacucgaccuggucuccugaaccugugucagcacggauauaagggaagugucacuggggacaaaaaucacucuaagacuggacaauuccaaucugagaaugaauucugaugaaugacagggaagugaagcuaaaugcugagcuccuuaaacaggaaggaucaaaggcuagugaaaccaaauucugauggccucucuagcccucuuccauaauagaagagccucaaaauguagacaaggggacucagcauuuagauggcagggacaucgacagagaagaaagcaagcaaucacgguacguaggaaaaacaauaggccugacgcaguggcucaugcccguaaucccaacaccuugggaggccaaggcaggcagaucaccugaggucaggaguuugaggccagccugaccaacauggagaaaccccgucucuacuaaaaacacaaaaauuagcugggugugguggcacaugccuguaaucucagcuacuccaggggccaaggcaggagaauugcuuuaaacgggaggcagagcuuguggugagcuaagaucguaccacuguacuccagccugggcaacaagagugaaacuccaucucaaaaaaagaaaaaagaaaaacaacgaaacacaucucugaacacuugcuauaagccagcacuguucagacguucuaucauguucccagcagaucuauaauacagggugaguuauaagccauauuuuauagauaaggaagucaaggaucccagucugagguuccauggcuagcaaguggaagagcccuguguuggagucuaagaugucugauuuccaagucuaccacaugcccuuucugcccauuacauugacuuuggccacccagguggauuuuccuguuauucuuuagauguuauagguacucagauguugaaaaagaaguaaucugaaaacaggacaugucugguguuaguaggacacaaaucugcccccgugaaugaaaacauucacaaucacucaacagguaucuacuuaacccuccuguacaccaggcagcugggaacccacugauaaggggagagaauggcacacagcacaugcccauagacagaggcagugggaagugaggcccugcgugcuaccaccucggaggcugaccacuuagggcagagccuaggccugucugguugguucagucacaagacuggaccuaagguauggcaugaacuucuaagcacauuguccauaaagccagacgaccuucagucuugcuuccuccaaugcagagaaauccuacaguugcugagauugcuagaauuaggccuacaaccagccaggcacaguggcucaugccuguaaucucagcacuuugggaggccaagguagguggaucaccucaggucaggaguucgacaccagccuagccaacguggugaaaccccaucucuacuaaaaauucaaaaguuagcugggcaugguggcaggcaccuguaaucccagcuacucaggaggcugaggcagaacugcuugaacacaggagguggagguugcagugagcagaaaucaugccauugcacuccagccuaggugacaagagcacaacuccgucuuaaaaaaaaaaaaagaauuagaccuacaacuccagcuggccacucacuagcaauauaaguguuuccuuacuugaaguuuucaacggagaaagaagcuaaaauuacccccuacaaaagauacuguaaagcugaauucaauuaaaaaauuaaaauaaaaucgagacuacgccagguuauaugaauuaagguugcagauagaauuagguuugcuagucagcugaccuuaaagugacccuugauagcuauccagcugagaccaaugaaaucacaaggguccuuaaaaguaagaggaggaggcaaaagacaaagaaccagagacauggccauugaaggagucagcccaauguugcuggcuggaaggugaccgaaaaggagccauggaucgaggaacaugggcagucucuguaacguggaaaaggccaggaaauguauucuccucuacaguauccaaaagaacacagcucugaagacaccuggauuuuagcccagggaggccugugucagaccucugaccuccagaacuuuaagaaaauaaaugucuugucucaagacacuaaguuugaagaacuuuguuauggcagccacagaaaaaugaauacccccccgccaggcugcuuuuuaaaaauaauuauuacguuaaguaaugaacauuuuucuuccuucaaaaaaauauuaaagcauuauaaaccagacuaaagucugccuuuggcuuuucuucuccuacuccccaucucuccuacagccauuaccacuagaaguaaguugagucuggauucuuuaggcccacucaucugcauuucugcacauguauuuguaaggucacauugcuugcucacuguuacggcauugccagucauuaaacaguuaacacgcaucuccccaggagggaaguagcucaaaagcccaacaacugcagaggaaucagugucugcuucagugcuccugggggugaaggaagugacaguuugaguaccuuucagcauaccuucugucucccaguuauaaauccuccauuccggaccuugugguaggaacugaauucuccaagcuugacucuguuaaguguucauugcuuagaugaucaagaaaggaauuuguuuauauacaucaggccuuggauuaccaaaaaaauuggcugaagacauacagggaaugcaacugauaggaaaccaaccaguccaaccacacugugccaccuagacauaauaaaugcccacaaagcugccagaaauugcucacacuucacccaccgccccccuuucuuuuucuuuaacccacaggaugucugguauuuuucacaagucccacaucuguaccccauagcuucugggagacuauucacaaaucacaaauuaagucagacuuucagugcacuagguguuugaaaucuuccucuaagccacgcaggcagcuggcucuugcacucacucgucuauuucucuggggcuucccaagcauccacuccgaugccaagccuggcuccuguacaucgugacaacaagggugccccuacccucgaaggugggucuggggcugcguuacagaggcucauuucuugcugggaauugaacuggguucucucagggcuuaaaacauugaaaagagaugaaaaugggcugacacagcugugagagcaagcaaaggugaguaaaacuccuuucuuacaagccuuacccuugcuaauggaagccaaaucucuagagcaagguuuugggguauaaauccccgaucccagagagaugccaaaugugcugacacgaagcaugccuuuuccacugugacuggcacauggcccgcacccuuugcaugcagaagcaccgggguggcaugcauucuggugaccacuaagucuuacuguacauucagguccacuuagcugcaauggcacguccuuuagauacacagccaaaggcaucaaucuggugauuuggccuugcucucagagcugaaaacaaauuagcuucccaaggaguauaaucagcauguguuuguuauucugugaaauauuaauucauucagucaacaaacauagugcaggcugugugugcgugcaugugugagcacaugccaaacacuggccaggaggugugagacaaagcccagaagcacacguuucuagaaaagccacauacaauagaggugaaauuucaguggguuguguguguagcauaagaaaauucguggguagaaggaaacacaauaaauguucuuacggaaaauucuguauuacuuuuggauacaguuaccagcaacaaaaacagauggguuuaaaacaauggggcaagagagcuauggaugaugauagaaagaaaaggaaaaagagagggggaaggagggggaaggaggaggaagggaagauaaugacaauaauugugcagaucacaggagcgacaguaacuaaaugcguauuaaugcccagacccuggcucuacgaacuucacgcauauaaccuaauuuaauccucccccaaauccugccauacauccaauuauuaucccuauuuacauaggagaacacucuaacuagaacaauuaaacaaccugucaugguccagguaguggagccaggauuagaguuagacuucaggaccacaagacagacacugcugggugcacaucucccaucauccuuucauuucucuuauuaacagcauuccaguuuaauucuggguagucacguacguugauugaaagagugaaacucuaaaauauuuaaagaaguuuauucccgacccaaacaagagugaacaaagccuaagacagucucaagggguccugggaacgugugcccaagguggcuggguuacaccuugauuuuauacacuuuaggggaaaaaaguuacaggcacacuucuaucaauauauguaaggaguacauugguuugguccauaaaggaaggacaacucaaagugauggggaugagggcuuccaagucauacgugguauauuagcccauucucacauugcuaccaagaacugccugaaacuggguaauuuauaaaggcaagauguuuaauuuacucacaguucagcauggcuggggaggccucaagaaacuuauaaucagggcagaguggaagcaaagcaccagguucacaaagcggcaggaagcagaaugaacgcagagaaacuaccaaacacuuauuuauaaccaucggaucacgugagaacucacuaucgggaguauaugauucaauuacauccaccuggucucucccuugacaugucgggauuguggggauuacaauucaagaugagauuugggguggggaugcagccaaaccauaucagguggauucaaggauuuucagauugguaauugguuacaagaguuauuaacuaaacaccugagaucaauagaaaggacugauuuuggguggggauguagccaaaccauaucacauggauucaagcauucugugauuggaaauugguuaaaggaguuauuagcuaaacacccgagaucaacagauaggacugucugauuuuggguggcgaugcggccaaaccguaucagguagauucaaggaucuucugauuggcaauugguuaaaaguguuauuagcuaaacaccuggcaucaguagaaaggacuaucuggguuaagauaaguccacaaaaagaccaagguucuuaugaugcagaugaagccuccaggaaauaggccucagagagaauaaaugguaaauaucucuuaucaaaacuaaaaaggugccagacuccuagugaaucucuccuggaucaggaaaagaccuggaaagggaaggauguucucuacagaauguagacaagaaacagcuuugcagggccauuucgaaauauaccagagaaauauauuuugggguaaaauaauuugauuucuuuccaugccugcuaucugcaaagugauccuauacuagaguaggguugaaauuugguaucuuauugcuauaaagagucuguuuugucagccuuaggaucuguuuuaaugcuaaugcuguucaguugugacugaauuccaaaaaaagaaggguauaaugagucauauccaacccccucuucccaucacugccugaacuaguuuuucagguuuauuucggaauccccuuggcccagaggcagggauccauucaguugcuuggggagcuuagaauuuauuuuugguuuacacucaccuagcaaggggcaaucaccucugcagacucucuugcagcucuggguggcuguguggcauggugcuggccacuaacaugcuaggggaaggacucccacacugcacugccuauuuccaaagcucucaccaugagagaaaaaugaaggccugacugggaaagcuggggucucaguccagucccugcuagugcaggcaccaugggaagguuaacucaacuacugcagauucaacuucagcccccuuccuccaucagcugccacauuccagagugucacacauggaucugagcuugguucugaagugugaauggcauggugcuuaaccacaauugaaacugugcuaaauuagagugugauuuuuuuuuaagguacagucuuuaacaugcuagacaucuaguaaauaucuuuucaguaaaaggagaagaguaaggagagcaaggagggcagcaaucugcaaaaccucccaugaaaaggaauauuaaggguccaguaugugggaggcaggugccuuuacucuuagcauucauacuuguaugaguuucugaucacugcucuaacaaauaaccaugaucuuaggucuuaaaacaacacauuuauucucuuaucauucuggacgucaaaagcccaaaaucaaccucacuggguuaaaaaaaucaaggugucagcacagcugguuccuucugaauccuccaaaugauaauccauuucucaccucuuucaggggcuagaagccaccagauuguugccucacaccugcuucaccucuucucccuguuuccuccucuuucguagucacaguccccucugccucccucucauaagaacacuuauaauuguacuuagggcccacuucgguaauucagguucaucuccccauuucaagauccugaacuugaucacaucuccaaagucccuuuuugccacauaaagcaacauucaccguuuccagaagccuagaagcguacucuauucacuuguucaagaaacauuuauuugacacuuggcauugugcuagcaaugaacgggcagcagugaacagguaguuaguucccuacuuacuucauaaaaaaaauaccuuuucuaacagaugcugcuuaaguucuugauaagucaggucccacaaaguagccacgguguagaaaucccagugaaaacaagauaugguagaggcucaaaaaguuggaaguuauuaauggguugcuaacuauuaucuaacaaagauauaauggagaacugucacaggaaacguugaaggaaaaaacccagaagguuggaaauggguuaugaaacagauaauacuggaaaccugucauaaggagagugggcagacuacucacagacacacuacacaagugggguucacugggaauugugggaaggaguggggcucaguggggauugugggaaggagugagauuuacagggaauugugggaaggaaugggacucaguggggauugugggaaggagugagauuuacagggaauuaugggacagaguggggcucacugggguugugggaaggagcaaaauucacagggaauugugggaaggcauagggcucaucaggaauuuggggaaggcauggggugggaauugugguaaggaguugggcucacugggaauugugggaaggcaaugucucaacucuuugaucuggaguaagaaauauccucuccuggccacaaguggaagcaagcccaauauccaggaacaacauuauaaauagagugaauaguugaagcugcacagggggccugccuuugggaaaggugcccagaugaacucucauacaacucuggggacuucuguggacaccaugaugcaggguucugaaauaucuacugccacaugggaaagaaaaucuucagcaaaucccugaucgccugaccaguaacacauaacaacccauggaaacacacugggaacagcuagacucacccuucuagaaucguauacuguaauuauugucauuauccagagguaucaugaauguuauuauuccauaaaugcgguucccaaaucaucaaaauuuuucuuuuugucauuuguucuuucuuuggaugaagaagccacccguucacuauaaauguaguuaagcuauaaaaacaugaauuacuagaaggcaaauccuuuggaagacaggcagcgagacgcaaaugcuucuccacauggucucugugggcaggugucuauauauaaacacagcucgaauugauuguggaaucaaugagaaaaguggauugcccauguaaaggacaucuguauuagaaccuguucccaaucaaaggaaaguaauucuugguggucugaccacuucacucaaaaaagaacugagccaacuuuccucaaugagccuuucuuccaaccaaaaaaaagaaaaagaaaaaaugagaguuggcuacugguuauggcaauguugugccacaagguuaauaaugauggguuucaggucaccggcaauuucucauuucaaacuaacuugaacuauccacugucaagggcuaauuguuuaaugugggcugcgugguacccaaguggugggugggugacuuucugucauuaaaucauuaccaaaacaagaaaggggcuuuucauucuuuuuuuuuuuaaagugcuccuauguucaagcuccauggaugacacggucuugcucaguuucaagaugacuggaacgggaauggucuggggcuuuuuaaucaguucacgggaucugggcuuuaacuuccagagggaacucagggggaaagauuccaaauaucccugccaucauuuggaagaguucuuccuccacauugucuaugcuucuucuuggauguucauuucacuucuaaauggccaagggacucauccagagguuacauggcuuuuuccuccuggcuauugugagcaaggaggccggagggacagaacaccagcucacuuggcauuugcuauuaacagcaccucccuggcaagggaggaucaucacagcagcuggagggccccggucuccaugaaaaacguagucccccagaaaggggaaggaaaggaaaaaaaaauucaguuggugauuugaaucacacuaugaaguccuggccuaauacacacuaguguggcaggagaagcuuugauuuacacaacuuggggacugagaauccacagcagcagaaaagacagaauucagauucccagguaggguggggugagugccugaguuuaaucacugcccugugcugccaaguuaucaguauguuuuaaauggcaaggaaagaaggaaagaaaaggaaaaagggaaggaaagaaaagaaaaaaaaagaggaagaagggaaaagaggaaggaaagagaggaagaaaaauggauagugaggaaaauggggauuuucccaaugcuagcgaaaugugucaaaugguucaaccucaacagagagaaaguuggccauauuguacagaauuccucuucuaggaauggauccuuucuaggaauagauccuuuccauucagugauacauguugacaggaaauguguacaagguugcccauuaugguguuguucauaauagcaaaauaauggauacaacccuaacauccaucaacaaagaaugcuugaauaaauuacagaccagcucugcaauggauuaucgugaagcagcacgcguauauaucucuuuauauauuaauaugaaaaagucucuaugaaauauugugaagugaauuguguggagugcaaaacagugugcuuacccugcagacauuuuacuaagacccacccuagcacuaugggugugcuggaguuugcagagacuauuucugaaaggauucucauucaucugaaaauucuagaagccucugcagaaggcaacagcauggcuggaaaaaguggggaaaccaaaccuccacacucacccuuuccaucguuugaauguugaacaaugucaaugcauuaaccuaauuaaaauuuuacaaaaaaguauagcauucaaaaagguagaaaguaaaaggcuaaaggccuaugcauuagaaaggagagugagcagaggaugaguaaugaugagaaucagauguccugguuauuaacgaaucccucagauaacaaacagcugaucgggagaagaggccacgggaaggaaacacuuuggggaggucaugacucagguuucuuggagaaggagcaccgaagcuauguuuccaaauguucagaagaggaaaaauaaguaaacaaagggcuggcuccuuuaaagcuccuuggcugaaaccucagggcuaguaaaacuauuucaugcuaauuuaaaagggcucuaaaagaagcugcuagaauugcguauagauucaaaagcaauagcugacggcuuggcucuuuccagaauaggaguggggguggugguuggcacagggcaguggugggagaaagagcacgggucuggccgggcacgguggcucacaccuguaaucccagcacuuugggaggccaaggccaagugaaucaucucaggucgggaguuugaggccagccugaccaacaugcagaaaucccgucucuacuaaaaauacacaauuagcugggcaugguggcgcaugccuguaaucccagcuacucaggagucugaggcaugagaaucgcuugaaaccgggagguggagguugcagugagccgagauugugccauugcacuccagacugggcaacgagagcgaaacaccaucucaaaaaaacaaaaaaccaaccaacaaacaaaaacaaaaaacaaaaacgaaagagcacagguggugaaaauuugaaaaguggagcucaaauccaagcucacucaacucccuaguucuggauccugauuaaaagcaacguccaugagcucaguugcucaaguuucaugucuguguaggcuguucaagcuccucuucaaccaaggcugguaccuaaagcgcaucaggccugggauuaaaaagaccacaaugagaccaacauaaaaaauacuucugauuauuacuuggaugucuuauuuauuuauacuuuacuuugucuaucagaaaaagaauuugucauugcuuaaguaacauaaauuagagauagauuuuauuuaaaguaggggaaaaaagggcaaagauauaaaauguaguuaagaauaagacaaauacucuauaccuuaaaaagugagcaacaauucugauucuaagcauccuagaagcugcuggacucccuguuuuaaagggaaaaccagcuguuccaauaagagcaucuaucuucccaaaugaaaauccauauggagaguucucccagguccucugagaaaggcucugggucugaugauguucuaagccuugucuucaacaagaccauuacaguugauaaaguagugagguccacagggaaauuuccugcagcaacccaguaacaucaaaccaaagccaaagguuuggagccaggaaaggggcugagggagcuggcaaauugcauaauaccuaaaacucuuaggaaccaagagauaugccaaguaacagguagcaaacuuaaauguguacagugucuuggcaaguagcaggaguguguaaagcugcuucgacugagaagggagacaauaagguaugguggagauuguggcaaaguagagaccacaugcccucuacucagcacuggccaauuguuaccuccucuuccaauuuucaagucuaaugggaaagcuauauuuuuauaugaaaccucugaauuggcauuucucucagcauuuuuauuuuguuuuuacaucauguguggauaagacaaaacaugucugcagguaggcaauaucuccugaggcaguggaaugguccacugaguuuucuccuucagaaauaaaaccuauagcuguggcuugucucugggcuggggcaagacaaggcugaaaaagagaggcugaggcaacuucugggaguuaguugauaauuaauccuaaaacuuuuauaacugauauauuuaccugucaaauuucauggcuuugggaauaugaaaaacacaucuacaaaccucaucuaaggccgggcacaguggcucacaucuguaaccccagcacuuugggaggccaaggcaggcagaucaccugaggucaggaguucgagaccagccuggccaacauggcgauaccccuucucuacuaaaaauacaaaaguuagccgggcaugguggcaggcgccuguagucccagcugcuagagaggcugaggcaggagaaucgcuugaacccgggagguggagguuacaaucagcugagauugugccaucgcacuccagccugggcaacagagugagacccugucucaaaaagaaaaaaaaaaaaaacacccucaucuaauuuuagaauguuacuuugauguauaaaccaaacuuauggguagaagaggccuuacucugugaucuaagauauguuaaauuccugcccuccaaccccaagaagguggaagaaaggcucaguccuaacccuagguaacguaauccugaggccuggcggugugucuguuacccagugcaucugugcuguaguugaaccaucagugaccagagacaguccugauuuccaauucucagucuuucuuagacucuaaucacaggcaaacagcccugaggucuuggaggguuuguuuuuuaaccugagacuugaaucuuccuuuccagcucagagccgugggaagccuauucuguuagagauaaacagagugcacgcccacaauucuaauuaacagauuuuuccucccucuucucccauguuucaccaaaggaaaccagcuucuuagcugggccagaagucaaaaccagauucauaaagguacaacaaaauguacaaaacaauaaguuuccucaaugaaagaaaaguaugaaaaaaauaaagaaaaccuugguagccgauaaagaaaauuaguaguauacacaguauccagaaaggagccuucccucuaacccugaucccugaaaaaaacucuuuaauaaacagacuaauaagauacaauaccaaauguaaugugugaacuuuacagccugauugaaaacaaaaagcuauaaaagacaauuugugaauaauucaguaaaucuuguuauggacuagguauuauuuuauguuagcaaauuauuaccaauuucauagacaugauaaugaugauaguugugauuacguacagcaaugccuuuaguuuuaggagaugccagccaaaguccuuaaggguaaaguuuguugaugucugcaacuuacaugcauggauggaugauggauggauggauggaugcauggauggauggauggauggauggguggguagauggauggauaaauguauggauggauggguaaguggguaguuggauggauggacaaagagauggacagauagaugaacugacaaaacauggcaaaacauuagcaacuguugagucuagguggugaacauauggccccuggagacacugacaaccuacaaguuauaugcugguauaaaggacaaaucccuaagagcugucccaaacagagucaacuuuuaaaaauaguuuccaaucauaauauuucagugacaggagaaaaaaacguuaucuugaugguaaaggauuuaaauuuauggcauagcugaaaaugguuacugaauugaaaucauaaaguaaugaaucauuucccgaaaaagucaagccauuaguaaugccauugcaugaaaaacuauuuggagaugucagaugcgaaaggaagagagggaagggagggagagaaggagacaggggaaagagaagaggggagaagggagaggggagagggaaggagggagggagggaggacaggcauggcaggaggaaucacucacuccugagauuagagaauaaaaagguggcaggugacacagacauguuauggcacccacugaguaacggccuccacuucacgcuagcuuucggaauccucuagccaagaauuuuccuuuccgagggucacucuucuggguucuucagauacggaugacaauaugacuaacacccauauuggagacaaacuauuuaaccuagccucagaauauucuccauguaucuccuaggcuccuagguuuugaagacuaccuuaggaaauuauugaauaaacguagauaucuucuagaagauuaaauuacuuuuuaaaaagaaaauugaacagacuucaugauucuguuggaaaaaaaucaagcuaugucuuaauuucuacucaauucuuucuguuuuaagcacuguccuucuuauaagaugcagcaaucuguauuucucaaagauucccuuguaggcagcuguuacagaugaaccaacacugcggccaagccuuuuagacuucacaaucucuuggacucggcaagauggucccugccaucucucaauacacaguaguggaaacaaccugccccaaauuuuaguccaaauucuuagaucucaacuuugauguccugcuugacaagaaauaggauuuccaggccagugcgguaacugacaccuguaaucccagcacuuugggaggccaaacagggcacaacacuugagcccaggaguucgagaacagccugggcaacauggcaaaaccccaucucuacuaaauauacaaaaaauuaggcgggcaugguggcacaaccuuguagucccagcuacuugggaggcugaggugggaggaucacuugagcuuaggaaguggaggcugcagugagcuacgaucuugccaaucucgccacugcacuccaggcugggugacagagcaagacacugucuccaaaaaaaaaaaaaagaaaagaaaagaaaagaaauggaauggaauuugaaaucacagcucaacagaugugcagaaauuagggagacaucauaaacugauucagcacauugauuuguacuuuugggcucaacuauucuugguuguuuucauuaauaaauguagguaaucaggguucacucuacugaagugaugaagaauuuaugcauaccaaagacucugaaggugagaaguggccaggcacggcaggaggaagcacucacuccugagauuagagaauaaaaaggugccaggugacacagacauguuacggcacccacugaguaauagccuccacuucacgcuagcuuucggaauccucuagccaagaguuuuccguucugagagucagucuucuggguucuucagauacugauaagaauaugacuaacacccacacuggagacaaacuauuuaaccuagccucagaauauucuccauguaucuccuaggcuccugugaaaccagaaugcuggcugcaacccagcucauccuuuuuggcguaaacuuucuucgaaagaggaagggcaaggaacaggaaaaggaagaagaagaaaagggaaaauaagaacacuuguccgguagcaauaagagagcuaacaguuacugaggccuuacuaugucucagggacaguguuaaacaauguaaaugcauggucuugcuuaauccucacaaucuagaaggacauaauuuuuuuuuuuuuuuuuugagacagaguuucgcucuuguugcccaggcuggagugcaauggugcgaucuuggcucaccacaaccuccgccucccagguuuaagcgauucuccugccucagccuccuaaguagcuggaauuacaggcaugugccacuaagcguggcaaauuuuauauuuuuaguagaggcaagguuucuccauguuggucaggcuggucucgaacuccugaccucaggugaucugcccgccucggccucccaaacugcggggauuacaggugugagccacugcacccagcuagcugugacuauuauuaaucccaauuuacaggagaaaaccgggacucauaaggauuaagcaaacuacccaggaucacacaggcauugaggggcagagccaggauacaaacccaugucuaucugaaacuggaaaccccaaagucuuagcuacucugccauauguggccuuccaagucauucuuuuugccuauagagcucuucucaucuccuagcucgagauccugccuaagaaagauggcccagucugcaggcuguuugugaucaccccuguauuagucccuucucaugcugcuaagaagaaauacccaagacugggugguuuauaaaggaaagagguuuaauugauucacaguucuacagggcugcagaggccucagaaaacuuacauucaugauggaaggagaagcaaauauguccuuccucaccugguggcaagaaggagaagaaacagagaaguacagagcaaaguggggaaaagccccgcacaaaaccaucagaucucaugagaacucacucacagcacgggggaacggucuccaugauucaaucaccucccacgaggucccucccccuagcacauggggauuacaauuagaauucaagaugagauuuggguggggacacacagucagaccauaucaacuccauauggaaaaauggcaccuucccuggaacuccugcacaguuuccuuguaccauguuuaaggcuauuaaagggaggguuuuauugcccauacuaggauauaaagacaggucaugacuuuuguauuccaccaugcauaggucuccauaggcucccaguucguagauuacaaaauaaugcuacacugcaucaguccggugcuccgucuccaacaguugugucaucuauguuugguggaagaacugaacauuuuaagaguuaaaaaaauggcauuuguucaauaaacauuuauucaguccauaauacauucaaauuugucagacuccagcagucuacucgaaauugucagauugccucuuaggaagaaacuaaauggcauauuuuuuuggcaucaaauggaaaucacuacuuaauaugguucuacaaauggcagacuuaaggcauuuuuuccaaauucuccacccaaagcugugggggaugcuguuggaaggcucccuacaugaugccauaauuacuagaaaauggaaaaauccaagaaauauggggccauggaacaggguucagggacuaagggcaacuguugauccaugcaaagaucaaagcugugcagaaaccauucucagguuuacacagcugcaugcuccgugcgagagccguaaaauaaacacaaucuggaugggagggaaaggucuugugacuaggagugugugggugucaaugacuccccaggauaccaaacgaacccagaggccagagagccaccucacuccagggcuagaaaaagaaacuugugcucuuuuccaacccaggacauauuuuuauugggccagauaauuuuaccaauucagccuucaaaaauauaagaagagaaaggggagagaaucauuagcaaauaagcaaaagauuucuugacuuuaauaaacaccauccaaaaaaaaugaauugcucaaaucuuaauaaucugaagaagagaaagucucugcuccagcuacucuuauuugguugccauguacaacaaccgaacgagacccagagcucucaaaacuccuuuaggugcaucaauuccuaaacuaaauaauaacaaagccauauguuacuuuauuuuuagauaugaauugcuguacaaugcacaaacacaacagcagcucccugcuaccauuuggauucauuaaaaauaaaaucaucucauaagcuugcaaauguugauuuuuuuuuauuuuuuugcauuacaaaacuuucauauuuccccuguguacagaguauaauuucuguacaugguuguucucaaugucuugaaguugauauacauguacuacauguaauuuuagaaaaugaaaauaauaauaauaauauauauacauauauauaugaauuccugguuucauguauuagaaaacaauauguuuugcucaucgaaggcgccaauauaaaugcuauaaaccaugaaauuaccuuugagcccuuccugaaauaaccaguucacaaacaaaugauccaugcaaaaaggcaaggggagauuacaauaauaagacuaaguuacauuuucauuucaggaguuuuuuuuaauguaaaaaaguauuauuaccagaaaaccgacaucuguggcgguacauccaauuuauaaauuuauauagaaagcaccaaacaauacagauagagugaagaaaaagacauucaaaguaaggcuuuacaaauuucccaaaugugauacagaacucauauuuacaacaaauugcuucaauaaaacuuuugguuuucccacuucgaagagcuaguuuuaaagcaaugacagcaaaagcauuuuacuaaaauaacuuugaugcuuuucauacucagaaaauaagauucuacccuagugaugacccaaagaagcugcagauggcaggaauccuaccccaugagucaauacucugcagcugaaauuagcaaagcccuucaucuaaugugauacccaaacaggcaucaucaucaacaucaucugggaacuugcuagaaaugcagaucuuugggcugcacuccagaaguucgaaaauaaaaaugcugggggcgaagcccugugcuacguguucgaaaaaucccuccaugagauucuggugucugcucauuuggagacaaguuuuuguuuguuuguuuguuuguuuguuuguuuguuuuuuaagacugagucuuucucagccacccaggccggaguccaguggugcgaucuuggcucacugcaaccaccaucuccuggguucaagcgauucucccaucucagccuccugaguagcugagauuacaggcacuugccaucauguccggcuaauuuuuguauuuuaguagagacaggguuucaccauguuggccaggcuggucuugaacuccugacuucaggugauccacccaccucauccuccaaaagugcuaggauuacaggcgugagccaccacaccuggccuuggagaaccauucuuauucugauaauguaaacagccaguguuggagauaauaaugcuacuuccccuaagaucaugcauagaauccccagugguuccuccauauugcucuuaaacucgccaacugcuguuccucccuauccagaaaauggcaucugagacagcuugauuagcacauuucagucuagauuaauccucgccacucucucugcucuaacacaucugaucugcaggguuguagaugauacaucuucagccaagaccucaaaauaaaugagagguacugguucugacagaagccaaggggacaugagacuccuggauuuccuccaagauuuaaccaccauccuccuacagcggccccacaauaccuaggacacaggccagggugagccuguccugggcaggggacaacccagacuucugagcauggccuaccaggagaccuuagagccuuugugugaaauccaaauagaaaacaaaguagaaagucgcguaucuccuuggggccgaaucuuguucuugacccacucauacauucauucauuuguccauucauucauucauuuguucauuuaguguucauuaguuuguucauucacaaucaacaaauguugaccaaacucucuucuucccuccuucccauccuuccuuccuccuuuccuuucuugucucucucucacccuuaccucccucccuccuuuccuuucuuccuuccugcugggaacauaaggcuauauccaacuaucucaucauggagucacauuauaagauuugcaauagauagcuguauuuagacuauccuuuuacagaccucacagccuaguggggacauacauacacacacaaauagauaauuaugauagaaugagguaagaguaaaauggaaaucugcaucaaggaguauaaauaagagaugacuagggaaauuguuuuguugagagggacucacacacaauacagaacuuguagaacauggcucuuauagaacaaguagaagccagcaauauuggaaagaggagguguugguggguuccaggcaguggcaagaccaggaacaacauuuuucugaguggaaggggcucaucaguugcaagcucuucaacucaagaaauaugcaccagugccucugcaucugcaaccccggcacugggcuuggcacagagaugucaaggcagguccagagaagaaucaacuggacaggugguuaggaacucguggaaggaagucagcucuugaggcagggagaauccuuauggcucuaucugagcaacccagacaaggagaaaggggagcugucccacccagggaccagcagcagaggacaaaugggcagaaggcacagcaaggcuguguggaaauccaaauugcuaaacacgaagggauccgaagaggccugugaaucaccuuucaggaaagccuuuuuuuuuuuuuuuuuuuuuuuuuuuuuuuucugagacagagucucacucugucgcccaggcuagagugcagugauaugacaucggcucacugcaaccucugccuaccaggguucaagcaauucuccugccucagccuccugagcagcugggauuaaagucacgugacaacacaccuggcuaauuuuuguauuuuuaguagagacaggguuucaccauguuggccagucuggucuggaacuccugaccucgugaucugccagccucggccucucaaagugcugggauuacaggccugaggcaccgcacccagccaccuuuuagggaagucuugaaugaaaacaaagguuucuuugugcuuggaugaaguccuaccagaauugaccggaucagacugaaauggagauuccacuuuaugaccuacuaaacaauucucccaccagcacgggaggggaaagaaccuccaauugcccaguucccgcucagaggagaagacaagugauccauagagcuuagaaccaccguaagaaagagggacgacauacaggagagaagagaggauguguaacccagcgaaaugaugcuagguuaucccaggggauacagaagagcagggaccauuucuguuucuaaagaugccuggacucaguuacaaaaucuggcaggagagagugcaaagauaaucaacccuuaaugccugcuuauuaagcaccauccagcucccagggagauuuacaaauauccuccuuguuaauucuugcaacaccaagagguaaauguauaaucccuguuuggcagcugaguuaacuaguggcucaaagagguguggccacuugccuggagccacacagcuagaauggaggaggagguggcuugugucccagccugauuccaaaauccaggaagaauaugaucuaaguagagaggcgaaagaaaggcucagauaccuuggaggcuaaagugguugacaggucaggccaagaaugcuccaagagcaaaggaccaacaagaaauggugacuuuuccagagucuguucaacaaggguggggaggggaggugucuccaugaggcugugaaauuuccucacacucuggcagaauaccuuuggccuggaucacuggcuugaagauucugauuuggaauccucacccuccuagcccauccuugaauaccuuacaaaguauuuuaaugaagugcacauucagcucuacaaauaagaucugugugaaucuauuuggcucuucuacgaagcccuccaaacacuuuaggguaagggcagcacauuuaaacuuaauggaauuuccugccuuauuuagcagugccagaauugcuccaacauguaaauaaauuuaggaagagcuuuauuuuucuuccuuuuuuuuaaaaaaaaaagauauagaacauaaucuuucaacuaaauccuaauuuaaauauucuaaguccgacagauacuuauuuggaccauagaaauacugcauguggguguaauguggauugcaugcauagcuauaaaaaauacuuggcucuguuauuuucuuaaaauugcuguguuguuaccauuuuuauuggguuaauuaaaagaccauaaaaauccauucaaacauguuuggaaacagauuugcaaauuucauaaaauguguucaguuguuaggccaaagauaagaaaaugacagacagcucuguacucaucacuuugacguauucaaucuuucauucuucuaaccaauaccccuuacuaugggccacgccuuaggauaggaguugccccugcccucauggcaccaucagucuggugagagacagaaacugaaggacaucauguagaucagaggguggcaaacuuuuucuguaaaaaaaccugagguuaaugagcugagauugcaccacugcacuccagccuggacaauagaaugacacugucucaagggaaaaaaaaaaaaaaaaaagguaaaaaucauccucaucucauaagccauacaaaaaacagguguuucacagaaucugacuuuguuacacagggaaagguaccaucuuaugguugacccaauauccagaaaagaucaaucugggauucccagaugcuaaguccacugggcuucucuaucaaucccgaaggcacaaaaggggaauucccucccucagcuggcggccaucagaccucucagcucacugcaaagauggcuucuugccugguuucaaggagcggucuuuuggugacuuucccugcucccugguggccuuggaaauaugccccaaacuugauaaagugcuaauuuugcuuuuuuuuuauuuauuuuuuacagccguuguguaacuuugauaaaaagccaagccaauccuuucugaaaaucccaagaaacguuagcccacagauugaaaccuggggauccaaguuacaaccagaaggcaauuuucauggucaacuucuaaaacuauccaaacagcgguuucagaccgaaauaauaagaaaccucugcaguuuucccagguucccaguccugccuggauugcugaauggcagccgccagccagcucaguuauaacgacagaaacauaacuuaguucacgugaguggccuucgcgggcaaacguucaagaacauuaagguuuuaauauaauuauaauuauagaacauguucagccaauuaaccacaaauaugcuguuuaucugaaaggccgccaacacugugaaaugcagucaaaauaacauuaggcugugguccuuaagcaaagaauacacaucgagucaaaagagagaucagaaugaaaaggccaaaauaaauauuuuaucugcuauuuuaugaauauuucuucaaaugucagauaaaaauaugucaucucaacuucccauauauuuacuugaugaaaucagauuaagugaguuccaugacacuacugaaaaacaucauaaaccaaaagaagaaagagagagagaaagugcacuguguaaacuuggcagccacggcauccuaacaccagccuaaguauaauguaaauaagaaaaggcaauuagaacaagucauauuucuuaaaggguuaagaaacugcucaucacuccuccuaccuuucuuaguuagucuuacaggaauuuaagcaaaauuaaacuuugccuuagcaacgaaauaauauaagccuucucauaacuuucuccuaugaaagaauuuuuaaaaaaagaaccuagucauaccauuuguauacguacaauuuguacugcuguaaaagcacauuuugaaaagugcucccuaaauaauuaagcuauuccuuuuaccauacuucccauauuacagaagucauuuucccaccaagaaucaauaagucauucuucacgucagucauuuuucuccauuuaacggaauggacuaaaguccgacacggcaaguuacauuaccuuugaauuauguguguaauuuaaaauucaaaguacuacacuaaggagcuuuuuagacugaccacucuacacucucuucauaaauacggucccuugcagacccuucugacagauuuaccgaacaacaggaguuugaaacaguugagccugugagcccuacaggaaagcuguucucuguaacaaugccacaaaaacuacucucuauucagaggaagcacaaagaaaacugucauacaucauucaccaggaaacaacucuauguuucuagauuaaugguaaagccauucucaagcaucuuaacuuuaauuacaaauaaacaugggauggggggugggggggggaacgaggagggagcugauaucgacauguccgcucgcagagugcucgcagagugcucucuaaguaaauguugccaagugaguuuuguuugaccaauuccaaggccucggauuacacuuccaguguagaaaccccaaguagcaaugcacuaaagacacugucauucguuaaacacaucacaaggcacaaaauaugcagagggauauauaaaucaaaaaugcuuaaaagugugugugugcacaugaaugcacaguaaaaauguaauaaaagugacauuaaaaaccuuuaacuaaauucacgggcugauguacuucugauuauaaguaaaauacaaugacaucauugcuuagaaaaauuuuuuaaguggcuacuaaaaaugucagugaacauucuuaaauuugcaauguacugacacuguaggccaguaaaaccuuuacaaaaacaccuaucaagcaaacggcguuucucucuacagcccauauuauuuuauucaggaccuccucuaaaggaccagaccauccuagccaguauaaaagaaaacaagacugcaauguuguauuuucaaauauuguuuauuuagaaaacaaaauagguuugauuuuacaauuggaaucuguguauauaaacuuaggucucuuauucuucccuucguucaugaggugaaucauuuaccuuuaggggaguuuuauuuuuuuccccuguuacuggucacagcaggacagcggaaccgauuguugggaaaaguacuucccuggcuggauccaaguuacaggguuucucagaccaagucacuguagaguugcuacccuguuccuucccacuacccugcagccuaauaaucuuuuuuuccccuuuuuuucauuaguaaguaauucugauaacuguacacuuuuccugauguggaacaaucuuagacuauucgagcucuacuaaaccacucuaggacaugccuucuuugggucaucaaaaaucaacucuccucgccuagguuuuauucuugccaacuuagcauucccacggcaauucacuaaaaacgccuuaaaaaaucauuagcucucauuuauucaacuugaacaucagcauggccugaagcucgggaagaaacagacuggcauagugacgcugccagcaccaaguaaaguuuuaccucccagcgcuccagguucccagcaagacuuccagccagggcugccuuccacuccauuucagccuggcacccugacucucgcucuaccagcuguuggcacgccuuguguuaaccgagaauuugugagaaaagcagaaccuucccacugcguguuaguuuugcuuggcaacacucaacaaucucaaauuggaaggccccaaggaaaauuuuuuguuguuguucuucugcccccaggaugauuuuuucuucuucuuccugaaccuguuuggauuuuuuuccacuuaaaaaaucuagcagcccccaccuaacugauggauacuuguagguaaaugacucuaucugagcaaugaugcgcugacugggccuauaaauuaugacccauugugguuaguucaaauaaaaggagguuccgauaaaggaaaacugacacucggaauuuucucucucaaaaaggaugaugucuagggaugcaaaauucaggaauauaaagagagaccuugcaaauguaucaggcucuucuaaaauacaagggauugguauaaaauuguccuggugaaaucaaggggaagcacacaggacuaaggaaagagaggcaagaaauauauuucuucuccuuugcagggaaaacacugcauugggaagaagcuugcucuuuccaaauacauuccauuaaauugacaaccacagccaccacugccaccacaacaaaaaucaggccaaccuagaucaaauuacuaggaauaggucuaauguuacuuuuaugaccaugagguccuggcccucaucagaaccucuggguuacccguccuaucacuugguaaugaauuucauauauguaugugcuguuaaagcaaaaaaaaaaaaaaaaguaaacucauaaauaauucaucacacugucuccugccaacugaucauauauuguucauguuucaccggccauauuaaauaaaaauuuaaaaguguuuccguuuuucauuuaaaaaccuagucuauaauuggaggugaccacacgaagugucuugaagguagcaggcauuaaaaaaaucauuacuuaaauugcacaguuaaaaaauauucauuagaaauggcuaaauuaaagaaaaaaauguuagggaaucuuagggaaauguuucuccuaaauguugucccuaaaacugcuucacucuaaaaaucuguuuugagcgaccugauaaaagggaaagagagaguuucagcucaaacucaggaaagaaaggcuguaccaguuucuucagaauggaacauuaaaacaggccacuacugaaacaguucuugugccuuuguggcuaauuauuacauaauugaucuuaaaaaaauuuuuuuaaguuuaggaaaaaaaauuagaagccuagugaaaguaccaaaaacacuguaacuuuuuuguuuaaaaauuuauaucaugaaucgaaaaucagaggagauggccguuuuggccuggucuccguccuuuccuucucuauuuugauugagccagucccuuguuaagccaucagaaaacagagcacacuuagagcucuuaaacugcuuuagacacaaagaaaaaauuuaaaaggaaaaaaaaagcaauaaucgugugacaucucagagaugauagcauauacuguuguuuugcuugaugacgauaacacaauucuuuuugaacuaaguaucucucuagacuacaacugggucaaaauuauagauauuuuuuguggcccuggaugaauuuucuauuugccaaaacucaaaggauucaaaaccagguugaugucuaguuaaagaugaugcuccaacugcuugagaugcuaguucauuucaacagacauuaagauugaaggagugucauagauugcuuaggcaauuagaaauuuaaaaccguuucaaagaaaagaaaaaacaacaacaacaaaaaaguuaugccauaggaagcaugaagccucauuuacuaaaguggagaaauguauuuuauuuuauuguccuuauggcguugauugccaguucugacacauauuacaaauuucacauuguuuuucugaaugcugaggucagaccuaccauaagcuugucccguuguauuaccaaauggcuaauucccucccagguauuggagaaaaaagucagaagggcagcauccuaagagaaugggugcccaguaugacaaggagcugcuaagauaaaaugaacuuucuaacuaaaaacagaaaagaaacuauaaaauugauuuuaaaaucugcaggacauuuuuuuaaaauaaaggauaaauuaacuaugaauauauugagugguuaugaaacuaauauaucuuagcauaacagaguagagacagcuuuaacuuuucuaugauacucauauaguuauauuuuaugaugcucuaauagguauaggguacauaaugaagaagaagcuguuuguggauucauuguauuuuauuuuauuuuauuuuuuacugcuuugaguaugaagagucugcccaaauauacuacuuauaaaucauaccaaaagugcaucagugaaaaccacaguuccauuucuuaggggaaaaaaaaaaucaagaaucaaguuuuagaauccaacgaucacauuuuccuuaauuacaaacgaagacaucauguauuauuuuucuguauccacaagagaugagagaaauguaauuuuuaucgcauguuaaguuuucacugaaucacaguauuauuaagcuuuaaaucagaggauuguuuccuucagcuaagucuaacaauacuagaaaguaaaagggggggacaacccccaccucaucuggggcugcaauauuugcugaaaaaaaucuacuucaaaacauuaaucaaauuuuucgcccacugggcaaccauaugguacagcagcaugugaaucucacaaacuugcugaucuccuguaacugggugcaauuaauuacgcuggcugcauccaucucuuggauuuucgccuugugaaaaaaguauuuauugcaacagcuuuuacaaaacaagggaaugaaaaucacaauugauuaaugagcugaauggaaauauuuccguuagcagauuuuuuuaaaugaauaaggauuaauaccauggaugggaaugaacacacgucgaucucgccuuguacuuuuuggacccccaaaaagguggcaaaagagugggcagagacggugcugugaguucuaacaugcauaauucacuagcaggcuuuaggucgcaaguaauaaagccuuaaaacuggugaaguaauaaagaggcuggcuuuacaagauacuauccugggagacagaaagcuuguucuuugaugugaaaacacagauauuaaauacucagugggugaggaacauuacaggccugacaaagaagagaaagggaagggcucuugaaguaagcaaccuacuuuguccucagcuauuuaggcgcaaagguugcugcacauaugggccgauuacuguuuuaagaucccuccauaaaaccaagcauccgagaguccgucagaaugguaccacuguccuuaccuacuggcuaaaggcacaaacaaugcauaauugcaaaaucuucccccagcaauguucagccaucaugcacuugacuuugcuuaacagucagaccucguucuggugcugagccauccuauggggcuucauggagcuuguuucuugauacacaugagggucguaaucccucccuucuaacuuaauuuuuuuuuuaguuuuuauuuuucagagacagggucucacucuguuacccagcuggaguacaguggcucacuauaauguugaacuucugggcucaagugauccuccugccucagccucccaaguaguccuccaaaggacuacaggugggugccacccagcccgguuaauuuuguuuucucuuuuuuuaguagagacagggucucacuguguugcccaggguagucucgaacuccuggccucaagugauccucccaccucgccucccaaaguucugggauuauagaugugagccaccuugccuggccucaauccuucccuucugagggagugacagauccaaggcugacagucuauaaacaaagcagaagcagaugcacuuugccccuuuucagaagugcccucuggguuuaaguccaccagcuagccaagcauuaaugacaucaucauuacaugcaugccuauuucagaaagaucaguuccauuuucccuaaauagacagcagaggagaccgcuuccaacauuuugcuaguuguuaaauauguaucuugagaaaacgaaacuaauacuaaacauaauggaagaaauacguaaguuugaaagaucaaauaucguaugacucuugaaacagauaaaggaaaaagcuguuaggaccaagcuuuguaagucaacucuuaagccaacccuuuucuuuacugcaucuauugcauuuaaacuucuaccaggaaauucugcaaaggacuugguuaaagagaauuuacuauuauuuuauuaaugccugcagaguguguguggcuaguaugaugauuucucugcucaaguuuguugauugauuuuguagaaauguccacaggagauaaaaucugcaaacaccucaaagaugagacuguguccaagaaaagaguaaugauacuuuauaaaacaagaaguaagugacauuugaaacgaugguucaucucaaacaacacauuuccucugagcuccauguuuauguuaacauguaaguuuaggaaugcugauguaauagacaaagauaacucuugccacuucaaaguagcaggcaugccuaggugggcaagagguucagaaagccagcacuuaagguguugaagggguaauuuuuaaaaaucuuaagaaaaucauuccauuugagaaucggagccaccuuacaaucaaagaagccacuguuuugaagaaaccacuauccugcaaaaaguagacggaaguuaccaacaaaaaguacuuggcucccgaagaagaggaaaaucagaugggaacggguuguccaaccccuuaaaccagugacccuacaaaguacaccaccacccaccaccaccucucagaugaucucuaaaccccuccuacacgcaaugguuguuggcuuaaaaguuuaaagagcuaacaaaauguuuuaacgagauacaaaucucagagaucauuaaucaauauguucaauguuauuugugauaauucaucaugacgugauauuaauggguuacuguacccuucagaggugagauuaaugcaaaugagcugccacaauuaacuuuacugcucccaccucacaggaauggacagaugauuauaaaugacaacuauaugucaauuacaauauccaauaaagugaagcuuagagaacaauccaucuccuuuuauugcucuuccuugacguagcugaauuuagcucaacccacuguugucacuauguaaccauuguuugggggagggaaaagagauuuuucuucuuuuuuuuuuucuuuuuuaauuuuucgaugucuuaagaagugcuucaaaaacguccauguaaauacguuuucuaaaggaggagagccacaggaaaccaggaauaaaugccacauucauccuaugugaguuaaagaaaacuguauccguuuucaaauuguagcaguaaggccagcaaggaaacaaccuacccagcuguguauaauauauuuacucaauuaaaaaaggaagacauuagcacagcauccugaaaagccuugaguuucacuaaacaaaaguuauuugaaaaugacuccaucgaaguaaauaggucacagaguggaaagcagguaugaggccgagggcgggaugaaagguuugaugucagucuguacaccugcacuuggagguguggaguggggagcaggucaguaaauacuacagugcuggcccucacagcagagaauuucugugucugcaucguuccuccuugcauggauggagugauuuuugacagcagucucucuggugaagguaggcacguugucauguugccuccucaacccagauucuccugccgggcuggugaacccagaagcuguaagaauuagcuaguaucucacagcuaccccuuccugccccacuugagaggcuauguccacgccgcccucuuccccagcagacacuggcucaucgcugacugccauaggucagccaggcccuggucucagucaggaccaacucugcuguacaauucacccuccagagcuucccgugggaucaagcugaagcugaucuucagcuaagccacauccuuccuggacauuuucccuguccuuuuuuuuuuuuuuuuuuuuuugagauggaguguugcucuugucacucaggcuggagugcaacggcacgaucucggcucacugcaaccuccaccuccgagguucaagcgauucuccuggcucagccuccugaguaacugggacuacaggcgaacaccaccacucccggcuaauuuuuuguauuuuuaguagacauggggucucacaucacauuggccagccuggccucaaucuccugaccuuguaaucugcgcaccuaggccucccaaagugcugagauuacaggcgugagccacugcgcccggccacauuuucccuguucuaagccacucuucucacuuccuuucugaaagcauccugacccccaucaaaucaguggaacaagaagacuaccuugaccugugcuuccagguaacagaacgcaaggcagguaucaaugagauggaaacaggaaugcucuuaaugcagugcaauuuacaaaagaacuguucuuugcugaccacuaguaagagaccauccaacaggcuccuuuuugaagccacaucccgaaaagauccccuccugaugucucuagaaacaugcaaaaauaaaauugcaacgucagaaccauaaaaggaucauagcagauugacgguagaagcuauagauuuguguguccagaauguuuccccaggugccuccuuuugcaaaauuggaccucauuuuaccauuagggaacggggccucucagacuccguggagaagcagagaauuaucuccagccuugacugcccaggcugcagagaaccgcaucauccggggacaugacugauucagggauaggugucugccuaaaacuaggccaauccugguucucccuguggcuuuugggccaaggguaguggggaaaacagcuucuugucacugggggaacaagccaagaugggacagugcucgucugccaguggcagccccauuuggagagaauuuucccuuugaagaauauaacccauaaaagaucaucaaaacuaagggauuaaauaaagaggggaccucgaugacauauuuaagcucugaauaaagcuagacucuaagcagggguuggcaaacuauaaccgcugggccaaacacggcuguguucuuauacagcacacaggcuaaaaaugcuucacauuuuuaaaugguugggggcgggggggaaagaauaauauuuugugacacaugaaaauguauaugaaauucaaauuccaguauccauaaauaaaguuucucgcagccaugccugcuccuuuacaugucguuuaugccuguuuucgcacuaugagggcagaguugaguaguuggcaacaaacacuacaaggccccaaaauauuuauuaaauaucccaucacagagaaacuuugcugacucuugcacaaaacuucgcauuuugucagccaguaaugacccuuuccucuuaagcuaguuuaaauuuggagcuuuuuguguguaagaggaaacuccugaucuacuaaaagaaaaagcuauucuuaguccuucccagauaucccugaaccuccacccacccagucugcugggauccugauauaguuuggauauuuguccccgcccaaaucucauguugaaacauguccguaaugggagguauuugaaucacuggggcggagcccucauggcuuggcgcugucuucaccauagugagugagaucucuggagaucuggucauuuuaacccuuuucccauuugccccaagaauacuuacuggugugcaguguuuacccugagaucgcuuugccaugaaauaucucgcuuuuauuauuuuuuucacaucacucuagcauaucgacuuuggaaacgaaggauaucguucuauuuauagccuucuguuuuuaguagugguauuuccauuuacaaaauauaauaguucuccaucacugaaaaugucaaauccgagaaaauguagcauuccugcaugugauguuaacauaauucucgaacaguuguuggcugaagauucauuugaugaauccgauuuuuccaaaauacacaauucugaugauucagaugauucugauguuaguucuguucagaaauauuuccaagaacuguuuuuauauuuuauuaucacuuugaaaaucggucacauuugcuucagcuucaaagagcauguuuauguaaaauuaaaugagcgcuggcagugagcugcgcuuuuuuuuuccuaaacaggaaaaggguuaaaaguggggcaccucccacccccaccccacgcucugucacuucccacugucaccaugucaccugcugcucucucuuugccuucugccaugauuguaaguuuccugaggccuccccagaagcagaagccgcuaugcuuccuguaccacuuacaaaacugugagccaauuaaaccucuuuucuuauaaauuacccagucucaagcauuucuuuacagcagugcaagaacagccuaauacauauccuacagguaacgucucaauauccagaucaagugacugguuguuucucuuaccuguuucgcagaaguuauugcauucuuuguugaauaucacaaacuguuaauauguuaaucuuaaaacaugugaaauauauauaauaucuaucauuacaacuacaauuccaaauauuuauauauaacgucagccaugccaauggacaugcaauucuaggcccagcaauggacgauaaaguagguuaaaagugggggagaaaaacugguuuuaaaaaacuguaccugaagaacauauuuaauuuaaagggaaaucccacaacagcuaaauuguucccccaguuggguagagccugccaugauuagcuguaacugccuggaacacucuagacucagcugacgaaacuccaguugccuggugagaacagagugauuuugaugacuuuugcagaggaucagaaagaggggaaacggauucauuugauucaucugugguuuccuguuuuccauaaggagauaguuacaggauuaaauuucuccucccuuuucccuaugcacucacaccugggucccaggacagaaggaccaaucgucaggaaaauacauccauacugcauccccugauacuucaucucagguugggcaggaggguuagcagaagaguuauuucccuuugcgaagauuaaaggguaucucacuuuuauuuuaacaaugugaagacaacuguuguuccuuacuauuaccaaucuacuacacuggauucuaauagcucuauuacauuuuccauacauucuccuggcauggggcauaaaugggugagacagcucuggauaaaucacugccagcagcagaggcauuuucuuuagggaaugaaggcuuccauauagcauuuaacuaacucucuuuuuggaaacaccccaucacaaaugagucuuucaaacugaagaaauugaaauugauuucuuaggguaauaauuaaccucagaaaauaaugaugaaaaguugcuuauuaauuauuuuuuauaauauacuuugggaauauuucuuuuuuccaugaaagauagagacaaaaguagacacauuuuacaaucauauaaaaugugauuagacucauauuuuauaggagaaugaaacucauuuaauuugcaaaauacuuaauaugagagggaggugucccccuacacacacacacucuuuucaagacucuuaaauagcccuuuuuaaaacaacacaaucucucuguucuguucuuuauuucuucacacauaacugccuuggagcuuuuaauauauuauugcuauuucaaucccccaugguuuuucuacuuauucaaaaagaagguauuuuucaucugaauagccauugacagcgaacucuggugacauccucagucuuccuugacaaugggaggaggaguugucaccaagaaacuuguuacuaucccaaguaacgagcuagcaucccucagauaauacaauagagauggacuaguguuuuucaaacaauuuaaaacacacacacuuauguacacagaaaaacacauguauacacguacacgcacacacaaacacacacacuuuaaaacacccucuuuuucuuuagucaccugaagagucguaaagcauaacugcaaacugauaaagguauaaauuaaaucauauaauagauguuguugcaaaucguacaugucugucagaucaccgagauagaagucaaaacaugaaaagaccaggaaauacccacaaaagaagauguaauugaugagacuauucaagaucuuuuauuuuuuccuucuuuugcuaguggaaaauuuuuauucugcacuuuucuggcggagggugguauuuuguuuucuguaagauacaaacaaaagacaguuguguaaaauuaaguuaugagaacaacauagaacuguuucuugaagcauuccaaagauaaguuuuugcuaauuaauuaacaaauucaagcugguuaaauaaaaccuucuuccaacaccuccuauuuaauugcaguuuggcaccaacaaauauauaucaaaauuauaguauuuccccugacaggaagcuccuuccuuccacacacuauuauggcucucugcagaguaagccagaauugcugacaaccuugaacacugcuacaacaauauuacuauacuuggcagagaaguacccuugcggcaagagaaaagcuguaauuuugacugucacuucacauuacacuagauauuauuucacuguauacacauacacacacucacaaacucuuaauagacuacaguuuucgcacugccugccuuuccaauauaaauggcaauauaauaccagcaaaccgccaaugagauccuggagagaaacaaauguuuggcauuauggaaacaucaucagaggaugcauuuuaagggauauuucauugcuuugucccccacucacaccguucacaccccaucaucaacuucauaagaucaucaccuugguuaucaaaaagaaauucacuuuuuuuaaccccauggugggccaagucagcauuaacaaauuccauguucaaaaauuuccacgguguuagcaaagguugugcuaugauucguaauauuuuggacauucuucaaaucugaugccuguuauguaaaauuuccagauuucaaaauguauccuuuuuccugcauuuaucucgcuuuccuucacacccggggggaaucuguuaaacugcagugaccacuggccgagucccaagccaagccaaaccgugcaaacaugaaacggccccacaaaucaugcaaacccuacacgcugucccugccagagagcagcgccugucuuugcagagaacuaaaugcaacauaugcuuccuucuuaccaagcucacacugaagcagauugggccagguuccccacugugcccucccccacccccugcccagcuuugauuuacaagaugcuauguuaauauucccucuauuugucccaggcaaggaauucugugaugucgguaugagcuccaaauugagaacucccuggaauccggagcacaggucagaaggaugaauacacagagggagaaaacugcaacuucccucaaggagagaaugcuagaaauggcaaugggcaggaaagaaaggauccugacaucauuuuauagagagucguucaucccuuacacaaaccuggccaaaaaucuacagaaugcugaggaaacacggcuauucaacaagaaaaucggagcuucucucucuacuuaaucucugccaucccccuuuuuuuccuccccuuucaaauugcuacuucaaacgauuuaaauaagauuuaaacuuguuuuacugaaucaaggaaaagcaacagcaaacucuuugcccucuguuaagagaauguauccaaaacuucaccgggucugcugaccacaccgaauuuaacaagguucgcaaaugaacuagaguaaguuucccacagugacacauuaauaauaaguuccuuaucccauccaucccaagccaugaauauguaauguuauaaaaugaguccuuuucacacaacggaaucucagacgugaauaaauaaaaacuauccaucacaagccugugaaaaauuaaugagaguucggagaugcaaagaaaaauggggacaaggagagauggcccaguucauaaaagccucccuaaaacuuucagacaguaaauauccuagcccccgucccucaccaaauugccagguguggguggaaagcaacagauuuuauuuuuaaugggcuaaaauuuuacaaucuuaaagcacaauucaugcaagcaacugagagaucacagcuacaaacacuggacuuucuauuuucuccaugcgaucccaauuucagcugcagagccagaguuuauuucuuuaauuauucauaauucauaaccaaccuacuuccagaaggauuugagguugcucacagcaguuaugagaaaagggagaagaguggggcucgcgcagggcucaaacaucaggagacuggaaaaacucugcuuugugcauuguuccuugacaucgcuguggacacacagugccugauuaaauuguaugugucgcuuggguuauaauuauuaucauugucaaaaccacuugcuggaugcucacucucugcccagcauuacacuagugcuaugcccugcauaaacucugauucucacccucuaugaccccauuugacaaacagggaaacugaggcugggaggagcuaacuaaccuaccccaagucuaagagcuggugagaguaagagccaaaggaaggagguuagccagcuccaaaucaccugugcuucccaccuggggccacucacuaccacucaugaguuaagguguaugaaaacggcuuugguaaccuccuucuugccaucaugaaacugcagcacgcuaauacugucagucugucucagaaaccccugccagccagaaggcuuaacuuugagaugaaugcaaagcagaaugaagcccaggaaguuugggggucugggcuaaggcugaugcugggcagcagauuagaggcagagcagagcccagaaguccagccuccccucccagugcacuccucgacaagaggcugcacuuccucgucggaaggacuccaggucccacuuugggaccagacaugcugcaaaaacaaagaaauucacccaaacugguuugcccuuuacuggauuuuuucugagacugaaaguguugccuuaagggacaaauaccaaaaggaagauuuaaaaauggaccaauggggacaaucugcuuaaucuggcccaaccuccucccuccucccuucuccaccauccauuccaugugggcagaacacgugacucaugggauuacugggagccugccaugcuguucuguuuucaacucacuacuuuugucugugcuauucuuucauucaggauaccgccccaaccucuccaccuggcuaaaucacucauccuuugagaugcagaagccaaagagauccucagcacauaccuccagaaagccaguuacugcaggggaugcguacggaccagccagguaaugucaauuuggaaagcgggccagguauaaauuaauaggggcugguuggugugagcugacccggugggcacaagccccaucauccaacuggggcggccaccguacagggugagucaagggcugcgcccgggaaaugugggagcaaaggugccagaccuuccaguuuuuuaagagaaaccaagaauccagguuuuuaugcgaacuuuaaaaaaagaggaugugggggugggggcagcaaacacaugccugcaggcugaauucaccaccccccuccacguuuuagaucuuauaauuacaucuucucuuuaggauccuuaaagcauaaaggcaagagccaagucucaguaaacucugcaugggccacagcucggaaaagaaaaaaaccuguuauaucaugggagcucagugcuugcugaacugaacugauucacaucaugacuugggauucaugaaccagaagcacaggaaauuaauaaaaacugaaaacgagccaaagagaagggaaaggcucucuuaccacuguugagaauguuauguuuaaucccugcaagcaguagagacucaguguacuuccaugaagugcugcuugggcauucaugaggcauuaagggagaaagaauuuuuaaaaucuuugucuucucaaaagggaauaccacgauggggccaugucuagagcaaggugucuaaggugauucuagggcccucgcccaagaaacgaaagcagcauugaacauguccaggaaggaugugaagccugaagccaaugcagaagacaaagcuagauaaccccugucucuaagacauagggacuuagaacucuuacccugaugagcaacauugaacauuggauguguucaccagaauggaaggagacacacuccugccgaaaucaugaagggcaaacugacccagaaaagggacaggucaaggaagguauuaccucugcauaguucuagguguccugcuuaacucauucaggaauuucgggccagagggauauccaacaggaauucuaaccugaagaguuuagaaaccaguaggagaaucaggaugaauucagaaauuacuauaauaugcauuuucaagugauaaaucccaucaaaaacagaaaaagugcuugaagaacuggaaggaacagugaucauucuugucagauggaaucuuaaaauccaguggguuucaaaggaugagcaggagcuggacaugaagggauuggaggauggggacuggaaauggggaguucauugcaaucagaaggaagagcaagaaaggaacaaaaagcaagcaguguuuggggagaccaggaugugauuccaguuuggccaaaauauaggguauacugggagaaucuauugagguuuugggaguguauuuguuuguaguuugaaaacaccuaagcaauuuugaagagaagcagacucuuuaagucagaugcuggguucuccaguccaaauaugccaauauaauugugucuggucaaugucuauccuguccaucccuccugagugccagaucuaaauccaggugccaauggaugacuuccacuugggugccccacaggcgucaugaauucaguaugacugaaaaggacuccuccuaucuucagcgaugguuccacuacacaauacacuguccaagccagaagucccaaacuagccuucuguccuuccuucuccauucaccacgccugucauccccuucagagcuguuggccaaaucuuguugauuuuaccaaguaucuaucaaaauguuuccucuuccucccuguacucacugcaaucacuuuugcucaagggcucaucauuucgugccugggugacuagaguuguuucccagcaggucuccccacccuccuuucucacauggcugccagaacggucuucugaaaggcaaaucugaccauucgacaacucugcucuaaauuccuccuauggauccccauggcuuggauuuaauaaauguuuauugagugaaugaguucucugcauacauguuguucucugccugguaccguggaggucaggcucgcacagaagcauacuuauggucagaguuagucaauaaaaaaagugaucuauucugaguuccauaccaccccaaaacacugaucagcuuggggaaacuuagaaaguucaaccaccuggggauaaaguuuggacaacuaggcuagggccaauucaggguacagguggaggcuaggaaguuuggcauaggauaucauuaaaggucuucuaaggaugaaggcaauuggagcuacacuauaggaaggcacagcaggcggagaacagacuugagaaggauuugggaggugaagaaacagcuaaaagacucuaucucugacaaagauauaaugcccagaauuagaagaguggaaaugaaggaaugaugaaugaaagagauuaucaagaagaaacaaacaaacaaauaaacaaacaaaaaucccuguaaucaguaaccaucuauuauuaugucccagauuuuggaaaugagacccuaaugacaagcacuccuaaaccuucaacauagcugcuguuaaggauguugucuugugggggugaaaggcagaccaaaaugauacuaccacccuacuccuuaccgaugaguccuuucugauuuuaagcaaauggcauacaguguggugaauuaaaaacagcauuauccugauuuuauuacuaguaucauuacuauuagcauuauugcuacugcuguuauagguaaaaaugggaacguugugaacauuucccauugccuauccaaggugcuugguacuuuacaugauaucucacuuaaucaucagaaaguuuggaguuauucuauagguaaugagggagaugcuauuauuaccugcugugguggaauaaagauggcugcaaauucuuugucacuucuaccagaagaaagugagguguaugucugcuccccuugaaucugaguggguuuuguaacugcuuaguccacagcagucaugcugugccaaccccuaagccaggccauaagaaacuggcagcuuccuguuacuuucuuuuggaauccucugggagcccugagccaccauguaagaaaucugauggcccuauaucugccaugcaggaaaggccauguguagggcucuggguaagagucccucagcugagccaagcaucccagucauccucgugaaagugccagacccaugggugaccauccuggaccagcugaagugccaguccaauucauccuccagcauagcaccacugacugaccccagucaacaccacaaggggcagaagagucacuccacugagccccaacuuacagaaaucacaagauaaaacaaaaugguuguuguuuuaagccucuaaguuuugggguaauguauuaugcggcuauacauaaauuggaacauccacguuuuacagaugagcuacuuguuacuccaaaaguuuggcugacuuaucuguagucuccuggcugaugaggugugcagccuggauuagaaccuccaucugccugaccuggcugcacacaaugcuuguuaaguuaucccggaaaacguaaggccauacagguguggcagacuaauuaaauucaccaugcucuuugggcugugugacugcuaccaaaauguccuacccuaccucacauauucccuuguuagguagagaaggcuggacgaugcuacaacugcuucuccgccaggccucccaacgcccucgcugggcagagucccaugugacuguuuucacugcuagaaaaauuaacuugcauaaugaccaggaaguaaagauaaacucaaggaugagagaaaaccucccaccucagaggcuccaccucacuggggugaacaagcacugaccuucuaucauccuauaaggaaaacaagaagaagagaugcuuacuugaauuacuacauaggcucccugccuacauccacaucuugaaaauucugagcugugaagcucucgugguuggcuccugggaacuugagauucccagugauauuccaaugcugaaacagcccagcaaggugaugcagguaagcacgcuuguaggauguaacaaugugaaaccucagcacacugugguuauguuucaaagcacgaggugacggaagcaagagcgaguuuacaugggcuugugauuuccuuugacaagauacacgcacucauuccuucaaccuaagcaaaauuuccaggacuacaacagauuugaaacucagguggacgaaaaaaaccaucugugaaugggauaacauacgaaaucaucaaagguaauuguuuuaaaaacgugacucaagauggcacagaacagcguccacagauguauucuugguuacuuaaaaacacaauuuaaaguaauuagcuuaauguugauguaauucuaaagaucgauaaauaaaccuaaaaaucuuaauuugauauugaaucgccccaaauuaaacaacauauuuucaaaccacuaaauauugauucauuuguaagaugaggccuuucaaugcaacuauuugaccugaacgcaaacaggaaaggguugacacauuuucucugugaagggccagauaguuaaguaccuucaucuucgggccacguaucgucucuggcacacagccuucuuuggauuuuuuguucauuuuuguuuuuuuuaacgggucauaaauaaaaggcuacuggcuggaguuagccuuugggccauaauugguucauuccuaccuuuucauaaucucaguuauugaucaggugauuuuucaaacugugaagggucuacacguucacccucuuccuuguaaguuaaugaguuagcuaccaaguuuugaggaagcuagcagaaaacaggagacccaggaucagauacagaggacuucguuacucauggcagagcaaacagcaugagcuuuauuucugcacugauucccauugcccuggccccuagucccacagggaggauguggaacagcccgguagaugccgugcucauaguacguuucagucauggcugaggagccccaagcuuagaaaccccaaccuuuaucaagcaaaucugccaaaccguuguccuggaaggaggcacugucuuuauuauacuggaaagaaagccauccuguccucugcuccugagggagacacuaucuguaccuugcaaguuucuuugcuagacaacguuccuuggaaagauggccugaaaccaaagcugccagcacuucuguucccaagacaugugaaaacacaagagacccgaggaucacuguguccaaccaaugacagcuaggagaaaaugcaaaaacuagcauuaccuuaaucacaggggucuuuuucuaugaaccaaucaagcagauuuauguauuuuuuucagugccguaaaaaaaauuugaugauuuugaggcuuaacaucaaauaccagugagaucaaaaguuagauaugacaucauacacaucauuucugcugaaaaaguaucuuuaguuaaaaacagaaaccaauuuguaaaugugaauuaaaugcauacuccacaaaaaaauaccuggugaaaguaaaaaaaaaaaaaaaaaacuuccuuauguauagauauguuuccugacagauguaaaugaaaacuaauacggugacauuuuucaaauuagccacuggaaaacuguguguguguguuuucaaacagccugagcaauuuucaguuaugucggccucggaaaguauuuaugaaaaggauaauaaauaauuaauucuacuggccagaagcugcaacuccuuucugcuucgacaauauacauugaaaugcuguuuaaauuagaggagcaaauugauucaaaaggcuuccauuagugagcuggcaaacagguuugaaguuggcuaauaaauuuuagauaaagauagagcuuuugaugaggauggcaaugccggacugcugaucuccgagucaccaguuuguuaaaucgguggcugaagucuugauuucgcucccugugucauaacucacuguguuaaacaauaugucacagggcagcacgagcacagucaaaccagaauggcugcugcaggagccaucagcaugacuguguggcagcugcucacagagcagggacuaacaugggaaccagacuagcuuuugcgucccuuucugagucuccagucuauccggguuugcagaacauuaaucaagguuaauuaggcccaccugugacauaaaaauuucuaccuaugcuaugucuugcagcauaaagucacgucugacauaucuauuaagaaagauucuuaaucaaaaucaagaaacuacgcaugaagcucuuaauuccacuuggauauacauacuuuagcuggcuucaagcugcuccucuggguuguggaauauuacacagcucuguaaaggaaugauuuaaagcuguacauacuagccugaaagggcacacacuguacacuaccuggggaugguggaguauguguccacuuauuucagaaaaugagaacaaaaucuuauauauguguacaucuauauuaacaugaaggaggauguacaagaaguacaaaauacuaaucaugguugccucagagggauagaauuagaugaaggaauagaaaggguuuuuuuaaugccuccuuuagacagcucuauaauuuuaaaaaauuauucaaauaauguauaauaauguucuuuuauaauuaaaaaaaucuaaaaccaagaaauaaacaacaugaaggcuuaugugacuugcagaaaauuauaaaauggggaagucauuuauuugcuuagcuuauuucuaccuggccaguuuggggaagccuguggagaacugaucaaucugucuuucuguccauccacucuuccacguauuuaaccaagaaaccagaccuaggaaauggugggugaagaguaaacagcuuuagaauccaccaggccuggagagaaauucugccucuacccacuugcaaccuaugcagcuuuggaccaugcucucgaugucuuccaaaaauaaaauaauuguaagagcuacagcaaaugcagguagugacucuacaauuucauccacaaagguuagcucuuuuccugugcacaccaggaucucaguauggcuacccugagcagaauaaucuacacuuggccaagauggcaacccaggaugauaaaagcaaaacacauugcagagaucugauuauuaaggaauucaaauuuacacuuucucaaauuuguacuacuuaccaauggggaaaaauagaaugcuacuuuuuuuuuaaggaauacuauauuuucccuuuuauuuguagccacuuuucaaauggagccuuugugaaguacuuccagccuuggucccaccaugggaaagguggaauucauagaggaaaaucguggagcaagccagacacggcggcucacgccuguaauccuagcacuuugggaugacaaggcaggcagaucgcuugagucaagggguucgagaugagccugggcaacauggcaaaacccugucucuacuaaaaguacaaaaacuuagccaggcgugggggcacgcaccuauagucccagcuacucaggaggcugaggugggaggaucacuugagccuggaaagucaaggcugcagugacuugagauugcaccauggcacuccugggaggcugaagaaggagaaucacuugaacccggcaggcagagaugagccugggcaaugagagugagacccugccucacaaucaaucaaucaaucaaucaaucaaucagguggaacagauacuaucccucacuacaaguggacaaguggaucugaagcaguguagggagcaggaugaggaccucacaggcaggucucuuaaaagacagugucagauguccugcagcucaugucucaggcuugguuuccaugccuggauuucgcugccaaggacugagccuuccucaggggcucauuccccucgaguccugggcugaccccagcaagagggaaggacagauacaaugcauuccaaucagauggccuuccuuuaagaacacucaugaaagcuacugacacuuuacacugacuuucacauuuuaauagacuacaaaauaaaauauccaaauugugcaaaugcagaaaaugaagcgaaaagucagagugauucauuuuuauuucuuaauuauaaaacaagaaaacaugcaauuaauauccgugugaccacauuaagcacuccacacauaaaugaagcagaaagaacaacuaaaaaguauuucuccccuuucuuagauacaaaaauuacguguguguggguacauguguguaugugucuauguguauuaguucauuuucacacuguugaaaaagacauacccaagacauggaagaaaaagagauuuaauuggacuuacaguuccacauggcugaggaggccucagaaucauggcaggaggcaaaggcacuucuuacaugcugguggcaagagaaaaugaggaagaagcaaaagcaaaacccucugauaaacccaucagaucuugugagacuuauucacuaucaugagaauagcaugggaaagacuggggcccaugauucaguuaccucaccuugggucccucccacaacacaugggaauucugggagaugcaauucaaguugagauuuggauggggacacagccaaaccauaucacuaugagagagagggggagagagggagacagagagagagagagagagagagagagagagagagagaauagaagaauagaacuugcauuuaucaagcacuuauuacauaggaggcgauguuggaagcgaugaguuuagcuaaguuaacuugguucauuccauacaacccaagguaguggauacucauuauuucuuccauuugaugaggaaucugagguugagaaaaauaaaaaagcucaccuacaucccuacagguagucagcacagagccaagacuagacucaagcaggcuaguuccagagagucuuauggucacccuaugcuauccugccuucagagggaagggacaaauaagaagaacaaaggcagacguggagaugauaguagggguugccaagcuuucuggaaaggagcagagaguauuuuaggcuuuaugggccauauagucuccaucccaacuacucaacuuugcuggcauagugcaaaaguagccacagauagcuuauaaaugaagguguguagggcuguguuccaauaaaacuacuucagaucucucuggaauuucaauaaaaguuuuuaaaauuuaguuaugaacacugaaauuugaauuucauacaauuuuuacauguaauaaaacauuauucuauugguuuuuucccccaaacaauuacaaauguaaaaaccauucuuagcucucgggcuguacaaaaacaugacaggccacaucugaccuucaaaccacaguguguagacccuucauaucagagacaguuugaugcaggggaaauuguuucaccuuuagugugagacaggucugguguucagcccaugcucugccccugugaaagagcucugcaacccugggcaaguucuucaacagcucuacaccucaauucccacaucuguaaaauagggauuaacacccacuucaucaauguguuuugaggauuaaaugaaacuggauguauauuaggccaagcauuguacuggauacaggauagacaauuuauuaaggagucuauuuacuugacaaauaacuuacugaguccuguucugugcuagaaacuauuuuaggaugaagacacagcugugaaaaaaaaaagcugauacaacuuugugcccucauggagcugacaaaaaaagauauucguguuuuuuguuguuuuuuuuuuuuuuugacauggaguuucgcucuuguugcccaggcuggagugcaacggcacaaucucagcugacugcaaccuccgccucccagacucaagcaauucuccugccucagccucccaaguagcugggauuacaggcaugcaccaccaugcccggcuaauuuuguauuuuuaguagagacgggguuucuccauguuggucaggcuggucucgaacuccugaccucaugauccaccugccucagccucccaaagugcugggauuacaggcgugugccaccacgccugcccguuccaagauauuucuaaauaugaaagcaacccaacuuuucaucaugauucuuaguccauccaggcugcuauaacaacauacauucaacagaaauuaauuucuuggcugggugagguggcuuaugccuguaauuccagcauuuugggaggccaaggugggccucagggucaggaguucaagaccagccuggccuacaugaugaaaccccguuucuaccaaaaauacaaaaauuagcuaggcauggugccaugcaccuguaaucccagcaacuugggaggcugaagaaggagaaucacuugaaccaggcaggcagagguuggagugagcugagaucgugccacugcacuccaaccuggacgacggagugagauucugucugaaaaaaaaaaaaaaaaagaaagaaagaaagaaagggaagggaagggaggggaggggagggaaggggaggggaggggaaaaagaaaaagaaaggaaaggagaaaaagaaaaagaaaggaaagaaacaaagauacugacugauuucuuacaguucuagaggcugggaaguccaagaucauggcaccagcagaucuggcgucuaaugagggcuccaucucuacuuccuguaugugcuuucuugcuguguccucacauggcagaaggcagcaaacaaguucccaugcgcccguuuugugaauguagggguuaucaacaaacauugcagccauaccacauguauagacccugcccguugaagaaugagucaagaaauuggguggguguucugucaucgaucaacucuugcuuaucaccccucugcagugcugcaagaggaaucucauauacgugauggaagugauuugugcuuucagcugagaguagcacuguauccauuccaaagcuucaguuagccucagucccugaugaucugcaggaauuucuccuucucucuuaaaaaagaaggaacaugauaugccacuuccaagauuaggauauuuuguuuaaaaagaggggauaauuuaagcagggcuggcggugggggcggggagacaauggaaaaggcugacaucuccugagcauggcucaagaaggcauaauucuuccgcauguauaagaauaaaaccucuuaacucaucucccaacacacugaugugguggcccaaaguaggcuuucaggacagucaccaggagaaauguuaucuugugggcuauaacucaccuucucccaagugggucccuggggcccucuguggugaugagcaaauucaugccaaaugucacuucguaaugaccaagacucaagaagugaucaccguuacaauauucagauacacuuagggcagguggccagaaacaaaccauccagagauaaaugaacauuuugcgcuccacagcaaaaaaacaaaaaaaaaaaaaaaaaaagauuucacagccaaacacauauuucuuuguugcauuaagggaaaagucgugagauggcaagcaggcuguauuuuuaaaggaugaaauacagcaaggcugcuuccacacuggccagccugagaagcacacuggugaauccaucccaaggcagagacuucuagagccugagaguuggcuucauuggaggcagguguacuggggaaaacugauauccuuucuacuuacuccagguaaguggcagauaaaucucugggaaguucuggcucaggcauucuucucaucaguaauuacaaaccuaaaaauuacgaucuacauuugaguggaacaaaauggacugguggcacuucuuucuuuucuuucucucucucucuuucucucuguugacagccccaucacaaagucucugcaaagcuaugauaaccucacgguaaguaacaaaucaacugcagccagcaaggguugauuaagaggcguuucaucacugcaugguguuaaugagcauuugcuguucuuaccuguccugcacuuauauccccuucuccccauucaccuuugggcaaccccucuucucugugcacuucaggggagccggaccccacauccugaauuaaggggugagcacauggcccuggauggaccaaucggagauggccucaugacucaggucuguccaauaugcaugaagcccugggcacugauuggaacuuugaggaaagagaaucacuguuguccuggucuugcugagaggacacaguguauuuauuucuuugagaggaagucucgcucugaagugcagaggugcaaucuuggcucacugcaaccuccaucuccuggguucaagugauucuccugccucagccucucgaguagcugagauuacaggcacgcaccauguuucccccagcuucuggcuugcuacacuguggaauggaagacggaugcccaagaagaccaauguaaggaaagcagagccaagggauggagacagagcaugcccugaaaaaauaaggcaagcccaugagaguugagcagggcuaaaaacuguuuugucucuccuuguuguuugauaguguuucaaagcccucagggaaugcugcaaauagcuucucaggcuaugagaauuucagcuccuacuuuuaugaucaacagaguaagggcaucuaagaaugacuuuuucucaggcugucaccuccccacagcccagaugggccuauauuuaaagauccgagucuuagcaguccaggggcuaucugucaucacagaccaucugugggaccuuagguagggcaggucuguaagucuaaauauccccuccuccugaguuccuguccuguccccuuugccugaccuucuccaacuguucucauuagauuauacuucauggaaaggggcauauaugccuuauaugcuggaugguaagcuggggacaggggccugucaucucugguguccacaggaagucaacugaauggcugcaucugcccccauuaucaucucugaaaccucagcauaaggacuaggguuugccauauagcugguucugaauaaaauuuacugaauaaauaaauuaauaaagagauugcuccaaacagacugaaggucccuugagagcaaauguagacuucuguaaaucugaucuucuaacaggaagaucagaauagcagaauacuuuauaucuaccagagauucucuguaucuaacagaaugcucucuaucuaacagagauacacuguaucuaacagagaccgaaauauauuuguugaaugaagacagaugccccauuagcaguaaaaaguaauuuuaaauccacuuacaaccaacugguacuauuuguaauucacccuggauaggaggauguauauuucccucuuuccuucuuuuuuuuuuuuuuuuuuuuuugacagaguuucauucacucuuuuugcccaggcuggagcagagcgcaauggcaugcucucaacucacugcaaccuccgcuucccagguucaagcgauucuuucuugcuuucuuaaagcccuacucagauauaaugaggccuuggccuguacuaggucuugcaauuugcauuauugaucuaaaauuuaacuuacacagucaauuucuuaaugcaaguuaucagaauugguggagaaaaaugugaauuacaacugugauucgagaacccaccacauuauaaguauauauauauauauauauauauauauauagauagauagauagauacauagauagauagauagacagacacacacacacacauggcaaaugggcccacauacaacauguuuuagaaauugugauauugcaaguggagccucaagcugagaucugagauuguucuuccauagucucccugauucccaaacacguaguugcaaucagacuuuuuuuccuaagguuaaaaggacaaaugcuugcagguauauaugcaaaaauacauacacagucaaucacagaugaaauacaaaacuaaaaaaaaaucugcagaagagaaauggaauuugaguggcuuucuuuuuagucuuuucuuuuuauacagcuaugauaccuuuuacaaaauauuuauuuauuuauuuauuuauuuauuuuuagagacagggucuugcucugucgccuaggcuagaaugcaguggugcaaucauagcuuaccauacauuaaaaguauccucuuaccuaauuuuauauguauguauguauguauguauguauguaucuaucuaucuaucuaucuaccuuaccacacauuaaaaucuuacauuucuacacgugcaggacuagaaugaacacacauaaagcaugauaccaaucugcuuuuuuggccaccauauaaacauucuaugcuaaaaugucaaguuguuucauuuuacuuaaaaaaugugaaugugaaaugauuuaaacauucaaaaaaaaacuucgaauaucaauaauuucacuuaaagcuucacaucauauuugauuaaaaccaaauauuuaugaaucaauaaaaauuucauacuuucauuauuacuuguaauuuauauuuaaauuuuaaucaauaacuuuuuuuuuuuuuuuuuuuugagauggagucuuacucuguuucccaagcuggagugcaguggugugaucucggcucacugcaaccuccaccucccggguucgagugauucuccugccucagccuccccaauagcugggauuacaggcacgccaccacacccagcuaauuuuuguauguuugguacagacgggguuucaccauguugcccaggcuagguucaaacuccugaccucaagugauccaccugccucagccucccaaagggcagagauaacuaauuuuuuuuuuuagauggaguauagcuuugucacccaggcuggagugcaguggugcaaucucggcucacugcaaccuccaccucccagguucaagugauucuccugccucagccucccaaguaggugggauuacaggcaccugccaccaugcccagcuaauuucuuuuguauuuuuaguggagacaggguuuuaccauguuggccaggcuggucucaaacuccuggccucaagugaucugcccgccuuggccucccaaagugcugggauuacaggccugagccuguaauguaaaugagccuuacauuuuugugaauuuaucuggcuucgaucuuucaggcugcugaccuuuggauggggucuuugugggaacuuguuuguuagugauguuguuguuuucuguuuguuucucuuuuaacaaucaggccccucuucccaguaacacugcuguaguuugcugggggucuacuccagacccuguucaccugggucccucccacaccaggaggugucaccuguggaggcugcagcacagcaaggauggcugccugcuccuuccucugggagucucuguccucaagaggcaucgagcugauuccagcagaaacgcuccuguguaaguucucuggcaacgccugcugggaggucucacccagucagaaggcacgggaucuaggauucauuuaacgaagcacuuaguuuacauuucuguaaacugcauaggauuuuauccuaugcaguuuagaucaucauaaaauaacucaauuguuaaauauuuuaaguuuuuuaaaagucuauaaauaauauaagcauaaacaucacuguacauaaauuuguggauauaucuuuaaauauuccuuuacaauauuuuucuagauaugaaauuccuagguaaaaaaaaaguuuauaaaacuuuugauagagaucuccaaauuauaucucagaacuaugaaaaucaauuguucuucccauccacaguauauuagaaugcccacuucuauacuucucaaccuuguguauuaauaguuuaaaccuaaguuaauuuuacauuuauaaaaauggggucgaacaugguggcucaugccuguaaucccagcacuuugggaagccaagguggguggaucacuugagcccaggaguucaaaaccagccuggccaacauggugaaacuccaucucuacaaaaauuagcugggcauaguggcgugugccuguagucccagcuagucggcagacugaggcaggagaauugcuugaacccgggaggcagagguugcagucagccgagauugugccacugcacuccaaccugggugacagagcaagacucugucucaaaaauaaauauaaauaaaaauaaaauggaauacagucucucuucuaaauugugucuucucugcuaauaacuuuaaacauuuuucaaauaucccuuggucuuuuguaucacuuuuuagaguuuugccaauugucccauuauuuguuuguuuuauuugagcuuggugauuugaaagagcugcuuacuuauuaagcagaugaacuauaugaacagacaguuuuuuaaaacucuauuucuaacucaaacacauacuuacagaacuaauucaaaauggugcuucuuuuauuaacguggugcuaaauuacuuuaugaguucuuaaagauucuuauuuuuggcacgucugagguaaggaaugagaaguucucuguuuccauaugcgagcacuaguaacacuguuugcaggccaaacacauguuuaaagcaggcagggaagugaacucuguaaaguggagauuuguggagugugauaaugaggcaagucguuauguucuaacuggucuuaacuguuccauaaauguuucuuuuacccuguaaacuuuaaggucaagauaauaugaggaguacuuaaaguaaagaaaagccaugugggccuuggcuagggaauaugcccuuuuuuuuuuuuuuuuuuuuuuuuuuggagggaggaaucuggaauacucuuuaacugucgaacgaacacauaaaaguacauuuucuucucuaucauuuuugccaaacucagaauaaaaacaacugggcugcaucauucaccuucuaggcuguuccuaggaauuccauggaacugucaaggccuccaaaaggguuuguuuuguuuuuuaaagcagagcccuggcagacacaccauaaacuuagcacagauuaccccucguagcauccgagugggaaucuaguuuuccaaaggaaaagaucaucgcugaaggcauuuuaguuuucacaccaaugcaauauguuaauaccaaaaaagaacauguuggcauuaaaucuuccagugaaacuacauucaguguauauagccuauuuuuaaaucccuuuuuagucccaccaaacggagagcaaacaauauacgguagaauuugcugguacguuaaauaaacaguggaauuuuuuuguuauuaaugcuaugauaugacugguuuguuuuuguacaaguggcuaauaugauuuuuaaaucuuccuucaaacuucauuaggaaaugugcaauuaauggagccaugucuccgaaauaaaauauuuuuaauuauagggagaauauuuuaauaaaugagcagcucagaagucauaauugucacacaauuaacagauuuuccuacaucauacuuacauacaguaugagcugcauuuaaauauaguuguuuuucugggaaacaaaguuugugagauuuuauauauauagucucugauuuuuuuaggagaaauaaaaaaauauuggaaacauacucaguuccuguuucuagaaagaaaagaaaauccuaugcaagagaguggcuauuugucccacgucacauaaaugagauaguaccagaaucuaagucuuagaaggcuaagaguuuugaaaguuaucaaaucacuuuuccauucaaagcagcagagcaugagugauaaucguuucaaauccuuccaaaagaauaaagaaucugggaucuaauuuuucuuuuuuuuaagccucccaaugcagaaggaauggagauggaaaaaaccgcugcgguagacaucagauuccauuccuugguuuuaauugcgugguugcaguggggaaugaggagaguaaacagcagugccucccacggagcucccugcagguucuccuuguaggagugagauuuugcuggugauuuauauuguuugagacauacccaaagagucuugugucacucaauccccagcuccaucccuggcucggaggagccugcaccgccucacgggagccuguaacugucaaauggcauuccccgaauccaucaauacuguuugcugccaaauaaauacccugcugcucuacagguugcaaauauuucaaucauugugcagaucugcacaaacuuggaaagaaaacucaugcaaucucauggccuuauuuccccuuccuacauaagagaaacauacaugccuaaaccuucacuuuccaaauguuuacuagaagauuagaaaaacaacagaugacaggcaaugugucagccuagaagaaucacaaaaauccuucuuuaaacaaucuaguagccagaugaagaccccacgccacgagccuguaugugguuaagaaguucauggggcgaccccauuccuucugauugcugcgaaauguaaaagacacggccucaaguccaaagccuaaugugccauuaagaguagacugccuuggccucaccugaagcaaaugcaucuagaccugucugacucuuugacucacagugcaggagauuagggauucccuguaugguuguucagucuguacacugaacaacucaguuggucaacauuuacauagacuacgaaaugauagagacuucuacagguaugcaaucacagaugacagcuugugugauucuaaaggggggcgucugaggcaaucuacuaccauucaccaauguucugcucuacucucuguucauguuucuguacaucaaccauucauucagucauucaacaaguauucacuaaaugcaaaugaaaugucagucucauccaauccuucaaccaccuuauuuggcagacacuauucuucccauuagucccauuuagcaaaggacaguuugcuaaugacccucuccuggccucaguuaauugaggccaggagagggucauuacauugccuaggagggucacaaagcucuguccuccaagucugaguccaguacauuucucuccuggacugagcuacccaguuuauuggagcaaaaauuuccuuucucaccaaugaauuuaagagucaaguucucaagagaagcuggaagguagggucagagagauuacagugagaagugaagcgguagaggccaguagguuuagaaaccagugcugugggcugacagggggugacaauuuccagcuuugguucuccucauuuaggagagacaugaagucucauggugugguagacaggccacacaagacuggaagucugaagugugcucacuucauggaguaaauguguagccuugaaugaguuacuuuuuuuuuuuuuuuuuuuuuuuuugagauggagucuugcucugucgcccaggauggaguacaauggugcagucuaggcucacugcaaccucugccucccggguucgagugauucuccugccucagccuccugagcagcugggacuacaggcacaugccaccaugcccgacuaauuuauguauuuuuaauagagaugggguuucaccauguuggccaggcuggucucaaaccccuuaccuugugauccaccuaccucagccucucaaagugcugagauuaugagauuacaggcgcgagccacugugccuggucgugauuuacuccuuucuuugaacuuuaaguucuucaucaauaaaaugagaauaauaagaccucauaaagcuacugggaggaguacauggauuuauaagaacuagaaaaaugucuggcuauuguggauguucaauaaaugauggguauuauuauuauugacuguucuugggauguguucuacuugggugugucucuggcaucucaaguguacguauuuuccuaaguggggugugugugugaaggaagaagaugcccuucuuuugugccucgccuuccccaaaagacaucaggagaguaaacaugcccccuauagugccaagagagaaaaauguaaauucuuuuggauaaauuagcuuuugcagcuaccucucucuuugcuaugacuucuguuucuccucugcuuaagcaacaaagagagaaguaaccgcaaacgcuaauuuauccagcggaauuuacauuucucuuucucggcaauauaguuucuuagugucuuccaaguuuuuaaauccuuuagguuuauucauuauguuccuuuuuccugcuucuaaaagguagcuguucuugcccacuguuuuggaaguaagaaaaccuaggagcuguucuguaagcucauaaacauagugugccagaaacugacuagaaggacagcagggggacgggggaucugaaugugccaagacaguuauacccuuauggguuauggcaaacauuaaauggucuagaaaaucagaggccuuggaaaagacuuguaaaaauaacaaugugagaacuuagcauaaaggccaggaacaugaaaggggaagccauggguggcacauguuggaaacugugcuggaaacacauccugaacugcucuugcaaagugaggccucuuaagcaguuccugcaauccuccucccagcccuccauaccaggcagaccaagaugugcucccagccucugggcagacaguggguuuucaacaacccugacuggggcugagguaugagaggugcauaucagagccccaagagggcucuuagaaagggaaguuggccagauguggugguucacaccuguaauccgagcacuuugggaagaugaggcaggcagaucgcuugaacuugcgaguucgagaccagccugggcaacagagugaaaccccaucucuaccaaaaaauauaaaaauuagccaggcaugguggcaguggcaugcacccgggugcucaggaggcuguggucccagcuacuugggaggcugaggugggaggaucacuugagccugggagguagagguugcagugagcugagauugcuccauugcauacuagccugggccacagagugaggcccugugucaaacaaaaaaaaaaaaaaaaacaagaaagaaaagaaaaagaaaagugauggaacagagguggugaaccucuaagcaaaaagauaacauggauuuucugggguggggugggguggggauuaaugaucaagagaagaauucagcugggugugguggcucacaccuguaaucccaacauuuugggaggccgaggugggaggauugcuugagcccaggaguucgagacuagcccuggcaacauaaugagaccugcccuccaacccugccaccaaucucuacaaauaguuucaaaaaaaauuuagccgagcuugguggugaauaccuguagucccaccuaccaggcaggaggaucgcuugagccugggagguuaagacugcagugagccaugaucacgccacugcacucuagccugagugacagaacaacucauugucucagaaaaaaaaaagaagaauucuucacgaaagacauuaaaaaagaccaucacacagagaccucucaaaaguuaugcuagcuaagccacuacaccagauuuucugaguaagcagcuaugcgaugagcuucccgguugcacucaauuuguaaggcaaaaugaaaugccuguugaguuguaccaggggaaugcgaggcuggaggugggaaguguaugccgaaagcauguacguaagcuuaccaccuuacauuuuucuuucccaagucaccaggacauagcuccuacaauuaaucucuuggguuuuauuuaguaaauuccauuuuaguugaaagucauguuguuuaugcugcucuaagacucuuuaaaacuaaauugaagguuuauguuaguaaaguuaaauaucuuauuucuaauauccuaaauauauuuacgauaucuuuggaacacccauuugaaucaaccauuaaaccaauacuguuugaacagguuugugaaaucauggcauucaugggucaugagaagacggucaaagcacaaaagugugacacuucugcagauacuggaacacagugaugacuuccaucauccaguucugccacuuacuaacccagugaucuugagcaggguaccuaacuccuuugcaccucaguuucagcuauaaagcgaacaucauaauaaugucuauucacaggguuucuguaaaggcugaaagucgaagcacaugcaaaacacuuugugcauggacugguaaaauaagaguuaauauguauuagauaugguuauaauuauuaucauuacuauuauuaauaaauuacuggcuucagacaugcuaaguguuauaugauggaaagaguacuuauaacuuuagaagcaggaccuuaaguaaauuacuuaauccaucugaaccccaauucccucucuucagugauauagggagaauaccaaaaaucuuucaaaaauuaaaagacacaaggaaguagaugccaaauucaucuuuacuuucuugcaaaacagagcuggaaaauuugaacaauuguuccgaucuaaacagaggguauggucccacauuuauaaagggccuacguaaauagaugauauuacugccacuguuugcguuucuaucagccccuaugcugaauaaucaauaaugaauguuguuuaaacaaaugguguaauuuugcaaucuguguuguucuaaaccgaccuuuacuccuuauugccauuuguaaugcaugcauaauucaaugcugaagccgagggagaaauaaggauguuggucuaaguggcccuuuuuggguuguuuuuugaugauuugcuauaauccuauaaauaauacaaagcuugucacuguaaauauguauuguguuaucuagagguauauucaguggcuaaaacaauaaaagcucgucuacgucuccuggcaaucucaaggcauaauuaaucgcugguaagauguauucuagaacgugagagcccuuaaguagaaggaaaaauaaaggccauugucaacacaaaugcuaaaagaaaugccuaacgggcauagucauuugccaucugggaaaaguguuugcuaguguacuuguuuggaaggcaagaaggaugauucaaaagggauuuuuguucagguggugaagaagugugugugucuguauguauauacauacccacguaguuuuuaauaaauuauaaaucaagauguuuaccaagcuaacuugucaauuuuaacucauuucuguuauuuguuuacacacaccuccaucugacaaauauauacaaaacaauguauguguaugcacauauacauacauaugauuuuuuuuaaauaaagcauaaaucaggaggugcucagagcuagcuucuguccauucuaacccaucugcuauuuguucacuugcacacacucacugugcaauaaacccuuucaaugugggagacaagugcaagaugccccucuuuccccaaagggcaccucugugugcucccucagaucauagcugaugacaugucaaugaaacggugcuugcucucaucccagagaucaaaaugagggcuuaaccugcaauuuacuuuacaagucccaugacacuugccagaucugaagacuucauucuaaucuucccuguugaaaaaauaaucaaauacuccaacaaagauguauugacaacucuuaauuaaccaugcuaauggagggaagagauagcauggauaaaugaaauccacacauaacccaaaaccuuccuuccccauuaauuuccaacuucuugacuaaaccuuacugagauaaguggguggggaguagggagaggcugacuaauccuuuaacgauagaauuacuugaugucuacaucuguacuaugccaaucagcuguuggacaagguaacaagcaaggaaguggccaaggacaccauguguucccaaagcaucgggguucagcgguaauguuuuugaaucuucucggguguaaguaaauauauuucagacagcuuuuagaaugaaguuagcuagaagaguuuugcagcaauagaagcugauuugauguagaccuucagguuucuuaucuauuuauuggugcugcucaguuggaugggaaagagaggagaagcugagagacgccuggcaccuguacagagugaaacaggcaaugcuguguaacgagcaguugacagcaaugaauaaggguugcagaaauggcaaaagagggcaccaaauuaaccaaagccuagggaagaugacgaagccagaguauucauuaagggaccagaugaacuagcauuuauugagcaccuucuguuugccagggcauauaagaacauacugugaugaggcaccaugaaauacgaccuuugaacagaaacuggguaaaaaacaaaaguaggcuuccuccuccuccuaacagcaucuagugcagccacauuagaugggaagagccagaacuaggcaaguuauuccacucccugauccucagcugccucgguugccaucucugcaccugcagggugaacacaccccaauagcgguaacguaagcauacccuuagaaugauccugugugggagaugcaccugaaugugugguccgggcuggggaauccaggagugaccaacccagagauuugucccuuauauauaacagacaucugugccccaugccugucccguggaacacaggccaaacaggggauugagguccugaguuuggaguuaaaugaagauugccagguagagguuguuagggggaggguguuaagugaaggugugauauaaaccacaugacauuugcaggugguuaugguuuuccugcccagcccaccgccaccacuggacuguagggagguggauauccuguccagccuacugccacuggaccauuucuguauguaaggugggcaguuguacuauccagcccgccaucacuggacucucuccccuauauguaaccuccuaauaaaaccccaugucuaucuguuggcucugagugucuucuucagcucuugaaccuggugccuuuccuauugagguuaauagggguucagcaugacagcaccuccaccucccauggcacagcauauguacccaauaagcaguccuuacaauaccaauaguuucuaucuguugggcacugccaauuagccaggcaugucaaauggaagaucucacuuaaucuugccaaaaaaaaaauguuguucguuguuguuccuucuauuacagaggaaaaaacaaaggcagauggagguuacauuauuugccuaaaguuacacagcuagaaaggagcagaguuaagaaucaaaccccggccauccagcuccagaaccgagcuugugacccuggcauggguauuuccggagcucucgcuaaugugccagauagacguugugcuaaagaaaugaucuguguguguuuucucauuuaauauccauacagcccccuaaauuggagauuacuacuguuacacaaaugaggaaacugaucuuggagagggccagucagcugccaaggucacagagccagggaguggggguggcuugcccaaggccaggucugucccuccaggugaagguaaugauuaagaacacaggucuggaguggguuugaaucacuguguguucagccgcucacuggggaccuggccucagcccucugauuacugcagggcuuuauuacuuucugaguucucuuugcuaucucacucgcccuuuccucccauuucuccuucuggugccccuucuccccuuccaggcccccagcccccagcccccaccccacagccaucucuguauuaaauguuuguggaauguucaccguucaaaagccacguucuaguuugaggcuuucaauucuugggaagaaaggggccauauaaauacaaaaaaucaaguccgaaauguuguugaaaugaucauuuugguccaccuaaguuuauacaaaaacauuuuccaugcucugaucuccccacuugcacuguuggguagcccaaguuccagaugaacggccuucucaccugcaugcugaaaccagccgaggcugcugccacauuaaaaacucagcccaggcugcuccugaaaauguuucugcccucagagccacguacuaaaaauuaaggggauuaagggaacucuagauuuacauuuaaaauaaaggagaaacucauuggagaggcuaaugcggcgugcacuggagguagcuacuaucacuaagcauuaagauaaacaauacgaguggcauucuggcccacgccuggcaaagugcaggagucccuggaggaaaaggaaugagagugcaucagcgaccucgugaggcagugcagcuuugcauuaaugccugcagcucuggaggcggacuuccuggguucacauucacaacaccuccaccgccaccacuccaugagcuugggaaagacauuuaaccauuccaugccuugucaucuauaaaacggggcaugacgccagacacgguggcucacgccuguaaucucagcacuuugggaggucgaggugggaggaucacaaggucaggagaucaagaccagucuggccuggugaaacuccaucucuacuaaaaguacaaaaaaauuagcugggcaugguggcacgugccuguagucccagcugcuccggaggcugaggcaggagaaucaccugagcccaggaggugaagcuugcagugagccaagaucgugccagccuggugauggagcaagacucugccucaaaaaaaaaaaaaaaaaaaaaggccggggggcauaaguacuuccucagaggguuguccugaggacugaaugaugucauuuaauucacauugauaugguuugaaucuguguccccaccaaauuucgugucaaauuuauuuauuuauuuuuugaaauggggucucgcucuguuacacaggcuggaguacaguggugcgaucucaccucacugcaaccuccaccucccggguucaagcaauucuccugccucagccuccugaguagcugugacuacagguaugugccgccacgccuggcuacauuuuuguauuuuaguagagaugaguuuucaccguauugugcaggauggucucaaacgacugagcucaagcaauccaccugccucggccucccaaagugcugggauuacagagugugccaccgcacccagccuucauguccaaauguaaucccuaacguuggagguggggccugguggaaggugauuagaucaugcggacagauuucucaugcaugguuuagcacguaugcuguguggugaguuggcucuccugagaucugguuguugaaaaguguuuugcaccugcccccuugcucccucucuugcuccuguuugcaccaugugagaugcuuuccuuccccuuugccuuccaccaugauuguaaguuuccugaggccuccccagaagccaagcagaugcuagcaucaugcuuccuguacagccuguggaacugugagccaauuaaaggugucuuuuaaauaaauuacccagucucagguauuucuuuauagcagugcaagaaugaacuaauacacacauagaggauggagcacucugcccagcucaugccaacacuccaucaauguuaguacuuagcaucagcauuauguugcauagcugaugauucauauacacauuacucccugcaaucaaugcccaagccuugcaagauaugugcuucaauccccacuuuacagagggcuauggaucgccaaggcuccaccugcaguuggguucuacauaaguguccucuuuccucacaucuucaguaaaguaugagaccuccaucaaugccugcuugggugaggagcacaggugggugaaagguaagggaacaaguggaacuccauauccaagguaggcacaguguggaccagaagagcaucccuaggacagugaggugauccacggacugaccugccccaaggccagagacgcaggaguggaaagucacauggaaccaugagcuuuuauaaggggcagggggcagguguugggaaauugcagaacuaguguuugagcagaugcaacagauccgaaggaaauagagauugcaguugaaaucuggguccaacuggcccuaucagcugcauucauguguuaccucccuggucagcuguacccuccuucaggauuaggacugcauccuuaccaaugcugaguccucugggauccccagaggcaucuuuugcacccauggcaaaaaaaagaaaggugggcagcagcaaugagaaccauguccacuaggugcaaguaauaacgggugcauuguucgcuaaggacuuaaaaguauuaauaaaagugaccaaaguuuaacugcuuuuuaucaucaccaugcuuggugauuccaaacaaugucagugaaaacagauuccuccugcuggcaggggggcggccacacccaucacacccccucuuggcaccgccaugauuuuacacacugcacucaacaaauauucucugaagggcugaaaaaaagggggcuggggaagggcagaaauccuguugauuucugagcagcaaacacguaaacauaacugacauuaagauauacaaaauacaucuuucaaggaaagaugugccauucuuucuugugugaaauaaaaacaccuccccaugcaagauuccaacugcacagacugauacugcuauggucugacuggaaacaggacaucuugcauucuuguggcuccgaaaaucacucugggguccaaggauuuauuuccucucucgggagucagggacagauaauaaauaccccucaucagcugaucaauugcucgcacuuccaggcaagcacccaucacuccccaccaaacacaccgccccacgccaccugaacaagguuaaaagaacggacucaugacugauggucggggggaacuggcuucagaagaggaaguugaaaauauuaagaaaucaacacgggcauuuaaaagcaaagccuuuuccaugccacagaagacguuuugcuauucaucuuguucccugacucugcuucaccaacuugauggaagaugguuuaacugacauaaaaaccagcuauacaugaacagcagugauugauggaaccauuccaaacaucagccaaaaauggcacugaaagaugccuugggcuuccuguuaacuguuuuaugaggggaccaacagguuuccccccucuucuuuaaagaauauauuagcaguacaaguacuuucaaaaacaggguaguguuauaccaagagagaaacagaaggggaaaaaaaagguaggaggucuuuugcauguuaguauauguaugaagggaguuaggaccuggcaaacuggguuauaugaggcuuuuuccauacacagcucuuugguuucacgguacaugauuuaaauagguuguauuuaauuccauguaauaacaaacugugccauuaaguaguucuccuguacaaaugcaauguuucaauggcaacagaaagaaaauccagccuuuaaaaaaugcacagaugcuccaaaugagccaugauaaagaaagggguggggagcgggaugaucugcaaaaaagaaugagggaaggcagauuuguaccacuugugcuaaagcguggagccuuaccauucagggagaaugagacguuugcaaaauggcauccuagucuuugaaugcuucuuaauauggaacggacgagaacagagguggcaagaggguuagaauucccccucuuuguucuccuuucuggaauggagaggaccuuuuccugccuuucuuugcucuuauuuugaagagguuaauuaugaccuggaagcgcccaggcacuugggucucagcuauugucgaggaagaauauugucugcgcuguaccgcaagaacuaacuuaggaaacauucaaauuuggaacugcuuucagaagccucaggaccgauuccaugugguggcauucuaugggaugacaaauccccacuccguucccacuacuugucuuugaagacaugcacauuagugaggcagaaaauucacucgacuuuaaaauaaaauaagcugguuauuuggcccaucuagaauacauucguaucucaacauuucaaaucaaaaggcccacuuauuccuguccucauccuggcucugaagccaagcucaaggugcucucaauuacaugguagauuucuggcccaaguuaauauguaucaggacuucucaagcguuuguaccuuugaccuagaaauucuacuucuggcaaaucaaucccauagaaauaauuuuaaaugggaaaaaugcuuuagaaccaaagauguucguggccauggaaaugacgacugaaaagaguuagugacaaccuaaaaauacaguuagaaggagaaugaugaacuaaaccgugguuccucucauugguuuacuaacauguccccauucaaagcacuguucaggaccgucuagaacaaccuggaggcaugcuuuuaaaauguuaagagagaaaagaaacuauuauccauaugggauaauuaacaauguguuaaaaauauacauaucucuggaauauuugaauugcaggaggagaauuaauuuagagauaacaagcaaauccaucacgaguacauaugccacaauuguaacaaaacaaaauaaaacaaaauggccugggcauuugaaacuacuguaagaauaugugccaaaaugcuaagaguagauauauauuggaggauuuucuuuuucaaucuuuuuuucaacuuuggaguauuuucccuuuuuuaugaauaugucccuauuguguaugagaaauagcuaauuuuaagaagaaacagaacuccaagggggaaagaaaacacuuuuuuuugcuccuaugagaauucacuggauaagggcuguacauuucgggcccgccuacuucauuccacaggaauuaguaacugcaggugcaaguguugcuacugcucgaaggcuaagcccugauaaggccuggggaggcccagagacuaacaaauggguuucuuccaggacuuugcugcugauugaucacugcacuuaauccuuuccagagauaguuacucaaaaggaccaggaaagguaaauuuaccaacgcaggccaacgugacuaaaaauagaaccauaaaaaucuuggggagaugcaauguggcaagaccauggucuucauuaaggcagggcugaagguggaauccuauuccagauacuucacagcuuagaucuuuugccaagccucucacagucucaaauuccccaucaucagcaggagucauacagauugcaaggagguuuaaaugaggcaauacaugaaauaugccauaaacggcaauuuaucagcaucuaugaucccuaacauuaaacacugaccacuuccuuaugugccagacacaaagcugagcacuucacauguacugcuucacauacuccgagaauuauuuuauuuaacccccaucgggaagagacuauuaucaucuccuuaucacccacagggaugcugagguuacgagguaucaagggaccuacccaccauugcacaggcagaaaacaggagagccaagacugacacccccagcaggagguguuccagccaccuuggacaccuuccaccacaggcuaagccgcagugaagggcuuucagaggggcaguccacacuggacaucaaacgguagaguggagauugggucaaggacaggagcuucauuaucuuaaaugaauuaaugcgggaagagaaaaccaacuaccacauguucucauuuguaaguggaaacugagcauugaguacacaugcacauaaagaagggaacaauaggccaggugcgguggcucacgccugugaucucagcaccuugggaggccgaggcaggcagaucacucgaggucaggaguucgugaccagccuggccaacauggagaaacacugccucuacgcaaaauacaaaacuuagccgggcaugguggugcacaccuguagucccagcuacuccggaggcugaggcacaagaaucgcuugaacccaggagguggagguugcagugagccaagauggugccacugcauuccagccuggaagacagagugagacucugucucaaaaaaagaaggaaacaauagacacuggggccuacuggaggguagaggguggaaggagggagaggaccgaaaaagcaccuauuggguaccaugcuucugaccugggugacaaaagaaucuguauaccaaacccccaugacaugucauuuaccuauuuaacagcccugcacgaguaccccagaaacuaaaguuuuuuaaaaaaugaaaauuaauaaaaauuaaaagaaaucacagauguuugcauaucacaucaguuacugcagauauuucaaaauaucauuuacacucaacacuacucaaaaguauagguguuaguagauacacuauuaccucuugugauuuaauguacuauagaagaaacguguauuacuauagaacaauaaaaauguugauauuuguauuucaaaaacaaaacaaaggaauaagggcuuccaaacuuuaaaaugcaagagagcaucaugggaugacaguggaagaauggaccugggugagaggaggcuaggauggggagagggaagggaaggcucacaugucucuuuuuuuguuuuugguuuuuuuugagacagucucccucuguugcccaggcuggagugcaguggugcgaucucaguucacugcaaccuccaccucccagguucaagcaauucucaugccucagccucccaaguagcuggaauuacaggcgcacaccaccauacccagcuaauuuuguuauuuuuaguagagauaggguuucaccauguuggccaggcuggucucgaacuccugaccucaagugaucugccugccucggccucccaaagugcuaggauuacaggcgugagccacugugcccggcuggcuuucauaucucuuauucuuucugcuuccgcucucuccuguccccuauuagccauggguuccagagaggagagaaggcucgggagagcaggggacucaggaggucacccugcuacccucaccuuuuuaauaacccuccucaaacccugguuccacgucucccucacucaaggauuuaugucucauuuucaauggaauguuacauuuggucagaccacgaagaaaacuccucauuauaaacuaggaaauguguggagagagaauuauuuacccaaggcagugcucaaucaguguugcccgaauauuuauuuagcccacacacggagaaguuguguuaauguuugccaaagaauguagcuuuauaaaguaacugggucaaaaaagacagcauaucauuuuacaaauaacuuuaaaauugcuuaaguuaaauagcugggcucucucagguuugucuuuucaaaaacgcugcagaaacaauauccagaauuaugucuaauaaaauacagguauuacaaaguggcuguuuagcccauuaaagaaaauggagagugaaaucugaauuauuucuacccgaggcagaagcagacaaaguuaccaaaauuauguuaggccgacgucgcaauucuucaagucugcagggcggcaaggcuaacagcuccugcaccaagacucuauuaggagagcuguauuuuucagucaacaaugacaggcauuccauuucucagccucaaaucuaguguagcuauggggaauucacccaaaacauuugcuuuugcuuuaucaguggcauuugucugccucaaaagccuugugagggagagggcuacuacgugacgcugccaggcaaugcuguuggaggcagcugauuugauggacaagaaggggagcagugaccaccugggucacucugacuccgcccucucugagccaagugaaucugagcaaugaugucauaauaaucaucaauagcaacaguggcugcgcgugaggggcguggugguucacgccuguaaucccaacacuuugggaagccgaggugggcagaucauuugagcugaggaguucaagaccagccuggacaacaugcugaaaccccaucucuacuaaaacuacaaagaauuagccaggcaugguagcacaugccuguagucccagccacucaggagccuaaggcaggagaauugcuugaacuuccccagcuucaagaggaagagucugcagugagccgagauggcgccacugcacuccagccugggugacaagaguaaaacucccucucaaaacaaacaaacaaaccaaaaaaacaaauagcaacagcaaccacaaucaucaucaccaucaaggcuggaacaaggaugaggcaggcaggcucugauagcaacaggaggaagcagaccaaggagggagagaaaggaaggcagagaaggggaaaaaaaaacacaaaugauaauaauagaugcugacauuuacggagcacuuacuaugugcugggaaccaugcugacggcacaccgaauccacugaacagguggguaaguaucaugggucaauaucauucucauuuuaauguugacagucacaagacuuucaucuguacaauggggguacugcuggcucccaaggccaguguugguggaauacagugaauagaggugaguaccgugugacaggaggcugcaucaguaagcaggggcagccagccaggugaggaacaugcccacugagauggaggucaggacguugagagauccccaaauugcaaguugucauccugagacaagcgauaccuugcuggacacuaauucauucuuggagucucucccucucagcccuuuggcuucauguucuggagagaaugaccagagagacccauuuacucaacgcuucucaaugagacagggaucuucuaaagggcacugucuuauauagauccuugcaccugcaauaccugccuggcccagccuggcccucgcagguucuugugaaauauuugcuuaugaguaagcaaaugcauaacacgagacggcugcucuggaaugacaguugcgaacacaggaggcugcugagacuuccagagacuguagauaaagaacaaagacccugugaaguuccuccgggaaaccagauguggcagugugcuagggcugcccuagcguaucagcacaagcucaacagaaacugacucucacaguucaggagaccagaagucugaaaccaagguguuggcaggggugacuccuuguggaaaccgugccagguuucucuccucguuucugggggcugcccaugaccguggcaucucuuggcuuguagacgcaucacuccaaucucugccucugacuucacagagccuucuccucuguguccucuccuccuuuuucuguuuugucuuuugguguuauuuuuuuuuuaagagauggggucuugcuauauugcccaggcuggcaaugaacuccugggcucaagugaugcccccuccgcagccucccgaguagcugggauugcaggcacacccaccacugugcccccugcuuuccucuucucaugaggauaaccgucauuggauuuagggcccacucuaaagccugaaugauuuaaccuugagauucuuagcuaauuacaucugcaaagacccuguuuccauauaacguuacaucugugauucuguguggguguggauuuuggggagacgcuauuccacccacuacccuuacacugcaacucacacccacacugacagcuucccuugccugugucuguccaacuggcuuagaaccggagcauggcaucgucaccauggacuuugagaauguauaaagacaggugccuggucccauucccugugagucuugaggaaaaaagaaaagugagcuucaaaaacuagaagagccagccuggugugguggcucacaucuauaaucccggcauuuugggagguugagacuggcggaucaccugaggucaggaguucgagaccagccuggccaacaagugaaacccuaucucuacuaaaaaauacaaaaacuagccagacgugguggcaugugacuguagacccaccuacucaggagacugagacaggagaauugcuugaacccaggaggcggagguugcagugagccaagaucgcgcugcugcacuccagccuguaugacaaagcgagacccugucucaaaaaaagaaaaaaagcuagaagaaccaaaucacuaaugccuaagcaagaacagaggggauagaggggccugggaagcaaggccuguaagaucccuugacaauaacacaccagucccaugagcaggaacacaaaacauuaucccuggacccaguucuccaucagggucucagcaugaaugaggcucuuccuuccucacggggaugggaggaccacccugcuuucuuugcccuucccaggaggaagggaacagcaccuuccccaucucugccagcaucuguccaucaagagcuggucaacagcuuagacucaggggaugccacaguccacauuacagugucacugggccagggcugggagaagccgugggagaaaugcagaauggggaggcugaggcaaagucaggaugaaccaaaaugugggugagcaccagacacaguggccaccugaggaggaaacacacaacagcugagaauccacgggggaugcguggccagguuagagcauccuggaaucaggcagguacgaggaguccacgaaguggagaggugaugcaaaucugcaggccuuggggacaagagcacaucaaacccuugggggccgaugccuucaguauuccuaauuccuccauguuagaaagguauuuugggccagguacuguaaucccagcacuuugggaggccaaggugggcagaucaccugagguccggaguucgagaccagccugaccaaaauggagaagccccaucucuacuaaaaauacaaaauuagccgggugugguggcacaugucuguaaucccagcuacucgggaggcugcggcaggagaaucgcuugaaccugggagguagagaucauggcgagccaagaucacaccacugcacuccagccugggcaacaagagcgaaacuccaucucaacaacaacaaaaaaaguaauuuagcacauauacugcauauuacaaaauaccuuugcgggguuuggggcaacauccuauaacaaugacauuucuauuucuucagugaaaauaugauuauucagccuggccaacaugguagagaaaccgcaucucuacaaagacacaaaaauuggcuggguaugguggcacaugccuggagucccagcuacuugggaggcuacagcaggaagaucgccugagcccgggaggucgaggcuucucugagcugugaacacacuacugcacuccagccugggugaugaagugagaccuugccucaaaaaaacaaacaaaacaaaaugaacauucacacuagaaaggagaaacagggacgcuaaagcugaagucaaauuucaccaccaaauaaauuugcuauaaauauacaauaaauuuguuuuugcuuuucagaucucuuuggguuuuggaauaacaaaaaagggacuguacauggauauuuccaagcuggaaccgaggcacuuucuagacgaaggcagccuuauccccaggagguaagguguggaagugaguugaggguugaggccagcaagacucagaccacagccuccugcuccaaacagccacaucacuuaaucuauuuuguaaaccaggcuucccucaagggaucugguuuaaugagagaauuugggagcuacaaaaaagacugaaaauuguuguuggacaucagaugcuggcaaacuuuuuuuguaaagggcuaaauaguaaacaacuuaggcuuugugagccaagaggcaaaaccgaggcuauuacagagguauuuacauaacaggagagaaaaacaaauuucugcaaauuuuuuauugaugaaauucaaaacuuuaugacacugaaaucagaauuccauaucauuuuccuccuucaagaaauaauauucuccucuuuauucuuuuuugcagaugauugaaaauguaagaacuauucugagccugcaggccauagccaaagagguaccggcuguauuuuguccaugggcaggagcuugugacugcuggucuaggucauuccaggucaaccaggggccucucccagagugagaaccacuggugauuccccagagugggaccaagugaaagcacuuggcuggaucagagggauaggagccuggcugcuccuaaaacaagacacuacuugccuuugauguucaagucauuuaagaacgcaauugcuuccuacucaauuuuucaaaaccaaaauaacaaauacgauaugagccauaacuuagcaaaauuacguguuuuaaacagucucuuucaaaaaacaauagauuaaaaagugcaauauuuuuacccccucuuaaauuggaaucaugguauagcaggcaggauacaaacuucucauuuccauuacacauuuucagugccaucauuaaucugaaugacaucaacaaaaugcccaaugcacauaaaucagucagacuuugaaucauuccugcagccucugaacauuuaccauggagcucaauaagccaggcaagaacacagauuuuuuuuuuuuuuuuuuuuuuugagacggagucucacucugucacccaggcuggagugcaauggcgugaucucggcucacugcaaccuccgccuccuggguucaagugauucuccugccucagccuccugaguagcugggauuacaggcaugcaccaccacaccggcuaacuuuuguauuuuuaguagagauaggguuucaccauauugaucaagguggucuucaacuccugaccucgugauccucccaucucggccucccaaagugcugggauuacaggugugagccaccgggcccagccguaggaacacagauauuaucaucaugggacaagucauccauucccagauuccaugacccucucugguguccacuguggauuucagcacauguuuaacuaugaaacucuagucacgcuuuuugauauacagguucaugguuacuagugucuuauccugcuugagccaagaauaugcacuaacacauuagacaaaccuugaauuaaaaugggcaacccaccauccaaauggggaaagaugauuacagacaaguucguacgaguaaacuacuugaaggcaauuccugugcuuaaaauggccacgugaaaggugucccugacauggaaaggacaaaccaugaaaugacccuugaagcucuuaaugugucugucaaaaaagcaaagccaacugucaaacugaaaagccaaaaucaucacaaaaacaccuauucuucagaggccucaaaucucaaacuaucucccaccauccuuuguaaguauguauaaggaggccaggaaacuagcauuugcugagacuuuauucucagcuuuguaugcuuugcauaaaugaugucauagaacacauugacagugagaaaacuaacguauuaacauuuuaauuaccuugcccuaucacgagauuagaaagauucagauaugagacauccaaagucugugaucugaacaccagagucagaggcuggcaaccuauggcccacgggcugaaucuggcccacugccuguuccuauaaauaaaguuuuauuggaacacauccguccauuuauauauuaucuguggcugcuuuccugcuguaacaggagaguugagaaguugcaacagagaccauaaagcccacaaagcuaaaaauauugacuauccagcccuuuagagaaaaaggccaugcccaggcuccuguggguaccugcuaugcuacagccccucugcugggggaaaccagcccacucacagguucccagugaggcaggaucucugggcaguuccuuaguaauugguggcucugugacuuccuucccccaaucaccuugaccaucuagucuggacaauaugagcgcccaugacgugaggacagccuuguaaacaggguggccuggcuggaaagccuuguccaaaaggcacaacagugacuacacugaacccaucccaugcauccuuuugagaguuagaaggaggcaauugcaagccggcugcaaaagacaaaagacaccagagacuuagaaaccagugaagccacgcugaagaugcagacagagagcuagagacaaggucaggggccucuguugcacuccagacccgguccggaggcuuuuccaugcuuaggggcaaggauugucaggguucugcugucccuuucuuuaaccuccuuuaugauuccccaagagcauccugagugcaccuccacucccugccaccaggggucagaugagccggccuggcaggcuuguuucccuccaccagacaacagcaaggaccaagauuggcaaagugacacauccucuccaaaagaagaacaugcagaacaaaucaaagaacacaaaccacgacugacaaacacagccacacucgauuuuaaaguacugagcuguuugaagaaaggaagcauggcaaggccccuuccuacuaauaacaguaacaacaauaauacuaaauauuuuauaauaauuuuaaauucuuaauuauuuaugauauuucccuccauuaacaucacgaacaucauuacguguguguguguauuuuucucauuuuaaaaccagcagaugagaguaaaggauuucuuuuuccucucccccaccucuuuacaggaccuacuguuaaguuuucaagaccacccagaaagaaauuugaaguuggguuuauauccuuaaucccucaguuagaaaaaaaagaaaagugaagaaacugcaucuccaagauccugcuauaucaacuucaguuuuuugaaguuaaauuugauuuuuaaaucccuuggcugaugagaccuguguggguuuuuuuuuguuguuuuuuuguuuuguuuuguuuuguuuuaucauuguaccucuauuuuaaaaauagagacuugugguucuuuuuccaaaagcaguccaacagaaagugaaugguggucaaugcauaauaaaaugagaguuaccuuuugacuuggaagaauuauuagcauuuugauuugauggguucuuagcucuucaaauucaaaaauaccuuauucaagucuaggaguuuuccaaauacuucgguucuaaagauuacccuuuuucgaugcuuugaaaacuaaaagggcauaucagaauagaaaucuggcuguugaauaacuuguaagcucugcagagacguacaaaaacauggccacuuuagccagcgguauggcgaaagucuggggcccacacuacacacacacauaugaacuucucaugacccucaaguauauucauaugauauaucacaaauaccauaaagcagcauuguaauaacagggaggaauugauuuuaaaaggccuacaucaaaaugaauagucauaaaaguauaauaaccuagacuggaaaauuuagggauuagagcauuuugaacauuauaccucaaauuuauaaaggcuguauauuaacauucacaaagguuuuuaaagauggaauagcuauguacacagugaauuuauucuaaaauccagacucaaaaaaaaaaaagaauaugaacuccuccccaccguguucuggacuaaaaucaauaaguucccuuuagguaauuaaaaugcuggucccacgaccugccauccuauucccaggcuuagaauguuaggaacacuguuucugcuuugagaauggaagagagcagguuacccugaugccucuggggccaaacacaggggauacauuuucccaguagaagaaaucagcccugauccucaagaagaagaacauauuggcauauuuuagugagacugaggcauacugcaucuugggguaaaaacugaaucaucaggccaggcacgguggcucacgccuguaauccuagcacuuugggaggccaagacaggcggaucaccaggucaggagaucuagaccauccuggcuaacacggugaaaccccaucccuacuaaaacuacaaaaaaauuagccagguguaguggcaggcgccuguagucccagcuacucgggaggcugaggcagaagaauggcaugaacccgggaggcggagcuugcaaugagccgagaucgcgauagugcacuccagccugggcaaaagagcaagacuccaucucaaaaaaaaaaaaaaaaaaaauuuaaucaucaaaggaaaauguuucaaauucuaggguaagcugacaugguacacauauacagcgaaauacacccagggaggcugaaaguccaauaggccaccacagcacguuaaaaauguccuguuuuaccuauagucaacaauaauaauaaauuauauauuuaaaaauuuguuaaaaggguaggucucauguuaaguguuuuuaccacaauaaaauauuuguuuaauguccucuacguggcuauuaugauuggaaaaggcauaccuugaacagagaugaauaaaucugcauaucugugaaaugucaguucagcauguugaucgucaguaaucuuuucagaacauuucagauauaugaaaauagcaccaaugucugaguuugaaccugaacugguuucagcuaaagugaucaucuucagccaaaauaauggguauuucuuucuuggccuuccuucuacagacuucuaaaagacaguggaagcacugaauauccuuuuagaaacaaacaauuacaaauuagcugggcaugguggcgcacgccuguagucccagcaacuugggaggcugaggcaggagaauugcuugaacccaggaggcagagauugcaguuagccgaaauagcaccacugcacuccagcccggugacagagcgagacuccaucuuaaaaaaaaagaaaagaaaagaaagaaaaagaaaaacagcuacagauauucauuccuuuuuaauuucuugauaaauaauagaccaguaagaaucacauaagaagcagucuacauuuuucaaagaguuuuuacagaucccauuugaucuucaaaagggccuccauuaggaaaaacuaaauucaaguuuaaaacuauccauuuuauuucucccauaaaaauauauucagccccuggagauaaucuccaaauuccucagauuuuaaaaguuaauuuuucuuaucuugacccaaaaucuguagaaacaaggauuuuucaccaacagugagcucccuuuucauaaaauccuuaucuaccaagauuuaccucugcaaaccucuacagucccugguugugagccccugauggaagaagcuagcauaaagaaguucacaacuacuggggagggaacgaccugacaaguugcaagcaagaaaggagugaaaaacugaguuaauuguacaagaauuuguguauuuauaaaugcaggauaaauaagaucacguagaaacucucuuuagacuuccauccuuacugcuguaauugaacgaacagacgaauguguuugaccgcaauugcccuaauacuauuuuucccauaaauaccugaaauucuucaauuguaaguuuuccuacucuggcaauuuuaaggaaagugauucuugaggcugugggugaaauaccacauucauuuuuuuaaaaaaaauaagguauacuuacuuguacuuucuaccauuuuauauauauucucuguuuaaauuguguagccccuaauagacugcaaagacaaugauaaaaaggaacuugccuuauucacagguacauccuuggaacuuaguaaagggcuuaaccuccauagcaggcagucaagacuuacugaaugauuaaauaaaaacacugaauuccauauugugcaggaaaaaaaaaaucaagauuagaccucagaaaaaauugacaugucuaguagaacuuacuaucugggcaaacuugaagagaagugcaaugggaaggccuccucaaaaaagacauugaaaucaagaugggacccguuccuacccuggauuucucugaaucagcuacuccuuaaguucguauuuuguuccacucagccaauggcaauuccaggagagaggcaauugauaauaauuauguuuucugccuucucuuggguuaugaauuuaucaugaugcaaaagucgagcuacuccgaugccacguuaacaaugaaaaacaccauaaagacaaaaagaaacugaauuuaagcauuuggauucugcagaggaguuuauugaacagauuaacuaaggaaaggcaaagcuacacaauuauggaaaacagguagcaacacucaggcugacuauuuucgauggccaccugagagcggauuuccaaugcccucauuucuguagguacauuauccuguguuuuauuguuagucacagcugcaaguugauuaauuugcauucagaaauucuaaguggcaaaugugcaaugcauaguaauauacauuuuuuuauggacacugugaaaaugccgaagccacaucucauaaguaacucuugcucaaccagugaguaaaauccauaaaagaguuugcaaaaggcuuugaaagaguuugguuugaaaggaaaacugcaagagcaaaucccucuccuccaccccagcccuuaaaaaacaaaacuaaacuaagucugaagcaaaaccaaacaaagagaacaguugggugaugucaagcugccagaaucauaaauguugucaguucacgucccagucuuccugcucucuuggcauugccaauaaaauccagaaacaccagggaugacucaguaccacagucagugcguaaauaagggauaaagauaccuguuaaauccauugccucaaagcaaucaugggaguuucuuaagaauacugaaccuccucuccguuuucugcacuaaagagauaaggaguggcauggagaaucuaaauguguggaaaauauauaccauuggugugagaacacauauugugauagguguuccccuccaucagcccccuagucuauacuccuagcugcuuuaucuuccagaucaugccuccccugcucaaagugaauuugccuucccuuucacacugaccuuagaaguggaucugagaccaugcuuccuagcaggagaaaacaacuuuuccauuugaaaaccuuugcgaauuacccacaacucugacaacaggugcucagcaguugauaguauucuuuuuggaaaguuuuaucaaccacuuaaguuaacuugaagacgccuaacagcaggauauggucaagcaaacauguucaucaauuaauucaaaugcaauuuuaguuuacuuuuauaugauuucccaugcuuaaaacuacuaauugcuuucccaggcuggcugcaugaacauggcccaaucaaaggaugcaacagucaaaugcuuguguacaucauguuaccuguccauuuccaucagagacaucauggacacagcugaaauacuaggccuggccuuuuguaaguucauuagagcaucacaaacauaacugcagcuauucucacuguuugugacucugugauucaaauguuuucacaaaccuucccuggcacugcguauuagauggauugaaagaugcugaaacguaaggccgggcacgggcacgguagcucacgccuguaaucccaacacuuugggaggccgaggugggaggauugcuagagcccaggagaucgagaccagccuaggcaacaugguaaaaccccaucuccacaaaaaauauaaaaauuagcugggugugguggcaugcaccuguagucccagcuacuagggaggcuguugcagaaggaucgcuugagccccagaggucgaggcugcagugagccauggucaugccacugcacuccagccugggugacagagugagauccuguuuagaaaaaaaaagaaagaaagauguugaacuauacacaagaaaugaaaagaaauagcugagauauggcucuuggggagaaagaacaaagcaucaacuaauagaauucagaaagaaaaggagguacucaucaaggcacucugcuaagguuugacuaaugggauuccacauggucugcauguuuauggcuuaaaugagcuaccaacacugaaacuguccacuuaauuagcccccaaaacaagaaguacagacugugagucugagaccuacagagacuccaaaaacagaaacuaccaucgccucaagcuaaucacucuaaguccuagaaauacaucugagguugcaaacaguccauuucauucauuauuuuauauauauauauauaucucuauauagauauagauaaauauauauacagauauacauauagagagagauaaaacagaaaaaaucuaaaugucuaaaggaccagauauaaguuaaucauaaaacgaugacaacaaaaacaaaggcuucuugaguuaaaaagaauggaaaauauuuaacuagaguuaaaaagaaaagcaauuugaucaagagucaggaauuguagguucuaguccuggcucuuuuuauucuuuuuauuuauuccuguuuuuuuuuucauuucuuguauauacuucaaaaaggcaaaauauuuauaaaguccuucugaguaugaacacuaugauucguaaccucaucuuugcaauggaaaauucacuaguauauuaaauucaaccaaugggagagguuagguagauguaugaucacaugcuggaagaagcuacagagaggguuauacaaacgggacaugcugguauuaugaggucaaauaacaaguaucuuagcacaaaccagcccuggcauaauucaggauaacaaacaacacaaggugcaaaaauagaaguaaguacacaucaaguggacauggagcuuccuguuagauuugaccuuccgcauaaucaccacaaaggauuuaaaacaauuaaguugaaguuuacggacacuuggcacaaaaagccacgagagccucacccagguagaguauuuccacaccuccaggaaggagagagugguaaaugaagggucuuccagcagacucugaaaugaagaaggaugaaacuucaaugacauaucugucaacuaaugauguucaccagaaaguuucaauuuuaaaaguucuacaaggugaauuuuuaagucaucugaaauguuucagugaagagaauaugauuccuaggccagauacaguggcucacaccuguaaucccagcacuuugggaggccaaggugggaggaucgcuugagcccgggaguuugagaccugccugggcaauguggugaaacccugucucuacaaaaaauacaaaaguuaguugggcaugguggcaagcaccuguggucccagcugcucaggaggcugaggugggaggaucucuugaacccaggaggucaaggcugcagugagcugagaucacaccacugcauuccagccuggguaacagagugagaccaucuccaaaaaaaaaaaaaaaaaaaaagagagaauaugauuccuauugacucauguaaaugucuacugaggagaaaaauuguuuaugcagcugaugccaucucccccugggugccugccuucccauccagugaagaaacgauuucagggguaagagaacacccuggacucugggaaaaucuucuuguguccuguugccugccuucucucucuaugcaaaggcuggaagagaugggccccaggggaggaaagagacaucaaggcauuugugacaaagccaaccagcuuccucuccccauagcccugggcaggugcuguuugaugaccauaacucuauuugccagagagaggguccauagaccauguugguguggugcccuggugacaucuuguggugaaauggaauauaaauaagccuaaaauucuacccauggcugcacugggguucaauagaaccagaucucccgguauguuucuuuuuguuuguuuuuugagacagaguuucgcucugucacccaggcuggagugcacugacacgacucgacucacugcaaccuccgccucccgaguucaagcgauucuccugccucagccucccaaguagcugggauuacagguuugcgccaccgcaccuggcuaauuuuuguauuuuuaguagagacaggguuucaccauguuagccaggcuggucucaaacuccaggccucaagugauccacccgccuaggccucccaaagugcugggauuacaggugugagccaccgcauccggcccuuguauguuucuaccugaacaacuucuccugcgguccuucaaaggguggauacugaaguccaguggacacauacauuuaaccacaaaucgaaacaaaugcuucccaguauacaguaugcaagaaaagagcagcauugauuggaagaaugagagauauuuucagagaugaaaacauucuuuauucccucgguccccauguguuccaauggaaaggaacuacauccuaugggcggagagucucagguaacacaugauuaccucccaagacuccuuaaauaaagccuuggcucagaagauaaaacuccauuaaauuuaugugaaaagucauucuuauucaacuacgaauuccuuaaccuuaaagcguacaauucgcaagagguaaacuuaggguguuugucuaccuggggauaaaaaagaguaaugaacaggaaagagauuccaacagauaaaaugauuucgugguaauauugcgagcccgcguggcugugauugcaagcacagaugaagagauuagagcagugaggaucagaacgggaagcugaaccacuggcauugugaacuaaagaaguaaaagagaagcacaugccaaugguaacagaaaucccucuuguuuuuuugcuuauuuuuucacaugccugcugugucaaaagaaacaccucuuuguguccaaaguaauuucuuuuucaacuuugaaaggcaaggggugcauuuacuggaagcgcuaugaaucuaucuggaugaaauccuuaggcugggagcagcccucagcagguagggaaggcugggggaaacguacuuccugcguacgacacacuuaucaugcaccuguaauagugugcccaucagcaggaaccacagcauagccaugccggcgucuauuaccuauccagugugacaauaaaugaggccaggugcacaccucuguuaccuauuauucuccacaagaauggcagcaaagcagugagaccugagcuauacaagaaaauaauacaggaagaaagaaauaaaggaagaaaggaagaagaaggaaaggaaaagaaaagaaaaggagaggaggaggaggagaaggagagaaggaaggaaggaagggagggagggagggagggagggaagacaggacaggacaggacaggacaggacaagaaaggaaaggaaagaagggucuucuuucuaauauuuucuaggcagcaucagaaaaaaaaaaucauuaaaguuuuucugccagaguauacaucccugaaaaugcugagauuuaauacacaggaucugagcuguaagauuaauggagauucaaaauguuagguacccuuuuccuugauggcugggaggcaucaggcuuggugcaaucugcaagcugaauuuaaccuaaacucaaacuggagagggcagaauuagagcaaguuaccccaaagggcucagcuuugagggcuuaaggcuauucaucucuagcgguucauuccacucauuucucgaggauacucagauguugcugaagaauaaacaacugaacaguauaugcuuucauucaccaagugagccaacaugccaaguuuucguuguuuuguuuuguuuuuuuaagaugcagaaguaccaguaaaaggaauagcaguauuagaauaaaaauacaauuaguacuagaacuauuuuuaaaguccugagugaaaacagacaaugcacuauuuagauguagaauagaagggagucaaauuauaaaaacagagaacagaauauaauucaaagagaggugcugcuuggaaauaaggaaaaaauacuaaaacaugggaugccauguuuuuuccauguuaaccuaauauuucaugcauuaagguggaauaauuacauugaagcacaguuuucuuaauuagcccagguauauuuccuggggaaggaauaacuuauugcaauaacugguguugggacaaugaacuacucaucuggagaaaaucagcuggauccuuacccaauuccucauggcaaaacaaauccucaaugaauuuaaugauuucaaagucaaacauaggcacguucaaccaguaagacauaugagucaauauaauguuaccauggagaaggauuuuuaaagcguaacaauuaaaagcagagaucauagaagacaggcugauagauuugguugcaauagaauuaaaauuaaaagacaaaaguaaaacaaaaauuaaaaacuuaaagacaaaaaaagcagaggucaugagaaaacauagucauacaccucauaccaacauuucagucaauaacgaacuauguacacaaugccgaucccaucagauuauaauaccauauuuucacuguaccuuuucuauguuuagguguguuuagaugcacaaauaugucccauuguauuacaacugcuuacacuauucauuacaguaauauacuauacagguucauagcccuggaggaagaggcuauaccauauagccuggauguguaguaggcuauccaucuaggcucguguaaauacacucuaugaucuucaugcaaugacagaauuccgacaauacauuuuucagaauguaucucccuuguuaagcgaugugacuguaccugugauauacauaaccacagguuaaugucuugaacauuuaaauaguuccugaacacauaaaaauucuuaccauucacaaacguaaagacaccaagauagaaaucagucacagaacauuaauagaucauuugcaaaagaaagaaauuguuaacacaucaauaaaaaauaauguuuagcuucacuaauaaucaagaaaaugcacaguaaaauuagauucuaccuuucucuuacuacucagcuuuagaaaaacguuacuuauuccuagugaagauacuggaaaauaguagccucaauauuucaagaaagcaauuuggcaauuaaucucaaagccuuaucuuauucuuggaaccagcacuuccaagcgcaccaaggaaucacucacugguguguacuacaaaaacauucauugcaauuccacuuacaauagagaaaagcugugaauaaccuguauguccaacaacaggggauugguuaaguaaaucaugacucacccauccauuaggacauugggcagcuauuaaaaauaaugcuguugaaggauuuagugacacagaaauacuauuacaugaaaaaaggcaguuucuugaacacuuccauuuucuuuuuuuggcuggcuuuuuuuuuuuuaauuuuuaaagagauaauauauacguguguuaucaggaauuacauauuggaaaugaccaccaaaaaaaugacuuguuccacuuaacaaagaaggaaaaacaggccggacgugguggcucacaccuguaaucccagcacuuugggaggccgaggcaggcggaucacgaggucaggagauagagaccauccuggcuaacguggugaaaccccaucucuacuaaaauuacaaaaaauuagcugggcuugguggcgggugccuguagucccagcuacuugggaggcugaggcaggaaaauggugugaacccaggagacggagcuugcaaugagcugagaucaccccacugcauuccugccugggcaacagagcaagacuccagucucaaaaaaaagaaggaaagauaaaguugaugccaccuuuggucucuuccuuucuacugacaaaucauguguacuucagcagucacuuacuccaucugggccucuguuuccucaucuauaaaacaggaauaaugacaacuuccccaccuuagacauauggauucuaugaauauagucuugacauguaaauggcuauuuuguugugcugcuguuuuggaaacuccgccauuacgccagccaugugaaaaucauuucucagcuccauuugacaaagguggccacucagcugggcuccaacacucuuccccacucucucugccacugaacucaaacacccucuccuuugggaaacccaggcuggaaacugaaaggauggcuccauccucuugcuucccaagacucugcaccgcccagggacgcugagcacuuugcauguuuccugccacaucauucagcagccccugccuuccaccguccaaugugccuaugcauccuucucuuugccuacaccaccuuccacuugguaggagcucaagcaucccccaucaaccucuugcagacccaucaacacaucccuggcauucuucucugaccuauuagugcuucaagguugaaaagcauaaaagggcaugguccacacaagugcaggguuucucagccucagcacuauugacuuuuggggccagacaauucucuguuguaggaugcgccugugcauuguaggaaguucuacagcaucccuugcucuuacccacuagaugcuaauagcagccuauucuccuccaagauaugacaacccaaauaucuccagacaagugucccuugaugggcagagucacccuugguacagcaccacuguacacagugagaaaggcaauauauuuauuucugcuacugacagucacagccuacaagcagcagguacccaaaucacauaaaugaucaccgcaaggacacuucuugggcaggaaaguccaugccagagcuucaaccagaaucuccugagacugaaaggggaaugacagggagugcgucccucccugcauuccucuggcuccccucugagccuugagcaaaaggaaggggacagcccccugaacccugagccuauuugcaucuccucugagagcauguucuggaggcgcuccacagcgagcgggaagaucuuuugugagauuacuuaucuggagcgcgugucacuucuucagcaccauaaaacugaaauacuugaaauagaugucacuacauuugucaugaacugacauggccaauuaauauuacaaauucaccauggagaaacgcuuccagcucccaagguauaaacugcugaacaucacaauuuccucuuguaacaaugggccagccucgccagggcuauaaauacgaagaaguacaggcugauuaaaugguaaaaagugcuguucacagggagucucuuuccagggcugacacuagcgcugugccuaaaguuaacagguaccccgaugucucggcugcaaaauauguauuuuuuucucucuuucuucaggaaaaaguugacuguugcauacugucauuuuuuucuccucccagugagcaaauggcacacucauuacaggacaugaaaggcugugggcacagguugucccaaguucuguugccacucagcuaguuggacuucuccuuuuuuuuuuuuuuuucuauuaagucgugucacagccaaacucucaccccuaaugaggcacagcugggcccuuggcccugaagaaauacgcguuggaaaugaacuggaaaacacuuggccucccucaaacuucccaggagacagcuuagccccucgugcccccugggaguuggcuucuuuuccagcggccaucuucacaaucaagcaggaaaaugccauuguuccaaaguacacaauagguucuggugguuuucaaacauccuccauauaccagugcaaauggaggggcaucugaggcgaauuccacaggauguuuuaggagcccacaggccuugacuuucuuuucucggcagaaguuuuaaguuccaguccccaggcuucauucuuuauauucuugguuuggaagacagaggcagcaguaagaaaauagauuauguauaaggaagacaaauagggcccaaugaauuacccaaaccaaacaaacaaagucugcuuuggaaauaagguuuuggagggaggugagaccuguaugcaugaguguauaaaaucagagagaaaugugucaaaaacaaauuacaaaccuuccaaauacgggauuacacaugaauggaugguaauaaucacacaucacuccaaggcaaucuguguauuacaucuugcauuucaucaaacaaggcuuagcucuugggucauuaauuagcaaccucgguuccagauaccaaaauaugaggaaggcuauaguacucggguccugcuucaauauugugauuuguuuuucuuaucuacuucucuuuuucuucccuuauuuugcucacaaugccuucugaggaaagacaagaccuuucuuauaaaaggaaaaauauccaugucucuacccacagaguccaccauuaauggaaauaggagauugcuuucuucaaaguacacaauuaaaguaacguacuaacuccuuuacacauaacacaagaaagcuagaggaaguuuuauguauuuauauuacacuuuuuccuucuuccucuuuucucaauauaggaaucuuucuguuuuaugaaagcuaagccacuccauacaacgaacaguuuacuccaauacaaauagaaauuauagaaaauauaaaaauccuacuaaaccuuuuaaucucuaacuuuccaagcaggugaauuaauacagaggacauuagagauuuauuuucuuuaagcuccaacaguaaagaguguuucaaagucauucucaaagcuguagagauuuuuaaaauccagaugaaccgagcuuaacucugugaugugauauauaauaaaaucuacuccaagauucaccuacuuaaagauauaugauacauuuggauaagagaaaaugaaauuuuaaaaucuaaauacauaugaaucaaaugguuaaaaaauuaaauagaaguuucuugcuuagaguaauaaaugcaagcuucucaguggauauccuuaauccugauuuuagaaugaguccaaaaagaaauugccagagugaauaccagguaacagaagaaaugaugggcauguuucucuguagaacaaccucccuucccuagccgcuaacuauggugguacuuacucaucacauucuagcucagaacugccauucugguccuuucauucuuguuagucauaccagcauuuguaaacugcuuuccacauuaaaagaaaaguaaaugguucacuugucccuaaacuuuuugucuuacacaagacaacauuaagcauauuucaaauaaaaauguucaauuuucgcuagcuauguuaaagguuaauacccaagcuaaaaccacuggguuuuaaaagaugguuaaacugaacagaaagcuuugauuuucaaguuaugaucagaaaauaaccaugggagacugucgagaaauuaaaaauauagucagaaagccuuuaaguauuacuuagcaaaacagcuaugacccaaaauagcauuguuauauguuuguuauucacuucaguaaugacugaaagugaauaaauaaaacuugcucggaaaaauaagguuuugaaggaagauaaaaacuguacauuuaaguguaugaaaucagaaagacauaagguaauagaaguauccaucacauaacuggccuuuaaaccauguaaaacucauugauacccacaugggaggccaaagaaacgcaauuuccaacucaagaaacuaucacacaaaaucccaacauguucuagacaccacuggauaagaaauuugagggaguaccccgaauaaacaaacauucacaaucauucacaaucauucagcauuaccucccauucuacagggggauaauccauuuuaaauuaauucugaauucaucaaaauacaguucacagaauaauuauacugguaaugauucaggagacacuuuaaaagaguauuauagcuuuauugugauauauauaguucaaauacauuuugcccauuuaaaacguacaauguuugguaaguuucaguacaaucgcagauauaugcaaaccgucaccacagucgagagaagucaagauaaaacaagagaacaggaagagaaagaaaaacaaagagaaggagagaaggaaaagagaagagauuuggagguacauauuccagggugaguucuuggggucuuuauuguuuuaggacuucucaguauucgucgugguaacagagcuuuaucugccugguugccaaauaaugucuucccaaauaauaugagagagaaagcaaaagagaacuguucauucgcaaaacugagacucaccgaguuaaaaaauuaaguuguacagaucagaaauguaaucauaggagacaagcucugagaguuuuucaaucacugugggguugcaucaauuuaaagucauguuacauuaaagagaaaaaugucugggagagucucuuccugucacuuuagauuagauuuguuguuguuaucuggcugugcauuuugucggcuucauuuuacauuuuaaagauauugcuuaauguccauaaauaaaaaacucauaaccuacgacuuuuucuccauuguccagagauuaguagauggcgcaaauuaacaagaagagcaaaacacucaauguucaucuagauucauauuaacauauuaacuaacuuccuuggaguaaucuaacauaggccaacuucaaauccagugauuuuuuuuuuuuaacucugcuccacuuaauuuaagaguuacacaaaaucaauuuguggucuaucucccuucaccuagucucuaucauguaggagggaauuggaaaauuccaucugguguguuucaauguuuccucaagcgcaacuuccuuuaucucaccaagaucuuguuaaauugcacaugacuuuaguccuggacgccaaggacuucuaaacaucaaguugcauaaaagugacauuucaccaauuuaagugauaaguuuucaaauugugaagcaucuaauugcaacgauaaauccaccuugcuuuccucuauggccagacaucuguaucuuuaacaaacaaaaguggcaguuuaaaaacaauuagacucaaaaacucuaaugaauaaaaaucacugucccuacagauagcacguaaacuuacaugcgcaccgaagcgugcuuccacacugcacggcgcacacuggccagggacauucugaaccagaaagggcccuggccccaaagucgugcuuucccuacuuugcuuucuagaauggagaccacgcuacacaucauaaaucuagagaacacguuaaaaccuugaugugccugucauuaauguagcugcuuuaucgugacauuuuuuuuuuccuuagaagaaggagaauaguuuuccuguggguuggcgguaaauuuuaaaaagcauuuucugugaccucauauagucaaaucaugacuccugucaaccaacagccuccuggcauccucacacacccuuaguccuauagaguuacaucauacacacauuuacaugaauugucaaagacauuaagaaaggcaagcaaaggccaggcaugguggcucaggcuuguaaucccagcacuuugggaggcuggaggaggacugcuuaaacccaggaguuugagcccagccugggaaacauggcaaaaucccauuucuacaaauauauauauauaaacacacaugcacauacauaaauauaaguauaaaucagccagguauggugacacacaucugcaguacaagcuacucgggaggcugaggcaggaggaucgcuucagucugggaguuacaggcugcagugagcugugauugcaccacugcauucuagccugggugacaagagugagagccugucuuaaaaagaaaaaagaaaagaaaagaaaggcaagcacagggagggagagggaaaguaaaaaaauugagggggugagauacguuggccucugcuuuuuguggaaaaggaggcugcugcauaaauacaaggaagaaaccagcauaugaguguccaaacugaguugccaagggcaugaagucuggaaggaucuuugagggucauuugacuucacuccacuuccagcuuauaugcugacuucagaacuugaccugugcagaagaugagucuccacggccugcacagcacacagaauuauuuaucccuauacccccauauauuacacccccuuccccgguaagugaagaaacugucugcugaaagaaugcaugaaucuugccuuuaacgucucaggcauguguuaaacacuuuccgagacaccuggcaccuaguaacuuucaauagauuucucuucugagcccucuguuaaguuucucggucucuauuaaggucggaagcccagcaucugggagaagagagugguucagcucucaucucaucggcaggaucacaugucucaacacagccaggauuuaggaacagcaauauuccaucuuaggcaguucaccacuucauacgauuauuuggcacccucgauuuuuguucugcugcucacaucacacaaaggcuauuucuacuuuauaucuuuagcauuuuccccacaccagaguuguaccuauauacaugcuguuuccaccagcaggaaaguaggagugcaaucagcuauccucgcuuuggccaguggugcuaggaacugauaacuccacauauccugcaaggcaggcaggagaaguuaggaagaaucagggaggaagggaacagacuuuuaugacuguggaugcagggcaaugggcucucacguugugguagacaaaaugaugcccauuucccaaccaaagauguccagguccuaaucccugaaacccgugaauaugguagacugcguggcaaaggagaauucagguuaccggugaaauuaagguuguuaauuaccucgcauuaaaauagggagaggggcugggugugguggcucacaccuguaaucccggcaguuuaggaggccaaggcaggcagaucacuugaggucaggaguuugagaccagccucgccaacauggugaaaccccaucucuacuaaaaauuagcuggcaugguggcaugugccuguggucccagguacucaggaggcugaggcaggagaaucgcuugaacccuggaggcggaaguugcagugagccaagaucaagccacugcacuccagucugggcaacaaagcaaagcucugucucacaaauaaaauaaaaauaaauagggagaggacccugguuaucuaggugggccaaaugaaaucacaaagaucccuaaagguagaaaaaaaaaagcaggagaagaguccugguaaaaugugaccacaaaagaaagacagagagaugcaaucuugcuggcuuugaaaaaugaagaggccauagcagaggaaugugucagccucuagcgucaugggaaaaggccaaggaacgaccuucccccagagccuccagaaagaaaugccaacaacuacauuuuagcccaaggagaacccuguaggacuucuaucuuacagaacugaaagacaauacauuuguguuguuuaggugcuacacuggugauaauguguuacagcggccagcagaaacuaauacacuuggaaacaauggcuguaacgcauccaucaguccacugguuuucuaaccugcaaguguucaaaguguugauuuacuuuaaaauaauuaagccaggcucuggggauuauaaagaccaaaaaauuguaucuauuaucauuauuacuccccccauuguuuuuauguauauauuuauuauuuuacuuuucagcuguucuuauuuaauugacaagaaucagaaacaaauugagauggaaugguccacacagggcccaugcugagacaggcaguguggcugacggaugagaccauugguuagcgauguguuugugucucuguugugccccuuauucacuguccugccaggagccaguuaguggcucaucugugaaaugggaauaagaacagucccaauaucucacagaucauuguauuaaucuguuuucuuucucuuuuuuuuuuuuugagauggaaucacccaggcuagagugcaguggcaugaucucggcucacugaaaccuccaccuuccagguucaagcgauucuccugccucagggucccaaauagcugggauuacaggcacacaccaccauacccggcuguuuuguauuuuuaguagaggcaggguuucaccauguuggccaggauggucucaaacucuugaccucaagugauccaucugccucggccuccuaaagugcugggauuacaggcaugagccaccgugcccaaccuguauuaguccguuuuugcacugcuaugaagauacuacccgagacuggguaauguauaaaggaaagagguuuauugacucacaguuccgcauggcuagggaggccucaggaaacuuacaaucauggcagaaggcaaagcagaagcaagcaccuucuucgcaaagcagcaggaaagagaaugaaggccaggggaaacuuccauuuauaaaacuaucagaucucacgagaacucacgugcuaucacgagaacagcaugagggaaacugccaccacgggccaaucaccuccuaccaggucccuaccuggcacguagggauuauggagauuacaguucaaaaugagauuuggguggggacacagccaaaccauaccaaucaucaugaggauuaacaaagaggaaacacugugcauaaaacaccacgugagcacaacaccugauacauagcaggugcuugauauggggaagaaaaugacccaugggacuuaagugauuuuacaaacagcacacagucaaagagcaaagccagaaauaucaugcaaucuuccauccucuaacacucuuuccccagcaauauccuacaucuacuaccaaaccccgccaugucucaaaccacugaacuuuggcccauauuggcuaaacagcaaagacaauccucuuaauuuaacccauucucaugguagucucuguaaagcugcuugaauaugauuaaguaucaaauacugucauaucaguagaacuaaaauauaccaaguaguaucccuaguuuccagcccagcuccaaauuuuuaaacgacaaaccuuuuuuuuuuuuugguaauauuuauucauugacuauugauauuuaacuguuuucacaaugauaaaguagcucauuaagaaacaaauaaagacauaaaaucaaaguaugaagccaacugagggucaaacugaauggagcguugcugggcauuaagguuacaaagaaagaaaggccuugccuugcuuuuagcaggcuuagcaacuuuuucagggaccugggacacgaauauucaaaaaagaaagugcuaggcaguguggcuaaauggcaugauuagaagggacagcauauucagagggaggugcaaucccugagggcugagguccaggaagagacuucgggaggagaucagacuuggaggaugacaggggugggagugcagacagcgaccacagagcugacagcagcagacuucgauugugcacagaaugccagccacuguugcuuggugguuuaucaucuaaacucucacaaaagcccuaagagguaggaacaauuacaaaccaacaccuuuuacagaugagauaauugaaguucagagagguucaguacuuggcuagugaucgcacagguaggaauuagcuugaacuaggaccccucggucugaucuugaaagcacucaagaggagcugcggugacuuugggugacaaagcacugacagggagauagggauccugagacgugaggguccagggggucagucugcaauguggagcugauguggacccagucaugagcccagcccuaggcagcagggcaugggcagcaggggaggcaagguaagucugaugggccaggugccccugccccaguggcugggaggcgcagacucuggaacacagguuacaccucucauuucagugcuuagaagagcagaggcagcuguacaggggaggcgcgggccacagcgugacaugcucacaccccggacaggucuggagacagccuccugaaaccgcccugggggccccagaagcccucaggucuccagggcuugucacucaggcaccgaauacacuuagccuaauuggauauuauuccuucuucaugaagccaagcagguugucaccuaguucccuggguaagacauuugcagcuucauuuugcaauuacaucucccugguauuugucauggcacagaagugaaauuucugucucugguccccaaugucaucuuuuccuucuguuuaaaaucuaggugcuaugccaguucuuuuuuuaaucuguaaguucuuuuccacccucucccccacaaaaauccugcaauaucugaccaauuauuuucucagucacauuaaaaauagaugccauucgcauugccacuauggcaguugugagcgcugcucauaaguauccugaucuucaauucuuuagggcacacaguaggacugcacuuaucuuucgaauuggggcaugaccauugccuugcuuucaccaauggauuguggggagaagcaagauuucugaguggaagugcuuaagccagacacuaaucccccaugcucccuuauauuagggaaagaacagaggcacauguaagagauggugcugaggucagccuggaucccugaaagauuuuuuuuuuuuuuuuuuuuuugagauacagucucgcucugucacccaggcuagaguacaguggcaugaucucagcucucugcagccucugccuccacgguucaagcaauccuugugccucagucucccgaguagcugggauuacaggugcacgucaccauaccugacuaaucuguguuauuaguagacauggaguuucaccauauuggccaggcuggucucgaacuucugaccuaaagugauccgcccaccucccaaguugcugggauuacaggugugaggcaucgggcccagccagauccaugaaugacuuuaaagcacagccccuuaccucccaucuguggucagauaucacgaaugggaaaugaauucaccaugcuaagccacugagauccgggcguguuuguuacagcagcacacuccagugcagcuggccugagaaaagccauuuuaagcaguucaaguuccauccuguguuccaugucuuucucaagagguuggcuuuuacuuugccuuccagcauuaccagacuguucaugaguuaucaagggcagaccaggcaggccucccaaggggcaauaucuauccuaaaucuugcguccuuuuugguuccucucuaugcugcauacccucuuucguggaccuaauucagauuuguagaacaagaaaauguuucucaccaccuugucaugaaggggaccuaggugaacucacccacauuucagcuacaaaauucaaaugcagacacagcccaucuaucaguccucaugggacuuugcagaauccaauauaaacuacagagguagucaaagaagggguuguuccuccauuucccccuggcaaaucaccaccauuccuggggccuggaugcuuuagggaucacaguaggauuacacuucccuguccuuuugaauuuggggauggccauugacuugcuuucgccaaugcaaauuguuuccucugagguuacaucuauuccuaccagccuagauugaucagccucugcccucagagaagaaaucaauccccccuuuuccauggagugagcuuuccuucugugacagcacuagacugccaaagaagcagagagcugaaaugcucccagcagcucuacagcugaggccaggugcuagccucuggaaugaggcuggacugggcagggcaguucccggcccugcauuccaaacaggaugcucaccugcuugcugcucccacaugccuuucccaaauacaccaaauaauaacaaaagaagauguucaaauaaauagagcucccaugauuauguaccaugguagcaaauaaauagagcuaccaggauguuaacaugcauuaucuccaguguccaaaacaaacucagcucagagaggguaggggcaguuaaugacagagccuggauuugaaccucguucuuuccacaccauauucuggucccucccacuggugcaaccuuccucccuucaugcauguucuuugaguucuucucccugcugggaagaucuucuccaauccuagcugugcugcaaagccagguucccacugcaaagccacuccguuauucauucucacccugaacucuuccuucuggaaccacuucucuacgguguugguaacagaguuagcacacugauucuaagcacacaguccagcagccucuuuuuucuauauuuccaagacaucaauguagucuugacaaugcagcagcagcagcagcagcaggagcaacagcaacugccaaggucugcaaguggcuucaagaugccggggacuuuauuaagcaguucccaggugugaucgcucucucuugcacucauacacucagcucaaaggucaccucagcaaugaagucuuccccaagaaccugacaagaucagugcucagcacacaguaggcccacagcauguauuugauguacaagugaacaaaaggaagaaugaaugaaaagagcucuucaaagccaugccucuggacuccuugugacgugugaguccccugccacagccauaagaagucuccagcgguucuaccaucgccuucuugagaaguaacacccacccuagacucgugggaaauuggcagcgugggaauuaaacucacaaugucuguucucuuccacugagcugcacuagggccagaacccaaaauaaauuccuuucagcccucuagccucucaguaggaauaucugaaguaucuuuaaucaaacuuuagaggcugaaauugcccacaauucuaaaaaugccuccaguuacuauggauuuaucagugaagagaaugaaauaaagaaaauuuguuucauaguuaaagccaaggccacuuuaucccagauguacuuaaaucacuuagcucuuaacagaaucuuuaacuauaaauauacuaaauuugguaguaggauagauuaacuacaaaaggaaauuaacacugccuuagagaauguagauaacauauuaaaccacagauaggcuacuuuggagaauuauaacuggguagaccuaacauuuuuaaauggauauuagagaugaugaaaugccacuuggccacccucugaaaugcaauugaauuuacauugauuaaggaaaaacaggggaaaucuaauauuauauaaugccuuacauuaaaaacuuuaaacaagccccaaaguggcuccuuaggaaacagguuuugggugacuaagcagugugucauuagcccucuggugagaaaacgcaggauuuaguuccuuaugagagacagagaaagagagagagacagagaaagagagagagagugugugucugugugugugcacgcgcgugugugugucagguuucaacuguggguaaauuagcacuugccuuccaaagagaccagcagcaacuacaaaaguuugcagggcuuugucauuagccuguuugcauucuccaaagcaaacugacagucucaugaugcagggcauuaaaaauccucagugguaucgacugccugaagccgaugcuucccuguuaaauacagcauggcucaauuaagagcucuucaauauacaauuuaauuuuucuuucaucuugauccacagccuggcucaaaaugaggaaugcuagaauagauguacuuugaauauugaagcaagucuuuauaaauaaaccuaucacccuuguaaugauuucugucauaacaugacaaaauagaugaagcucggcgucuggaacuucagcucacacgucauuuuuccaacaucaccaggacccacaauuuuuuuuuuucuuuuuggcuuuucucguacuuuuuuccaguuaucucugaauaacauucugcuguuuaagaaaaguuuauccuuucuucuuuucauucccuguguggcaauucuucagaaagaacgaagaaaauuacuauucugcuacuuacauguaagagaaagaagguaacuuauaaaugaauuaugaaggucuuacccuuggaaagacauacauauuucaucauaaaugugauccauuacacuuauucuacauacaguauuuauauuuguacaugauuauucaagguuucuuuuuuuuuuuuuuuaaucuccgcaagcccauacuuucaaaagcaaauccaacauucuccuuuaaccuguaaggcucagacuagaggauacaaaagguacucccaauugacuccacauguauacucucucucuggauggaagguauuagauuuacaaagaauagcaagaaucaugggauuucucaaaggugcacauauuauacagaacaauguucaaauaccugcaugagcuugcuaugagucaaggaggaagacguuucacuuugggccuaagacaauuucuuauauugaaacauauucauaaaaaacagacuugacaacaguuaaugccuuggauagaauuguguagcucugacaugcauuucugacaguuggcuugagcuagaugaagaaggaacagggcucucucucccgaaguggauaaaguaucaguggagcagccuaauacccauucccuuucugaucaaaucauuccaguuggucuuuucgggcugcagagcuccuugcugagaucucagguaacgucacagucacaucacgacaacaaauguaaacuuauuuaaaauuuacugguuuuacccauuguauuugauuuucauguuauaauuuauaaccuauuuuaaaaauucaaacagcauuucuuauuuuucaacuugaucacucccuauuuagcaugaaauagacauuacacauaaauaugcauauguauauacauucaaauacaagcauucccaauaggaauugacaaaaccacccacauuuuaaacacacuccuuccauucccauucuucuuuccccagaugcugcacuuaauauaauuuggaaagaucuaaaaaaaauaaauaaauaaauaaaaagcuguaagacaauuuuuaauugucagagauggagcacuuagaauuuauaguaauuaacuagucauuauuucaaauaagaacauuaauugguauguucagaaaaucugcagcacugcaaaauuuaaaauaaacauuacaaagauaucauuuacaacuaaucuauauuuaccauugaagugagcuucaaacuauauuucuuucuauuaugcuuuuauuggcuacagcacacaguaaauggaguguguuaugcacagcuuccuaaacagcuaaauuuauaaaacccaauuacauaaauuaauuaggaaugaacgcaugcauuuaugccuuuguuugcaacugcaacauauuaaacaugacaaaauuaauaaagacacccuaaaagaaaaaauagugccacguauucauauuccauaacagguuuuuaugagauuuaauuugauuugucuaguccuaagggucgugacucuuaauaaauacgcaguuucucaccguuucauauacauauguaacgguauguuuuuaugacuccuaaaggaccaagaacauauaaauucaagaguauuuauuucaagauucagagacagaauggcaaagaauuacucaaauguuauuucugccuucguuaucuccuacauuguuaucaaagacagcuuuuugguaauuagaaugauucgccauccccuagcuuuauuauagaaaacguccaguaaaacaagcuuacucugagcuccacgaaggaauaaaacauuggcauaugaucaagcuagccagaagagcacugcugaggccagauggagaggcucaugccuguaauaccagcauuuugggaagccaaggcgggcggaugaccugaggucaggaguccgagaccagccuggccaacauggcgaaacccugucucuacuaaaaauacaaaaauuagcugggcgugguggcaaauaccugcaaucccagguacucaggaggcugagcuaggaggauugcuugagcccaggagguugaugcugcagugaaccaagaucacgccacuguacuccagccugagcaaaagagacucuaacucagaaacaggaaaauaaaauaaaauaaaauaaaaaagcaugguugauaacagacccuuuuuuuuuuuuuuuuuuguaauagggucuuccucugucacccaggcugaaaaugcaguggcacaaucacagcccacugcagccucaucaucccagcaaugcacuguuauccuguuaccggauauagcagaugcuacaucuauuguaucuucaaacuaaagagacucugaaacaagucaccaaaaaagaauacguucugcuucucaauuaaaggagugaaaauuaaaaugagaagcuacuuuaauccuaacaaaguaacaaagauuaccaaaaaaaaaaaaaaguaagggagauaauacuuagugcugacaaagauguaaaaagacaagcccucuuagauaauguugguagaaaaacuacuugauucacuucugguaaauauuuggcaauaucuaucagggauaugaaaauuauguauacacuugaaucaaauaauuuuuaagauucuaugauacagauauguaauaauuuauguagaagaauagucaucaaagcccacuauuuaaaaaugaggaaacagcauaaauauauacaaaaagaaaacaaaauaauuuguggcaucugccugggauagaguagguccauguggguaacuaagaccaucauauuuuuagaaagugggcaaaugcucauuaaauaguuuuaacugguaaaaaugagcaauagguauuaccaguagacaauguagaauuaaucccaauucucccuuuccuuagcccucuggcccugggaaaauuacuucaccuuugcaugccugagucucuucaucuccaaaaugaggauaacaaggaaucuaucuugaugaaacacuaugcagauuaaacuuuuuaauucacauaaaacauucaauuaucaguaagggagagguaucauuagcuauuaucauuaucucaauuuugcaacacagaaaagacuaaaagggucugaaaccguacuuugucacuucuuuuaguugugugaccuuggacguauuccuuaaauauugcaguugucugacuaaucuaaaauauguuaauaauuaacacucuagucaaaagguaguucugauggugagagaagacauucagcccaauaucugaacccuggagguaaucaguaaugauuuucauaacuauuaauuguaucuacaaaaguauucaccaagaaccccuucagucuuaaaccagaauuaaaaauagaauagggugaaauucuaaauuuuugauggaaacaccaaagguaauauuuauagaugguuucucauuccuacuccagguaguagagcagcaucagcuuagaaacuucucucagucuuucucccgucuuuugaagguaaagaccaaaauggggucaacauuuaaaguuccuaaucuuagaaacccuaaaauaccaagguacuuuaccuuuaccuuuuuuuuccuucuaauucuucuccuccuccuuucuaaugguuguuccuuuauuuuaacaaccaaaauacuuuugcugggacauuuaacgagaaauaaaguauauuucaaugacaggcucauuuccaaaauuauuuauuuucauucuggauugauauuccaccaccaauaacuucaaagaauuuagcauagcuguuauuauaucauacuauaucucaaaacccugaaaugguucccaauagaacauaguauaaaaaauuucaaacuccuuagccuagacauucuagauccuacaaagacuucaccugauuucuucucuucuuccauuaaucgucuauugauaaacacaaugcaauggugaaacaaaauaccagcaaguuaauaauggagacaggaagggaggaagggagggaggaaagaaagggagggaggaaagaaaggaaggaacaaaagaaagaaagagaaggaaggaaaggaaaggaagacaggaggaaggaagggaggaugggaggaagggaggacggaaggaaggaaggaaggaaggacggaaggaaggaaggaagguaggaaggaagguguggguagaaggauggauggccagaugggugaaggauaggugggugggguggguagaugaauagauggauagaaggaagaaaacaacgaaggaaggaugcauggauggauagaugaaugaacagauggauguguauggauguaugaaaggguagaugaguggguagauggauggauggaaggguggauaauuggaaaggcagauggaaguguguauggaugggugggugaguggaaggguggguggauuggcagauggauggauagauucauggguggauggauggguggauagaugaguggauggauggggaugacuagaugaauguauggaaggguggauggguaggugggcagaugggcagaugaaugaagaauaagugguuguguggauggauagauggaugcaaggacgguuggauggauagaagaaugaaaggauguaugaacgaacagaugggccaacugacauauggauacguggaguuuuucuauccuaacuuauuguuugguggcauuuuuucuguuugucuaccuaacuccccaucucuuuucaacaguaauaauucuacuugcaacucuuccacaaagucuuccaugacccccacauuccauccccaucacuggaaaagacugcuaugugcucugaacuuccauaauugucaugucauccuguccagcucaccacagaguucuuuaauauccaacuccucugccuccuggauuugagcuucuagaugucagaacugauuuaagccccauguucaugucugccauaagagugucuucaacaaaacaguuuauucauucauaauuauuuauuaacugauuggauaucccaaauaacuuuuaauuguucuuuucaacauccacaaggcaagaaucuagaauuuaaaauucucuauucucugaucuuagaaaauaugguggucuaaauuuaccuaacuaauggcaaggagguaagacauaaaaaucaacagggucuaacuuugcuuccaucacagacuugcuaugcaauaugaggcucaucuuuucucuccuccccucauauuucucaucccagcacgcagguguguaaucagguauuucucagggccuuccugccucuccgauugugcagucccaugaugcagauggcaacagaaugcaccuacuaugcaucuaagauuguguuucuuggaucuaaaaaucaaaacaacugaacucacagaaauggagagcacaaaaaugguuaccagaagcugggaaggguagugggggguugaugaggagguggggauggucaauggguacaaaaaaauacaaggaauaaauaagaccuacuauuugacaacacaacagggugacuauagucaauaauaacuuaaacuguacauuuuuauauaacuaaaagagugacuggauugcuuguaacacaaaggauaaauguuugagggguuggauaccccauucuucauaugugauuauuucacauugcaugccuguaucaaaacaucggauguaccccacaaauauaagcaccuacuauguacccauaaacauuaaaaauaaaaaaaauuuuaaaaagagauuaggguuuaaaagaacaaaaaaaggcuggagggucugcccacaucugguaauaaauagcuuuucacauucuuguucucuccaaauaggaagccagcugcuauggcucucaaagacaugcucuugcuacagguaguacaaacugucccgucuccgggcagacugugcccucaccaccuucucaccauuccugucccuggaguugaggggauggcugacaacgugucaguggccacaccgccauguccaagcagacuauagauacacacuuguuacccaucaacucuccagaauuggaaagaauucaaggcagcaagcuuccacacucacuguuagcccaggcccacucucaaaagccaugcacagggcucuuuccagggaaggucuccuuuauguaaucauacuaugagaaagggaggagaguaaaaugugauucaucugucacgaccacaccagugaggaaaauaacuagcacgcgcuugcccaagaccuucuugaacauugagccucauuauuuuaccugcucccccaucccuuccgcaucuaguuuuaugcucucaccuauccauaaauuccuccccaguucuccucccuaccuguggucgcaagaauguuaacugacaucucuugaucuugccuucaucuugcagacggagauacggucuucuugucaacuaaaacaaguuugccuaauuauauuauugaauauguuuuauuucugccaagaaaaaacauaucgaauaucuccccauaaagacacagagaauuuugccuuuuccgucauaaacuucuauccaaauacacucaaaauauuuauuauacaaccuaacaaauuucucuucuccauugaaacauauuucccuuuugaaugaaccuacccaucauuaaacuugcuuaauauugauuugucccagaacaugaaccagugcugcaguuucccagucaucuuccccagucaucuacuuggggccccccaaaccauugcaggaugggcaggcaaaggugggucucuugauuuugcacuaaguccaacagaaccacagugagguuaaaugaacuccgccaggcucugcaguuucucaccuguucccaggccucuuucuuccccaccauccagccuuauggccuuuacuugaccuccccuuucuaaagacaccaguucaaggauaggcugaggcaggaugugauuguguuuuguuuucccacuauaauccagacagccuaauucuauucccuuuacuuccauaguuggcagacagccugugcaggaacugguacuacugaaacauguuuuuauuuucuguuuugaccuucucaaaucaguuauagugcugaggacaaaauaauugcucauuuauucaccuaugcuguuccaagaacuauuccaggaauucuuuucuacauggagcauuuaaaaagacaaaaaaaaaaaaacccaccaggcaaugaaaaaaacaaaaaauugcaaauauaaugagagguugagcuauuuuuuaaaguggggacacaguacagagacagagaacugggaggacacucuuuuagacaggguauaaauacugcugacaaauggauucauucuaaguuccugguacuccagucgaaugaaauuucuuucccaaugaaauuuuauuuuuaaaauguuaaaagcugaaauacaugcacuuacaaaaauguuccccaaacagaaaacugaucugacaaacagaucaacaaccaagucaaugaaugugaugguuacaaccgaggucuacauggcuuuuuugagauucaauucuugaaaaggugaccaacuuagcuauguuccaacaaccuaaggcuuaaaauggauaaagccagaucgacggaauuuaagaaaccugaccagcuacguaccuggaaaaggaagggaacagaaggaugaggcaugggccaaggguuuggagaaccacccuucauuccuuccuuucuaccagaggccucauggucauggcauguugcaccaggaccaacaacucuuccacgucaguaaucugagcccagccuagaaaggaagaugggacaacacuguccccaagacauuacuggucuggaaucaacuagguuuguggggaguacaggagccaugucaaaauuguucccuuauuuagcagguuuucagccagauugcaaguccaggauggaagaagcuaguaaaaguuugggaaaggaaaggggugguuacaaguagaguuuaaagaggaaaaaucaaaaacaaaaggaaggcugggugugguggaucacaccuauaauccaggauuacacuuugggaggccgaggcggguggacugccugaguuuaggaguucgugaccagccugggcaacauagcaaaaucccgucucuacuaaaaauacaaaaaauuagccaggcaugguggcacgugccuguagucccagcuacucagggggcugaggcaagagaaucacuugaaccugggaggcagagguugcagugagucaaggucacaccacugcacuccagacuuggugacaaagugagacugucucaaacaauaaauaaauaaauaaauaaauaaauaaauaaauaaauaauccaaggaaugcccagugaggggacugggggucugggagagggguaaagaugagcuuaagggugacucagaaauaaucccacaaacacaaccugguaggcauggcugagguaggacucucuuccagaagggacuaaauuguuuuagaaaacuauaaauaucuacuucucucuugccucuuuuuucaaccugcuacucauuuauuugguuuugccaaacauuuaucauuucaggucuuaguuaucaacauuuuagacuuagaauacagucuuagaauaaucaagcccaaaucauuaauaccuuccggucaugccuccucaugcuuucaauauucucauaagcuuaauaaguuuucaauacaaccuuagccuuuccacauuccccacauaauaauguuauauuaauuugucuucucaaaaaauaagugucuuaacagacaaucauuuugguucuuaguugaaauuccuucccuacuucaacgaucacagaagaaaaggaauacacugccacauuaaugaguacauuuuaacaccuuaagacaaaaacauuuuauuuagguguuuccaaauaguacagucccuucuauccaggguggauuaauacgagcauaguaaaagaccagaaauggucauauucucuucagcucuauguuccuuauaacugcuuccaugagaguaaagagacuugcuaugucuauuuaaaaggcagaaguaaauguuuaccuuucaaucaaaagcuuuucuucuguuugccgucugcugugcacccauacccucucacaaauaaaaaugaaaggaauuuuuaauugcaugaauagaauuugggagugaugccuguuuuccccuccagcacagcccaucgugaaugcacacgugcaaagugcuuccacccaggguccagcacauauaaccgaguggacgggcccaagacagaacuuggugacacuuucuauaaacagacagguucaccuugggcaaaggcaccacacuguaaaauuaauccagcucuacagauaacaaaaauuccccagggccuaaaacaaggaagucagaucugccaguauguggauuaacugauuuaaaaaaaaaaaaacucaagggaaagcacaguaauaaugaugauauuaaaaauuuuugugauacuuuaugguguaauggaugcucuacuaagcaccuggacaagaccagugugagcccucacaacauuuuacaugcugggaaacugaggcucagagaaaucagacaucuaaaccaaacuuuuuuuuauuccuuuucucucuuuuuuauuccuuccuccuuucuuuuccuauuguuguaagagcgaaugccccaaccuuuauagacauccacuuaaagaacugucagcagggggaaaggaauuaaaacaaacccagacaacuaagcagugagucacgugaaaaucagaagucgggcgaggaauuuuuaagcugccuacuacgugcagaggagaucagggucagcggcugaggcaacagucagcaaacauugcuccuuccaguuuuacagcugacucaaugucuggccuuagaaaucucuuggcgacacucaguaacuuaaaacaggagauauaaagaaaugcauuauuuauuuccucccuugccauuccuacagcuuuugaaagaaaauuagguugcacauugacuaccagguccuuggugauuucuacugaagcgaucaccuuuguggcuccauacauaaauauuuuuccuacuaggaaauggcucuucuugcauacauuaguguuuucccucauaccauugaucacuccauccaacagccugcuuagccugucaaugacucauugacagugaaaucuacagacauaaaugccaucagcugcuggauucugacaagagagaagagggaucuuggagucuggaacucagccuaagagagacauucacaaaugugauuuuuuuuaugggaaggggguaggaugucauguauaugugacacagacgucugaauaaaagaagaucaucuacgcaggcucagaaauaacaggugaguagcacuaaggagauuuagaaccuguacccuuuaagcugcuagugagcgaauggcaugccacagugcuagcaucugguagagcauaaaaaagagaagagcccaugagaacacuggcuuuccuggguaguacaaaggucaugaugccggauccgcagagcaggaaauacaacacagggaaagauuaguugacccuuggguuagaaauuucuagauggcccuagugaugaacauauuuauugcuucucauauuuuacagucaauccauagauaauacaugggaguuuuuucguuguuguucuuaguuuguuuguuuguuuguuuguuuguuuguuugagauggagucucgcucugucacccaggcuggagugcaguggugcgaucugggcucacugcaaccuccgccuccuggguucaagugauucuccugccucagccucccgaguagcuuggauuacaggcacgugccaccaugcccggcuaauuuuuuguauuuuuaguagaaacgggguuucaccguguuagccaggauggucucaaucuccugaccuggugauccauccaccucagccucccaaagugggaugcaugggagauuuaauuauggcuacagaguggaaggugaauguuauggaccaugauaaggcagaaguauaaguagcagaaguuacgggugaaaggggaaaagaagagguagagggauugaucaggguacaaacagccucuucuuaugagaaagggaguaaagaacucccagagcaaagaacuguccagagcaauuugagcaaaaauggaaacuuacauguauauauaccauuacauauauguaugcaugugugugaaugcauauauauauauauaaaauguuuacauauugacauaugcgaaauauacaaaaucugaaguuacaaacauaaugggaggaaggugauacaacuagggaagaugguaaaaaugagcuaaauccaugcucguaacagcaaaagucauuagauagugccugaaaucaacagcugaagaaguggcaguuuaagcacaauauuaagacacaggaagcagccacgagagcaucaaaaacagaaauuucuccuagaaguugccuuuguucaucccugcagccaacauccagagaaacacuggcauagagcccauucuccaucaguauuuauugaaggaacaaacaaguggacagaguggagggugugaagggaagggugagaggccauugcuugcuaugguuugucuccuauaacacuggauuuuuuuccuacugacaucaaauauuaccuugcauguguaucggaugcgggggaugggggagggugucguuuuuaguuuuguugguuucauucuaauuccucugguaggaauccaguucccaggaucuucuuugaaugcuggggauguccuauguaaaaaugcaagaucuaggaaucagucuggaaguagcugcaugaccagacaagccuggcagagacccccagaggcaccugccccaggagccagacuccucagacuggagaccuggagcguagaugccugcagagacuggauggcuuaccaaccgcuaccaggagacaguggccacuuuuuaguuaaacuacaguuuuagggaagaggagugaaaacugcccuuugcuccaccauaacuacaaauuugcuguaaaaaggaaagaaaauggaagaaauuuaaaaaaaaaauaaaagaaaaacuaccaguacagggaaggaggaggaguaugugaccuagucaguuuccaaugagcaguuaaaacauaugggggcucuguuuucaaauucugcuucugccaagguaucagcagcguggccucgggcaagucgcucaccuccucuccuugucaguaugucuugauugcacugccaucucccucauuugucaagugaagacaaugacauccuuuucaugggguuauuaaaggaugaaaucauauaaugucuauaaacguuuggcaugcaauaaagacgugaaguauuauuucccuucucccccucuccuuaggaugaaaacuggauaaacacacagccuucuaucacaaaaugaguuuauucacagauauuuccuaaaaagaugggagaaauguuucaugguaacguuuauuaaacucagauucaaauugaccucaaaacauaugaaaaaaauuuuuaaucccaaagacauuuugauggacagucaaaaaaguuacaaaauguaaagcucaguagguaauuagcugaauucugaaaaaucauauuauauccauuauacuugaugugguguggugggaggcaacuaauuuacagcaucauccaggaggugugcucauauuaaagcuugguauaauaucguauuagaaacugugguauaugggaaagagucagguggcuuuggagucagauggcccucaaucugggugccagcaaugccacuugacagcugacggacccuggcugaguuucuuaguaucgccgagccucaguuuccuugcagaaaaaaggaucugauaucacagauggcgcagagguaccaaggaauaaggaauaauggaggucaaguggcugauacgagucuggugcagagcuggcucucaacucccacuaacugcuauuauuugcaaugcaauaucaccuucuccuuaugccugaaauuauauauuagacaaguaauucucucuucugugugggaaggaauucaccaggaaacaaggagaugagaaucauguuuugucuucacuuaaaaugcuuaaaccaggcaguagucaguggggaugauaaaauugccuuguggaucuuaccaugacuuuuguccaaaaugaucagagaguacauuaaaucauuagcagaaacuuugcuaccugcugauuuuacaaugcaggcaaugaaauucauugcagaagcaaaauagggccaauaauauaauuacagcacucugccuguacagucagagcuaaugcuauuauuugacauugcaaggcugugcuuuuccccagagucucaguggagacaagguucgcccuaauugguuccaaagcacaaccuccccaacacaaucuuuccucaggaccaguaauguuaauuuccacacgacuguaaauaguauuugcaaacaauacaaacaugguaauaagaggcuagguggguaauuaaugugguuacaaaguagcuuauuugcauuuuuauuuaaaaacggccuucuuuaaaaagcagcucagauuucucuuugcaaaaggagccuugguuaaagaguacagcaguaauuacucucuuuagggguucuuuuauauguccuucagggaauuagaaugaaaagauaagcagaauuauaaaggaaaucauguaaaauaugaaauguacuauaaacacuuaguaguguauuuaccagaagcuaggcuuaccuucuucacuaauggaauauuuuaaacagcuugcaauacauucaaauuaauuguagauauggcuaaaagguacaaucaucuaguuaaacuuuucuuccuuaaagguagauuauuucaagauuugacaggccaucauaguaaauuccacuugaucaucugcagaaaagugcucucaguaaaacaaaggguuaaguggggcccaucaucgagauaaggcaaagauuugcauucuucucuaauagaaggaagccagaauguuagagcaauacuuucaucuuaucuuuucuuagcuuacaucuugcacucccgggcucaaaaaauaggaagugcgaaaauaaauucaaaagcccaguuggaacggaauucaaucuuuuucauuugucucauauuccacauguucaaucuuuuuuuuuucuuuuuuuuuuuuuuuuuuugaggcagagucuugcucugucacccaggccggagugcaguggugcgaucucagcucacgccaaccucugucuccagaguucaagcaauucuccugccucagccucccaacuagcugggauuacagaugcccagcaccaugucuggcuaauuuuuguauuuuuaguagagacaggguuucgucauguugcucaggcuggucucaaacuccugaccuggggugauucgcccaccuuagccucccaaagugcugagauuacaggugugagccgcucuuuuuuuuucuuagcacuuagaaaucacuaauguguccagccugcaucugcaaucuuaacauguggaaauuucuggaagguggccauggugucaggaccaacgguacuuaagacaccugaguucauucggaagccauccaaucaucacccacuaaccaguaggaggugagccagcugcugggucccagggaugaaaagucacaucucccucccucaagaaguucauggucuuaggguagaacugccagguggaggcaucugucagguuuaaugaaggagcagguuccagucagucugccagcacugggaaaagcuucacacaggucauagugcucaagcugucccucccagaugagagacugagaucugaacaaguggaagggcugggcucuccagggugaaguaccagcaggcaccaaggaacuggggauggaacagcuuggcaggacuggggaaccucagaggguguagcagggaagcccacuggggucccaguuagcagaaggcauaaaagaaguugcaaacucagaugucagcaaggccacgugugccuucauuuucuccuucaacagauguuuaaaaaggaccugcuaucgcgucacacagcacugcuguauagcagaacgcacauucuacuggagggagacagucuagaaacaagaaauggaacacguaagacaguuacauagagcguuaguggguucuaagugcuaagaauaaaaagaguagaggaaguuuaaaaggaucgggaguuaagaggguugaugguuaaaccaggcagggauaacauccaaaggaguagaagaguuaaggguagggguuugggguugggggugaucaccugucccaaaaagaagcagcugcuauucagucccagauaauuauugccaugucuuccaauauuuuuaagagaggccagaaaugugaauucuugacauaaaucuuuuuuuuuuuuuuuuuugagauggagucucacucugucgcccagccuggagugcaguagcaugaucucagcucacugcaaccucugccucccaggcucaagcaauucucccaccucagcaucccgaguagcugggaauacaggugcccaccaccacgccaggcuaauuuuuguauuuuuaguagaaacaugguuccaccauguuggccaggcuggucuugaacuccugaccucaggugauccacccgccucggccucccaaauugcagagauuacaggugugagacaccacgcccggccaaucuuauuuuuuaauuaaaaaacagaaagaaaaaccuaucaccuaccaagcaguuccaauaaaccugucugcaaaacaucacuguaacaaacacccugacuccaaagagacauauauuguuuuaaaaaauuaaauuaaguugcucacgccuguaaucccagcacuuugggaggccgaggcggacggaucacgaggucaggagaucgagaccaucccggcuacuucagugaaaccccgucucuaccaaaaauacaaaaaaauuagccgggcucgguggugggcgccuguagucccagcuacuugggaggcugaggcaagagaauggcaggaacccgggaggcggagcuugcagugagccgagaucacgccacugcacuccagccugggcgacagugcgagaguccgucucaaaaaauaaaaauaaaaaauagaaaauaauaauaauaauaaaaauaaaaaauugaaaauaauaauaauaauaauaaauaaaaauuaaauuaaguuucaaaaggauaugucuucacucucauccacccuccaacaauucaaacaaacaaaaaucccaaauuaguuuuggcuaagucuacccuucuucuuguaagcaucuauacucacauacccauaugguguugaaaccuucucacuuccagccccuagcauccccuaaacagccaaaacauauuuuccauaagaauucuaaugauauuucaaugauauaagacuagaucuaaauaagaccagcuucuugguauugaagcaggcauuuccuacuugugccauucaugugugguuaauggggugacugaucacugaaaagaccaccgguuugauucucagaaauaagacuaguuaauguuuuccugacucagaugugccuuucuuuucuuuuuucccuuuugaaauuuucaacauguauguucgugguuuuagcuacuucugggagcuugagauaaaacauuaaacaaauuugugaagugcuauuuuacugaaagguaaguggcaaccauaucaagaaaaccaucuuuggucaagugaauucuuuguucacaauuaucauucccucccugccuuugccucacuuuccugugggcagaauacauuggucuuggcuguuggucuuggcuacugccauugauauaugacaauaugacgcacacaugagguacaacaauguaugaacagaagccucugugagguuuugcccucugcaggcccugaugacaucuccuacagccugggcccugcaaggagacgcugugagaagcugagcccaggaaagcccacccgugacuguggagccacggccaacccucagccacauguguuaugagcaaacaaacacacauuuauuuuugcaagccuugagagucugggauuguuuguuacugcggcaaaagguggccaauacgccauccuugucaaucgacugagaaaauuucuaaccacaaaauucaagucauagcuuuauguuucacuuaaguuacauaauucaaaacauucaacuauaacagcacuagaccuguaacaaguaaauucucaccaaacaaauaaaaacuuuuuuaaaaaaagauucugucaaaaaauaaacaaggaagagacuauauccaccauuaucuguaacaauaaagcuucaacauuucaaacggucaccagugagacaauaacgguaagaagacaccaguaacauuacaaaguauuuauuguaugccagacacuauaaugugugccacauauguucacguauuuccucaacaauccagggauauggguccuauuuguuuuuguuuucuuucuuuuuuuuuuuuuuuuuuuugagacggagucucacucugucaccuaggcuggagugcaguggugcgaucucggcucacugcaaccuccgccuacuggguucaagugauucuccugccucagccuccugaguagcuugggacuacaggcacgugccaccaagccuaauuuuugaauuuuuaguagagacggaguuuugccauguuggccagacuggucucgaauuccugaccucaugugauccacccgcgucagcaucccaaagugcugggauuacaggcaugagccaccguacccggccuucguuuucuuuuuuaauaauuucaacuuuuauuucagauuaaggggguacuuaugcagauuuguuacaugaguauauugcauuaugcugagguuugggguaugaaugauccugucaccuagauaguaauagguccuauuuuugucccucuuuuauaaacaaagaaauagaaacacagagaggcuaacuaacuugccuagaaaauaaauggauaaccgcaucuuugucauucuuuauauaauuccagguagugccucauccaauuuuaguguucucugugugucauacuuucaauguaaugaaaauagauuaauuuaaaaauauuccaaguacaggcauuccauccaucacuccugaggaaaguuacuccuaugaucaaauauccuguaaauucugagaacuguucuaauaauuauuccaguucauuuuuccacacagcagcgccucccacucugcaaugccauucucaaauccccucucagauaagaaucucuuccgaggaucaagaaccugccuuguucuaaauccucacccaaaaccuuccccaugugggaaaucuauguuaauuccaccaaacuggagcuauaaaacagcaaucauguauaggagagggaaaaaagaccgaaacucauaaaaaggaauuaacauauucacacgggaugcuauauauaauauguacaaaacagguauccaagauuuuuuaaaugcaacuuccuaaaacguugggaccauacauugauauauuguggcggcauauuuuucaaagcccaaacaaauauaguagaaacucauuacgaugcuauuuucuauuggcagauuuauguuuuuuuaccuuuccuaccuaugaucaaagaaaaauucccaagccuuguugcuccaacuuaguagcucaaugguccaaaagcaagguagggcuaaaucccagccugcacccuguucaccaggcugggugcccagguggaggagcugugggccccaagaggagggggcaucuuuucuuaauucucacaaagguguguguggcuggcgggcuuggccuugggaggcuccaggggcucuguggucuagcgguccagcuggauccagugguccagcggcaucaucuugccuggucuaguccucaacacugcgguuggaaagagggcucauaaaguagauuuucucuuaacaaggggauggagaaugacacaagucaccaucaagcugguauguggacauuguggaccagaggugcaagacucaaguaaagguccuugagaaagucacacaaugaucagaugacugauacccugggucccaaaaaaacaacaaauggggauuggcaggaugauauaaugggaacuaaaguauagcgaacccaugacaugaaaagcagccuguccagcauucuccauuaucacagcagucaacuuuacaacuugaugaaguaugcagcgucaucuccaagauuaauuaucuggcucagguuggacauccacauagaaaaugagcuggguuucauaccaagugguuuuugacucugaaauccaauacacuuucccccugccaugccagugugauuacagucagacccugaaaggaugcaggaucugagccaaucacucuaccuggggcccaacucacccuacgaauaugugugcacaauagaguuggcuggaagggaugugcacuguagccaucauggggucggucggggagacacucaguacccagcaggcauagccuuuggagaccagagagucacuagguauacuggauaggacugauuugguugcaagugacagaaacucagccaaaacuugcuccagcacaaagcgggauuuauuaguuccaccuuauuucaaggucggggucaagguggucaaaagaacuguuuugcucucucucucaucucagauugacgucaccuuucuuacugucucccuguggcaggaaacuaagcgcuagcagcccauauaaacaucccugcaccuccuaggccuucagauaagagauugccccuucuccacaggcuagggacuggucuggccuaagccaagugcucaucuuagcaccaaccauuucagcaaggauguaacagaccauaacuggcccaaaccaguucaugcaaauuaccaccaccccccucacuuucauaguuccuaagauggagcuauuaauaccaaguguggacacaugugcuggacaagauaacagcugccacaauaggaaagguuugggugggaagugaguucuugaggaaaaguaagaaggauuugagccgggcgugguggcucauuccuguaaucccagcacuuugggaggccgagguggguggaucacuugaggucaggaguuccggucuaaccugacaaacauggugaaaccucgucucuacuaaacauacaaaaauuagcugagcgugguggcaggugccuguaaucccagcuacuuaggagguugagccaggagaaucgcuugaacuugggaggcggagguugcagugagccaagaucacgccauugcacuccagccugggagacacagcaagacuccaacucaaaaauaaauaaguuaauuaauuaaauaaaauaaaaaagaaggauuuguuuaggugccauuauuaugauagccacuggcuguuaacuacuugaucucuucucuuucucaaaaauagacuucagaccucuugucccaaugguauaugcccucugugugguuucacuuaaaacugucuucaguugucucugaagguggacaaaugauccagcauuauuacaaagacauacagacuuugacauaccucaugggcauacaccaguaaagacagcgauggagacaaggacaaucuccauguuacaucaucagagcaccaaagugcccacggcuaccaagaggcagugggaagugaaaccccucggggcgggacuacagcaggaaagggcuccuaggagaccaucguggcacaggugagcugcagcucugaagaucuugcuguuaacuugucacaaugugccccaugcccacgccaccucuggaaucuagguauuccuagucuugagaagccacgcuuucuccaguuucuggcuuggcucagaccugaacccaugucuugcaacucuacccuccagaugagcugcacguucucagccacagcuugaaucaaacaccagcuucaacaggaagguugggccucaggcaugaccuugacucugccugcaccuccaaauuuuaccuuccugcccccuucccccauucuccucugcagccucuauucccuuccccuuuuccuuguacccugcuucaauaacuuuaaagcagagucugaucuucaccaaucuuuucuguuagucaaaugcagaauuaaaacagagcaugugucauaucuugucaaacagggguauuauuuccagugaucccagggaaaaccacugauacgauuucaaaaggccugucauuucuccccaguagccaugaaggaucuuaacacccaugggucugucaauaccuuuauguaagccagugguuuuccagccugggucaucucauaugccccagaguuuagugucuaucaaguaacauuugcuguuauuuuucccuaauauuaucgucucgaaacuucuaaaugaugguccuacuauucugggauuuuucaaguaaagcugagucacuccaauucuagagccuuaaaacuuuauuuuuucccaacugaggcaaacaaucuacuauuuuuuuuuuuuuuuuuugagacagagucucgcucugucacccaggcuggagugcaguggcacaaucccagcucacugcaaucuccgccuccuggguucacgccauuguccugccucagccucccgaguagcugggacuacaggcacccaccaccacauuggcuaauuuuuuguauuuuuaguaaagacgggguuucaccguguuagccaggauggucucgaucuccugaccucgugaucugcccgccucggccucccaaagugcugggauuacaggugugagcucccgcgcccggccaaggcaagcaaucuauucuauguucagauguaaacucuucucaccacuuugauaaauauaacuguauugauuuaauacauauugacaaguacuaaauuucauauaaauagcuaguuagaaaacuauagcaaguaccuuuuaaucgauugaauaagaaaccacacaaucccaaguucucauaacucuaguaaggaauuacaaugaaugaagugauguuauaguaauuaaauucuuggaaugcauccauaauaccuaauggaaauggaaaccuuacuaggucuuaaugccugggaaacaccuguuacgucacugaaaucccuagaacccaccgcaucuaccuuucuccuuuaaaauugggugagaaaguaacugcuuucuaauguggcuugaaccauucuugcccugcugaaguuaagguaaaggaaggacaacagacauggguccugaaaccuggagaaaagauuccgcacuauuuucuucccuuuggcagguuaaggaaccgauuucuguuacacaaugucacaccuucuagugaaacuguuucuguaacccuucaaagacugagcuccuuugcgucuuuuuuuggggacagagucucgaagucucagagucucacucuguguguggaccaggcuggagugcaguggcgcgaucucggcucauugcaaucucugccuccgcgguucaagcaauucuccugccuuagccucccaaguaggugggacuacgggugcacaccaccacggccagcuaauuuuuuguauuuuuaguagagacugguuuucaccauguuggucuagaacucccgaccucaagugaucugccugugucagccucccaaagugcuaggauuacagacaugagccaccgugcuuggccucaaagacuaaguuccuugagugcaguccucuuuucuuugugcccaccuggcaccucuugcaaaguuuggcauaacucggccaugugugaaggguggguuggaugggcaaaaagacagacaaggaaccaagagcaucauuugguacuaacuugccuaagacaauuacccucaguuaaccugguuaagauauaacucaaagaauaaaaacuaagguaaaggguguuucuuuggggagaugggacaguucuguauccugacuaugauguugguaaaccaaauguauauauguuauaacuuuucauagaacuacacacacacagagagagccgcacacaaaugaguacaugcaaacacuagcagaacucggauaaaaucuguaguuaguuaauauuaucaugccagugucaauuucccagacuugauuguuaugcugugacuaucacuggggaagcuggguuaaggguacccagaacccuugugaagaauacuauagacuauucuucgcaacuucuaugagaaucuaaacuuauuuuaaaacaaagcuuuuuauuuauuuuucuuuugagacagggucucacuuugucacccaggcuggagugcaguggcacgaucuuggcucacugcaaccucugccucccaaguucaagcaauucuccugccucagccuccucaguagcugggauuacaggcacgugccaccacgcccggcuaacuuuuuguauuuugaguagagacaggguuucgccauauuggccaggcuggucucaaacuccugaccacaagugauccaccugccucagccucccaaagugcugacauuacaggcaugaggcacugcaucuggcauaaaauaaagcuuuuuaaaagacgaauguaaagaauaaaauuccaacaagucaaaggauaucaauugaucaacugucagguuaaacugugaguucuagcaauuaaggauuugugacaaaaauaccaaauuguacuuuuuuccucuccagugguuacccucuaggucggcaaugucugaugaaaauaaagggucaccuacauauuguuaaccuuuccaggagccgugucaaaaaaaaaaaaagguaaaaagaaacagauuaaaugaacuucaaugauauuuuauuuaaccuaguaugucucaaauauuauuucagcauggaacuaauauaaaaauguuaauuaagauuuuuuuauacugucugaaaccugggagucauguuauuuuauaucaacagcucauuucaaucuggacuaacuaccuuucaagcacucaacugccacacauggccaguggcuaccauacugaauggggcagagcuagccaccgccuuuaaguugcuguuaaagucacuuugaggccgggugcucugacucacaccuguaaucccaacgcuuucggaggccgaggcggguggaucacuugaggucaagaguucaagaccagccuggccaacauggugaaacccaucucuacuaaaaauacaaaaauuagcugggcgugauggugggugccuguaaucccagcuacucuggaggcugagacgggagaaucacuugaaccugggagauggagacugcagugagcugagaucacgccacuguacucuagccuggguaacagagcgagacuccauguaaaaauaaaaaauaaaauaaaaagucacuuugagagcuuuucauaauugcgccuuuuuauuuucuuugaaugaacgcauaucuccagcauuucaugccuacuucauggugacaggaugcaccacccugggaaguaauauaucuaaagcucucuaccaaugagcuucuacauguaaacuuacuuaaaaaaaaaaaaaaaucacaguucacaguucaacuugaaaaaguucugcggcuucgaggauuuguaugcacugugguguauucuuggggaaagcugugaauccuuccuaucagaucaucuucgaaugaagacagagucucaucaauuuuaaacagugcgguuacagaggcgggagggucuuugacgccuguucuauauucuucugauuccauguugcauuaaaaauagaacaucaauuaaauaacagcaaaaaggcuugacaugaccguggaaagaaaucuuuggcuauucucugauaguccaguucucggccucccucuaugcacauaugguggguuuguacacacacacagcacccuacuacugcccacuccuuggcccugagacuugcuuuggccaauggaaugugagcagagauggcaggagucacuuuugagccagagcgagggucagcacaucccucucuuccucugucacaacauccagcagugcaggcugcucugugggccccgguggcugagugagauccccaucucacagaucccuccaagcaacucaugaugaaaauacaguuugagcaagaaauaaaccuuuguuguuucaagccccagagauuuugagguugguuguuauuacagcauaacuuagacugucccaacacauaauuccauuguugauccuguacaugugacaucaacgauucuuucccagacaucucucugaguaugagggcuuaucacaucugcuauauaacccagacuugcuuuuacggugguugcauuaccgaccauaaaaacuguaacaguggaacuguguaaacaaaccgaacaguguuuuuacuguaaaacaugaauguaauauaaauauuugucuuugccuucucucagcaucuguaaugagagcagaaaauucaugccauauguuuauaguauaaacggggaaaaaauagaucucggugauucauccaugugggugccggcuaagcuguuuaauauuuuuaauucauccauuuuccuucacauauaaauccuccacaaaucauaaaacgcuuaugauugucagucacuaaguucaugauuauuucuacacagggguccuggcaaaggugaaugugagcaugaugauaaugaggucauuuucucuggcaucaugagaaaacaccaagcgaaucgcuacagucugucccuugccuaccccagcccaccccauccccguaaauucaaauaugaaaacacuucuccaaacacuucaaaaucccuauccuaccucuggcugaagugccacugaacauuugggacccugacaguuccugcuuuuuaaaaauccuccuacagagaagcaccgagcauguuaaguggcugcggcugcugaggaccuucugauaugguggaaggaagcauuaccgugagcaccgaggucugugccaagcauggaauccagcuucacacacagagagcaacgggggagguuuuuauauuggagcugcaauugagcccuugaugugaaguugcugaagccugcccaaaguguuugugcaggcuuuuaggaugcaagccgaaaggcacagagaaugauucaauuuucuccaaauuggcucacggaccagagguuucuguaaacggucaccauccuacaaaauccaacacugcagccaggaugcuuuguuugaaaaugacacaaaucuacucaggggaggcucuguguggcacugaggaggccagucccucgugggcacaagaguuguugaugggaagaaggaaaggugggggcaccucaaugaguuagaacccaggaugugcaaggcaugaaggggugguauucaggagauuucggcucagugagugguacuuggcagguguuacugagcaugugccacuaaccaggcacuguuaucucauuuaauccugacaagcauccuacgguucggggaugcaauaccuccauuucuuguaggaagauagagaggcauaugcaggaacaccuugucugagauccacaacacugcuacagaacggcgcagccaggauuccaaccuccaccgggcugauuccaaaauccauguucucaaccacuaacuagaccaccaaagucaaagaaaaccuuucacgcucauaaccaacugguccuaugccacccaaaagugaugagaaauacaggcauuguaucugcucuugcccgaauauucuugagcuugggccauaauacaggccuugcuucccuccccagccacaccgcccccaacacauacacacauagaccccuagugggugguagauauuauuauuacuauuaauuuacgugucugucuccacacuuagggcaaggacaacgucucgcauaccuauaugugcugagaguccagugggacggcugguauagaauaaaggaucaaaacaugcuuguugacuaaauaaggagaccuacaggcaaacaaucaaugcacuaugugauccgugcugucauagaugcauauuuaaaaaccaaaacuuggaccaugaguucuugggaggaaaaaaccuuugcuuucuuucuuucuuuuuuuuuuuuuuuuugagacagauucucgcucugucacccaggcugaagugcaguggcgcaaucucggcucacugcaagcucugccucccagguucaugccauucuccugccucagccucccaagcagcuggcacuacagguacccgccaccaugcccugcuaauuuuuguauuuuuaguagagacgggcuuucacuuuguuagccaggauggucucgaucuccugaccucgugauccacccaccucggccucccaaagugcugggauuacaggcgugagccaccacacccagugagaaccuuugcuuucuuuaucacugccauaucacuggugcucagugcucuaccugacccagagaagaagguugacagcgaugugcugaacaaaagaaggaagggagggcaggagacaggaaagagaagcccaggaaagcuuugugggaaagauacccuugaacagagacucacaggauacagaggcagauguggggaggaaaagcuuagcugagacccuuccaagcagaggacauagucugugccaagaugcagagagacaggaagguuuagcaacagcagugaguuugauaugguuggaacaagaaagagaauggccagacaggagccuagacagguaggcagagccccaagcauuucuuuucuuuucuuugccagcacuuggaaagcacacgcuagguaccaccgcaaguacucggguaccaucaugaacauuucacauuagcacuucaguucaucuucacaacaaucuugugauccaaauacugucaucauccccaaguuacagaugaggaaacugaggcaauaagaacaagugaaggucacaugguuuucgcaaguggcauaaaccggauuugaacuugggaaggcuaaauuccagaugcguugcuuaggcccccauaacacauuuuacagcucaauccuuucagacugaugacguuagcaaguuuuugcaguccuucguaaguggagccuggugcggaaaaggaacucgcggaggcuaaaagaguccuuuccaagggccaucauguugauggggugggcuauuuauucuccuuaaauaaagaccuuccauaccuccaguuuauccacuuauacaucuaaaauauauacuaucucuaaaaaaaucuauauuuaauuauacagcaucagugaaauuucacucagggaacaauaauccaacauaaaugaaugcuuccaauagaaaaagcuguaauuuaaaauaaauuccuguguuccucagaaaaaaacaaauuuacucucuuuauagcaagaaaaaaauauuaucugguauuaaguaaccccagucaauuagaaaauuucgucaauagcaaagaaccaaauuaccacccuaaauuccuccucucccagcguagauuucacuguggaucccagccacggagugugccacccgcuccggccuuaguuucauuaaggcuuaaagucaauuaagccacgaauuggaacaaucauuccuccuuugcaaaguauugauauuuuuuuccuggccgcuuuaggggcuuuuccagagcucacgaagagauuuauguuagacaauuucuuucugauuaaaacaaaucauagcucaacaauucuaauuuccuccuuucuaagcaagaaaugaucagagaacacugaaaacagugaucaacacccccacacacacaccgucaccacgaugcaaagcccagcacuaaaaaccucauaaaaacaccgcuagacagguucucucucucucucuccuucugucucucucugucuuucugucccuccuccgugucuccaccuccccuucgugugucugcgugucucucuuucucuguaugccugucucuccucugugucuuucucuuucaguauacauuuaucucgacaggcuucaggacaauuacuuaugaaacaaaaaggaagaaggauauuagaagcaaagccaacccaagcuggguuuucagcuuuaaguaguagaaaacaagaagguuuuuauacuuaccuccaaaacccuaccaucaucucaggccuuuuaauuuuuaaagccuuuacuaacuucggaucaaccuucucucucucgaugacacccucaagcacaguccggacgucugcuggauuuacccacuagcacucauguauacaccugcucuggggugcagcuggguuuaccugcuagcccuaacauaugcccccuacucucguguacagcuggauuuacccacuaguauucauguauaccccauaucucagauggagcuggauuuacccacuggcccuaacauauacccacaacucuccggugcggcuggguuuacccacuagcccuaacauaugccccaacugccaggugcaacuggauuuacccacaagcccuaacauauaccccuacucucaggugcagcuggguuuacccacuagcccuaacauaugccccuuacucuccugugcagcuggauuugcccaauagcacucauguauaccccauaucucgggugcagcuggguuuacgcacuagcccuaacauauacccccuacucuugggugcagcuggauuuacccaguagggcuaacauaugcccccaacucuuggguacagcuggauuuacccauaugcccccuacucucaggugcagccuuuuaagcuguucauucuaccuaaaggcccagguuucugucccucaaaaucaagcuggauuaugaguccacucugcaucacagucggcucccacugcuccagaaugaccaggcaaguuagagauuuuccaaaucaggaugggucauuuucaaagaacuggaauaaaauacguuuaacauaauagacuguaaauaaggacucuuucuucaacaagcuacaagguagaugaugaauuggggagacuucaguaacaucaacaugaaaccaauucacacagcucaguacuuaggaaaacacaacaaguuauuugcaacuucugcuggucugcuuuccaaaaacuaaccagccgaucuguccccuccuacaauggcaggauuacugcugcccaaguuauaacucccauggcucagcuguuuuacccucucacucacucaguaaauauuuaccaaaucccuccaauugaccaggcgcuaugcuacucacugggguuauaccaagaggaacaagacaagcaaggcuuccacaucccuaugguacgcaccucuguugcuguuugaaccuagacaucccuguggcauuucaucucucggcuguuuguucccuaagacucagucuuucaucugaaaauaggauucauaauauuagcuaucucauaguguugucauaaagaugaacugaauuaaugcauuuaaagugcuuagcacuggaaaacaaugcuagcuacuacuguuauuauuauuauuaucaucaucaucacuaccauaaaaauaagaauuuaauaagccauccaauuaagcaugaagcguugggggccauauuccuguucugcaggcagaauuaauuauuaacuauaauuaauuaauugccuaaguuaccuucugugggccucaguuuucuugucugucaaguggggaaaguuaaguuggaugaucucagaaaguccuuuccaaucugagaauguuaccuuuucacaaccacaauauacccaaauguaaucuguuaauccauaacucuuuccagaaggacaaaugacuuuacuaauucauaccucaauuuuucacccuauuagguuugcacaaauuugcucacaucuuugcugucccugcaaagcaaaggcuaaaaguuauauaaagcccaauggaucauacaugacugaaagaaacuugauuuuuaacagauucuuuaaagcacugcagaauuauuucuguguuucugucuccccaaaaaugucuauguuggcaagucuuugaggaugccacaaauggugacuccacccagccaccugauuaucaucaugaacaccccugccaagugcccuggcuucuccuccaaugauacaaaaugguccacagccccauguaaacauuugaccagcucucgguuauccgcguuuacagacuaaacacgagguaaaccaucccgaagagaaagcaauucuaaaaugauuacuuuuuuuuuuuuuuugagacggaaucucgcucugucgcccaggcuggaaugcaguggcaccaccuuggcucacugcaaccucugccucccagguucaagggauucuccugccucagcuuccugagcagcugggauuauagccaugcgccaagacaacuggcuaauuuuuguauuuuuaguagacacaguuucaccauguuugccaggcuggucucgaacuccuaaccucaagugauccacccgccucggccucccaaagugcugggauuacaggcgugagccaccgcaccuggccugcuaucuauuuuuaaaugucacuaugcgaauuccggguaugaaaggauguggucuagcacugacauguauuccuacuccuaaagugcccaucacuacccauaagaggaagaauccagaagguuccagaugguggaggaaaucagaugaaagacgcucuagaauaaaagcguagcagccugcuugacaacaaggucuguggggccacagugacauuuccaacuguccaauaaacagagacaauuuugggcuagaggcuggcugagcuuuugcgggaaugaaaacagcaacaacuuaaacaggaaaagugcuuaguaacugcagacagcacagaagugcugggacgggggaccagugagguuugaaucugcccuaauccccucuguaccaaacccagccaggccaggccacuugcauguggcugucuugccugcucuccggguauaauuaugaagagcuccucccuucacugucagcacuuccugauucaaacaguaaagugucucaucacccuccuccuaacacaggguugcagauaaguaaacacaugucuguuuucauggaguuucuacaagugaggaaugcuuucucuuauaauuuguuaaugguccucacaacaggaacuauugaaagggaugauuauuuuuagccuuugaggcuccguggauggacguuaaaguucuuccuugaaugucaggaacuaagcaagucuguucaguccccgucucguccuuuucugcucuuugcgcccaggaccauggccaacaggccaacagagucuccagaccccgcacuccccucgcuaauucagcccaaaugucugucuaucucagucacugaguauggacuguaucaccaccacucagacucagccagugauggcugccaggaccuagagaauaaagucuauucuccuaagacuggaauccaaggccccgaaugaucuggccucauagaggagcugccugcccucuccccgacaccacacccaagccugacaucuccauucccaggacaaacuacuuacacucuguggaugcucuuccuccagcuccagaugcacccuugccaugggggcuguucacaguccaccaauacuuucuccugcaaccauccugcuuuaaagcacguggggagaccaucuuucaugagucaugggaguaucacucuuaccacacuacccaggcgcuggcaucgaugacaguuuagggguaucaccucauuagcaaaauccuucuagacuaucuugugucacccacucuaccaccuagcacguaauagauguuggauaaauuaaaauugcccaaaauuuuuaaauuucagccaauuuuuaaaauagcuugaaaauuugggagcuacuugguaaacuggguugggaaaacauuugauuuucauaagcaaagauaaaaauguguacccgcccuuuuauaaaagaaaaagcaagcugcaugagaacuguugagccaugcuucucaacuucugcagauaucaaaaucuccuggaguaacugcaaaccacagauggcugggcccuaccuccagagauucuuaccuaguaggucugggguggggcccaagaauuugcauuuccaacaagcucucaagugacacugaugcugcaggucagggaccaugcuuugaguagcaccauguacauaucugcagcauuagagaccacaaaguuuaaucaaugaaacaccacggagaccacugcaaaugcauccuauccuucccugccuuaaaaauagcacccuuccugccccuuccuuuuuauuuuuaucuucuuauugcuugcaauuugauguagauuuuaagcauccuguaauucaucaacuaauucucuccuggcuacgcauuccaaguaauuaaaguucaguaauaacuuauucuuucugcuccagcaccugcauuucauuuguuuauuuucccagagucauaaaucugaagggcugucaaagugccauaauauuagugcaauaaucaaaguuaauuagucccucucaauaaacaacaacaaagccauuacaaagaugcauugaaguuucucccagcuacccgguuuacaggacgcauuguagucggaacaauuagaaucugagaauugccgguaaauaagugcaugguuccccugccauuuaaaagaagacugugcucuucauucacacugauucauuaacuccagggaaggcaaggcaggucuuggcuccugagucugcacgcucuccagcugccuagccuuaccaagugcaucccaagcuucaauaauaaaaagagggacagggguuacaaagaaaugaguggggccagucucacugccaacuuuuaguaucccaauaucuucaauaacuuuggauuuauuauuuagggaauuugagagacgugaguuuuagcuggguucugaugagaaugcagccaguggaacucggagggcaggaccagggccggugcauagaagacgcucagaggaagauucugccuucaauaugagggagaacuuacuaauuaagaggugugcagaaaugggaugggcagcauggggagagaggaacuuaugccaaagcggggugauuccugaucagguauguuuuaaaaguguuggagagaggucaaacaaggugaccugggagauggaugcaaccccgggaacuuaggauuccuugcacacaguggagcuuccuggguaaguauacaugucuuauccuuagaacucacuguccagucucucuuaaggauccuucuccccuugaggccauggauccugugauaguuaucuaccgcuacaucacaaauucccccagagcauaguggcuuaaaacaguaaccauuugguaucuuaccauauuuugugggucaaggauucagaaguggcuuagcugcugggugguucugacucaggaucucucaugacaugaaucagccagggccucagucaucugaaggcuugacugggcuggaggauuccaagggggaucauauacauggcugguggccucaauuccuuguugcaugggccucaccucaggucugcuugaguuuccucacaacaugguggcuggugagugauccaagagagugagcaagaagaagccacgaagccuuuaggaccuaccucaggagucauacccggccauuucugccaaauucuauucauggagagugagucacuaaguacagcccauauuccaagagaggagaacuggccucuacuucuugaaaggagaauuaucaaagaauuuguggacagacuuuaaaacaaucgcagccacuucuaaggcuuccuuuuacagggucuucagaaccuugggcauagcugcaucuuccaccuaagggucagggacuagcuccagaugaaccccccuaggaacacaggguaggcucugacaccccuacuucucuccagcauuaacuccagaaccuguggaaggccagcuagcuccauaccagggcacugacacugaagacaugauaggcaccuuucugcccucuacggauggaaggggcccccugcuccuuagcacagcauaccuuaaugguuaauaaccuuagucagauucuuauuauuauuauuauuauuauuauuauuauuacuauuauuuuugagacagagucuugcucugucacccagauuggagugcaguggccugaucucggcucacugcaaccuccaccucccagguuaaagcaauucuccugccucagccuccccaguagcugggacuaaaggcgcaugccgccacacccagcuaauuuuuguauuuucaguagagacgggguuucaccguauugcccaggcuggucgccagcuuuugagcucaggcaauccgcccgccuuggccucccaaagugcugggauuacaggugugagccaccacacccggccaccuuagucagauuauuaauugacacauuggugggaagcugaggaaagaaguggcuacuucccagugcuuugaucauuuaaaaaaauuaaaaagacauagacuuuacagcugaugccggaaugaguuaagauuuuggggauauuuggauguaauaaauguauuuagcaugucagaagaacaugaauuuuggagggcugggguagaaugcugugaauugaauguuugugucugauaugguuuggcugcgccccaccgaaaucucaacuugaauuauaucucccaggauucccacauguugugggagggacccggggggagguaauugaaucaugggggccggucuuucccaugcuauucucaugauagugaauaagucucaagagaucugauggguuuaucaggcaguuucugcuuuugcuucuuccucauuuuucucuugcugacaccauauaagaagugccuuucgccuccuaccaugauucugaagccuccccagccauguggaacuguaaguccaguuaaaccucuuuuucuucccagucgugggugugucuuuauuagaagcaugaaaauggacuaauacagugucccuccaaaauuauuauggugaaacccuaauugcccaugugaugguaguuggagacagggccuuucagaggugauuagaugagaguggaauccucaugaagggauuagugcccuuacaagacacaugagacagugcgaccucucucucucucucucucaauuccucucagcucuccaccauaugaggacacagcaagaaacaggcuacuuaaaaaccagaaagagggaccucacuaagaacucaacaagguuggcacccucgucucggacuuccagccucuagaacuguaagaauaaauauuuaagccacucauuguaugauauuuuuguuauuagcccgaaguaagacaaagaagaaauauugcuccaacaagauuuaugaguauauuuuacagaucugcauuggacaaguuagcuuucccugcaacgaccauuuacugaaucuuuacuaugugccagaaucugagagucauauuagcaucugcagguaaaucagccaagguucaaagagaugacuaaggccaggcacgauggcccaugccuguaaucccagcacuuugggagacccaggcaggaggaucgccugagcagaggaauucgagacuagccugggcaacguggugaagcccuuccucuacauuaaaaaaaaaaaaaaaaaaaauuagccaggugugguggcauaagccuguagucccagcuacucaggaggcagagaugggaggaucacuugagcccaggaggucaagguugcagugaaccaucauugugccacugaacaccagccugggugacagagcaauacccuaucucaaaaaaagaaaagagagagagagaugaccagauuugcccagggacaccgagugaguuaguauucacacugggauuuaaccccagaucuguaugacuccaaagcuggggcuaccucuauuccacuggguugcgucugcauauguaaaaauuagcugcauuuuaaauauuugucuaaaauaaaccuuaaccuaucgcagggcgugcugccccagccugagacuggcugcuucaucuacaguuguuucucuacuuguccuugcguagggaaguuuuaucaccacaaggaccguuucuccucuguuuaaucuaacaccugcuagucugagauucucuaaaugucccacaauaaauaugaaaaacagucucaggcauauuuuuccccucuuaaauaauggagucuaaaugccaaguggccaaaagcaggccuuucagccauuggcggcugaacacugucugaacaugaaauccgucucuucaaacuaugucaaaauugcuuaauaagaacucaggggaccccacauuaaugaaaggaugcaucugcuuuggguuucacauuauugggagugaugguucagagccagccaccuaugcuugacuuucacucuuuaaaacucugcaguuaaucacagcccucauuauacaaagguuacauggauauaaaguuugaaagauucgguucaagacugcgagcgguggccaggaaaaaaaaaaaaaaggagaagacacaaagacaaugaucaaagaacaaugaauaacauucaagacuaagucggugcaaaauuuucagaaugagaaaugaaacggaaaacuuagaggauaaguaccaagcacaaguuuuagguauucuggagacaggaaacucagaauauuuuagcaaccgauuaugucuaugagggggaugaauaauuuauuaucugauaaagaaucuucccugagccugugacaagaaaggucaaauaggcaacugaaguagaacaguaaauacacgauauacuacucgaaaaggaagucuggaacggaaggcgaaggaaagagcuuccuuggcccauguucaucaacucccucagauuacaagaagcgcagcggauguacuuuuuagguacccucauauuaggaacccagaaguauucauacaaauaaaugcaaauaauguaugaguacaauacuugucuaaguccuugaaaaaggccaaucuuccggcaucacccacacaccagcugcaaaucuuggauccaccccguuaucucccagcugugugagccugggaaagucuaugccucuuccagccucuaaacugccucaucugcacaauggguuucacacauaauauaaauacuuuacuguuaaaugcuaagcacaguaccuaguacaaagacaaauaggaauauccaaccccccaccugcaggugacaauaauaggacauuuugcaaacgccccaaagaagaacuucagaacuuuacguuccuuugugagcaugcgcuuauugacuugagcaaguggcuuauauaguucuugcugguuugcagacuuguuuauaucauccuuuauuuauugaaaauccaauacuauacagaaaaacaauuuguaaagcaaagaaaugaggaacaaaucuaauggcugauuuaggaugcgcucuucccgguaaucuacaacuauuaauaauauuaauagcuuuuaucuuuuuguuuagcuacagaucguucagaacaauggagauaagcccugugacuugugaugcguugacgaaugaucaucuuuuccaagccaagucaccagcuuagacaggcaugaggcucguauuuuacccgccccacauaccacaugccuccccccaacacauauaucauaaaagaaggccaaggccuuccauccacaaaggcaaaucaugggacuuaagcuuuuagugucaaaggagauugcauggaauucccacaaacagugaagcuauaccagcucauaaagucacugaauuuuaaggagccuaaaaguagguggaguuuugcagaagucuuuaaaagugcgagcaauuuacuccucagcauccuacccaucguuccuuaauaucaugccaugaaaacacaggaugcggcaguuucccggcagggaaaacaacaacaacaacaaaaugaaaacacaggugucaguaucuaugaaaagcacagcaaaauguugagcccaugagccuaauauaaugguugguacugagugcucccuaucugaaaauaauguuaaagucauuauuuccgaugcuaaucaaugaggcugcaaucacauaaugcugucaguacuaucccuaucccuucacucccacaaaauaaauagacccgauaucaacucuauugaaaaccugaaucauuacagcacuucagcagcaaaccgugugguugcaaucaacugagcaugcgcucucucccuaaaacaugcacauuccauuaccucuggcuaauaaaucuuuuauuuuuaccccucaucucucugcuuucucaauaaucauuuugauauaaaccauugcuugcuguuccugaugacuaaucccuuaaucaucuuuccaaaauauaugcagaguguauuucuuuguaaauacaaaagaaaaagcaaucacauaaauaguuaagauggcuuuucaaaugacaguugagugcuaauaugagcuacacuggaaaauacuaaucaacaaacuaaauacacauccauuaaaauguaggaguccagacauaugaagacagaaaaagaauucauugcaacuccacugaaaucaggcugauaaacaucugcccuagagcuccucuuucagccaguuggagagguuaagaaaaguaagcaucacuuugcacuuucaugcgugaagaaaauauuauuauuguuguuauuaauagcagcagcuaacauuuaauugagcacuuaauuuauuccacaauggguuaagacuuuauauacacagaguugauguguuuaauagaaccaccuguaucucugaauagagauauuaugaugugcauuuuacagaugaagaaacugagguuuaaagaaguuaagaaacuugcccaaggucauaagauguaucugauucuaaucuuugccacuauaauacagcauguuuuauagccgugguuaugaacuggggacgauuugcacccccaagagacaucuggcaaugccuggagacauuuugguugccacaaacauacuugggucaccccucccauaugagaggguaauagacucaagacacauucugggaagucaggggugagucaaauaguaacucuaagggagagccaccugccccucuucccauaccagcccucucugaccaaccuguggccaucucaauguccagcagaugcugauguuucacaacacuuauugggccccucgcuauacuaauggccaguccccaacagaagcucuucugcacucucuguuaaacagaucuagugagggccuggcaggcaugaggaacauugguuacucauaacaaucccucuccucucucucaauccaccgccccugccucccagccucagccucaucccuuuuccuccugcaaacaacguagggagauggaugacaucagguccaucugcucccacucuacccuaccuccuucuuccacaggaccagaguuuuagaucccaaguuccggggaucuaaaauuuagaaacuaaaauuuagaaaucuaauagaaacagaagaaggaggaacucagagccccacuggggucuuucaagagcucuacacuggaaugucgaggucuugcuguagcuguucaugaaguauguuuugauaccuaauaagcucuuguucuuuacaugcagagguccugagaucucagagguccugagaucucaagacagggagugggauaugccagaccccgagaaauaaagcaacagaagcccaacuccaauagauacuggguaaaggaaagaauaaaccaugguaaugcaggacucagacacaccuaucguugucccagacuuagagaacucacauggauuccuaacacauagacacugcuguuaaauaaaagagaguccacugcaucuugaaaacaggaaaacaucuuauuccaccagccacacuggccucuuggaauacacaggaaaacgauaggugcuugucuuaagaggugagggcaccaguguauaauucacauaaggaugugaaugagguagaucacaucugugugcuguuccacaacauaggaacaagccccacugccccguuuucuuuauuuaaauaugaaugggggcugaugugccuccaucuccucccucuuuuuuuaauuaugccaaauggauuggccuuuuaagacagugguuuacuucuguacuguccauguuauccuguuuuaauuguuuucauuuuuucucuucuaacuuuggagcaucuaaaacaucucagcaggagggcauuuucccaugaaauaauuaguagucauaguaauuacauauagguucuuaauauacuucuauauggaauguguuuucacuuaaguuguauuuuauuaaauagcuccuucuucccaaaaguaauuugagagcucuauaaaggauaucuugaauauaaagagacgacaggguagaucagaguggcuuccucuaagaaauaggauggauccugaaauuaaucacucaaaccgcagcuagagaguuugaaagcaaaaucugcaaaguaugaacauugauacuaaacaugguaaaaagaugggccaugggguggagcagacagacuuggaguuuggaagccagauggaccaagcaaggagccugacucugagcucaccagcugugcaauucgggugaguuccuucacccuucugagccaucccuuggcucgucuggaaaaugcaaaaaaaaaaaaaagaaaaacaccagguuuuugcauccuccuggaugagggauauaaagugccugacacagcauaugacagggauuugauaaaugggggcuguuagcugucccauuguggaugugagaauagcauucugcuggcuaaaaggcagacaugaauguucuagaacauggcgaucccggaaugugcagugaaggcaggaagaggaagaaugggcagggaagaacaaguugggauggaggaaugaacucuuaucuccagaagcagagcuaagaaugcccacggagccuuggcacaugacagccuccgcugagccaaauggcccaaagacuucugaaugagcuuuugcugcaacaaaaaacuuuggaucauuuugagagccucccgugaggcgccaauauguugcaguaccuucccggccccgacacugaugugauucaucguagguaacauaugaauacgcucaagcuggccagcagcuugaaaaauuggagucuaucaaauugaccuugagaaacacaggaagguaauauuuagugacauaccagaugaaauccuugcgcagagaugugaggugaggaaggaccugaagggaaguagaccagcaaauaucaagggucaaggaguugggggaugauauagagacgaagccuaacagaugucaccagagcaagaaggccuuacgacuucacauccucucugcaggguaugaauggugcaauggaaugaaaugguaacuacagcuucuggugcaaaauuugaguuuccauaaucaucaucuugggaaaaugaggaacacaauauaauggcauacagagagaacaagugaaaagaugagagaugaugaacagguugaguuucuucagccuacaaccuaucaaaucuaauuuuaaacaucuggagccacguguauuaguuuuguuucuguuccauuuuccuuuuucuguguccccgacggugaaugauucugaauaauucuuagucugggaucacuggucuaucucaagguacuacauguuagaguaaaacuauaaaacagcaaauucuaucaucggaaauugacucacagggacccaauuaaggcucaaaauauaagaaagaaagacugaacagugggucuuugacaucauccauccaaccuuuuuccuuaaagaugaggaaacaggcuccaaauagauccagaggcuuacccaaggucucaucgcuaauuggggcagguccaggaauuucugcucuaagcaucaaacaauaauuaaaauaggauaaaugcagaugaauguguucucauauauauuguguucucagaaaagaagaggauaaauuuaaugaugcaaaaacaguugugcuacagcauuaucuuccaagacugguuuaaacaugaaugucacuguacaaucagguuaccauagugucacuagcgucccuggaauuuuaccuuucuaguuucaaauauuacaucaaauaggcagaguuuuacaauuuugacacgcccuccugcuagucccaagaacacugcaagcccucagcaguugucugucuacacugucagugggaauggaaauuggagcaacaagauaagaaaugacucgggaggucgggcacgguggcucaugccuguaaucccagcacuuugggaggccuagguguguagaucaugagaucaggaggucgagacuaucccggccaacauggugaaacuccgucuguauuaaaaauacaaaaauuagcugggcauggugacgcgugccuguagucccggcuacucgggaggcugaggcagaagaauugcuugaacgcaggaggugaaaguugcagugagucgagauugugccacugcacuccagccuggugacagagugaaacucagucucaaaaaaaaaauaaaaaagaaaaagaaaaaaaagaaaaaagaaaaugacucgggaacuguuaccaaaauuuuaaaugcauaugcccuuugaaucaaggaguccagugcuaagauucugccccaggcauuuacucacaaauacguaaauaaagaaugcucacagcagcauaguuuaggcccaauaucagaugauaucguaagaaagacugaugcaagaaagagagaacugugaaacaccauugcuuggaauaacaaauagcaaaacaaugcaaacaaccuaaauggccaccaaagggaagacugguuauagcauaagcacaugauggaauauuauacagcaguuaaaacaaugaaguagaucuauaugcacuaauaagagaucuccugcaguacuaaguuuaaaaaaaaaaaaaguacagaacagaaugugaguguguuugcugguauauagauaaccuuuuucuggaagaauacauaauguuuaucuuccaagagaaggaccaagaacgacuuucacauuucauuuuucaccuucccauucugcguguagauucaaauaagaugcacguauucccauuuguacucuucucaauacaucccuaaaaauugcuacuaucccaccuacuagagguuacuacuuuuuaacauuagucagaaagacaauaaaaugaucagaaaaaguaagacucuguuuucuuuuuuauuuaacccaaaauaauaagcucagugagcucaagauaagggcucauuucaaauauacugaauuucaaauauuucaucauaaauacacugaaaaagcagaaauaaaucuuccuuuucuuuauuuucacuacuuuucaguccagaguaccaaaaauuuucuuaaguacacuguagucuauuucuucaaauggcaagaaaucuuucacagcauucaaaaaugaagacggccuccacaggguguacccagcccccuucaggcucugcucccaaacacgcugcucuaucuccuccucccccuccucccagggccucugcaccugccauuccccuaccccaucugacccuucuccacccucuucaggucuuucuucagaucuuaguucaaucacuucuuccuuggggaccccaaaggucucccaacucccuggcaucauuacugauuccuaggaccacucacugcuuuuucaaguuuacauuaagaucuguguuuuuugacuaaauuugucuuccacaauaggcugaaagcucuacaaagacaguggcaacgucuguuguccuuaacaguagaccccagcacccaucacagaggugcacuucaugaauaugugaaugaaugaaaagugaaugaaugcagucuggacuucauucugaaauccagcgauguuucaaaaaucaaacagcucgcaucacucucuagcucaaacccucuaaugucuuccucaccgcuaucucagagucuaccagauacccaucccccaacagcaccucuccuacccacuccauucaucuccagccacacuagcuucccugaugauccuugaaaucuccaggcuugugccuaccucugagccuuagcauaugcucuucucacugcuaagagaauacuucucuugacaucugcauggcuuaccccuacuucauucaggucucagaucaaaugucacaacuuuggaaggcucccugcugaugacuccaucacacucacgcuaucauuccccccaccuuccucugcuuuacaguccuuuauuuacugacauuauggcaaauauuaaacuugauuauggucuauuuuuccuaccuagaagguaagccuaugagggcagggauucuguuucguuuaauacuauauccuuggucccaagacuaaggcaagcccuuaguaaauauuuauguagacacguaucaacaucaacuucuacauagacagagaaaaguaagaaauuagagauaggguuaaagccuccuucuuucuaaucuuaacaaccauaagcauaacagucuccuaguugcaaucaugggcguucaccacguuuuauuuuucuuaauaaaugaguuaaaggaagaaacauucucaaaccccugacuaauaaagcagaugacacugacaaugaacuacaaacaaaugcgugaauaauaauggacuugcucaugcuuucauucauaagacaaacaaagugaagaugacuuuaaaaauaaagacaugauuccaagagcaauaaacuuuacacacuccacugaaaucuccauaugguuagcccggcauguguauuugacaauuaaaaaaaacaacaacagucaagcacuuacccauucuucuaaaaugcgugacacugcuucacucgcccuugccauguuccugcaggccaagaucacaugugcaccauggagggcaaaagacuuggcgguuucgaacccuaugguuuaaaggaaagucaauguuagaaaacauaacaucaacacagugagucauguugaauggccuuuaccggagcaccacuuaaauuaccccaaguucucaaccaggggugauuuugauccccaggggacagaagcaaaugucuggagacauuuucaguggccacaguugugggguagaguccuacuggcaucuaguggguaaacaccaggcauuacaaaacaucuuaccaugaacagggcagccccugacaacauagaaccaucuggcccggacugucaacacugugauggugagaaaacuuguccuagggaugcagugauuucaaagaugaagacugggacauagaagaguucacggcauguccagccauuuaaccaucaauaaugaccagauccugugcccacgauaaggacuuuaugcucuacucuaugguaagugucgccagcaccucugcuucuaccaguguuaccuagguuucuuagccccauuuccuacugagaacaauuagaaaagauggacaaaauaacacacgugcauacacacccauaucuguuugaaggcaucagaagggcacuaugacuaagaauuuugggggccaagaucugcaaaaacugcaaggccagcauuuggcagcuuuuuuccuucaaggcauauuucauuuccaaacauagugguuggaagccugagaagaugggcugagcuuuuggcaauuuuauaacaaggaaaaagacauaaauuugagcucaggacccaccaggaaagggccacgguaaacacaccaaaccuugggucgggauccuaaagaguuauacccucgcuguaauaacaagagacaguccagccuucacaagaguggaaacucagcuucaggccauuucaauuccuaguuugauuaaagugaucagucccuaucuauccaauuuccagaagcaagagaaaauguucucuggaggaagauaccauuaucuagagucucaaauuaccacuaugauuauuucaaauacucauauaaacucucagacauucaaacaaaauagcuaagcauacaaaaagaaaaaacuucaccaaaagccagaggggaacaaauggaaauaaaugcacaggagaucugucuaaucaaguuauucagaaacagugauuaaaauaagucugacugacaaauucaaggaacaaaaaggcaagauggagaauuuugccagggaauuagaaacaauaaaaaaauucaaauagauauucugaaacuuaaacaaaauaagaguaauaagaguaaagaagaauucagcauauaguuuaacagaauacaagacacagcugacgacaagauugaggaaacuacaaaauaaguuaacaaaaaaauccaaagugaagcauaaaaagaaaaaaauaacacaauaaaacaaagcacaaaagagacauaugaaacacauucucccaggcucuuacacauacauguaaucugaguuccaaaacaagugaaauagacuaagaaaagcaauauuuaaagacagaauggcugauaauguuacaaaaucaaugacgcauacacggccaaaaaaagaaguauccugagccauaagcagaaauauguauguguauguguugacauguauauguauaaaugugugugucuacauguauguguguguguguauauauauaugugcaagcuacaagcagaaauguacguuuguauauauauauauauuuaugucugugugagccgcaaacagaaauauauaugugaguguguaucuguauguguguauguguguguagauacacauauauacacauacaugucaaagcaaggcacaucagaguaaaacugcuaaaaacugcagauaguuuuagaaguaguuagagaccaguagcuacaagacugauaguuauaccucucaggaaaaugauggaagccacagcugaaaaaaaauaaaacuuucaucuuagaauucuauaccuagugaaaauauuuuugaaaaauaaaggcagagaacaaaaauuuuaagcaaacgaaagcugcuuuuuguuugucaccuacacuacaccuagugucacguauagacccacacuagaggaaacacuaaaggaugcucuucaggcaggaggaaaaugaccuuagcuauaaacccagagaugcagaaaguaacaaagagcaacauaaaggguaacgacauguuaagauccaaaugguaagagugaaaucugugaguuuuaaaauauauagcaaaaauuacuauaucaauaauaauaacaaugcuuaaccuaggaggugaguaauggaagcaaaguauccuaagguucuugucuucuccaggaagugauauaauacugauuuauauuagauuuuaauaagucaaagaugcaagauguaaaucucuacaaauuuaaaaagcuaauggagaagaaaagcagaaugauaaaaaggcaagaaaggagagaagaugacuagguacaguggccuguaauucuagcaccgugggcggccaaagcaugaggaucacuugugaccagcuugggcaacauagcaaaacucugucucuacaaaaauuaaaauuaaaaaagaaauagccaggugugguggcagguaccgguagucccagcuacucagaaggcugaugucgagggauugccugaguccaagaguucaagggcacagucagcuaugauuaugccacugcacuccagccagagugacagagcaaggcccugucucaauuuaaauggaagaaagaaaggaaagagaaagaaagagagagagagagagaaaggaaaaaggaaaagaaaaaagagaaagaaaggauagaaauaagggaaagaggaauauagaauaacuuaacaggaagccaauaauaaggugguauauuuaaacccaaacucaaauauaucugucauuacauuaaauauaaauggccuaaagauggcaauuaaaagaaaaaguuugucagacugaagaaaacauaaauauacauauacuguccuuaaaaaagaauguacauuauguuuuauaccuuauuuaaacauaagcauaaaaaaaguaaaagaauagaaaagguauacuguauaacacgggccaaaagaaaucugauauagcuguacuaauuucagaaaaaaaagacucuaaagcaagaagcauuacaagagaaagugcugaauauuucacaaugguaaauuucaauccaccaagaauacaugacaauucuaaauuuauauguacuuaauaauagagccucucauauaugucaaaaauugacagaauuaggacaauaaauagacaaauucacaauuauaauggaagauuuuaacauaucccucuuaguaacagauaaaauaagcagacaaacacaaaguauauagaagacuugaacaacuuaauugauaaacugaaaauaauugaauaugauaaacacugaaagcaacagcaaaauauacucaaguacuucaagaauacuuaccaaaacugaugauuugcaggggcaaaagcaagucucaaugaauuucaaaagauuaaaauuagaaaguaugcucuuugaccgcaauggaauuaaauuacaaaucaauaacaagaucccagaaaauucucauuucuggaaauauauguauaaauaaauaagacauuauggcucaaaaaauuacaaugaaaguuagaaauauuuuaaacucgguaauuacaaacacauauacaaacuuaaggaguauagcuaaagccaugguuaaaagaaaaucuauagccuuaacuacauauauuaaaaagaagaccaggcacaguggcucauggcuguaaucccaggaaucgggguggccgaggcggguggaucgcuugagcccaagaguucgagaccagccugggcaacauggcaaaauuccaucucuacaaaaaauuaguugggcgugguggugcacaccuguggucccagcuacucaggaggaugaucaugccacuucacuccagccugggugacagagugagaucuugcuccaaaaaaaaagaaagaaagaaaaaaugaugaucuaagcauccaagaugaucuaagcauccauuacauuaggaaaauaacccagcaaauuaagccuaaagaaagcagaacgauggaaauaaaaggagaaaggagaaacuuauaaaucuaaaacaaacauaaaauacagagaaaaaaagaagcuaaaagucugucaauugaaaaaacuaauaaaauugauaaagggcuagcaagaaugacagagagagagacagagacagaaagagagggcuugaacaaccaauaucagggaugaauaaaaggacaacauuaugccacauaaaagcauaagcaacaaaagcaaaacuagacaagugagguuacguaaaacuaaaaagcuucugcacguuaaagaaaacaaucaagacacugaaagggcaagcuacaaaauaguaaaaaauacuugcaaaccucauaacugauaguguucauauccaaaauauauaaggaacuccuaaaacccaauagcaaaaaaaaaaaaaaaaaaaaaaaccacagauuuuaaaaacaagcaaaggaaccaaauagacaauucuccaaagaaaacauacaaauagccaaguguaugaaaaggggcucacugucacuaauucucaggaaaaugcaaauugaaaccacagugagaugucaccucacaccucuuaaggugguucucaucauaaaaugaaagauaacaagugugguucaggguguggaaacaagagcccccuuaugcgugagaaacuuacauuccuuaguggaauguaaauuggugcaaccauuaugaaaaacaguauggagguuccucaaaaaacgaaacaagaauuaaaaauugcuggauuaugauccagcaauccuacuucuggauacauauccaaaggaacucaaaucaggaucacaacaauaugucugcccucucauguucacugcagcauuauucauacuagccaagacauggaagcagccuaaauuucuacugaugaaugaauggauaaaggaaauguggaagacacacacacaaacacacacacacacaaacacacacaauggaauauuauucagccuuaggaaugaaggaaauucugcuauuugcaacaacauggaugaaccugaaggacauuaugcuaagugaaauaagccagacacagaaggacaaauacuacaugauacaauuuauaugaggaaucuaagacacucaaacucauagaggcaaaaaauagaaugguguaggcaaagggcugaggggagagagaaacaaggagguauuagccaaaggguaugaaguuucagguacgccagauggaaaagcccuagagaucuaccauauaguacugugcucauauuguaucauguacuuauaaaauauaaugguuucacagguauauacuuaucuccaaacuuaucaaguucuauacaucaaauacguaaggcuuuuuguacaucaaucauaccucaauaaaguuguuuuuaaaaaugaaaaauaaagaaaaggacuacagauccuaugaacccaaagaagaucuuaagauauggugaacaacuuuauaccaaugaauuuacaauacagguaaaaaagacaaauuccuagaaaaacacuacaaaaaaaguugccacaagaagaaauggaaaacugaaaaaguucuguauauuuaaaaaauaugaaucuauauuuuaaagucaucucaaaaaaggggaaaggagaggaggggaggggagggagggaggaaaaagaagaggcagucuaauccagagcuugaacaccaacccauugcucuaaacuaaaaaauaccauauuuuguaaucugugguggaagacccuauagaguacaguacaauaacaaaguagucaauucuacuagagaaggcagcuaugcaauucagccaaacccaugucaaauggccauaaauuauuguuuacaagauaauguuaauaugcacgcaaaaucagcauaccguuaucuuccugacaucaccaugugaaagagccuaguaaaguucauucauucauaucacucccacaggccuaaucuucauagaaaacagucuauuuauacagaauacuucucaaggaaaaucagcauagcacagaggaaaacucaaguuggacacacuuguguugcugccaguucuaagcacguacaagcugugggaucuaaggucacgccuugaacccaugugaaacucaguuaucguuucuguaaaauggggaauaagugguaaacauauauugagagccuaacauaaucauaguagguggaaaacaaauguuaguugccugcuuuuugcaaaauccuugguguccuaugccucuuacccaauucguacgaccuaccaaauccagcacagucacuaugacuaaaaaauuaaaacuugcuccuagaugugcuaccaaugguaacccgagggcugaaugacuuuaauaccaaccagaauucaaagaaaucaaccucgggcuccaccauuccguuugucugaauauggacucuggagcacaauuuaaccucauugcugagacaaccugaaauuauuucuugagauuuugccaaaucccauauuccaaaauacuuacuuauuaccuaaagaugaccucugauacuuaaaucagaugcugaaauaaugcacaaaggauuucaaaccugaaguauuuaacaccuaaauccauuugacuccccuuggguguguggguaguaaaagguuuuugaagcuguaucuccaaccuuuaaagcaagacgacaauaaucucaaauuuacucauuuuuaccugugauaccaaugucaccccuuaucaccagugagcaaaagacaccuagaucauuuggggaaaaugagagaaguaaaaugccagguuuuguagcccagcuggcugggggcaggcaccgaacaaagucuugcugacugaucugccccaucaaucaggcuaaugagaugccaacagccauaugcaagcaacacagugaccaaacacaacugcauuugggagcccgggacuucacacacccagaagaucuuggacggaaugguggacugugggucccuuugaaauuuccaggucaaagcaaugaucaggaauaucuuucuucacaguuucaucacaggguauuaaaagaaaaaaaaaagauguaagagaguggaaaugagaguaaacaauucuuagucauucaauagcagcuacguuuuuaacagauugagaaagcaucgauauaacacaaggccaggcagguuccagaacuugauugauugacugauugacugacugagacagagucucacucugucacccgggcuggagugcagcggugcaaucugcaaccucugcucacuagaaccuccaccgcagggauucaagcgauucucgugucucagucuccccagcaacugggauuacaggcgcgugccaccacacccagcuaauuuuuguauuuuuaguagagacgggauuucaccauguuggccaggcugcucucgaacuccuaaccucaaaugacccacccaccucgaccucccaaagugcugggauuacaggcgugagccaccacacccaguacagagcuuuauuuauccaguuucucagguaagcuccuugagccuuacacccuccaaucuccguauuucgccagacuagcacccaguaggauucaauaaauaucugcugaagaaacaaaugguucuugcagacugcuaauaggcugcagcucuggacuauuuuaaaacaauccaggcuguuucaaacugcaacacgauggcccucuuccuuccuuuauaauaaugaauaaauauuaaaauccugcaaagauacugcucacuguaguuuugaaugaugcuaccaagaaaucugugggggaaaagcacgccguuuuucuaucaaauuuuauuuucccaaacaaaccuguuaaguccugcuaucucacuugacaaaauaacccacggcaaaggacuuuuuauuaccagaaagggcacaucugacaagacagcagcaacaggcuacaggcucaagcuuccacccucucuccuuuagagaauuccugacuguaguuacggguaagccaucugucucugugucuugugaaauuacacucugguucuuacaucuuccuuuaucuaagcaaugcauuacccguugcuagucuacuuuuaaaagcugcaauagacaacuccauuuucuuacccuuuacaauugccuuuggaacagaaacaaagcguggcuauuucaaaagaugauaguuuaacaggaaggacaauaacacuuuuauaguaaaccauaucucuagaguguggaguuuuauauaaaaaaagcuuaauaaugcuaccuacuguuaaaguccuggauaaaacccaagagaauaacaucccucacucuuguaauacugcagcugacggccaguuuaauuagcuaaauguaguagugcuaagccuauucugcacagugccaaaguuugugcaaaauaaugaaggcaaugguuuacuaaauuuaauaaccugauucaucuuauaaaaaauuaacuuuaugacaauguuuaaauugaacuagcuuaacugcauggagauggcaagaguguguucggaagaauauguaaaccuaauaauaccaagaaaauaaagaaagacguuuuaaagcaaugaacagcaucaguuuuucuagcacuuguuacaucagaugcaaucagaaaaaugacguggccauggaggcuuaauagcucacugucuuggguuuuaagcuuugaacacaaacauucaaguucuaugaaauggaaaaggugcaaaguaauuuaaauaccuacuuaucuuauacuaucuuacauaguuuucacucuuuagaacagaggucacaaacugaugaucagaggacaagucaagcccacagaccuguuuuguguggcccauacuuucuucccuucccuuccuuccuucccuuucccuuccuuccuuuucuuuccuuccuuccucccucccuuccuccuucucuccuuucuuuucuccuuugcuccuucuuucucucucucccuuccaaccucucuuccuuccuuccuuccuaauuugaauuaguugccagcauuaaaacauuggggagaucacagguccaaaagcuagauguguagcuucucugaaaaagcuuacaccacugggggcccaaucccacguggugacagguuagcugagaagccacugucagcuagaggugggguuugggcuuucuaguuggucauguugaccaugaucaucacccgugcugcuggcauuacccgccaggccacugcaggcacuugaugcucagugcacauuauucaggaaacauccuugcuacagacaugacucaagccuuaccacaaaacacccucaguccauacguucacaacucaaucaccgaaucucaaagaacaucucccacugaucugguugagauuuuauuuaaaccaugucaaacccuacuaugucaagugugagacuauuaggaugcuagcuaugccuuggaaaaccccgcaguagcacuuggcuuugcguggacagagaagcacaaggguagcaggcucagggaucugcaggagcuugaacccauggugcaagcucccuugcauuucacaaaugucacugaguggcagcagaaccucugggccaagaacuuuacuggaaggagagauaaagacgaaacagacaagcaaaaaggcagggugcuuggcaaaaaaaaaaaaaaaaaaaaaaaaagaucaaggauuggggagcaacucuguguaaauaaaucacaugaauacaacagagaugaagcuccaugaagcaagcgaaaacugugggacuccucuguaggcagcgggagccuguggauuuaggcagggaguaaacacuaugaguuauuauucauauuauuauuuuauccauuuacaguaccuccaguggucacaauggacucgcucaagauacuguggccuugugaccagccagaaauggacgaggugcccucuuaucccgagcagcucaagguauaaauuagaaaaucauguaggaagcaaaaaaaaucuacaaagccagggacugccuaagucuagguguccaaggugcccugugggccacuggugagcuuggcaaguuguuuacccagacagggaacacaaagggagaaauggcuugggcauggugguggagagcaucggagcaggcagccgcacaccaugagacucacugguagguuggacagguggggacagucgcccacagaauccucaggcacaaaaaacaugaaggugggaacccuguccccucaaauacugacaaagcucccacagagguaggagcuaagaaaaaggcagcuucuuuccccgaugccaggaagguuccuucugguuuaaguuuuuuaauuuucuccauauuguggauguacuugggcaguguccccauuuacuguaaauuaugguuuuaauuaucauuuuuauuaagacgcccaaaggaguuggggcuuacaauacccguaauuucuaaugggugguuauuauuaauuuauaauugugaaacacuggggacaaauguuacuuguaacugggcacaauuaaaaggccacagagauggugauuuccagcccccuccagccccgccccacaaacauagcacuaaaacgaucuuuaggaaccaaucaacaaguuguagaaucuuccagcacacauccucucccucccuggagaucugccauuaugcauaaagcaagaagauaggccuaaugucuuucagcuuggguuagauuuggggacaaugcaaauguggggacuguuuuuguauuaacagacuacuaucuuuaaggaugaguuucuccuauauccuccuaaaaguaggaagaccauacuuuccaaacuaaucugauuaauguaaaugaaauuacagugacaugacauugacgaugaucuugaaauccaacucccccacaggcauuuccagaugaaguucuaagaaguacaccacgccuauaugcucaaugccacaucugcaaugacuagcuaauccauaccucuguuucuguaguuacuuugauuaccugaaugaucacauuugccucccaggccauuucaauuacauaguucugaguuccaaagaguuagagaucgugcuuacuaaacacgauccacagcugccaaaucuuaagaacuuacaaaacuacacaggucucucuagagaaaaauaagucauagccagcccugcuuuuuaaaaguauguguuauauacagcaagcaacaaaucccuacagagcuuccuaaauagcccuaauaacauaaauacaucucaaauauauuaaucaaaaaacauaccaacucaagaagugggaaacgggucaguucauguggaauaucuuuaaaauacaccaggcggcaucugcaugcuuugggcaguacaaggcugaggccguaauguuuuguaaagcuguacaauaaaucccaguugacugcaugagaucucucgagaggcaagacugaccccaggcuggcuacuagugcugccacugugcugggugaauaaguucucauuuaaccugccagugacaguccugguuaggaaugagugagaaaaaugcccaaagauuacaauuaacaugguccuagacaggcacaugcagacagauucuacaaggguaacuacauugagcggcaguccugucgguaaagauguggggcaaccaggcaacuucauagauuaaugagggaugggggauaggaaauggcuuaacauauuugggggcaguugggacauagcuaucaaauuugaaguggacaugcucuuugacccagccacaaccagaaauuuauccuacaaauagacuugcaaauaugugggaggaauauucaguacggcauuaucuacgacagacugcaaucaaccaaaauguuuuaucaauuagguuauauaaauuauauugcaugaauaggacaaaauacuguguuacaccuaaaaagaaugaggagaaaugauacggagaugcaaggaaacauuuccauguuauaauuuuuuuuuuuuuucucuugagacggagucucgcucugucgcccaggcuggagugcaguggcgcgaucucggcucacuucaagcuccgccucccggguucacgccacucuccugccucagccucccgaguagcugggacuacaggcgcccgccaccacacccggcuaauuuuuuguauuuuuaguagagacgggguuucaccguguuagccaggacggucuccaucuccugaccucgugaucugcccgccucggccucccaaagugcugggauuacaggcgugagccaccgcgccuggccuccauguuauaauauuaagaaaaaaagucaaaguaccgaacagcgugcacguaagacacaaaagugguuaaacaggugccaacauugauuacugcaggagagaguuaccgguugggggcaggaaaacuucuugugcauuucauaaugucgacgcuacuuccauuuuuaacacaugcauacaugccugcuauaggaagaaacuaaaaauaacaaaccaaaugcuaucuaauugauaauucaugggccuuuaugaauuuuaauacagagcaaucaaggcaagugagaaaaaaagggaggagccuauuccuauuccaaacaagguauuuccugagcauccugauuuauacaaaggaugcuguaauguccagguaaggaggagcacuucagaguguuacucuuggcuggguaccacgccaugugcuuuaugaaacacauuaacuaauucuaagguauucucuacagaaacccuauaaagugucauugucauuucauguaagagaaaaaccacugauccccaauguuaaggaacucacaagaucagagggcaaaaaagggggaggaccccaaugggcaugguagccugacuucaagcagguguaccccaccaucaggccccccacacuaccacaaucaccaugugacuguggauuugugauauugugauauaauaagaaauacauacugggucuucauccagguuccuggcacagagcuccuaaaauccuugaaauuggccaggcauggggucucaugccuguaauccuagcacauugggaagcugaggcaagaggaucacuuaaacccaaggguuugagaccagccuggacaacacagugagaucccaucucuaaaaaaaaaaaaaaaauuguggagcacagugccaugcaccugcagucccaguuacucaagaggcugaggugggaggaucacuugagcccagaaguuggaggcugcagugagcuaugacugcaccacuacacuccagccugggugggugacagagcgagacccugucuaaaaaaacaaaaaccuuugaaauuuucugagcaaugugggugaggggagagucuuuuauuauucacaauuagagaguugugaauaauugauaacccccacauuccccgccuugggggaagaggaggggcuggagauugacuuaaucaccaauggccaaugauuuaaguaaucaugccuaggguaacaaaaccucucuaagaauccuaaauggagaggcacaguggcucacaccuguaaucucagcacuuugggaggccgaggcaggaggauugcuugagcugaggaguucaagaccagccugggugacauauugagaccucgucucuaauaaacaaaacaaaaaaacuuagccaggcaugguggugugcaacuguagucccagcuacucaggaagcugaggcaggaggauggcuuuagccugggagguccuggcuguaaugagccaugauugcauaauugcaccacugcacugcagccugggcaacagagcgagacccuaucucaaaacaacaacaacaaaaaccuaaacgauaggguuuggagagcuuccagauugcugagcauguggugccuggagaggggcaugccgggaggggguauggaagcuccacauccccuccgcaugccuggcccuauguaccgcuucaucuguacucuuuguaauauccuuuaucauaaacagguaaacauaaguaaauauuucccugaguuuuaugagccauuauagcaaauuaucaagccugaggagauggucgugggaaccccaauuuguagccagugagucagaagugcacuugacaaucuugaacuugcuacuggcauuugaaguaggggaugauccuguaggacugagcccucaaccauggggucugugcugacucugggucguuagugucaaaacugaauuguaggacaccaagcugggguccagaaaauuggagaauuacguaaaaggagggaacacuccacacauuugucaugggaagggcucuguaugagagaagaggaagacacaguguuuccuuccuuuaggguuaagagcacacacuagaagcagcuccuggaggcaggagaaaccagccuggaaugcccccaccaggcucacaccccacagggucuugacugucagucaaauacaaaucaugggauuugccaucuauucucuguggauauuacgagauauaggcuucucauauguguacaugcuuggcauguguauaauuuaagcuaaaccuacuaagcagcuguccggaaagagggagaagugguccaaauaccaccuguuucaucaacagccuaccagugcucccuucgguguaaucccaucaaggcacagaauugaggucucuucagcuacuguauuacauaaaccuaccugcuguauggaauccauucccagacagugaugcauuggcaaauguucuucucuuuuacuugauauuucaucuuggggcucagaauuaacacuguccuuugcuuuuacaaacauuuaucuguaagggcugugagaugggaucaccaguccacaggaauaaguuucucucuauguucuuccaacaucaauaguuuacaauuauagacuuaauuuaaccccacuucuauacuuccaaccaguaaaaaaugaucuuuacaccaugaccguuacaaguuauacucaauuuuuuuucuuuaauuuccaaaagucuucacugucaaacuuuaaagaaccaacuguauuaacguccaacacaaaggccagccaggcacaguggcucaaaguauaaucccagcacuuuaggaggccaaggcaggaggaucacuugagcuuaggaauucgagguuacagugagcuacgauccugccacugcccuccagccugagugauggagcagauucugucucaaaaaaauaaaacauaaagacccucuaccaauaaaaagaaaguaacaccgcaugaaauuuuuuguaaucaaaauauacauggcacuuuuuuuuuuuuuuuuuuuuuuuuuuuugagacggagucuugcucugucgcccaggcuggagugcaguggcgcaaucucggcucacugcaagcuccgccucccagguucacgccauucuccugccucagccucccgaguagcugggacuacaggcgcccgccaccaugcccagcuaauuuuguguuauuuuuaguagagacgggguuucaccguguuagccaggauggucucgaucuccugaccucgugaucuacccacccuggucucccaaagugcugggauuacaggcgugagccacucugcccagccaacauggcacuuuuauaaacuugucugagaaccuuaggaagaaaaauaaaacagcacaaaauaaaacauaaaaaauuuaggccuccuguuaaaaaaaaaaauguaauggagcuuuuuagaggcagagaccucugugucuuuuaaagguucucaagaagacacagcucuuuugcucccuuucuucuuaauacaagaaaguaacaauugcuccauaauuccacccccuacacgugcugucuggcccaaguucauguucuucagagggcaauccuuuuguuaacuaaccaaugacacacacaggcaugcgcacacacgugcacacacacacccauggucucacuucguauaauucuguacucacacuccuaucuacuaagacaaccaaaguguuucugguuguuuagaaguagaaagauuuauccugaaguuuggccuuuuuuauuuugaugaauuaauuuauagccacuucaagagaagaagggaacccaacucugaauuuguaagcacacuauauucuauuacugaacgugucucauuguuuucacagcugguacaggauuuccuuucaccauugaggccuccguuacucuuucucgucugcucgagacaggguucuuuaugauuuagagcaagcaggccagccaccaggauucuacacgcacacacucauccaaagagaccccguuccuugacuuucuuaaugaccaaaagggcugugaucccucuuggcaacauaguuuccaccccugucaauuaagaaaugcuuaggagggaauuguuuaaaaaagaaaaauuaagaaaaaaaaaaaaagaccuucauuccauugccagcucucagaaaugaaaaagccagccccauccugcacuguccauguggacaaugugcuaccuuucuaauucaagcaccuuuuuuuuuuuuaaaaaaaaaaaaaaaaaaaaaggaagaaagaaaaagaaaaauucagauugaccuuggcucucaccauuaaaaaagcgaaaagugguauauuacuuugccucuugaaaagacuaaagucuuuaugcuaccaaagucacguggaagugcucaaaacacaauguugggaaaauucagcaguuuuuugaggcucacuuuuaaaguguccaaauugacuuuucauucuccaucgcuaguaacuuuuuaagacgcaacuuuucaaaaauaugacuuaaauucaggcuucgaagcuacaucaacggccagaguuccauuaacucugugcucugugggcucaccaucaccuugccuaaaaucaaugacuccuccaacuccaaaccggacauuuauugugauugguuaggaagugguacucaaacauacaaaaaagaggcaaaauguaaaaaacuuuaaagcaaauugaguuuaauagaaaaacacuaaauuaaaggauaauccuuaccuuguaguugcuuuuuuaaaaguaucucugauaaucaaaaaaaaaaguaucucugauaaucuauguaaccagaucacuaucuuagauaucuuuaagauaauuacuuuuuaaaguuuuguaaaaucuaacaguggcuuguguguguuuguuacuauuguuguuuuggucuuuaaaaaaauaaugcugacaccaucucaauucacacugauaacauuuaaagcaagcccuaaguuucugcuucugugaguuuucuugcaguggucaaauauccacaacagucccgcguggaaggcacgggcaaugcuagcuuuaaaacaaggaaguaaauuauacucuuuaccucacuucuuucacaugccaggaugcacggaacaaaacacaccgaaucauugcgaguuugaccuuuuugguuauaacauauucagugauuacagcacccagguucccacagggcauacaauugguaaaagaaauucuccaucacuuuuuacgcuaucugagaagccaucugagcuugaauaaaaucagacacucagaagggagagcugggaaggaguucuucauuugauaacauuuuguuuggggauaccaugaugagggacgggugaaauacaccaauuuugaaaucuauaccucucaggaaacguguaaucuaaccaucagcugugaucaggcaccugcuugugugaaugugagggaugcacggaggagcuuccagcugaggcugauuuuacaugacuucuggagacucgacagcuauaaauuuuuguuucauuccccucaccccgcugcugcuucugggccaaaaagagggucuugguaggauccccaacauagguaaugugaacauugugacuaggaucaauuuaaauucaaaaaagagaaacagagagagaaagagcucugaguuggugaaggcuuuggaacccuaacagaggauuccaaccugcacggcuugccaggcagagggucuugucagcagcgggagccuaagcacuugggaggcaaguacuccccaaaagaucccaacagagauucuccuuccuagaguaaacagcuuauggaagcaugcgcaacuagaauuguuaucuggcucaaagcugccccuaagcacacaccauuuuagcaaacaccauuuuaaaguccuuaucagggcaagggggacuugauuuucuucagugcuuugagacagauagggaaaaggagauaaaaucaacaugaaaccaaacaauuucuuggaagagaaacagaucaggaaucuuacgauucucacgagcugaacugcuccccugccaucccaaacucauacacugaagcccuaacccccaacaugacugcaucuggagauggggccuuuauggucauaauuaaggauaaaugaggucauaaugggggagcccuaauccaauaggacugguguccuuaugaaaaggggaaaucuggacacagcacacggugaggagacuaugugaacacgaagaagccuacugagaugguuaauauugagugucaaugugauuggauugaaggaugcaaggugcuguuccugggugugucugugcggguguuuccaaaggagguuaacauuuaagucagcggaugaagagagacagacccacccucaauuuggguugguaccaucuaaucagcugccagcgagccaagagaaaagcaggcaggagaagauggaacaacacacuugcugagucuuccggccuuuaucuuucucccaugcuggauccuuccugcccuggaacaucggacuccaaguucuucagcuuuuggacucuuggacuuacaccagugguuugccaggggcucuuggggccuuugaccacagccugaaggcuacacuaucggcuucucuauuuuugagguuugaggacucaaacuggcuuccuugucccucagcuugugauugugggagucaauacuccuuaauaaacuccccuucauaaauauuaaugcaccuauccuauucugccccucuagagaacccuaauacacucaucuacaagccaaggagagaggccuguaacagguaucuccucccaguccucagaaggaaccaacccugccaacaccuugacuucaaccuucuggccuacagaacuaugagacaauaaauuuuguuguuuaagcuacccaauuuguggugcuuuguuacagcagcucuagcaaacuaauagacuuaacuucugugaaccucaauuuccucaucugugaaaggggaauaauaagauguacucuuaagagcuguuaggaaaauugaauaaaauaacugcagagcucuuggcaagcagcaaauucuuauuaaaagaauuauuucaaauuuuaauuauuaaaagaauuaucuuugccauuaaaaguaacggcaggccaggcacgguggcucacgccuguaaucccagcacuuugguaggccaaggugggcggauuucuugaggucaggaguuugagacuggccuggccaauacagcaaaaccccaccucuacuaaaaauacaaaaaucagccgggcaugguagcgugcaccuguaaucccagcuauugggaggcugaggcaggagaauugcuugaaccugggaggcagagguugcagugagcucagaucgcgccacuguacuccagccugggcgacagaguaaaacuccaucuccaaaaaaaaaaaaaaauauauauauauauauauauauauguguguguguguguauauauauauauauauauguguguauauauauauauguguauauauauauauauauaguaauggcaaaaaccacguuugcaccacccuaauaaaacaucaggcuaucaggcuauccagcuuauuaauuauugcuacauuagcuaaaaggcucuccaugugagcuguaucucagauucucccauggaaaccuaaaaauuuguacugaagacuaaauagaauaaaugaaucuuaacuucuccagcugugcuauucaacuauuaaucauuagugccccagccacuaccgaaaacuauuuaaaacagcuuguaauagacaauugcauacaacccaggguuuuaaaauaacgcaauaaucaguaguaagacugacaaauugccugagccaaggggcagguggaaaauuucuuacagaugugaauauucuauuaucuugacugggguggugguuuauguguguguacacacuugucaagaccuucauguguaugauuuaaauguauggguuuuacaacauguaaauuaugcuucaaaaaguugauuuuuuuuuaaagugaaaauguauccccguguuaagaaaaagaaagcugauccgaaacgugaagugagcugguuacuuaaacauuuuaauguuuaaaguucugagcuuccuggcaaccaagguaaggaaacgaaauauaauacuuuauaauguccuccucauuaaacaaccaccaccaaaaaaaaaaaaaaaaaaacauaccaauucuuuuagaggaaugagcuuuguuuucuuaauaauucugaaaacuuauuagaggaauccuuauauaggaaacauguuaacagaauaaaccagggguugccaaacuuuuucuguaaagggcaagagaauaaacauaaauacaguaaauaaaugcaguaaauaucuugggcuuugcuggccauagggucucacagcuacucaauucugcuguuaugaugugaaagcagccaugggcgauauguaaacgaugagcacccguguuccaauaaaaccugauuuacaaaagugggccucggggggcuggauuugguccacgugccacaaucugacccuucgaauagacaauauccuuuuaacauucgguucuaaacugaccugaagcaaaacaagaacuaaagacgugaagaugaccuugaucuguagauuuucacugcaagaaaaugugaauaauuauaacagcaaguucagaacccauguggaugacaaccacagaaaauuuaauuuuagacaauuuacaaguuucuaugaaagcagauauaaagagaaucucauuaaaacaaauauaaaacaaauuuucuaaguauucaauaugcaucaaaaucuuauuacacaguuuguuucacccagaauuucauucagugugcuauagcuacauuggcuuuucauugcaaagcuggauguuuaacuauaaacuacauccugccucuccuuuuguguguaaaacugacaaauguguuguuuuuggauucuagaauucuggagaaagccaacuuaaaugaauuaagaugacuaauauguugauucuguuuccaguccaacaaaaugugaauguaagacuccaugucauaugaugcuauguguuuuaguucaaauuuaacaucgaauauugaauaaggcaguuucuaaguaaauuacuaagcuaaaaauauuccuucaacauagcaaaaacucuaucuuguuuaaauaaguggaaauuugaacaucuuugcucagaucagccuaaauaagaaauuagaaaaacuguaaaccuccauuacagucaagagcauugauuccaucuuucuguggaaaguagcacaauauuguauaucaaggaaaacgauuuauuuauuuaaaguuauucacccacaaucaugauuucacacaaaguucuuccuaaauacaacacuugcacaagacgaugcuuuucuggcauacuugaggaaucacauccaaggugaaugaccacuaagauaccacaaauauaacugugagaaugacaaguguuuuugaacacccagcuacuagggaguaucuagcauuucuaguucuuuugcagcuugauaauguuuuuacaaauguuuucauugcauuaacuuaacauuuggcugaggaguuccuguggcuauaacacacugcuacacaguuuuguuuuaaguaaaccaacauuaguuuuucauuacauaauagguggguaauuucuauuuccacagaggcaguaacuauuuugcuuuuuaaaaagcuguugaaaguguugcaaagccucaacucaauuccauaaauauugaccauguugcuuccauaaauaagacucuuagauguucaccuaauucuaauaacaaauauuucuaguuuucuuaaacuaauuauauuuauugacuaccaaaggaagcauuuuaauaauuaccuucauugugaaaaucaaaucuguuaugagauaauaaaaugaaggaaaucaguuagggagcaccaucuuuaaaaaaaaaaaaaaagaaauuuaaaauuuuauaaggaagaauuuagaaauccagggucuagaaauggaaacuacauagaauauauguauuuugccccuagcucuuagauucaacuaugacaggcugucaguaacugaauuuuuuuuccauuaccugccaguuauuuaggaaauuuccauuguuuagcaccguauaauucugaaaucaauacuacuuuauuaauuacacacugauaaauuucuauccaaaaaaaaccauuacaaugaaaaaguaacaaauauuucuaugcauauuuuuauuccuaauccuauucaaugaauuuuuaugaauaaacacacucucuaaagcaaguauguguauuuaauggaaguaugucuacguaacugcuacuaaugauuacaauucccauaaaguguagggauuucuuaauucagugucuaugaacaauccuuuccuccccuacaaaauuguacacaaaugccuggcuaggaauacauuuauuuuucccuuguagaaugggccagagguuccacuauauucucaaaggaguacaggaugcaaaaaaaaaaaaaaaaaaagaagggggauggugggguugacauccaguggucuagaaucuuuuuauuuaagcagagaccugugaaaacacuauuuguucccuuuaaagauaaacagaaguguuguauacuugacaaaacagacagaggcccagaaccuguccauuuguacaaucauaccaucuccgcaguggaaauggacuuuaaccaucacaaacccaaagcccugcucggcauuuaaauugccucugcaacauccucacuaagcagccaccaagcuaugcuuaaacaccuuugcaauucgaacucacuugcucaaggcagcuugcucugugauccaaaagcaggcaauccccccuugguuccuaaugucugaugauaacgaggcaaaagaacaauuacuucugaaaaucaugcuccauaagaaaguaagcugcacguaggcaggagcacuuuguucacugcuguaaucaccagguccuagagcagagcugaguuacauacuagacccucaggaaauaccuauuucuuucgaaugacuuguugaaugauugcuaugcaucuggauagcaucaaugauaaaaagcaacaucucuuuuauagcacaguugcuauuggucuaauuguguccccccaaaaagauauguugaaguccuaagcccaguaccucagaaugucaccuuacuuggaaacagggccuuugcagaggucaucgaguuaaacugagggcauuaaggugggcucucacccaguaaaacugucacccuuagaagaagaggagaucagaaaacagagacaaacaguaauagagggaagaugaugugaaaagauacagggagaauggcuugugcagauggaggcagagacuggaauuacccugccacaggccaaugaacaucuagggcuaccagaagcugaaagaggcaaggaaggguccuucccuacacauuuuaaagggaguauggcccuaccaacaccuugauuucagacuucuagccucuagaacuuggaaacaauaaauuucuguugucccaagccacccaguuuaugguacuuugcuacagcagccccagaaaacuaauaccacagcagaaaaggcuaaagccccagaauucaucaaacugggacucauuuauagucccaucagagagccuuuuaacuuuaaggauacacugugguagauucugcuuacucuuaagagaccugagcauggugcaggggguggacuguaucgggcaccucucaugcaccccuucaaauucucacagcuccauuuuacucaaaccauuuuuacgcucaccaugcaguuuucaaccaacuugacacaaaugcaaccagauggccucaccuggggcuacaauauggauccccccauuuccauccuagagauucucugacucugcagcaugggaugccuacaagaaccugcuuggcacuugcacaugugcaaacccaaaauucugggacaucaaaacuuaugggacgcccuuguccaacggggucagaagccgguggauaaaugcccuuuauuccgcaggcagacagcuaugagaugcauuuccuaaagugccuggaguugagcacuaguugccucuaguaaugacuaacuaaaaaacacauuuuuauauugccucuccuuccuuccugaauuccccaucccucucuuuguaaucacaucccaaauuaugcauaaauaugucuuuuucucugguucuguuuuuggaggaaccuaagguaagacaaagaacucuuaaaacauuuucaauacagaaaacuuacucucuacuuuuauuuauuuauguauuuagagacagagucucacucuaucgccugggcuggagugcaguggcgcaaucucagcucgcugcaaccuccgccuccuggguucaagcaauucuccugccucagccucccgaguagcugggauuauaggcgccugccaguacgcccaacuaauuuuuuguauuuuuaguagagaagggguuucaccauguuggccaggcuggucuugaacccuugaccucaugauucaccugccuuggccucccaaaguacugggauuacaggcaugagccaacagugccagaccuacugucugcuuuuuauacaaugugaaucauuagaaaagcaacacccucucgccaaccccacccccgacaauucuaaucaguuaaaugcugccuccuugcagauuuuguccauugguccugguucugucccuugaagaaagcuaggauuaucucucuccuagauagcuacugagagaacuaauuuacauaaaucuuuucuucuaccaacuaaccagccauucacucuuccuuuaaggguugcuccuaggacaugacccaaugacuuugccauccuuuagccugucuaugcgccaccccuaaaugaacguaauauucuagauacggucugauuggugggacuguguaccuuucuuuacaacaaaccaugaagguuucaaccacccagagguauaaacggguugucugcaucagaggccucguugcaaauguuaggaguugcaagaaacaguugcauggggggaacaucuuugagcagcuguagguaauagagaugccaaaugaugauugcaauucagaagccccauuuugagcacuugcuccccacucacauccguggaguggcgcauuaagcacuucgcugggacucucccgcagcgugcugcacgugguucuugaaagcuugauuacggucuacagcaguugggugauugcuacugaaggcaggcagaugccuggugacuucucagggugggcuguccccaguguguuuuaugaccaugcagaaaggaaaaauaaggaauuuaaaaaaucuucuuucaaaagauauggauucuuaucggacuuucauuccuuaguaaaguugcauuaaacccagagacauuuauucuuuaauuuucccuauucucucauauggaagguaggaagaauuugcacucaggccccacugaaagauaagugccagauucacuccuguccuccuuucccuuuugguuuucacauccuuauucugagcuaaccacaucacgagcacaucuuuacugcucaacugaguucuccugaagcauuauaaaaaacaaaucaguuacauguuuuaaauauccguuggcaagcaucauagcauggcucuuaaucugagaaauaauuuuaauuaaacuaaaaagagguaagucauugaacacacaauaauuaaacagcagacugugcugucagcaaaacugggcuggcucuugcaggauuaucagagggacuggcguugucaugugauguuuugugacucuucuacaguccuaccaucagcucucgugaagaggaugcagcgagccauuuagacaguuggccaagaacagucugcuagacaacuuuccucauugcauccauuauagaagcugaucagaagaauucucauuuuccuugagcgagguucuguuuccuuugaacaaugguuugcucacccacucuguuccuuucacuuccucuugugcuguuugugauauccacacacuauggauaagauuuaggucuaaacggauaaggaaaaagaccugcuuucauauaucaauucuauuaagaguauggauacugcucaaguacagcacauagagccauagcuuugcaaaaaacuuuuauuaucuguugacaauuuugcacacuaccuaagagcugucaaauaaaacaggccaauuuuuaucaaacucccaaaguggaacagagaccacaacaacuuuagaaucccucagcagacuguuucaggaaucuaaaacccaagcaaacccuuuuucccuguuucauaugacggugcaucuuaacccagcuccuuuuuaccuacaaagaaaaacgguaauucccucuguggcggcauauauaugaagucauccauaagaagaaaauaagaacuugguccuagacacaaaacaauacguaaggaaauuccucauggacuaacacaagcggucagacaccacacuaguugcuuucauuccaccuugucgaauucucacaacucugugaugcugacgucaugguucccauuuuacagaugaggaaacugagacuccggggugaaagauacugugccaggccccagaauuggcaagcuggaaagcauagacgucaaaacagcacgucuaguuaucggagggugaggauucacaauccaaaagaaaacuaggggguggacacacauuuacguugcagucuuauuucccaaggcgucauaauuuucaucacucucuuauugguugcaggaggaaaaaggcaucuucuccauuucagaugugucuuucugggugaagggaucuccauuugcguuaacaucccugacccccucugccacucacuuauuccugcucaagggagcugauccaacuuauguugugaaugguaugugaaugguaauuccaggauugagaaccgggcacacgcagcucugccucuccucuccucuuacagagagcacacacccugcucuccugcacugucuugaacaugcugcaugaauggggucugcccucugcgaaggucuggccugaccuagcacugacccauuacccugucuaauugugguggucaggauuagaaagcccaccagcucacacagcuauacauauucuccaguaucagcuucaugaaugacucaggugauguuuuggucuuccauuugccuaauggguggucuuacugcucaguuagguaguaacuugggaaagggaaacuguguuauuugauagaccucuuaaaacccaaacaucucuuuacagguuaacgaaccaaccugugcuuagauuucucuagugagaguaaaaagcucuacguuccucaagucucuguaauuuaagaauaacacggcuacacauuucauuucaguuugaaacucauaaacagaugugauaugacagcacuuuauuagguuuuguccucuagauuugaaagagcucacaggccccaugaugaagacuagauccaguaaggucuaaagagagagacaugacucaaugaacaccaaagcagacacccaggaaacagcauccuuugcucacccuguccugggaaucaaauaagccuguuaugaaucugaauguauauuacaagcaaauacuauuuuuccagcuacacguucuuccuuguuucacuguaucacaauaauuuuuuaaaagcauagggauaucaugaaaucccuugcuuuguagaagauuccauuauaagaguaaucauuauugaaccuuuuagcccagauguaauuucuuacauguuacaacaaguuuggcacgcauugugaauuucagccaagguugauaaaguucaauaacuuggcuaaccaaccauguguacuacucauuauagaaguaauaaauagauucaucaaaauggacaugaaaaagccauaagaaaaucggaugccauuuccagccugccucauaaaagcaccucuuggacuuuaauauaauuuuauauauaguuaucacaacugcccaucauucaacaccaggcaucuauaaaacaaucacccacccacauuugcaugcugaauaaauuccagcuacaaaggugaauucucuauucuagacgucucaaaagucacauagagguacaugugcuuauauguucaacucccaaaaggacugacaaguaaaaaaggaaucacagaucgacaugucauuuucccugcuauuaucuuuuugagucaguuuuaguggaagguguuuuuuuuguuguuuguuguuguuguuuuguuuuuuuuucaguaauacugucagucuaauuauucucauagccuauugguaauugaaaaauuuaguagaaagaaaagaaagccugauuuagauaaaugucauggauagaaaaaagaaaucuaaguucacagaauggaagaaucuccuaugauuaaaugugcagaagucaguaaagcuggcuucuauaauaauaucuaaacaacauuaacaaaauugaauuuagaagauuugaauugaagauaacuucagcaacuguauaguuaaaaauccagauucugccuacuguacgucuuuuaugcuucuaaaaggaaacucagacucuauuagacauucaaggaaacuaaagcuuccccuccuucucagaaagaaauagucccucacacuugguaaaccacaguagagcucuagugucaagcucuaaacuaaacaugaaaaggcacgugguacauuucaaacacugucaugugaacacuuugcuagguaaauaacgacucuugaguuguugcacgugggugaguuuucucugcaucccaagacgggaagccugaggguggaaucugcauccucuauuucucagcaaggccccaucuucauuuacaggaauggugggagucagguuugucuguauugcagggacugcauuguuauggcacugggauuuuucaaugcgcaggugacacccuuucuaucugugcauugcuucugcccucucccguucucacugugccaucagcaccauuugucaccagaaauguccccaggcuucagugaaaugcuuucuucuggauuuucucucuugcguaucuauccacagugggaucaccauaugacaauauuaccaauauccucacacucuccugguucuuuucacaucuaacauggagaaaaacauagaucaagcuuucuaaaaccaacguuauacucuuaacaacaaggaaaauaucuccugccauuaauugcaaacaacaccuaaaugaucccaaguuuggccaaauauugugaguuuuucacuugccauaagcagcucauaacaacaguggagugcuuuauuuucucaacaaguuaacaaaugccugauguuuccaagagcuuaaauacuauaauggcagauauugauguacagaaauuaaaguaaaauaugaaacuaaacagagaaugaagagauaagccagaggugugcucugaauaaaagaaguaaugaaaaggaaaaauuucauaccaauugucauaauaaaaacaaaggcuaaaggcaacuaagagaagaggggcucaacgguucccaaaaagacuuacagaauagguaaaauucagcaggcauugcgaaguauucacugcacccaaaaaaaaaaauagucuuugcaaagucuguacuauuguugacugcaaugcccaccauuaaaaauaugguuaaauuucuaaagaaagacuucugacagccauccagaaaugcuaucaauaauagcagauagcuuucuaucacaugguuuuaaaauaaagccauccugcuagcauguugacucuaaaauccaaugcuaauauuugagcaacuaguaaagucaacauuaacaauguuugccauuucuuauucgucacaaggguuaguucuccuaaccaacaugagaaacacagacacauagagccguaccauacaaaagcaauucuuuaaggaaacagucuagguacauugaagaaaacacaucuuagggauaauaccugugcaagaggcacaaaaucucuuaagaagauggaaggcaucuacaguccauugacuguaaauuuggaaucacuuauuucuaaaugugacaacucucuaauauuuuucuucccuugcaagcucagcucagccuugcagguaucucccuugcuuuugugagcuagcuuccccaggauucuacuucuacgcaugacaugcagucuggagguucuagcagucugauuuuucuauucauugaaagucaugagcauuuguuccucagggguuaauuugaaauuauuucaggccaggcaugguggcucaugucugugauuccacuacuuugggaggccgaggcggguggaucaccugaggucaggaguuccagaccagccuggccaacauggugaaaccccaucucuacuaaaaauacaaaaaucagcuaggcaugguggcgugagccuguaaucccagcacuuugggaggccaaggcgggcagaucacuugagguuaggaguucaagaccagccuggccaacauggugaaaccccgucucuaauaaaaauacaaaaauuagcuggacgugguggcacacaccuguugucccagcuaguugggaagcugaagcaggagaaucuccuuuacccaggagguggaccuugcacugagccgagauugagccacugcacucaagccugggugacagugcaagacuccaucuuucaaaaaaaguaaaaauaaauaaaauuuucacuuucagguacuucucaguuuaaacauaacacgcggauaagguuuuuuaaaaagcauccuuugaaaaguuaaauaugauuaaauucuucaauccaaacaagacuagcuuuauaaccaguaauacacggcauguagaagucacucccucaagguugauggugagaucuuaauuuggcuaacccuuccauuuuacauaauaagaaguaaaaaguuugcuuggaauuuguagauccaaauaccauccagaaacaugaccgcuuucccugcagccuugacagaauguaaaaucauaagcugaagugacgauucucuacuucauguucaaauacugugcuuugcagcugccaccccauuugagaagcugggaaauggaauggagcaaauaagaauuauggcaauuauaaaaccucccugguauagauugucagauuaauaaccagcauuagcagagcucagcuacaccaucagcacgugagaaucgaagagcccagagcuacagggcuaagucguaacaggagcaaagcaaagaagccaacuaaaagaaacccagccagaacuguaaaagaaaucugcccacaaaauaaaauggguaaggcugccacucagacuagcuacucauuuuuagcacauaccaucucaagaguacauaaacugcucagguuauaagcauggacuggacaucaagauacuggaugaccuuuuaaaaaaucaucacauggccgcauacguauuaacaaaaggcaagcaauggaagcgugauuaauauaaauuacagaagaagcaauuaaacuugaccacagauacacacauuuguucaagcugauggugacucugcacucacuccauaccuacuguagauuuugcuuuucuuuauaguuacucagaagaugcauaauuggaaauaaagguuaagaaaaaucaaggccgggcgugguggcucacgccuguaaucccagcacuuugggaggcugaggugggcagaucacgaggucaggagaucaagaccauccuugcuaacacggugaaaccccgucucuacuaaaaaauacaaaaaaauuagccgggcgugguggcgggcaccuguagucccagcuacucgggaggcugaggcaggagaauggcgugaacccgggagguggagcuugcagugagccaagauagcaccacugcacuccagccugggcgacagagugagacucugucucaaaaaaaaaaaaaaagaaaaagaaaaagaaaaaagaaaaaucagagacuaguaguaagacuuaaugagagugucauucaaaauagcaaaaguucuuuuuaacuuauaagaacauauuugcuguuagauguuuccucaaguaugaaaaaaaaaaaauccuugccaggcgcgguggcucacgccuguaaucccagcacuuugggaggccgacguaggaggaucacgaggucaggaguucaacaccguccuggccaacauggugaaaccccaucucuacuaaaaauacaaaaaaaauagcugggcgugguggcacacacaccuguaaucccagcuacucaggaggcugaggcaggagaaucgcuugaaccugggacguggagguugcagugagccaagaucgggccauugcacuccauccugggcgacagagugagacuccaucucaaaaaagaaaaaaaaaacauuuuaguauccuguacuuuuaaauacaaauagaaauacagaaauaauuagaaacuacccagaguuucgccagaugugguggcucacaccuguaaucccaguacuuugggaggcugaggcaaguguacugcuugagcccacgaguucaagaccagcaugggcaacauagcaagaccucaucucuauuaaaaauacaaaagaaauuagccaggaaugguggugcaugccuguaguccaagcuacucaggaggcugaggugagaggaucacuuggcccaggagggagaggcuacagugagcuaugaucacgcugaugcacugaagccuggguaacagagcaagacccugucucacaaaagcgaaucaauuuaaauguucucuagaagcacaaagaucaagcugcugguacagucacacacugcauaacaacacauuggucaacaauggagugcagauacaacggcggucccauaagauuacaacacuguauuuuuacuguaccacuucuguguuuagauacacaaauacuuaccauuguguuaugacugccuauaguauucaguucgguaccaugcuauacaaguuugcagccuggaagcaacaggcuaucccauacagccucuguguauaauggguuauaccacguaggauuuguaaguacauccuaugaggguugcacaacgaugacacugccugacacacuucucagaucauaucucugucauucagugaagcugacugcauuuugguguguuuuguauccuccacaagggcagggacccugccuguuucuacacugaagucuuagcaccugguacucaguagucaauaaauguuuguuaauugcacaaaagacugaauaagggcguggcaguggcuaugagccagugaguccaauaucaucacacaguuuucauugcagacucuaaaccaagcucaagccucuacaggaagcaggcagguaaacugaccauggaaaauagccugugccugccuacagggggucagccuauaggaacagcucuguucaaccucagugcaacuauguuccuugauagacauaagccauagucagcugaagcugcagcaacaaaauaucauggaccgaguggcuuaaauagcagacauuucuuuaacacaguucuggaggcuuaaaguccaaggucaagguggcagcauggucacguucuuggggagggcccuccuacuaguuacagauggcugccuucccacuguguucucacauucacauagcuuaaggaaaguuagcuaccuuucuauccucuucucaucagggcacaaaucuuacuuaugagggcuccacccucaugaucuaaucaccucccagaggccccuguauuagucuguuuucaugcugcuauaaggacauaucgaagacugggaaauuuauaaaggaaagagguuuaauugacucacaguuccacguggcuggggagaccucaggaaacuuacaaucauggcaggagaggaagcaaacacguccuucuucacaugacagcaguaagagaagugccaagcaaaagggaagaaagccccuuauaaaaccaucagaucucaugagaacucacucauuaucgugagaacagcaugauucaauuaucucccaccgggucccucccacaagacauggggaucaugggaacuauaguucaagaugagauuucaguggggacacaaccauguccaaauaccaugaccuuaagauuaggguuucaacauaggaauuuuuggggaagacauaaacauuuagucuacaauacucauucugauuuuucaaaacugucauaaaucuacauuuaaguaaaauauccugauuuuaguaugcuggcaaguagucugacaaaaaaaaaaagaaaaaaaaucccacuauagaccauuuuugugugguccauacaaaaaacaucuggaggccagauccaggcuccaggccaccaaccaguucuuaccucuguccuaaaggcugauugggaagcuuuacccuugagcuuauggaaauaagcaaacacaaaaauguccaccucccuuaaucacuaucacaugacaauggacugcacacacaacggcagucccauaagauuacaacacuguauuuuuacugaaccauuucuauguuuagauacacaaauacuuaacacuguguuaugacugccuauaaucuuagguuugcagcauagaagcaccgaguuuguggugguccauuauaguagcaacaggacauuaauacaccuucccaauaauuaaguaaacauguaaggaacauacaagugagaugcaaacauguguacacucggguaagucaaucacuaacagcgucgcgaugaugacacaccaacaagacuagcuuucccaaaucccucccggaucaggccagcaggaaauaaaaaagaaacacugggcaaguggcgacgcuaacccugggaggaaaaagguccucgugcacacaggcugacagcucccaagucagcuuuucaggcugaaaggaugguaucccuugccaaaaaucugacuccacacccugacugagauguuccccauauggaucuacuacagagcucucuaccuugucaaacacucaaucuaguaacuguacgugaacuuagaauugaaacuuccuuugcuaauagauaaagcuguaacagcauuuuuaaugccauuuggaauguacugaugaucucucagcugauagaagcuucucaaaccuagcugcugaauuuagaagccacagcugccuugcuguaucacacagccacacaguaaaaucaaaggcaguuggaagacauuauauugcaagauacaaaaaguuuugagaguucauccuuauagccaaugguggcugacacagcggagucucuccauuugaaagagauugauuauuuucauucuuuugcuuugugugaucaccaggaaaaagaguuucuauaaucaagauguggccagcaauucuguugauguuauauaagcaaggagcaucccguuugugucugaauccccaaucaguaucuaaauucgugcugcacugugagcagaaguaaggaccugggcaggugaaacuuaaggcaagcaggaagaaaucgcaucacccaagaacucgcaacauuuccaccuguguaaucucaacacaacugcaacccacagaaguuucugccucugcagguucccuucuuauugaaucaaguuucugcuccugaauaucuggcuagagucagagccugucaacuuuaaaugagaucgcaucauuaaaauuuuagucaucaccacccagucaauugcaugacaugcaacccuguuaccggacauccgguucacuucguaaacccugaagaagauauuugcagaaaccucuccccauauccuaacaacaacaaaaaaaaaaagucaagagcucuuauuuuauucuuuccauuaaggaauuaaauuacucucuuccuccaucuucuuccaacccuaaucuucccuuuaggagucuuucuucuauaacuaugauuuuuccccaaacgccagcaaccuuauauucauacacuauuggacuucuucauuacagcauuucacacauuguuuuacuugaucuguacaaaacaguaugugacagagaaguuauuauucucuugaauuuacaaacgaggaaauuaaggcucagaugguuaagugacuugccuuaagucacccaaguuaaggacaaucugugucaaauuacagcucucuuccuaccauguccaguagacgccaauaaaacuguccuaccuuuuuaaguggcaauaaaacuauauucaaacacugacacuuuuuggauaugaucaaaaaaauaggacagcaaaguugagcauuucuacuuaauacaccaggcaguccuauaaacuaucacaaacuugggugaacaagugugcuaaugcagaacucucaguaaaaaagauguuaccaugaugcaugguauaacgguuuuaaagaauaauaguuuuccuucucuuuuucccccaaguuuaauauaucccuuuuuguuccuugacuguaacaaaaauaaccucgucucggugguuuuuuuuuuuuuccguugauuauucuuuucuggaugaaagcuacugaccuccagccaaaaaaauucuaaaauguuuuccuucauaccaaagacaagccagugucuaaagcaguuauuuauacaggucauuuuaggacaaauucacagagauuauggcagccucuugaggaucugggaaccaggaagcuaggaaaauaccaaacuaauuucacugguaacucgauccucuugccucccauuccagaaauggcuacacguuauuaaacgccugcaaugaugaguagacaauucccugggcacucuggaguucccaucuuuaacaacuuugcaaaguaggaguacuguccauauugcacagagguggaacaggaguucugagaaggaaaguaacuugcucgggucauacagauaggaagugguuaucccagguuucaaaacuaggucacgucugcuuccagagucaguguuccucuccuacaucuuuccagauagaaacuugcuaccaaugaagcuugcccuaacugucagcgaagcuauuuucagcaaugguacaauuucuccaccugaaagcaggcucaucaaaugagagaaugcauagaaaagcucugaagcgcuguuacugucauuaauagaagaucuaggggaaauuugcauaaccaaaguaaucaaaucuugccuacugugucaucuugggacuccaccaccauugcaaagccagacaaguuuaaguuuuuugggguauucccuccuuaaaugcggguaccaaagcaacagugccuuugauuugaguugcagcuggcauaauagacaagaugugugcuuaaaagauuuuagugaagcaaacugaggaguuaggccaauuucuuucucugugaauuuccucuugaucacaggauugaacagguacuuaaaguaauagacacuuuauaaauuaacuucuaagggacauuuugaaaauuaaaugauagcacaugaggcaagcaaucaauuaguaaucgauacauauccaauagucaugcauauaagaugaaagggcaauucguuaaaaaacaaauggcccgacauaagaaaagccuaucaaucuugcuaaucaucagagauaggcaaauuuaagugauauuuuuuaaaaauucuaauucucaaguuuggcaaggaugcugggcaaaggagcauucaaauugguacaaucuuccagggcaguuugacaaaacaaaucaagauauuaagguuggggagcaaaucacuucauucagcaauuccacuuccacaaaauaaaacuauagaagagucacggauggguacaaacauuuaauuacaaaaugugcuucuccauuccacagcuauuaaaaagcuggaaaccacccgaauguaccacacugggagaagagcuggaaccacauaauggaauacuaugcagccauuuaagauguggaguauuuaacaacacagaaagauaaucacaauuuaaauagaaaaaucacgaaagaagggaaaacaugcuuacaaucauacaugcuaaauauuaauaguauacuucuaacugguaagaauugggguuuuuuuaaaucuuuuauucuuauuuuuauuuuucuucgcuuucuaaauuuuccauaaggaauacauguuaaucacaauaaccuuuaaaauaauuacuuauauuaaaugagaaggcacaucaagcuaaucuagccuaacaccuggcauauacaggcgcuugaugaaugcuacuucccauucccccagacuuauuccuuaauguuuguuuuacaaucauaauaccaaagugguuuugguaaagaaagcuucagcuuuuaaaaaaaauuugauuugguagagauggggucuugcuauguugcccaggcugcucucgaaccccugagcucaagcaauccuccugccucagccucccaaagggcuggguuuacaggcgugaaccaccaugcccacuccuaagcuucagcuucugaauccaggauccaaugcagucuggaaaugacaucugccuuggcccuccccgcagaugccacucccagcacuugaccgggcacagagcgaggcuucacggguuuaaauaaauugguugauuccaaacucaggauuaacaaaaugaaugagcugcuuagaaagagcucauucaggagugugcuguuauuccucccaacaggaugguggcauguacaguggaaggggccccaggcacagacucaauuacccuuugaucuauccugcaggcacccgccgcccaagaccuguaugaucucaagcacguuaccucaccucccuucucuuuccuuucgacauuaucacaagacagcuguaagcacggugcugagaauuaaauaugacaaguacggaaucuucauaaauuuuaaacggcuaucaauguaauacaacaugauaaucaauaaauacgaaucuguaacaauuaaguacauuguagagguaaggguaaaaaugaaaaacauuguauuagcuuuaacuucaguuucugugcaacuacagaagaaauuugauucugauuuuguuccucuuuauaugaaauaaacuucauacaaaaggcuuagcuccguucaucuggcuaguuauccuccaccuagguagaaauaguagagacacugaaauagguuuccuccccgcccccaucucucugucucagaucuccucuuagagucuagugaagaaaccuugucuugcuuucagagagcaccauaugacuauggcuucuaacaugaaggcuccaaaaaucacaaaaaguaaaaccaucaagcacagccuggugagcaaauaacucaaagacuuaaaacaauuagauuuaaaccuugucacacaaugcaacccuuccuaugcaccccauucaguuaggcuuguguagacugagaccagcucuucaugaaauguaccguuauuuaugaagccaaagggagaucacaaauuuaggcaagaaacuaaaagcgagcuauuggaaccugcuuuuugauccaucuacuggugccuuaauuuaagacaucuuuccaagaaggccuccuagugaccccaaccuuauuuuggagaaggcugaggauucauaucuacucauguauaggcuacaaaaguccaagaaggucugugucauaccaaacaggcaacggucaaggggguuucaacugucagcaucuuauuuauuaugaagucuauaauaauucccagaaucgccaucuaguuuuaacaauuuauuagauaaacaacgaacacacucguauaugaacaaccaaaauaucuuuacucuggugaaauagcuuugcaauguuacaaguauauucacaauguuuuucaggcucuugcauuuucaaaagagaaaaaguugcugaaaaaaaaauuauauaaauaaaaguauauaauauagcauauucguuuuuguccccauuuaaaaauuugaaaauaagcaguuuuguaaagccaaaguguauuccuuucugggccaaauuucuauuugacagcugaaauaugcgauuaaugggcugccucaaaccauaauuacacagccaaaacaaaaauuacccucccuaagauuguacauggagaacacuggcuaucugcuucacauuaaguagcugguuuaauaugaucccucuuacuuaagaaacauauacuguacugagcccaaaaggacacguuuucuucuacagcaagaauguaucauuaauaaacaauuuaauuacaauaaauuauguaacacuggguaaggcuuguagcagggggcaagggacacuauauucuuagaaaaaaacauaggguugcgggugcaguagcucacgccuguaaucgcagcauuuugggaggccgaaacggguggaucaugaggucaggaguucaagaccagccuggccaagauggugaaaccccaucucuacuaaaaauacaaaaauuagccagacguguuggcaggugccuggacucccagcuacucgagaggcugaggcagaagaauugcuucaaccugggaggcgaagguugcagugagccaagaaugcgccacugcacuccagccugggcaacagaggaagacuucaucucaaaaaaacaaaaaaaaaaaacaaaaaaaaaaaaaacaaaacaaaaaacaaagaaaaaaacauagggucaccaaggcguucaaaaugaaccuuaaacagagguauuaauacuuaaauauuacaauuuccacuuaggaaaaaaaaaucauauuauugcuaggccagcacacucaaaagcaauaaugucaugaaaacacaugcccuugugugauuuggcagaacaggcugcucccugaacacaaugggccuuuuuauuaaguggaucccuucaucccuggcauuuuauacaaacaaaacaaaagagagagaaaaagaaacaaacacgacacuaguaacagucuucaguuugaacuucaucacagagaauuagaagaccuaaaagauauguuagaaaaguaaaagacauuauuuaaccaaaaugaaagcaagauggacugagaggaacagaacuauauugcaaugcugccucuuuuguuuaauuauaucaaagggcaacagagcccucuaguggaaaaaaauaaaaauauauaaagaugguucugcuuuuagauuaaaggaaauauguacaacacccccgggcaugguggcuagugucuguaauccuagcacuuugggaggccaaggugggcggaucacuugaguucaggaguucaagaccagcuuggccaacauggugaaucccugucucuacgaaaaauacaaaaauuagccggacauaguggcucacgccuguaaucccagcuauucaggaggcugaggcaggagaaucacuucaacccgggaggcggagguugcagugagcugagaucacgccacugcacuacagccugggugacagagcaaggcaccgucucaaaaaaaaaaaaagaaaaaaaauguaaaauaacaucuuccauuacaauuuuuauugugccacucuaugauguaaaagcaaaagaucaaauuauuuuaauuggguuuuaaguaaaacaauuuccaaguuuucaagcuuuacguaaugcuacaaaaccucaaguagaacaaaaaucuauuauuaauuuuuuuaauuauggguuugacccacuuugucauuaaacaauaguuuguaugacucucauuuguuaugcugacaccauaaaaaaguaauuaaaaucuaaaccuacaugcaggcaugaaauucaacugauggccucaugugacaaaaaaguuucaguugagaucuaaucagguucacacugacaguagcccccccuuauccucgggagaugcguuccaagacccacagugaugccugaaaacuggauaguaccaaacccuauguauucuaugcuuucaccuauacauacauaccuaggauaaauuuuaauuuauaaauuaggcacaguaagagaucaacaauaauaauaaaauagaacuauaacaauguacuguauaaaaguuauguaaauguggucucucacacucucucucucucaaaauuaguauuuucagaugccuguugaccucagguaacugaaaccucaaaaagugaaacacgggccaggcacagcgguucacaccuguaaucccagcauuuggggagguugaggcaagcagauugccuaaugucaggaguucaagaccuguauggacaacauggcaaaaccuugucucuacuaaaaacauaaaauuaguagggagugguggugugcaccuguaaucccagcuacucaggaggcugagacaugagaaucaccaggcccugggagacaaagguugcagugagcugagaucacgccacuguacuccagccugcgcaacagaguaauacucugacucaaaaaaaaaaaaacugaaacaccacggauaaggggggacuacuguauacaugauuacaaauuuauuuuaaaaauauauauaacauacacacaccccuauuauaagcauuuuacaugagauuaccaaauuaugagaugaugcucauuagaauguuuuaaauuggucucuuccuuuagauauuuacuucucaaauacuuugaucacgugauuuccauguacacucaauguccaauaauaucucaguguaaaaugguuaagucauaagguacuaauucucaauuuuuauauaaugucauuuaaggacuuugucuaacacugucaagaaucuccauaguuucuuagaacaaaguaacuucaaaauaauuuuacuuacaauaccuggguauaauuuagcauaagauaauaguaggcacaaauguuuuuaauuuaaaauggaguuccaaugcccaaaagguuauuucgauuauuucagaauauuuuccuuuccuuaaugagcaccagguuuuuaaaaagauaaaugccaagaucccacuaguuuaagucuggucaacaaucagaaaggaaacuaaucaggcauuucaagaucccaagugcaaugaucucauaugaguguguuuuacccaugaaaaugacuaaauguaaguuagcuauggccccagauuuaugggaccuuuuggaauaacuagaaaaaaaaaaaccaucaaugacaugcuuuaggcucaaaggcaaaauuuaguaacauuuagguauggaaaagaaaacaaagaagcaaagguguaaaggaagcuggcguaguccauaauugggaaguguggauuuaaaaucuuaggaaugaauacccuucucuacaugaagaaaaaguaauuuucuucuauucacguagaacugguaaaauuugcacaagauaugaauucaucguggugacaauuuguaggaucaaagaguauggcaacuacaguucacacuguaauuucaacacaugauuuagaaacaagacccuaaguuuuaaaaaguaggcucucuaagcuaagacaaucaauuucaacaucacacuauaauuacauuuugggauucccugcaugaaauuuuuuuuuuuuuuuuuugagacggagucucgcucugucgcccaggccggacugcggacugcaguggcgcaaucucagcucacugcaagcuccacuucccggguucacgccauucuccugccucagccucccgaguagcugggacuacaggcgcccgccacugcgccuggcuaauuuuuuguauuuuuaguagagacgggguuucaccuuguuagccaggauggucucgaucuccugaccucaugauccacccgccucggccucucaaagugcugggauuacaggcgugagccaccgcgcccggcugaaauauuuauaccuucauuuuguuucaaggaaaacaaauugaggagugaccaauaccuugagcacguacuuuuuauaccucaaaauauauacauuuugauauguaaguaugcauauauauagguccauguaauacacguuagagaggugauuuugugacauaaguaccaauagaaaaugcaagugucagucccaaaauauauuucacugguauuuaccaguguggccagcuuguauuuguuugcaggaaaaaaaguuuuguuucuguuaauggguccuuuggcucaaaaacuguaacgaagcuaggcuauucuaacuuuaaaguuacaacacacaugaugcagcccagcguucuaaagguucgcaaggugaaagaaacuucaucuggaccaaacucugaaaaaaauuuuaaaaaucaaguuuuagccacugcugguuuaggacugaaaguuaagaaguuuuaucaucauuaccacagaagaguagacugaaaauaucuaauuuguucauacuugcuaauagcaucugggcacaguggcucacaccaguaaucucaguacuuugggaggcuaaggugggaggaucacuugaacccaggaguuugagaccaacaccugagcaacacagugagaccccaucucaaacauuaaaaaaaaaaaaaaauuuaauggaugucucacaaacccuggaugucacuccguaaauaugauaauaaaucugucugcuuacagaaaauaauuugcaugcgcuccaacaaacaucuagcuaauuaagacaaugaacagaguagguggucccacauuuaggcauccaacuaaucccucauuagaaggauccugccuuugaugagcaacaugucagccugcagguagcagggggcagcauuuuauacuaaaguauuuauaugcauagccaaauuagcugacugauaggcugugucuaaaaacgaagcagggaccuuccucaaugcgaaauucccucgccuaaaaaaauucccuuuccuaacacuucccaacauuugcauguaauguucaccgugcugaaggcauuuccguugcuuuuaccaaaucagagccaacaagcugcuaacuccaaagagucguaaaacaccuggcccuuccugcucagucuauguugaacacaaacagaaaugaauuccucccuugucucuacugguuagcauucaggacugcgggguuccgggccucuugaucuccuagcggaagcuuugggugaagagauggcuucccccuggauacugagaugcugaucuccacagagagagguccacaagcuacagcuuucaaucuacaaaguucuucagguucagaaagcugguuaaacaaaggucaaggagagaagaguguuaguuucugaggaggcaacauucuaauccuugcagcugccuaaaaaaaaggcggggguuucaggcaacauccccaacaguuacauacaaugugcugccacagucuuccuggggccuggggcauuccauuugccuaaauuucaucuaagcuguggcuaauuuagagaauguuagggugauaucacuuucaaugaacuggaguaucuaacauagcagucggcacuuuuuucugggaaaggccaaagaguaaauauuuacaguuuugcgagcuagaugaucucugccacaacugggcgacucuucugguaacaagcaaagggccauauuauuuugggauaacugaauauacacaaacaguaguucaacauuauaggaaugggaauaaaugggcauggcuguguuccaaaaaaaauucuacuuacaaaaucaggcagugggucagaguuagcccagagauggcaguuuguucaucuccaauccagacaguugaauccagucagcagcgguaauaccugccuauaaaccuuaauuauaaaaccuaggacuucaugaacccacaaugcuuuauucugacauuuccuccaaauccuuuuaucugucagaaucccugauuuuuuuuagaugaauuaagaaucccuccaauugccuuaguaauaucaguaucaaaaacucaaaauacagcuccguaucacuuacagcugcagagaggaaaaugaugacaagacagaguuugcuuagaggccacuucaaagggggcauggcucuagugcaacccuaaagucuaucaagggagggauguccccuucuuuaucagugagauccucaccaauggcaauuccaacaaagcagcgucauauggggcauuaaaaaaaaaaaagaaagaaagaaagaaagaaagaaccacuggaaauacuagauuugcaaaucggccuuuguaaggcaaauuagauaucuauguuuuuauuguggagucaccacuuucaaaauaaauccuguuauguuauguuucagcccaccccgccuuagagaaaacggacauucacaggguuaaagauuucacgguuuauccaaagaaaacaggcucccuugaguggccaaaggaaagggaacaccaacaccauuaaagcuuagauagaauaugacuccugaaugccccagaagucuuggaaguaaagaugcccaauucacucacucggcauucagcuauuucauuuuaaaugagcggaacuaaaguagugauagcaauuuauaaauuggcauguuucauagcuuaguagaaggacuuuaucuagaagccacagccuacuugggcaaggacacuuucuaaggcagccacgcaggauauaaaagcuaacuuagcaaagccaugugccuaucugcagccucuuccuuucuucagaccugauaccacugcugcagagugcaagugauuugugaguuuuugauugccuggaacuugcaguacgauauuauuucaaaaauucagaauaaaaaucuucaccacucaccuagacguaugcuucccaagaguggaggggaauggggugaggugacaguguuaaaggccauuccugcggaaggugacagcuggggaaagagcugugggcacuugaauaggaaaggcuggucucccuaagaccuugugcgacaucugugccauccugagcguuacaauuugccacaaccuccaacuggaccgcagacaccuccugcaguguccacaaaaugaauuauagguaucaggaaggaagagucuuagggggaagugggagcugugaagaggcacaaagaguuucuggcuuuacuccaacaugugagggccauucucagcaaccacaaauuuauucucaaugcuucagaaucuccuccucuccaucaagacuuauguaucuaacuagauaucacccuuuuaauauucugaaccaacucuaucaguccuggauuacaaugucgcaggucugcuguugcaaaucuuugaaagagcauuagcucuauucaagagucugcuaucuaaugucacauggagcaguucgaacacuuaacacaaaaaacaaucaguagucacauaucuuacucauuacagaaaaagagucuagcuagaagauuaagagaauaagaucuuuaaaguuucuggcuaacuuguuaaauuguuaaaaagacauuuuuaagcccuuaaguccuuuuuucuuaauuauuccacaauuguauggguccaugcauucacuguaacaguacuuaauaugaucaacaaaauguauucuucuuagauuggggauccagccauuguuuuaaauauuacgccaucaguuuugacuucaaugacaauuauauaaaauuuacuccaaugcagaaguucagacaaguggauugaacauauuuggagcccaggaugagguaugagaguugauuugaaauaaaauccuuucaauucuuaaaaaaaaauuuccauuugcuucuuuaccuucauaggcaaguacaguaaaaaaauucuccacucggauggcaaccugguagauuucacaccuuguacaacacaauaauugacccuugaacaauguauuuuuaccuccugugccucccuaaucaugcuagaaaauauuucugcagcuucaaggaauuguucaaaauuaagaaagaagugcagaugguuaauggguacaaaaaagauagaaagaaagaauaagaccuacuauuugauagcacaacaaguugauuauaguuaauaauaacuuaauugcacauuguaaaauaucuaaaaggguauaacugaauuguuuaucacucaaaggauaaauucuugaggggauggauaccccauucuccaugaugugacuauuucacauugcaucccuguaucaaaacaucucaugaaccccauaaauauagacaccuuuauauacccacaaaaaauaaaaauaaaaacaaaauuaggaaagagaaacaaaugaguagaggagggcaucaagggggccgugugagggcugcgggggaccaaaaggacagagagaacuugacagaagacagccaaaugcaacguuucauaugucgacaaaucugaagaugcauaucuaaacucaaagcaggugguucucacugauucagauacuuauguaaauagaucaaagcaaaaucagaauaaaauccuaugaagaguuaugguuugcucccgccuugcuccugucuccuuaauggcccaucauauugaagcaaggauacccucuugagccaucuacccaugauagucccuguggguaaacauuggcaauuaagaggugaagacaggaacucauucuccaauuuuauagagaaauaagauccugugcccaaaagaaaaugauaugcucagugaccagucgaaaccuguaguauccuuuguuccaaagacauaauaccuuguuguuccccguauucuauuaccaaucaauuuugguuugaauaacccagguaauuggaauaugcccauacaccaugcagaccaggucaaaaacucuuagacggagccuguugucucucaucccugaauaccaaaauagccacagucuuuugcugaguguucagcuuucagagacuucaaggucagccccuacacaggcuuccaugacaacauuaggauuuaaaaagagguagugauguuaaugaaacgauaucugaaaaggauaaaagucauguuuaaaucagagaaccacuaaacaaaauuccauuauagcuagaucuaaguggaucucauuauagcagucccaaagauaaauaacuaagugaagagccuaccuauuccugaauuagcuccagugaccacaaccacuuugccagugaaaucccggcccuggagaauuuccauggcaguggugcugccgucguaucuuugccgggugguuggcuuggucggauuaucauccacaguaaacgccagucuuggguccaaguaggugguucuuuuauuuauauggcugcccaaaagagaaagcagugaacccacagcaaugaacacaggcauuuauaaauauaagacaaucuuauacuuuaggaaaaccccauuuuucauagaccaaaaugcuuauuccuuaaaccugaaagaacuggggcccacugaaucuaucuucuggccuccagaaggaucacauuugugccaaaaaaagauagucaucgaauccuuuccuucagaacugccuauaacauacgcuguaacauacaauaacuauugccauguauccuuagaucucaaaaaaggcuucuugagaagguuuugggcuuuuauguaauucauguaaauguagcuauaagaucugucagccacucuuuucaguagauuucaauuaaaucucuuagcccugugcaagggccuaaagacguagagaaguagaaaacucaaaaugauaaagucuuaguuguaaauaagaaaccugccaacuaccaaaauucuaacgauuuucauuuuaagacucugcacucauaccuccuacgagcacucauuuugauuuggaauugaucuaaaucuuguagaaaugguauuaaaauauacuggaggcugggcacaguggcucacgccuguaaucucggcaauuugggaggccaaggcaagaggaccacuugagcccaggaguucaagaccagccugggcaacauaguuagaccucaucucuacaaacacuaaacaaaauuucaagugugauagcacacgccuguagucgcagcuacuugggaggcugagguaggaggaugaucacgugagccuaagagaucaaagcugcagugagccaugauugugccacugcacucuagccugggugacagaccaagacccuggguaaccauuaaaaaaaaaaaaaaaaaaaaggcacauauggaugaaaagaguacuccuuauaauagaauuuacuuuuuauaucuuaaauguauucuugggauaugagauaaagaccucagaauaucuuaaaaacuauuaagaagccucuaaauauagaugaaauuucauauuuuaaaaguauguguguguaaaauuaguuuaaaauauauacucaucucccuauaaguaccaagacucaagaguaauaauccaaccuuuauucuaauuauuaccauccucauccucauucuauuuauaacaaccuuaauuugugaccccaauauuauacacacacaacagagcaguucuaugcuagacuggcucaaacuggcuuacaagagccaaacgugacuaucucuucccaauuccucacuucaccuuggcagcaugaaaucagcuauggccaaaguauuuauacuguggaaacaaacaguggcuuuuuucccccugaagaccuggugcuaaacauuuaccagcaccccacugcaacaggcucagaaaagugagaacuagccaggggagccaauuuccagguuccccccaaagcccuugcuuacuccucuagauuagaccaggagcuggccaaaucuggcccacugccuguuucuguaaauaaaguuuuauuggaacacaacaacgcccaucacuuguauauuguguauagcugcuuuagcacuacaaaggcagaguugaaucauugcaacagaaaccauaugcccugcaaauccuaaaacauauuaucuagcccuuuacaggcaaaggagacagccccugcucuagacgggaggcucucaagcuagggaacaucaggauccccuggaugacuauuagagcgcagauugcaagccccaccccagugcugauucaguaggucuggggugggggccugggaauguacauuuuuauugaauucccaggugauauuaaugcugcugguccaggaaccaugccugagaacugcugcucuugguugauuaauacccauuucagggaguaacuuuccaagcgugaaugcaaaggcaaagacugcacaggagaaaauugauuugacuacauaaaaaauuuaagaaauucagucagguguggucgcucaugccuguaauaugaaugcuuugggaagucaaggcaggaggaucgcugaaggccagaaguucaagaccagccugggcaacauacugagccucagucucuacaaaaaaaaagucuuuaaaaauuagcugggcauggcagcaugagccuguagucccagcuccucagaaggcugaggcaggaggaucacuugaguccaggagguugaggcugcagcgagcugugacugugucacugcaccucagcccuggauaagaagagcaagacccaguauaaaaaaaaaaaaagaaagaaaacuuggaaaaaaaaaaaaaacauuuucaacauuuucaacauacaaccaaugcguugauacccuuaauuaguugaggaaaaaaaacuuucacaaguuaggcaaaaagccuuuuaacaaauaauaggcacucccaccuauccaacugcuagacagccccgucuuccuggggcugccuaugguggccugggagacuucucucaagcaagcuuuggccuauuugcucucaauaucaguuuugcaccaaaaguucaccagguuugcucaaaaaacacacaugucauuugaacuuguuacuguaacuacauuaccagcaagcuacuauuacacaaacugauaacaugggaggugaaaaauagugucagugguaucuaugaaaauguggucgaaugcuuuggagagccucaaagacaagcagcuaaaaaaaaaguuuugguucaaucaacuacagugaaaaugcuagaaaaauaccauaaaacucccaaaugauguagcaaucagauucuuugaaaauacuguguuugcucaaccuuaaaguuguaggguccagcccuacugggcuuagcggguguucuccccgugugcagagacgagggauuguaauaaauaaagacacaagacaaagagauaaggagaaaacagcugggcccagggugggggccacuaccaccaagauguggagaccgguaguggccccgaacggcugggcacgcugauauuuaucgcauacaagacaagggggcaggguaaggagggugaaucuucuaagugauugacaaggugaagcaagucacgugauuacaggauagagggcccuucccuuuuagguagccgaagcagagagagaaggcagcauacgucagcauuuucuuuucugcccuuaaaagaaagaucaaagacuuuaaaacuuucaccauuucuucuaccacuaucuacuacguacuucaaagaggaaccaggaguacgggaggagcaugaaagcggacaacguacgugaccauugaaacacagcaccacagggagggguuuaggccuccggaugacugugggcaggccuggauaauacccagccuuccacaagaagcugguggagcagaguguucccugacuccuccaaggaaaggagacucccuuucgcggucugcuaaguaacgggugucuucccagacacuggcguuaccgcuugaccaaggagcccucaagcagcccuuaugcgggugugacagaaggcucaccucuugccuucuaggucacuucucacaaugucccuuuagcaccugagccuauacaugccaguuauuccuagguuauguuaguaaugccacaaagaguaauauuaaaagcuaaugauuaauaguguuuauaguaaugauugauaauuguccaugaucaucuccauaucuaaccuguauuaugacuauucuuauucuaacuacuuucuuuauuauacugaaacaguuugugccuucagucucuugccucggcaccuagguacucuuucgcccacauaaaaugaaaguagaaauuguagauguuauguuacaggcaugcuuaggggaaggaagaccacacuggauccaugcaaguggacucacacucagaggagggcuggcccgaccccuaaauguugguguacuugaaucaaauacugaaacguuuauguuacauucauaacuuuaaaaaaaaaaaaaauuccugcucaaaucaacuucuauuaaccaaccaauccuaauccugucaaagacuauucaagcuucuaauuuaaauguugacaguugugaaacauuaauucuccucuuaacuacgguggucaagaguacagucccuggagcaggugcugggcucaaagccuggcugugcuacuucuuugcugugggauccuuaacaagucacuuacccccucaagucugugucacuggcaguaagcuagggauaauaacaauacuaccucucagggcacuguggggauccaaugaccuaaugcuacagauacaagaugauuagaaucaggccuggcucaugcuauauguuggacaggugguuacuauugcugcgugauaccggaauuuauccuaaagacagaaucagagaggugaaaaagucuuacagauaaggaugcucaauacauuauuuauaauuauagguucucuauaacaggaauuuagcauuaauguccaauaggcaauuugauaaauuauaguauaucuguacaaaauaauaacucuagagcugcuaaauagcaucuuuuugaaaaauagauauggauacaagaaaaugcucauaauauauuacauggaaaaagcagguuacuaaacaguccacacagugcauucccucuuuuuuuuuuuuuuuuuuuuuugagaaggagucucauucugucacccaggcuggagugcaguggcgcgaucucagcucacugcaacuuccgccuccuggguucaagugauucucccgccuuacccucccgaguagcagggaccacaggcacgugccaccacacccagcucauuuuuauauuuuuaguagagacggaguuucaccauguuggccagaauggucucgaucucuugaccucaggauccacccacuucgaccucccaaagugcugggauuacaggcaugagccaccaugccuggccucccuacuuuuuuuuuuuaaggaugcgugugcggggaaaauagaagaauaaaucuagcgauguuaaaaguuccagcgauguuaaaaguagucacuucugcuaagauuacagauacacacuguuauacuuuguauuuuucuacaguuacuauguauuacuuuuauaauuaaaaauuccuauuaaaaagcaaaacagcugagagugguuucuuugcagacacuuacucaacaaaaaacacuuguccguucucaucaguuucuuguucccauccguauggcaaaucugaaacacaagaaagacaggucuacaggugccagggagaaguaaagaccaucccugggucaggaagggaaggagcccucccagccccgcccccaagccugucccucccacccagcaguugucacaucaacuggcuuucgucacauguuccaacugcgacagcugcagaaggccccugaucccacccugggcuccacauuuuugccucuuguuuugaagaaaaccuauuuuauuccugaucgcucuauaaaccauacugguugugccaauccaugggaauucucccuugaaugagcucaaagaacauauguauaugcagggcaggcacccaacgucauucauacgcugaccucauaugacauuagagggcacggccauuuuuuuucaugugcacauguugauucuucagcuggauccuaaaccucuuaagggcaggaaccuucucauauuuuuuuuugagauggggucucacuauguugccuaggcucaccucgaauucccaggcacaagugauccucccaccucugccucccaaagggcugggaucacaagcacaagccaccgugccugucccuuucuuauacuucuauuccguggaucauacauuaucucagaaucaccuagaagucaugguaaucuuuacgaaauuuccaaauacuuauauauuuaauuccauaguauagccaagaacaauuuuauaaacacugcaacgauaggaaaacaucauaaacugugaaucaaaggccucaauuauuuucugguuuuuguuguuguuguugucgcuauuuuucagacagcaucucacucugucaccgaggcuggagcgcaguggugugaucuuggcucacugcaaccuccagcuccuggguuugagcacuucucgugccucagccuccaaaguagcuggaauuacaggcgcaugcaaccaugcccagcuaauuuuuguauuuuuagaagagaugcgcuuucaacauguuggccaggcuagucucaaacuccugaccucaggugauccauccgccucggccucccgaagugcugggauuacaggcaugagccaccacaucuggccauuuugguacuuuaagaccaguaagaaaucauccucacuccacccuaugaucucaucaucuucuucugccaaaucccauaagcuccucagagugggagucugguucucuaccagagagcccucccuaaacacacaauaaccugucaccucucugccagugacauuuccucaucuacuuaaugcuuccauccaagauccuuagacaacaacauacaaaccuccugccacucguuuucuuuuuccaguuuuuggauguucccacugagucuucuccucggugugacuguuaaaaaacaaaaaauccacaguaauaaguaaaaauuaacucuucuaaaaaguaaucaauuguauuaaauuuuuucucucccagauagccagauauaagaaggaaguagggggaagaaggagaaagaggacugugaccccagcuacggggucaacuuuaggagguuugcugaaucacucaaaauaucuagaggccgucgggagcgguggcucacaccuguaaucccagcacuuugggagcccuaggggagcagaucacaaggucaggagauggagaccauccuggccaacauggugaaacccugucucuaccaaaaauacaaaauuagcuggggacaguggcacgugccuguagucccagcuacucgggaggcugaggcaggagaaucgcuugagccagggaagcagaaguugcagugagccgagaucacgccgcugcacuccagccuggcgacagagcaagacucugucucaaaaauaaauaaauaaauaaauaaaucuagaggcauuuugcuguguauuuguuuugguuuuauuccacgauguagggacaaaauucauaauaucuaauuuauauaaucucuuaaaauguuuauuuauuuguguuucuuuuuaaagaaucagggucucacuauguugcccaggcuggacuggaacuccuggacucaaguaacccuccuauuucagccucuugaguggcugggacuagaagcccgugccaccuugcccagcuaaaauguuuauucuuuccacagauguaacuucaaaguguuucauuaagcacugguuccuaacuggucccaagagguaguuaagagaugcaguaagaccuucccauagggcaucuagcugugcgcugugcaccuuuggucaagugaccccacuccuuaaucuccauccccucaucugcaaaauggaaauaauccuagcacuggucucaggggcuacuauaagaauauuguacauccaggguuucgcauagcacuuggcauacaaaaagcucugagaaauguaagcuguuauucugaacaaaucaguuacacaaacuaguccuauuuuugcgucaaacuuaacauuucauuucagaccaccacccaaaguuauaauuaaaaacauaggucaauaacuagaaacacgugucaccagguaauaagguauccaggaaaacauacaauuauuucaaaagggaaacagccaggugcuacaagagguauucgaaggguaggcugcguuuccuaaaaguucaccuacucaugccaacccagaaaguuauauuauuuaaucagcaacaucuagaugauaagaugugaacauucuuucccuaucaauuauuuuacagaaaauaaauacagagagcacgaauuuucuaaaaaauucuacaacuugcaagcaaggucuuuucaugaacugcuggcuucuggucuguuugacaaagucuuggcagcugggucucugucauagugcaggaaugccucacucagcacgcugaagaccugagcagcccaugcuagcugaguccagccagucuccucagggcuacugccaccucacagagcugcugaaaaggcgagacacaugacaccugugacagugcuuggagaacgauuaaaaccuuguaccagcuacgguaucaguagcaaggacaaacuccuacuuuguacaucaaccaccauccaauaucacuugcaaaaaaaagcagcucuguggccgggcgcgguggcucaugucuguaaucccaguacuucaggagggcaaggcaggcggauuaccugaggucaggaguucgcgaccagccugaacaacauggagaaacccugucucuacuaaaaauacaaaauuagccuggcgugguggcacaugccuguaaucccagcuacucgggaagcugaggcaggagaauugcuucaacccggcaggcagaggcugcggugagcugagaucgugcacuccagccugggcaacaauugugaaacuccaucucaaaaaaaaaaaaaaaaaacaaaaaaaaaccguucugacucucuggcucucuaguaaggauaacccgcucucugcuggcacagugggaauauugguauaccaacuccugcuucuccuucaaaaugaauggcaacagcaaucagauaaaccaagcauuggcaauaacaugaaaccuuccagccccuugcagagcugugucucaagcuucuucaagaaaguuaagagauggacuugcauuuuccuugccugccauuaaaagcagucuuuaucucauaggcacacaucaaaugugcuugaagccuggcuccaaaaaacucugcccucaagaauccauggaguggcgggguacgguggcucacgccuguaaucccagcacuuugggaggccgaggcgggaggaucgcuagagcccaggagaucgagaccagccuaggcaacauggcaaaaccccaucucuacuaaaaauacaaaaauuagacagacaugguggcacaugccuguaaucccagcuacuugaguggcugaggcaugagaauuuccugaaccugggagguggagguugcagugagccaaaaucacgccacugcaguccagccugggcgaaaaagcaagacucaaccuaaaaauaaaaaauaaaaaaauccacaaaaugacccuuaacaguggaagcugagccuuguuggcaggcaggcuggcauagaaagagccucccagcccuuagaaggugaagcugggcccucagacauguagccucaugccuggcccacagcaggcgcacaaauguaaacaaacagaaugaauacuuuccaaaggaacuacaaaacucacucagaacaguuuuuauuuauucagaaagacauuuaaaaaacaaaacaaacucugucaaccuacguucuugacuuucacagaacaugccugaaucaggguuucuuauucucacugcugguggcacuuggggcuggaucauucuuuuuuuuuuuuuugagacagagucucacucugucacccaggcugcaguacaguggugcaaucucagcucacugcaaccucugccucccagguucaagcaauucucccgccucagccugaguagcuaggauuacaggcaccugccaccaugccgggauaauuuuuguauuuuuaguagagaugggguuucaccauguuggccaggcaggucucgaacuccugaccucaacugauccaccugccucggccucccaaagugcugggauuacaggcgugaaccacugcacccggccugcaucauucuuuguugcggggcugccuugggcaccacuggccucugcccaucagaugccaauaccccagucccauagcuguggcaacagaaagcaucuccagacauugccagccguccccugcaggacacaaccaucccuggggaagaauccggaaccagcugaagcagagagaguaauuuggucgugaagauucugaagcccaacugccaagguuuucugggucucccauuugccagccacucugcccuugaagaagucauuuaaucccaugccucaguuuccucaacaguuuagauggggacaauaacagcacuuacuucuugggguuauagagaaccgagugaguuaacacgggaagaacuaagaacuguaccuuucaauagaagacuuuuuuuuaauaaauauaaaaauuaauuaaaagauguucuuuuuaauuauaaccuuaaaugacuuuuuaaugaagagaaaauuagaacacauguccccuaagcauucuccuauucuccuuuaaauagaagccgucuuugauuuuuuauucuuucaacgagcuugucauuuaaaaagauaauuaagaguaaucuaaacuuaaaccaaaggauucaaauuuaagugaacaucauauuaugugaauaccacacuuccacguaugggguguuuucuguuaauuuuuuuuuagacaaggucucauucuguggcccaggcuagaguacagugaugcaaucauagcccacugcagccucgagcuccugggcucaggcgauccucccaccuuggccucccaccauggccagccuauggguguguguguguguguguaugugcgugcaugcgugcgugcgugcguguguuuuuugagcacaguguaaguuagcagggagaucuagaguugacagugaggacagccaguguguguguguguguguguguguguguguguguguguguuuugagcacaguguaaguuagcagggagaucuagacuucacggugaggacagccagcccuguggacacaggcaccauugaggccucugacugccaaaaggccugagcuucauaagaggcacggggaagggcaaacaaggacggcucugacacugagaccuugucccucacuucccaucucccaugaaggggcugcucugagacugugaggggagagggguagaagaaaggcccaccagcucucuuggguucccggucuaccucgaccucaccccugggagcccacccuggugggcuuuggagugcuaggacaugugugccuuugaggcacacaagugaaccgugaggcaggugggaaagcaggagaggccgacagcacccacacaagaccggguuccaccagaccccgaggucucagugggagcuacagccucuaucccuggccauggcccugcuacaguaggagaaacaauauggaaaagaaaugacucaaagagcagccuccuagaaagaacaaccacaaaguuucccaaaccccaagagaaaaacaagugucacuuccagagucaggaaugaaaagggguuggagccagcgcaaaaauuaaaacugaaaagaaaagaagggccaggaugcucacagaucaggagagaucaagggaaugucggguuaggauggaucagaggcauccuaagcuaacacccaaagaauuucagccuuucaacccugauccagagaacugagggccagcagggacggacacaagguccagagagugagcccuccagcugagagccagccaagcccuggcaucucagcugguguauacaauaaauagcuaaugcacggggggcugaacaacuaggugauggguugacaagugcagcaagucaccauggcacagguuuacuuauguaacaaaccugcacauccugcacauguaucccggaauuuaaaguuaaauuaaauuaaaaaaaaaaaaaaaaaaaaaacagcggagccagagaggccagcuugagauuuaagacacuagucgggagggcuggaggaaaggcguuuggaaaccauguaugcacccgaguccccuggccaggggccacucaggaagaaagcagaugggagaaaggccaggcagcaggaaggcaggcgcagggggcacgcaggagcaagggagccccagggcccuagcgccaggcuccagggcaagccugcagggaagcagaagcaccucuggggcugaguggcaaaggaggagacgccccacagagccagaggcagaggugggcuuaggaagccggaagcgggucaugugcaucuuuguacucuggggcccagugcaccacccacccacccacagaagccugcggcugacccucccaaggugauucauuuacucaucccacaggggcucaucuuauggcuucugggugccaagcacuggggacacucagaugaacaagcugccccaugacaucugcaaccugggcaagggagacagggccaacaaggaggaguacacagccaaggcuaagcacgaagaagcagagaaacaaggugacuaguacaaggucgaggggacacccacaguuaagaaggucucuugggcagugacauguaagcucagcucugaaggaugagaaggagccuuuccccaacagauguacaggugagaggaacagcaagugcccgcucaggagcuugccuccgucccugcaaaggcuacuggagcucugcugcuggaaaugucccuuuaauucuccagagccagaaauucuuccagaauucacaagcugaaugaaugccacucucuggcucugccaacagagcccaagcuucucggcaaggcacagaaauccuugaaauggguccucccuucccugccuuaaccuucacauuccuggacccucacaaagaucacaggccccuggacaggccaugcagggggucucuccucucacuguucccucuaccuagacugcccuccugccccacccaccucuacuugagcucaaaacaccgcucugggcuuggcacagugccucaggccugugauuccagugcuucgggagggaggcuggcuugaguucaggaguucaaaccagccugggcaacauggugagaccccauuucuacaaaacauguaauaauuagcuggguguggaggcacacaccuguggucccggguacucaacaggcugaugcgggaggaucgcuugagcccaggaagugaagguuacugugagggugccaccauauucccucacgacccccccaacuaccuacacacaccucaugccagacacacuacuuccugguauacacacugcguggggacgcuccuacacaugucacugugcccuaauaagauuggguccuaaggaugacaacuggcucuuauuugccucgguauaaccagugccagccaaaggccugucacauaauaccugugugugucuugaaugaacucaucagaacuugguuguuuuuccucuaccuugccaccaaaggcagcagugguucacauccuugcauagauuagaaucaccugggagggaagauuuuacaaccuaccaagggagaggggaggggccaaaccaauuaaaucagaaauucugggcugacgcaguggcuccugucuguaaugccaacacuuuggggggccgaggugggcggaucacuugaggccaggaguuggagaccagccgggccaacagcgcgaaauuagccaggccugguggcgggcgccuguaaucccagcuauucgggaggcugagacacgagaaucgcuugaacucggcaugcagagguugcagugaaccgagaucgcaccacggcacuccaguuugggcgacggagcgagacccugucuuuaaaaaaaaaaaaaaaaaggccgggagcgguagcucacgccuguaaucccagcacuuugagaggccgaggcgggaggaucacgaggucaggagaucgagaccauccuggcuaacacggugaaaccccgucucuacuaaaaacacaaaaacuuagccgggcgugguggcgggcgccuguagucccagcuacucgggaggcugaggcaggagaauggcgugaacccgggaggcggaggcugcagugagccgagaucgcgccgcugcacuccagccugggcgacagagcaagacuccgucucaaaagaaaaaaaaaaaagaaaaacccucuggaaguggggcccagaaaaaggcucuuacaaaaaaaguuucccagaugcugaaaaucagauuuacauccauguuucucaaaaccaggugauauuccaccucaccuggaaagcuuaaaaaaagagacucccaaaguugagagucggcuacaguagguucucuauggagacccaaaacguguauuuaggacauuuccuaggugauucuaaggugccgauauaagaggcacugucguaucuuaagagcaaucaaggaacgacaguuaaggaacagagaguaccuacuagacacggugcuaugugcuuuacgcacagugccugaacugacccucguaucaacccauuuuacaggugaaaaaaccaagauuaaacguuauuucaauggcccaaggucacacaguuaaagaugaaggcucugcugggguuuccaaaacuuucccaggaaaugauagugaagcuaucuaggacugcuacuaaaaaauacuccuggcuaggcgcaguggcucacgccuguaaucucaauucuggaggcugaggcagguggccugcuugagcccaguaguucgagaccagccugggcaacauggugcgacccuagucucuacaaauacuuaaaaaauuagucgggcauaguagugcacgcuuguagucccagccacucaagaggcugagaugagaggauugucugaacccaguagguagaggcuacagugggcuaugauggcaccccugcacuccagccuggaugacugagcaauaccggucuggacaaaacaaaacaaaacacaacaaaacuccuaucccugcaacccagagccugcaggagggagcugagcaugugcgcuuuuuaaaacaucuuuauuuuuuggcggggaugaggccgcuuugcccucgccgcgccgcgcagugcugcauccugaacagcagagggcgcgccgggaagccaccaggugacccccgcuggacccgaggcccaccaagggggccggccccuacugggaacccuggacccuuuucccugaagcuccuuaacaguuacuuucacuuugcaccgcacgcgcugcgcuggagugcgcguccuccccgcgcagguggcguccgugggcugugcagggucccaggugcguccgcggccccacugcggcccccuuacuuggcguaguaaacccagccguccuuggugguucucuccucccagcccggaggcagcucguccucacuguccgugucguccagccccgcguagcgcagcgcugccauggcugacuguggaggcaccuggccccccuaucgcccgcugccggguccacucgcucaggaacucacucccgcuccaaacgagacccgcgcgcgucgg

SEQ ID NO: 21452 - RNA, 9653 nt, Homo sapiens
cagaauugacaagagaaauuuauuacuaaaaauaaagcagcugaagguuuucccagggaaaaccaucaccacaggaccuuccaugaugaaauacguuaguaucuucuuuacuucugaauugcugccuucuuucauauacccaaaauuuuaguuuaaguuaaauuaaucacgacaaaaacgauguggcaucugaucccuucuuguucaaucugaagacugaauugggcuacccugugauggagacuucaagugcugcaggugaguaucuaccaaggguucaugugucagguacaugggcugguaagaagacacaaaggcugcaggcugaagcucugggagguccaaggauccuggagaaaacaauuccuuaaguuccacugcugcucgggagucugggcagacuguuuuggucagacauauacauguccuuucaaucaauuccuuaacacccuugcauuugucagcucaauuuugccuuuguuaagauaggacagauacuuuuacaaugaaaacugguugaaacauuaagugacuugccuaggguuauauaguauauuaggcaaagagugagaauuucaauuccauuuuuuaacccagaguuuucccuauaugaccccaaagccugaacccuugaucacucauuugugggaggaacucauggaacacaggcagggccaaggccuugacuugaccccacugacuucacuugaaauguuauucccugcacaguaaacuuuccccugguguucugcuccagucuugcuuagguuacagaaugagauaccuuaguuucugggguacccugccuuacuaugaucgcaggugcuccccaugacaucugugaguaaucuaggaagcuaugcaggccgcaggucccccucuaacucagcacuccgcaaggcugauucaaugaaagcuuuuaucacucaaugcauagauauuuaggguacucggcuaugugugaagaugggaagguagccuaaacacagucaauuuucaaaccagaaagguaaaguuaaagauaccuggcagaaggggaucauucugaucuucaucaaagaucugucucugaaaggcuucaaagcucauagcugcaucauucuccggcagccccucagguagcugcccaucuccagguuugcacacaucaaauuucacccacugguaacugcagaaucaagggaaaucacccuugagaguuaucugcuagacauaaauacccauuccuaucacuaaagggaucagguaauuuuucuuuauauuccgcccauauauaucuaaaacacauauuugcuaacaaaaaccuaaaagaaauaagcaggccucuuuagugacaaauuagucugcuagauuucccaccccuuuugcugucaugguacauacagaaaauaguaauaaucagcgaacaguggaguccuggcucuugcuuaccuguccagagggcuaagggggccaauacugagcccuacuggucgagaagcaggcaggcuuuggacacagaaggucagugaacaaaguaggaacugccagucccuggccggaugaucacugagcuuuucucaagggaaugaauuugaucacacuuacuugaugcauuuucgagcuccuggacagcucuggaucagguuguggauggcuggaugagaaaauccaaaaaagucagcuccagcuggaagcagguuaggcauuaguuucccccuaaacaggagagggauaauuuuaguuugagagcuuagcgggagaugaagauggauuuaagaacagaauagugguaugaacaaacaggauaagcuuucuugacuuugauaauguggaggcucuaguuggcacaaugucaggaggauccaggauagguuucuauaaaauaaaguaucuccacccauuaaaagcaagagaaaagguuucacuguaccaacagugaucuuuuagccuguuuucaagcuuuuggucaacuuacauaguagugcuuauaguccugagcaguucugcaugacaagcaucugcagaagagcugacaauggcauucugggggucaucuucaggaacaauuucaaacugagaaagacaaacgagcaaugagaucaauccucaagaaggaaggagagaggggcauacuacucuguaaauauuucuuuacucuggaacgugaagcugacguauaccaucuucagaagggacacacauacuuuccuauagggcugcuaaaaauugaaacaaauccaaguaccuagagaaaguccuuugacuguuucaguucuacccuucuugguugacagcuuuccaaaagugagcguuuaauuuguuguguaccuuuccaauccacuuauuuauauccuuaaguacaaauacaaaugguauuuuaaaaacaaaugagaucacucuccauguaaucuuuuaagucaauuuuacaagaucuaggagaaacaggcugacugcaaacugccauuucauuguauuuacuuucauuuugaacguuaaaauaucuugguuauguuaauaaaaagaaacuguugcaucgaaauuacacuaauucugaggaauuuuugccaagaaaauauuuuuguaacaaauguaacaaguuaacuagcugauuuaauuauuuggccaguuuucuauaaagcgcaaugauuuuuuugccaggaaaauauuucuguaacaaguucuaucuagccaauuaaauuauuugacuaguuuuaaaguucauuuaaacaguuucuaguucuucaauguuuacuucagucaaauuauccugaacaggauuaauuuauuuucuguauaauuuuuuagaaugauaucgagcacuacugauuucuaaaaaaagucaaagcaauuuuuacugaguauaguuuccacuacuguuaguuuucuucugugguuauuauuucacuggauucaauuuaccgugucaaauuuuagagaucugucaauuuugucaguaauaaauucucuugugagugguuucaaucaauggugguuuucuuauuucaaccaauggcauaccuugccagguuaagauucuaauguuuuauauuuauuucucagcuaauaaaugaaaaaaccaugagcaauuaauuucuuuucuuuuuucuuuuucuuuuuuuuuugagauggaaucuugcucugucgcccaggcuggagugcaguggcgugaucuuggcucacugcaagcuccgccucccggguucacgccauucuccugccucagccuccccagcagcugggacuacaggcgcacgccaccaggcccggcuaauuuugcuguguguaauuaauuucaaauaguccaggauugcucuacuauuuaguauuugucaugucaauuucaauuacuuuuuuuguacugaaauuuuuacccuauuugaguaaagagcauuaaagauagaaauguuauacuuuagucuugaagauaccuccuuguuaguacuaauguauaaaucuaccucauucuucuaauugcuguacauacaacgguggauauauuuuacuuaaccauuuucucauugauagguauuuaggcuauuucuaauuucuugcuauugcaaauacugccacagugaacauuguuacauguuacuuuguucacauuugcacauuucucuaggugcaaauguguaccuagugcagucuagauacuagacuaucuagacauauucugggucaaaugauacacauacuaaaauuguugauacugccaaguugcccucccagaagacuaccaauuuucacuccuacuaacguguacuuguuuuccuccaccccggccagcacuggauauuauuaaucccucugauaugugccuaugagcaaaauaagaucucaguuuuguuuuauuugcauuuccccacuuacugaugaggcccacacuuuaccaucugcacuguuucugugaaaugccuguggguuuuuuuuuuuuuuuuuuaauauugcuuuuuccuacucuacaggagcacuuuaucugguauuaauccuuugucauacguuuucuuccuguuuauugcuuguguuuuaacucugaucauggugucuuuugccauucagaagaguuuacauuuuuaauaguuaaauauguuauuauguuccauuauggcuucuaaguuucaugucuugcuaaagaaagccuuuucaucucacccuaagauuauaaaaaauucuuuuacauuuuccuuuaacauauuuauagaauaaaauauucaauaaagcuaaaguaauaaaaagucauauugacauguauagacaaaaagaugaauaaaaaggaaucaucuggaaagagauacaagaauuacauauauuuagucuguguguguguguguguguguguguguguguauauauauauauauauauauauauauauauauauauauauauauauauauaaaacagcuacuugacguuaguuggaacaaaauuugaagcuagauuccuagcucacacaccuaaaaauaauguccaguuagguuaaugaccuaaaaaagaaaauuaaaaacuccacagauucuucuuuuucaaaaauguucuagcauuuuguuuuucagagaaaauuaagaaucggcuuuucaauuucuacuaggauuuugauuagauuugcauugcauuuaaagauguauuauaaauaugguauaccguuacaauaaugagucuuucuaaagaaacuauugcauaauugaggucacguaagcucucaacuaugccuaacaaugcucugauaggcgugaugcaauauuaucuauaagaagucaagcugucucaggguucucccagcuucugcucaaagguuccuuaccuugccucuacuuccuucuaccuuacuuucuagugaucuguaacuuccucagugaagcuuagaacuccgaaaauggucuauuuuuuuguuuuucccuaacaaucaggagaugaugguuggggaaaauguacugucucaaaucuuagcacugagaaggaugaaaaaagguauuuaguaagacuaggauuuaagacucucagguccuuaagaguauuugcagccagaaacuaauaugcaauuucuuugcuaacuccaucuugguccaacuugaaauggcaguguaucaaacuaaucuucccucuauuuuggccuguaccucacauaaguaggcuugaucaagccucacauagucacaaagucagcaguugaaguagcaugguucaagagaaaagagcaucaguuugagaaugagacagauaauagauucacauccaaacucaaccacuuauuagcagaggugugacuuagggccagccacuuuucugcaucuugggauuacccaaauggugauuauacauaucuaccuuguaagguaucagaacagguaauacauauccuagcacagagaagguucuaaagacaaacagugguuauuauuagaggggguaccugaggcugcacaccaccauccuugaucugacagguauauagacacuucuggucugggcacuucaugcuggcauauauucgaguacugcaauagcccacgggguagauggcacucucaucaugaaagccaggucggucggugaugaucuauaaaaaacauucccccaaccugggauugaggucacugaagaauuuagaaguccaguuuccugugguagccuuuagaaccacuuuggggcugcaaagagugacaaaucacacaaagacagagaguaggcuguguagcagacaacacugaccugguuuugcagggacuggagauacgcugggguugguauggaucagcaagaggcugcugcuaaugggaacagggagggaaggcucaaccccauucccguauuucccugauucuccucucuauauaucgcuggucucacucaccucccccaggcuauauacuguuagacccccuaguccgauggggaacacaggccguccugagggauccagggcaaugggcugaaccagcuugcgagcaccucccgccauuuucuuuuucuugcauguuuucuucagaacugaaacgcaaaucuggggucacccacuuuaggccccuuccaauguugaagggaagggauaaauuugcacgugaauggugagggcaauaagccaauccugguuuuauauacuuacugaaugggcauauggggcuuucgcccaaagcccugaguagcuuucuaaccugcccagauuagugcuuaggagccaaaggccuuauacuuuuuaaggccucuuauuucaucuguaagaucagaaauuuaccaagccagcagugugcuccaaaggccaccuagcccauuucccugccucuaggaaagacuaaauggaaugcaacccagagaguugggggaagggggaagucucagucugcuccccuugcauuuaacgaagucuagcucgaauuucuccacccaaaguggcucuaauacauuugacauuuguuuucucaagggcuccuagggcuccuuaagaaccagaugagacucuaaguacaucugcagcugugugugucugucaguuaguaccaggucuaacugucauuaguaggugagucacuggggcaacugauaucaucuccccaaaguaccuuccaguuuguuguucucuuugccuuuuucuuuuuucuccuucuuaguuuucuucccaaaugguuccucagccccagugcugggcccugaaauaggcccagcucccuguauaguucccacagagcuggccacaccauaagucaggggcaaacuggaacugugggaaggagcugcagccuguacuuccccuucaguuagagccugaagcuggaggagcuucuuuagcaaguaccugagaucaggaaggaaaggagcagagaaaugaacuuccguauugucucaauucaguauuuuacucaaguacugggaaaagccagaauuauauacaaagauuacuauacucauaaaagaaagguucuuauuaggcccuaugaaucauaaagcccuggaggauaaucaauacuucaagaggccaaggauaagaacuguagcuuaucucuugcaucuggacgguuccucuaccuugauguuggacgguguuaggcuucugaaaggcacauuauuuacacauguauauauacccauugugcuuugcacagaauaguacguacagaauaaauauuuguagaacgagaggcaguugcuuuuaucacuuggcuuuuauaauugggccauaagauuaaauaaucuuaguaagauuauuuauuagauguggcaagauggcuuuuucagaaagaugaguagaggagcugucucaucgccauggcccaacauaacuugggugugcaggcaccaaugccucaggcuguaaguuucucugugcuugaucaaguggccaaggggcugugcgauacgcaucaaucccacugggaaaaaaagucuccagagcaguaacaccauuaucaaucaccaaaucaaucaccaaaaaggugaugcugaacacaaaaugaagccagcucaccuucuuucuucuuuugcuuuaagaaauuuuuccucaagacgagcaauuucaucacaaauagcagcauuuuccuuuaaguaaaaaugugaauauaauaacauaaaaugaauaaaaaaaucacauuauuaugcugggaagaggauccauauuucaaaccaaaaaagcuuguauuacugagaagaaggagcuauucgaccgugugacaaacuauaaauaaauccauagauaaagguagucagguucuacuauggacaggguauagcuauguaauuuauuauccaauccgggacaucuuugagugaaaaggggguacuauuaaugcuuaugccagaacaauacggugaaccaggacuguccugggcaagccaagauuaauggucacccuaauuaguauagccuuuggcaaagaaaaaggcauacugcuuaaauccuuauaugcuuaaauuaaauacuauaaauaugaaaacugucuauucccaagugccucaacucuugaaaaacuuacaaagccagucuaacccaaauagagaaaaacuggacagaacaaaaucaaauuuaguguguaaaauucuuaaacuucacaaucuacuuauacgaauucaaguauuaucuuuuuucuuuuuuuuuuuuuuuuuuuuguaaaugaugacucaaucuaucucccaagcaccaauccugaagggaaugcugaaucugaaugcccccauagguggaacuucaaacucucaauguucaaaacaacaucgcuuuuucuucacaaaaucuucauuauguauuugauggaaccaauauccuugaaauaacauaaauuccaagcuuuagguaccuuugacguauaggggauaaaagaaagggaacagucaaucagaugcuaaguucucuuaguuuuacuuuucuuguuucucuccagugcaaauagcaagcaauacacauagcaagugcugaauaagugcuuuuggaauguguauucuaauuucugaaccuuuccuuaugcuuccaaaaaugcugagagacguucaagcuuuugguagagagaagagaugaacuguugacuuggauguggggggacauuugaggacuccaccccuauuuccaagcacugaggcaagccaaacuauucuaauauaaaguuauggcuggcaagcuauauuaaguuuauucacucaauaaauccagugcuucuacaauaaaagaaaggaagaaacacuuggaacacucaaagguuagaggggggaaauuacugacaguuucauguaccucuuugggcaaagggucaguuauggggauuugaggugcucagaaaauagucuguguacuggaagucauaaaacggaaucagguuuaucuaaguuggagucagggcucugacacaguacccuugggcaaaucaucucucugggcuucaguguucucauuuuacaaauaaugccuaauucucagggcuguaucucgagaaucaaacacauuuccuagaguccugcaguaacaacgaugacuaaaauuuauugguaugucuuuuacgcaccaagcacuuuucuuuacucauuuaauauucauuauucugcaagacaguuacuagcucauuuacagaugaggacacagagaaauuacguaauuuguccaaggacacaaggcuaacaaguaguaacguauacggaaaagccaacacuguauuaauacugucacacugggaagggggaacagcuuggggaaagauuuugugagggagucuccaggaggggaccggcugaacgugggucagacucacaaacaccguggccuuggccgcuuugcgcagccgcagguacuucagccgguacuucucauucuggcucuucuucgggagcuuuuucauccuggccuugcuggacugcagcggagcccgcggcgaggaagcgaggccguccagcaggcucaugguccagccccgcuacgggggccccaggacgcugccggcaucggauccuaagucggggagcgggcgggagcgcuggcuuugucuguuccgggcuagcggaaucgggccucuaggaaucuagcucuccgggacguucccagggcugaccgcagggccagagacacccgcaaccgaacgggcucccggcgccucccagcacuuccgugucugucuuggaaguaagcccuucccggaaguuacgucccggugucggcaguguguaacuuccggggcagggagaguaggguggucugg

SEQ ID NO: 21453 - RNA, 152331 nt, Homo sapiens
cgggcccgggacauggaaucgcgcgagcccggcgcgggacggccggagacgcggccaacgcugcggccacgagcagccggcagccccagauagagagccgggagggagggccccggcccuugccgcggcggggaguucgaggccccgagacuccggaggaggagccgacacccguccgugagcugaucccgccccagccccggcgggagucccggguccccuucccacugcgcgcggauuucccucucugaggaaguuuauccuugugccuucuggaggauuucucucuagcucgacucacucuggacugacucgcucccuggcuuucucaguucguuuugggagauaacuuguuuugcuccaagccgcauccguugaccccuuacagucggauggucuagaugacugaauggaguuuugaguuggacuuuugugucccugacggaguugggccugaucccagagcacuggggguggggaggagguguuacuguaaaaugcaaguuggauaaaaggaggaccucucgccaagggccccaaugaguggcacacagucuacuaucaccgacagguugguaugaauuccuccuucguucggccucccggaaucgggcccgaccuagcaggggagucggugauugcagauugccuuuggccagcgaaguugacaggcagaggaaagaggguuguuucggagcugugcaguuagccugggguugcugccgaguuauccaguugauuggcuuuuggaaauguaauuuuuccggagagaaacuucccuuccgauucucagagaagggggaggcaaaaccaugauugugguuuuccgccuguagugugcauuaggauuguguacucgucuggaaaucagaggagaaggucauuuuaggugaaggucggugccugaagucggcucgguauugguguauuauuuaucagcuuuagccguguccugcaguagauucucaagacaauuacauuuuaggaauuucuaccugugaacuuaauguugagccuacugcauggugaucugggaacuugaucucuuucagauguugaccugcacgguguuuaauuauuaucuaauaacuuuccagaauguugacauuaccaguaaaucacagguucuugcuggaagcaauguccaggagcugaagaaaugaggguaaaucaugggguuugcuuuuaauucuuguauuuaaauauuucgucuuccagaaacacuuggcguuuaagagauauaagccguaagcauaguguaagcgcgcagcugaauuuguugaguucugugucuguccuuuauagcaccuaccaguguugcauggugguggguggcgaauugagcuagaccaugugugguugaagugcaguuugcuuauccuaaguuacucuuguuuauaggguaagggauaaaaagcauauugauuccuugaccacauuucauucucaauuuaauuaugacacugcaugcuagucccaaauuugucagcuugcuuuauuuuuaagucagucuucgaauuauuacaccgugaaaaaauagaucaaguaacugaauuagagggccaaagcucuuugaugaaaagugcaacaauagugcuucugcacaaaguagucuuaauuuccuaauaagaguuuuacccaauuguaagacucauuuguugauuuuaaaagggccaaauuccauuaucauaccauaacagcuacuccagaaacagaacuuccucuuccuguugaugcuuuccagcaucacaugaauguucacuuaaaagagucuguuaaauauuuaaaguauuuauauuuacucuuuguguauuuuucaaaguggguuuucauuuucaaugaaauaauuuuuaacuuuuccaagaauacacuuaagauaaguauugacaaugcuuaucuuacuuucuucugguuauccccauuuuuuuccuuucaggguguuuugcuucugagaaaucacuuuuacggguguggggauaauuguuuuccugcuucauucaauucucgcucuuucuguugagccuguaaacaaaagucuugcuaggaacuaauguaauguugguuuucauugcgaugcugagguguuuaauuuauggaaacagaacggacucauuccacacacaagugagugaaaagcccucaaguaaugguuuuucuucagcauugcuucucagggauuuuccuugucuucucguuaucuuggaaauagaaucuuggaauuuguauccucuuuauaacguagauggcauauaaacauucaauaaauaugaaauuacugaaagccuguuucuuuucuuuuucuuuuuuuuuuuuuuuuuuggccaggcacugugcaggcacaagagauuacaaaaugaauauuguaagauuaaucugcaaauugguuugggcauuaauguuuuuugaacugguucaggugcugcugccuaauuuuacauuuuuuuuuuuuaaagaaaagaccuuggaaagccaauuaauaagcacugcugagaccuguuucguaggauuuuuuuuuacuagggucuuuuuuuauuaagaauuauucuuauuugaccacauuuaaauauauuuuguaaauauaaagcauccauuugcuguuaagagaguaguuguuccuaauaugaauauauguuggggugaaaucuggagguacugguuuaguauuauuucucugccaaggugucuuaacaaaguuacgaguauauaauaguuucuagcuuucugucagcccuaccucauccuuuuuucguagugucuaacucuuacuguagguauauuuugcugacucuagaacuguuggaaaauuaacagcaccaguguagcuuuuuagauagagauccuuucaaguuugaagugcuguaugugguauggcuuuguuucguagagugugcagaaccaccaggccagcugugugaguuagaguucuuucauuguggugcuucugacuacagagucugucuguccucaguugaaaucagacuagcugguuuugggcguuguucuguuuugcaguuuguggcaggcgacacauggcugaacaagauaaggguuuuauucuuguguuagggacgugcuggggcugggauggaauucagcuauguuuaggcucugauuggucacuuuggauacucagaacucuguuacauccuguuauuauuuugcaguuaaaucaacacauuaacuugcucucuucucuuucccuucaucuuuuacuccccaguccgcaccccuuaaaaccuaaaacucaaacuuuuuaaaagacuuuaaacucaaacuauguucaugguagcuauuacuucuauguaguauauccaaacagcuuuaaaaaaaaugguaagcaauuuaugagcccuggagucuguaguuuucaucguuuagaaugagcacuugacaaguguagaaaugucugauugcugcuuuuuagucugcauugauugcugcauucagucuuaaaauacauccuaaucguuuccaauccuccuacaugucuuucuuguaucccugagaauuuagggguccuauagcaauuggaauuucuucugagagguagacaggagagaaugcccuuuuaguagacucaguaaaugauuucaggccagugucuauaacauugaauuuucagggacaguacagguaggaaaguuauaggguucuuccuugaaauaaauggacuuuuguuuuggcuagggcuuaugaauuuuguaguuuuugauuuauagauaaagacagguuuuugauacaauuuuuuuaaagcacugaauucagcuuugagcuguuuaacuuaagcagauuuuuaaagugaguguggaaaccugugacuuuauaugccuguacccaguaauuaaugauacuuuucauuagugauacuuuuucugucaaaauugcuguauaaugguuuugauuaaaaaaaaaagagcuacucauguuuauauguuauuuucaacguugcaugagucaucucucggcaaggugaaauuauuuguaaccuuuucuuguaaagucagccaguccauaaauacaaaauugaaaugggggccaaagaucacaguguuaguuuuguauucaguuuuaucuuugccuuuuuaguucaguauaaaaucuugagucauaaagguaugcaauaguacauucacuuguacaguuuuacaugagucaacaugcagaaucuaaaguaacuuuuuuugaaaguacaguguuguagucuuccugauuaaugguacauuuauaugauguucauauucaguaaggugacaagagaagcuuuauuugaaaucauuacaaaaauauguuaaccuuggaauaccacuuaacacauuggugguuuccgguuguuaacauguauauaccaucgaguuaacauguagguuuuuuucuuuuuugagucuugcucugucacccacgguggagugcaguggcgugauccccucacugcaaccuccgccucccagguucaagcgguucuccugccucagccuccugaguagcugggauuacaggcacccaccaccacgccuggcuaauuuuuguauuuuuaguagagacgggguuucaccauauuggccaggcuggucuugaacuccugaccuuaggugauccacccgucucggccucccaaagugccgggauuacaggcuugagccaccgagcccagugguuuuuuuuguuguugcuguuguuguuuuuuaacuaaguuugaguuuucaguuuaaaaaaugaaauuugaggcaaacauucauggaauccauaaauggugaauuuuacauauguuucuguggagcauugcgauuccagggaaaacaguuggaaaauauuucauuguacauaugugguugccucuucuaaaugucauccagugguggguaugaauugcuucccaaacugauacgggucacagaaacagcaagauaacauacugguucccagagguaauugaagggacucuuuugcaucaugguugucugacauuauuagaaauguuucuuauauacuugcuuguuuccuagaaauugaccaugacacauuuucaagaauaguagcuuaacuucuuuuggucuuuucuguuaaaacuugguuuugaugauguuccugagcuuuauuugaagacaugcuccuuucccuuauaauaauuacagguuuucaaaauagugccaugugaguuaaaauuuuuaaaucaacaaaauuauauuuuugccuucuuuugaguaaaauaccaucauguagguaaugauauccugugguaguauaauucuuuaacauuuacaauauuuucaguucaguacagggcagaucaugcuucugucauuuacacuuuaagcuaauucauacaguuuaagucaagauuuuaagucaagauuauaaaacuagaaagggcagacccaagauuuuaaccuagauuuucuggcucucaagucccccauuguuuuuuuucauuuuaaauuauugucuuucuuuguacuguauuuuucugugcuauuuuccuuuaguaacucuccagcuugaugaagucaguuggauuuuucucuuacagcauaguuucuaguaccuuacccauucuaauuuuaaauaucucuugaggauaaagcuuuugucacuuccucaggagacugaagcacagucugauagaucuugcugucaggaaguuuuuccugaucuuuacgucuaacuuuucuuuuaaguuguccuguuacuuguauguacuugcuguaccaggcuaaauaaugcucuccucccauuuuauguuuguaugauucuaaauguuucagacgguuauucauuauccuuuccgguccccuucccuuacucuuugcuuagccaagcuguaugcuuucuguugauccauugucuaaaaaucagcuuaucuuaauauuucauuagcuuuuucucaguugcucuccuacugcaaaaauauggguaaagagauucucaaggucauuuugauucacuuuuauuuuagauagucuuuaggauggauaugagauaugucacagucaaaugaaacaaauuuauacaaacagcaugauuaccaaaucaacuaauuaagcaauuacucauguucuaaaaggcuuuuuuacaaagcgauucuuucaaauaugaguacccucaauguaacaaauguuaucaauucuaugacaaaaggguaggguauagaaauaauguuagccaccuuugauggaaaaucaucuuguugcaauaugaugaaauacaucaggaaguuguuucuuauuuuuuccagugguuuuucaguucguuaucuuaaauuguaggucaaaacauuccucgauguuugguuuauuuuuaccuuauuguuuugucuccucuuauuuccacauguuagugaaauaacaaugcuuagcaguauuuuuuuuuucaguaaaauggauauugugaaaauugaaauauuuuacuuucuugcuguuguauuuacaagaauuguuaaugacaagacaguguaacagaaaaagugcauauuuagauuauuauaaaaucuguaagacuguagaccuuuugaauacuuuauuagcauauuuucuuuaguacuauuuuaguuucaaauuauugagauagauguccuuguuuuguauuuugcuaauauuaauauuuuguauuuugguaauacuaaaauuugcaaacaugccaaauuuagagcauuuuacuuuuucaacuuagaauaucuggaaucaucaagauagucauauagggaagaccgcuauaagacagcuucuaacuccaauagaagccuaugaagcuagugccuggucagaggcugugccuaaauugcaugaguauauagugucgacuuuuaguaaaagaaaaaauacacuaacuuuaccucuugaauuagcaugcaccaaugcaguuuagauucauaccgaaacaggaucuuuuacuaauucaaaugcugaguccugguuuuugagaucacagucacaugacaggccuggguggcuucucagugucuagagacaagcaaaucuacuggccaaugaaaaguagguuuccugucuuggacugcaaguaacaauucaugcagaaauuggaacuauauaagagagccugguuuuaguuaaugcuuucaauuagcugcuugucacacugcuuuuucuuuugguguuauauaacacauuagagucauuuaaagguacacucugauacuacaguuuuugucaaauauuacauauaaauguugauuuuacauucauauacucaaaagaucaaagaggacuuuguagaucuuuuauggauucaaaaaaauguagauuauuuuguuguagaaaaacuggccaggcgcgguggcucaugccuguaaaucccagcacuuuggaaggcugaggugggcggaucacuugaggucaagaguucaagacuagccuggucagcauggugaaacccugucucuauuaaaaauacaaaaaugagccggaccagguggcacaugccuguaaucccagcuacucgggaggcuaagacaggagaaucacuugaacccgggaggcggagguugcaguuagccaagauugcaccacugcacuccuaccuggaugacagagcaagacuccgucucaaaaaaaaaaaaaaaaaaaaaaaaaaaaacuggagacuucaucagccucugaaggaaugauaccugaaauugaucuuguaaugcagaaaguggcuauauguuauccagaagaguaacagauaccccaaauacacuugcuaacacaagaaauccugugaaggugcuuagacauacccuuccauagauuuuagauggguuaucugccuauguuccagacacaagccgauauguugugguuugcccaguacagucucugugguuuacugagaggaagugguucuugugggugaaggucugaucuuuucagagauuguugguggcauaugcacugucagccuauuuccuguuuuauuggcuguuuagcaagaccuucuuagggcaagugcugcugaagagguauuuaaauauuuuguauuggcaggauagaugguuauaaugauguauuauuauaucacuacuucucaggugauaugagaguuaaaugaauguuugugaagugcuuugagaucuuaggaugaaaaguacagacauguucuuagucauuugcagguuacugcuauguucagauauugcucucuugaaguuaaaacuuguucauguaguaaaguguuacucuauuaaacuugauuucuguaaccauucaaguguuguuuuaucaccacaagagucaugauuagaauuuuuccccuuuuuuuccuuucuuucaaugcuccuuuaugauuuuacccuagaagaguuuccuuaauagauuccuugcucuaguacugguuaaggcauauuuaccaaacuuaacaccuagcaagcuuguccaaccugccuuauuuugcuguuguucuucuguuuuguuuuguuuuaggcuuucagcagccugaagccaugguuuuuaguuucugucucuagugauaaaacggaaagagggaugaggaaggggcuuuacuggcccauccagaaacagaaacuaagaacccaugacuguauucucucccuugaacaacuguaacuagagcaaaccucuuugccaauuuaacuggcauacuaaaauaaugaaauugugagaauuuccuuugagauuaguaacuguaccauccauauacaaaacacuauauugcuuugcugaaaccugaaagugagcaaacugauagaaaugcauauaacaggccgggcguaguggcucacgccuguaaucccagcacuuugggagaccgaggugggcgguucaggaggucaggagaucaagaccauucuggcuaacacggugaaaccccgucucugcuaaaaauagaaaaaauuagccgagugugguggcgggugccuguagucccagcugcuggggaggcugaggcaggagaauggcaugaacccaggagguggagcuugcagugagccgagaucgcgccacugcacuccagccugggcacagagcgagacuccgucucaaaaaaaaaaaaaaaaaaaacgaaauggcguaugucauacuccuaaauauauauauauauacaguauuuagccuuggacguuaaaaaaauuaacaaugaaugggggaaggcuuuauuuaaagcuaaauuguuagcuaauacgugaguucuucaaggguauaagaauaguucuuauucauuuuuaaguaauuaucgguagccuuauuauauuuuuauuuuuuaauacugaaaagcagaaggaagaaaaauaaauggcccaaaugauccaacuacccagauguugcugcucagguuaaacgcacacacgcauacacacacagaaaauucaaaucauauaaaaugguauaaaaaaaaguauuccuacacaccuguuaguuuucauaccuucuccucauagguaacaauaguuaauuuuuuugguuuaucuucugaaacauuuaaaaauauauaccagccuauaauuuuauuuuuugcaccuacuccauaauaaguguaucugucuucuuuugcuagguuaugcugcuguagcaacacuaucaaauuucaguggcuuacaacacugcuuuucuucuugcuuaugcuacaccuugucagcuguggauugacugcagcauugcuucacguuucuuauuuuggaacccuggcucaaggagcauccccugucugggcugugccauuauuguggaugagggagagagcaagaaaacagaugcagacauacaauggcucuuaaagcuuucacucagucauguuguaugucacaucagcucacaugucaguggccaaagcaagucauauggucagagcucacugucagugggguaaggauguauaguccuuccacagguggcauugcaaguugcaugauaacagauaaggcuguauaauccucuuaaggaaaguggagguuaaauaauuuggaacaauaaauaauauagucuacaucaacaaguucaguaaaugcuuguuaaauggguuauuuggagucuaugaaaguuucuuuuuuuuuagugggaaauucaaacauaaacagaaguacagagaaugguaugaugaaccucccuuguucccuuuauuacuccagcaguuaauguacggacaaucuugguuuaucuguuuucuuuccccccuucucacuagauuauuuugaagcaguuuuuggauaucauaauuucacuuacaaguauuucacuaaguauuuuuaagagauaaagucugaacgugugacuucucauaguaaauuauuacugucugauagggugagguaauaguacuauauagacugacaggugucaagcagcagagcacguucauagagcguaucuagaauuugacagccugaacuuguuuugauuucauuuugaguauuucuggaggaggcuuacaacagaaugccaucuacuuuuccagccucucccuuucuuucuuucuuuccuuccuuccuuccuuccuuccuuccuuccuuccuuccuuccuuccuuccuuucuuucuuucuuucuuucucuuucuuuuucuuucuuucuuucucucugucucucucuguuucucucucucucucucucucugucuguguguguguguguguguguguguguguguguguguagcagaagcagguaauuaaccucuggaaaaaauaacauugcaacagauuugauuugcagagguuucauuucucacugagccucuguuggaaugaugccaguugaaaggaaucccagcucuuaauggcuccaagucuucugggagcucucagugauguuauuuucuuuggagaagaacaucagaaucauuuauaaaaauccuguguucacccaugccauuugcucuguggagaaaggaucuaucauaucuuuaagaugaucucuaagaugauauaaaaguaaagaaauucaucuaucuaauuuuaguuuagaaaucauuaaugccaauuucagcugcucagguuaguuugucuugaaggccugaaagccuccauuuugauucaagaugucguagauuuuaugagcauucaguauaaccaguaaguuugucauuuccaugguuguagggaauaugagacauucuguuauggaucuaggauuaccguuucacaggacauucuuuuuuuggggggauuguuagguaauaaacagugggacacaaaauaaacagauauaaucucuucaguuuguagauuuucaggugacaaugagguggcagaagaggauuugugcagauuaggaaauaaauaauuauuguauauaacaugauggaaauauuuuaguauaguaccacuaucaaauuaauuuuguuuccuuaacuagcuucuuucauuguguacagagacacuuauauuaaaguagucuuuauagauauccaguuagcuuuaguuuuuucuaauuacauuauauugcuagucucauuucagaguccauguaggaacuacaguagaaaaguagcuaucauuggcuuguaaauaaaauuacuuaauuuugaguuuuucuugggaaggaaaaaccaguuuuacagaauuaguggaguugauucugguuuugguuacuugugacaauauagucuauuuaaaauauaaauaaauaaaaauuugcccaagaagaauaaguuugacuugccaugauucauacuguuuuucuguuguuguaucacaauugagaacauuaguuucagagguaauaguuugucaguaugggucgaguagcucuaauccaaaaauccaaaaucagaaaugcuucaaaaucugaaacuuuuugggugccaugugccacagguggaaaauucuacacguaaguacauaauacaaacuuuguuucaugcacaaaauuauuuacaguaguguauaaaauuaccguuaggcgggggccaggcaugguggcucaagccuguaaucccagcacuuugggaagucgaggcaggcggaucaccugagguugggaguuugagaccagccugaacaacauggagaaaccccaucucuacuaaaaauacaaaauuagcugggcaugguggcacaugccuguaauuccagcuacucgggaggcugaggcaggagaaucgcuugaaccagggagguggagguucaagcgagccaagaucaugccacugcacuccagccuggaaaacaagagcaaaacaccgucucaaaaaaaauaauaauaaaaaauuaccuucaggcugugcauauagaguguacgugaaacauuaaugaauucuguguuuagacuugggucccauucccaagauaucuuacuauguauauguaaauguuccaaaacacaaaaaaauucaaaaugaaacacuucuggccccaagcauuuuggguaagggauacccaauguguaccuuuguuaggauaauauacuuguaccuugguuguauuuuaguugcaauuguuaguugcacaauuugggggaauguuugaggucucuauaguaguuacuguauuuaccaggaagcccugcaugauuagaauucuugagacaguguauaaaguuaaauuggguguguugccuggaugugaacaguaaaaaaggagaagcuucucaccauacaauuauagcuuaaaaggaaccagguacaauucuguuuccaaaaauagaaaguaagucaaauauuauauggauauguaauaguaauuauauuaauuuugacucccuggccgacuuuuuuuuugaagcuaucauuuuuugucagagauaaaaaguagcuuuuaaaggaaaagauaucucagcccuuaauuauguguguguguauguguguguauguauuuauuuauauauuuuagcccuuguaagagaggagcaguggaagggaacugaaggagcaugauauagagaaaagagccuggguuuugguguguugcauuuguucuguuacuagcugggagaccuugggcaaauuuaccucucugaucagcaguuuaauuuuuucaucuguaaaaaugggaagaauaccuacuuugcagaauugucgugacgauuaaaugagagugugugugaguaccuagcacaucguaagagagagcucaguaaguuauaguagcuguuauuguuuaaacuucaggaauuagcuagguuuugcuagaacuuucaucugugcuuguaagaucuuuuugaauccauauguauuuuuagcagcuguggcuaagauaguuuuuuucccuugcugugauaauauuccuuaucuuuuauauuucaggcuauuguuagaauuaaaugcguuugcgagugaggaauagauuuaagaguuauuucaauucagaccguggaacaucucuucacaaaauggguuaguuuggauuggcaguauacuuuuaaaucugccuucgaucacucagaauuuguccaguucuguauuuauuaacaucaguuuguuuauuuauucaguaaauauugaaugccuguucuguguaggucauugucuuggcaguuauuuugagcucuugcuaccugcugaauuauaucuuaaaaugaagaaauuuacaugauagagugauauuuauucaucugugcugaagauuaaagugagaaguauguggcaggcgcgguggcucacgcuuguaaucccagcacuuugggaggccgaggugggcggaucaugaggucaggagaucgagaccauccuggcuaacacggugaaaccccauuucuacuaaaaauacgaaaaauuagccgaguaugguggugggcaccuguagucccagcugcuggggaggcugaggcaggagaauggcuugaaccugggaggcagugcuugcagugagcugagaucacgccacugcacuccagccugggugacagagcaagacuccgucucaaaaaaaaaaaaaaagugagaaguauguguauuugggggaaguuguagaaugaaauaauaaugauuaaauugaucuuauuuccaaauuuuaaaaaugugguuacuuucuaucacauacugucuuuuuauguuuuccuuuuuauuuuauuuuucaguuuaguuauauuucagugaacuauuuagaccaaaauggaaaagacauugguguaaguuggaaucuaagaaguuuuagauguucauugcuuuugaacagaggaaguaacauuuuauggauugggcauuguuuuagucacuacuugaaggagaaccucuuacucauuaucagucucuuggaaauagcaacugauuaagccuauauauacuuugugcauccagugaaaaugugauaaauaugaugaucuuuuggucagagaaggauucuggaaacugcaguaguuugauuaguaagacaguguuuaaaucaugauuacuuguugcucuaauauuuuagacuuugaaagaugacaagaugugauguaggugacaaagagcauuuuuaaaaaugggugaaauuggccgggugcggugacucacgccuauaaucccagcacuuugggaggcugaggcgggcggaucacaaggucaggaaaucgagaccauucuggcuaacacggugaaaccccgucucuacuaaaaauacaaaaaaaauuaccugggugugguagcaggcgccuguagucccagcuacucgggagacugaggagaauggcaugaacccgggaggcggagcuugcagugagccgagaucacccuacugcagccugggcaacagagcaagacuccgucucaaaaaaaaaaaaaaaaaaaaaaaggugaaauuuaggccuaucaagauacuugggauguaggaaaggaauauauauauauauauauauauauauauauauauauauauauauauauuuuuuuuuuuuuuuuuuuuuuuuuugagacaaagucucgcucuguugcccaggcuggaggcuggagugcaguggcauggucuuggcucacuugaaccuccaccucccugguucaagaaauucuccugccucagccuccugauuagcugggauuauaggcacccgccaccacgcccgucuaauuuuuguauuuuuaguagagacgggguuucaccauguuggccaggcuggucucgaacuccugaccucagaugaucugcccgccucggccucccaaaauacugggauuccaggcaugagccacugcgcccggccggauguuacauuuauugaguacauauuaaguacugcucacuguuuuagguacuuccugugcauugucuuuuuuaaccuuucaacuaagcuaaauacuguugucccuguuuuaaaacugggaaaaaugagccucugagagguucacuaauacccaagcugacauaguuucuaaacagaagacuugggauuauuacuccgaugcucgcuuuuuugaaacuacuggucacagucguuugugguuauuggcucaucuagaucaaucaauuggaugaaacccagaaaauagauuuugucuucaacaauaccauuaaagaguugccuucacauuaaaauuuaauaacuacaucuuauccuuuguacucuuaaucaccuguuuucccuauuuucuuuuccagauuucugacaugagggauuuugucucauuugcucuaaagagugaaccuaaacauuguguuuagguuuguuauuaguugcuuuaaauauauacacaucuguaaacauugaacuuuuuugaugccucaucuguguugcuuauagaucauuuuccaucauaauuauuuuaaaguccuuuuaagaaguuuaaggccuaucucauauauguaauauauuaauaguagauaaucaggccuuuggaagcauaaaugauguaaguaaguuggguugcaguuuuuucuuaucaagaaucugcguguguuuaaguggcaguggagauaauauuuuuauuugcguuguuauaguguuaucuuuaucauuuaguuuauauuuucugccauuuaaagauaaaaagguuuuaucuuuuauagcuauagagucaucuucugagccuuaaaacacuuguguuuuuuuucuuuucgccguguggguggggaaagggguguguggcaauggcccugugcuuugccucugccugaguuacaggcgugcuuuguuugccuggcugggguuugugucucccaugcucaggaggguggaaccaguuucccagggccugggcccuaccuauugucauucuccccauaaggggaucuguuacguguacuugugggaccacacagugcucugggcagauaagccucuuccugccuauaucagaaccaacauagcccacacacaucugggaaagcaugccagggucagcaccccaggcgcccuguacucccagcccauuccccuucuucuucccacucaccuggaaucccugacccaaggcucuaccuauugguucuaauauucugguggacagaaucuaagaguccagcaagcucagaaucucaggaccuccucaucccuuuaggaaccaucaauuaaucucaugauuucagguugaaccacuggagucaauuucagaaguuuuggucuaucucagaaccuucagaucacacucaaaagcuuggggacagccucagaaccuugggacacaucucagcauacagggucaucaaucuuagaacuugaggucugucucagaaccuucaugcgaaacucagaaucuugggaagucccaggaccuugugcccgguauuauaccauuggaucaauuaucacagucgcagaaucuugagguccaucuuggaauggugcagucagccugaaccgugggaucaaguucagggacaugagaacaaucucagaaacuucuggccaguccuaggucugaaaaccuucaaaacagcaacagacucuugcgguccaucucaaaacuugagauuguggucuaaaagggacccucaagacuauccauccagucccuuccuggaauacaagucaccuccacagccucccugaucucgcugucuagucuuugcuaugagcccuccucgauagggauaccuggccccuacccacugccugccuugcuucuggauggcuccagcuacuaaaugaugucuccaaaaugugagaaucugaaaucugucuccuuuuucccacaucagcccucugagaccucugcagagauuucaaggcaagacccauaugcucaggguaagcuuugucccagacugcccacacuggguuccuccccugacuuccagaucuccacccgcccuucugaacacuguuaucugcaacacaguuaccuguuuaugcauuucaauuuugagccuauaggauaucucauacugcaaaggaaaagcccauugggaaugucugggguggagguggaugcccaacccugugcugggugaugcugggggaaucacagcaggauacagagccccagaaccccauggggucccagaggaggagcccagaggaggaagcgggaccauaccuggaggggcugccucugaucuccucagagacuaggggugcagugggaggagaagauaggagaugccuagagacccuggccccacagagaugccugugagaagagggaagauuccuguuucacuauucucaagagcugggagaggcuucugagagagaaccuguaaucccagucggcccaauuacagauaggaaagauaaggcucaaagagggcucaguccuaccccagagugguugggugagucaggacuaacaaguccucuuucccauuccccugacaucauaacucuccccaccaugauguuauguugcugcauuucagucuucucacuggccaucuucucacauuccagcuugacacuaacuaggaaggagagagaccaugggggucccacacaccccauaugagccaaagugaaaaacauuguuacuuuuaaucucauuucuucuuuguaaaugauuuuuugucucugaaauucugugacaugaaucaguuuagucacuuuuuaucuuauuaaauggagagaaaaauugcuuaagagauauuuagguguguuguuuuuuaacccuuuuugguuguaaauuguuuucuuucuuuguuuuaguaaccccagaaaaucuagaagaaaaucuagaagagagguaggcagaucauugguuuaaaaaaagaagcccaccaacuaaaucuuuuauugaguaaaguauuguuucuagguagagaaagauuagagaauuguauugagaauuuuacuagguuugggauuuacaaagaggcuaacaugcaaaaggcagugcucuucgaaggagucguauagauguggagacuuuauagcccuuagggagaucuacagacauccgcuaugcugaguucugggaagcugcuuuuucccaugcuugcagccuccccgugggguaaaggucuguuaguuuugcauaaauauuuaccauaucucauuuuagcuagcauugcuuccucacacuguuagcacuaaggagaacuuugcuuauccagcuugaaaaauuuacugugaucgauaugacuaaucuggaggauguucugucaucuuugagcauugaugaaguuaaaaagucagauuggcaaaaauaaugagggggaaagcaaccgguucacaguugacaaacauuugcccaugcuuguuuucccauauuuauuuuuuuaaacgagaagguuauuacacaagcagcauuucagucuugucacacccaauaaauuauuguugcuuuuauauguuuauuuguauacuagucguuuacauuugcauuuacuauacuuuuacaacuguuuccuuauuuuguaaccaugaacaccagcuucuacauguaaagccucauucuagguacuuuauauacaucauauuuaauagauauaauaauuguacaaggcaaauguuauucccauuuuacagaugagaaaaaaacuuagauucaaagacauugauugacuagaucaguauuucccagcuauaaauuuuuuuggaaccagguuuuaaauucaagucuuuuagcggggcacaguaccuguaguccuaguuacuuaggaggcugaggugggaggauugcuugagcccaggagcuccaggcugcagugagcuaugauugugucagucuacuucagcaugggcuacagagugagacucugucucuuuaaaaauaaaaaauaaaaaaacccagaucuuuuugacucuugauucauuacauuugcuacuguacccaauuuuauguuacuccaaaugaaaauauucagccaaagaagguuauuuaaucuauuuuaagauaaauuacaggaguaauuucuaaguuguguuacagggaauauccaggacacuuuaauaggaguguauuuuuuugacucaugagcccuacaacauucaggcauucaaggccaaagguagaauguaaaaugauauuaaaaggcaaccuucagacuuugaguuuauuauuuuaaaaaagauccagcuuauuauggaaaaauggccuaauccauuuuauuagucaaaaacaauccaacauuugcaauuucaugugauucaggcuaggagcaaucuaucaguaugacugcgucuuaaaucuugucaauauuugauaggauucuacuuuaaaauuuuuguguuuuugugucucuuaccuucuacuucuccuucacuccaugucuuuuuuaaaauuuuuuauguuuuugagaccgagucuugcucugucucccaggcuggagugccguggcaugaucuuggcucacugcaaucucugccuccuggguucaagcgauucuuguggcugagccacccagguggcuaggauuacaggugugcgccaccacaccuggcuaauuuuuuuuuaaguagagaugggguuucaccauguuugcccagcuagucuugaacucuuggccucaagugaucugccugccucagccucccaaaagagcuaggauuacaggccugagccacugcgcccagccuccccuuaucuuuuugcauguacacuuugucuuuauugucaucacuaagcuuuuaaucuuuccuuuguuaccccaucuagguccucugcucucccucaaccuuuuacuuauuucugguugagcccuuuugucauucccugcaauuuucugaccauguaguagauacccaguaggcuuccuggauuacuugguuuuucuguauuuugcuaaaaaguuacuccaaagaugauaccuucuauuuggaccuuucccacccuuuauauaccuaucuaggagguaguaacccaaccauuaaucucuccaugcaaaauacauguauugacuaaaaauuaugugcuagguacuguaauguuuccuacccauuauuuuacuuaauucucacaauuacucugugagguauucacaggugaagaaagagaaaguuuaaguagcaugccuagugagugguaaaacuuggauuuuaguaugaaucugucugacuucccaaccugcacuguuuuuuuuuuuguuuuguuuuguuuuuuuugagacagucacccucuguugcccaggcuggagugcaguggcgugaucucagcucacugcaaccucagccuccugaguagcugggacugcaggcaugugccaccgugcccuucuaauuuuuguauuuuuaguagagacgggguuucaccauguuggccguggcugguuuugaauuccugaccucaagugauccgccugccucaaccucccaaaguacugggauuacaggugugagccaccaugccuggccccagccugcaugcacucuuaaacacuauccuauacugccagauauggucagaguugaaucagauacuguuucugccuuuuaggaacuucgagucuaauagaggaagauagagaacuaagugcacagggcacaguggagacugaaaggagaaaaaucauuacuuuuuggacagaucacagacagcuucauagaggagaugaauauauuugcugaauccuggaaugugggauguaguuacuggacagguaagggauagaggaacaauucagguaaaagaaacaaucagguuuuuuugagacagagucucacuccaucacccaggcuggauugcaguggcaugaucuugccucauugcaaccuccaccuccuggguucaagggauucuugugccucggccucccaaaauacuggaauuacaagcacgugccaccgcagcuggcuaauuucuguauuuuuaguagagacaagguuuugcuguguuggccaggcuguccuugaacuccugaccucaagugauccgcccaccucagccucccaaagugcugggauuacaggcguaagccaccgugccaccaaaauaaggaauauuaauaaggacauagaggugaaauagcucacauuuucaggaacugcauauaguucagcauggcuagagcauggagguugaugauggaugggcacagcaguugguaaaguuggagugauaggugguaccagauuauggaaggccuuuuaagucauucuaaggaguuuggauuuuaaccucuggauuguagggagccacugaaggccuucagucagagaggcaguaagcguuauguuauaaaagauucuuucggugguagcgugaagaaaggauuagucuugagcaacaguuucaggggcagagaaaccaauagugagacauuuuucaguaauccauaugaaaaaugauacuaauaaauuccuaaacugaaguuguaacauauacuuaaaagcgaagagacaaaguuauuaagaagauacuaagaauaccagcagggugaaagguguguggucaaaguguggggcuuucuggguuguguccuuggguagggguugguaauacuuagcaagauagggaauguaaaagggagaaggcaggguuuuguuuuguuauuuuuguuuggcugacugauaagauggaagauggagaagagaacagacauaguaagggauagauuuaguuuaaguuacuaaaucuuuaguuuaaguauucacuaucuguuguaugauagauuaucccaaaacaauaaacuugcacuauccacuaugguaaccacaagacaaauguggcuauuuacauuuaaauuaauugaaauuaaauaaaauugaaaauucaguuccucagugacacuagccacauuucaaauauucacuagccacaugaagccaguggcuacaguacuguugguugaucauagaacguuuuaaauuauugcaaaaagcucuuuuggacagugcugccaaacauuuaucaacgcauaguuuacuaagaucagaaaucggugagcaacuuugcugggugguucugcuucaagguuucucaugagguugcaguccaggugucugcaacuagaagcaagggcuucaggaaucugaaggcucaacugcaccugguggguccauuuccaaggugacuuacucaugcuggucaagugagugcugauuguugguaggaagcccuagcuccucuguugguagguggacuucucuguggggaugugugaggcagcuggcuuugcccugagugagugauuuuagccagagagggagguagaagccauuauaacuuuugugagcugaccucaaaagucacacuacaucauuucuauaaucuguugguuacacaggucagcacuauucacugugggaagaaacuauacaagggcaugaauaccaagagucaauggggcccauuuuguuuuuuugagauaggaucucacuguguugcucaggcuggggugcaguggugugaucauggcucacugcagccugaaucucccagccuaaagcagucucucaucucagccucccaaguagcugggacuacaggcaugccaccaugcucagcuaauuguauuuuauuuuuauuuauuuauuuauuuuugguagagauaggguuuugccauguugccuaggcuggccucaaauuccucggcacaagugaucugcccaccuuggccucccaaagugcugggauuacaggcauaagccaaagugcccagccuauugguggucauuuuggaggcuucccaccacaaauacuuacggaauaucuggguacaaauaucuaguggacaacuaaauguauaggaaugaguucuuagcuagugcuauuauauuugugaugguaguugaagaaacuugaauagguguagaucaacaaggaugagauugaaccagaaagacaguuaauauaguaucuugggucacauguuuggggaggacagaaguacuuucaaaggcuggaggaacagcuacaggggaguaguaguagaacaggcaggggaguacauuauaaaggaaacuugaagggaugaaaguugaaaguagaauguaauuaacauuguucaguaguuaaauaagaguaaaacuuaacagagucauucuuucaaaaaauauuucuugaauaccuguguggggaaccagagaaagauugguagauaaauaagaccaagucucuaauaacacguaauacuaucugaggagacaaguuugggaagguuucuuggaggaagguaauauuuuaagguagagacucuuuaaaggguaaggaggugaguuggguauuuuagggguguggugguagagauauggauacuaaaguggacauuucaggcuauguuagauguggaacacugcuaggauaugaaguuuugugaugagggaaaguggugagaaaagaggcuggaaggccaauuagaguagucuugaauacaugcauguuaaggaacuugccuuuauccugcugacuguuucccauacuuaaauuuggauacuacuuuagugauuugccauaggcuuauaaccccuaaacuguaaguuacuaaacauuuuucuuuaauauuacucuuuauuauuuuauuuauuuauuuugagacaaggucucacucugucacucaggcuggagugcagugaugcggucauggcucgcugcagccuugaccucccaggcucuagugauccucccaccucagccucccaaguagcugggaccauaagugcauaccaccacauuggauaauuuuuguauuuuuuguagagaugagguuucaccauguugccccaggcuggucuugaacuccuaggcucaagcgauccgccuaccucggcuucccaaagugcugggaauucaggcgugagccaccaugccuggccaguaauauuacuuuuuaaacuuagaaaccauuuccagagggaacuucauuguauuguuauaaauagaaaaccaguauuguuugcuacauauaaaagagaauagaaaaaauaugaaugauuauuacguuaaaaaaauuaaaaguggaauguagcaaugcauccuuugauauagaaaaaugcccacuuggaaauaaguuccucagugagaauacuauuuuuggucaguuagcaauaaaagggccuuugcuugaauaguguuugguuucuaccuaagaugagauuuuaaggucauuaagacaauuccauuuuuaaauuuugauguuaauaagcaccaagaaucacaacucucaagucugcguacuuggaaagaucauaauacaguuaauggucaacuuuguccaacuuuauuguuaauucaagcacuaauaaaaauuaagcccuuuuguuccaagaagccaucuaaaguaguuuauagcagggguccccaaccccugggccagggcugcacagcaggaggugagcugccagggcgaaagagcauuacugccugagcuccaccuccugucagauugcuggggacgcauuagauucucauaggagugcgaacccuguugugaacugcacaugugagggaucuaggcugcacacuccuuaagagaaucuaaugcccgaugaucugagguggaacaguuucauacugaaaccguacguacacucaaauccccaucuguggaaaaauugucuuccacuaaauccgucccuggugccaaaaagguuggggucugcucaucuauagaaucuauucuucugagugugucaaguuauuuauuggacaucuggaaauggagaagggauuuuuuuugucuacucuuugcugccauccaguuugggaaaauucucgcaaaaauuuucaaaaauuucaagcaucuuuuacaauuuucgaaauauuuccagugaguuuuucagaggaauccuuaacugguccuuucagagaggaaaaaaguauccagcucaccuacauaucucauaguucuaguuucacauuuaucuuguucacuuuguuuuguacguggaauacguaaacuugucaggauaaauuuagguuguucacauaaguagauauauuugucaagauaugcuuauuugcagagccugucucaggcaugcacaugaucucacaaacugaagauuucuuccagaaauauuugaaauuuuuccugcagcucaaaaggaugcaugaagaguuuuccacucuuuuugccaaacucuauauguagccccaauuuugaaguuacuuuuauaagguuuuaaauaaaugguuuugaacuguaaugacuaacaaaaggcaugugaaugauagugcuagagaugcugccaccaaaguaccaagaaagaauaucaugcuugaugauaaaauaaaagcuuuggagugucucaaauuggcugaauacauuuaaugagcuauuagaggaaacaugguaaagauggauggucauuuagaaauucuaaaguccuguaauguugaggaagcuaaacauuaucaaaucuuggaagaaguaaucaauauaggaagaagaaggaggagaagcaauacuuuggauacuaagcaauaguuucaauacuaaguugaaauuacuuagcuaaccucaauuuaauggacucacuacauuuccucugcagaacaugacuuuuacccagugaguuaaaugcuugugucucauggcuauuuuguagugugucugaaugcuucuacuucguccaguugaauuguauaaucucaacccguuguacuugaauuggaauuagaugauuuaguuaaauauuaugaaaacugaaaacugaugaaaucugagcaccaaaaagaaaguuauuucuauaaacagugaguugugugugcuuuggaaauaagaguagagacuugucacugaaaaaaaauucugucaaauuagacguguauacaaaacaauuauuauuuggaaaguaucuucuagauuauuaugaaugucuuucguuucuugcuccacucuaaggaaacaggaaauaaaucauagcugauauauuuuaggacaguuuauaccagaaagcugaugggacacuccaaucaacagaccccuacuuaaagaaacagccaggcgcaguggcucaugccuguaaucccagcaguuugggaggccgaggcgggcggaucaugaggucaggagaucgagaccauccugacuaacacagugaaaccccaucucuacuaaaaauaaaaaaaauuagccgggcgugguggcaggcgccuguagucccagcuacuugggaggcugaggcaggagaauggcgugaacucgggaggcagagcuugcagugagcugagaucgcaccacugcacuccagccuuggcaacagagcgagacuccgucucaaaaaauaaaaaaagaaaaaaggaaaaggcuuugauccuacauuuuaaaauuggcaaaugaauguacauuuacauaaguugaaauaaaguuuaagguuuguaugaaugguuuuuaauuauuuccugcuuuaacuauucuuuuccauuaaaugaccaaccacugguaccaguggauuggauaagacaguuggcacugcguggauaaaggagguuuaaagaaaaggaaacaugaaaugccuucuuuuugaggcugcuacaauaaccaaguuacaagugugcugauuaauuuauuauuccuguuuccagaaaugucuuauuuguauuucauuuuuaauauuuuuaaauuuaauaguuuacauuucccccacuaguguugccuucuauuuguagcaaguuaauacugguuuucuauuuauaauagugagauaaaguuuccuuuggaaaggaauguuaccuuuaaagaaaaacauuaggugacuaauaauuuggugcuuaugugacuguggcaaaucaugaagauaguauuuuaaguauggaaaacaauugcuaaccagcaagauaaugucaaguuccuuaauaugaacucacuucuuggccuuugucuaccuucuccagcuucaugucuuaccacuuucccuuauuauggacuucauguugaucaaguggaggcucccucuccucaaggagagucccuaggccagauucagaagaugguugguagagaggggauuugauagcuucugaggacagugcuuuggauggagaaauaucaugcaacuuaggacagugcuuuggauggaggaauaucauggaacuuuaguuuuccagcuuuauugagcuuugccugugauauucacuuguuuggggggcuguuuggagacagggucucacuacauuguccagacacaaucaccauguacugcagccuugaaguccugggcuuaagugauccucccauuucagccucccaacuagcuggaacuacaggcucgagccacugugccugacucuuacucacuuuuuuguucccaauaccuggaagaagaucgucagucuguaaauauuugaaaucuaaauaaggguuauggugcuguaguauaaggccaaaucuugggcaccaaacaaaaaaaaauuuagaaaaaucccuuagcccaucccaugcugugcugggagcuucaucuuucuuuuuaauugcaauuuaaacgaucuacugcuacaagaggguugugguaaagcagaauuucuuauacugugcaggugggcauguaaauugguuuaaacuuacagaaaauaauuugacaauauaguucaaaagccuaagaaauguuuaaacuuuuugaauuaguaaugccaauuuugguauauaucucaagacauuaaggauauacaguuuuagcugucauuuuauacaaagagaucacccacaccauuauuuuaguaggggcaaagaggaaccaauguaagucuggugccucugaagagguagaccuagaaacugggaugacaaggaacucccaggggacugcuguuaauaaauuacuuuaugucauuugauaaaauauauguaagcauuaaagacauuuucaaguaaaccuuagugaggaaauuguucaugaucugugaaaaguaugggauaaaacuucaaauauaaugccaguuacauuuuuaaaaaacauucaugugaugcuuuuaaaaagacuucuaggacauguaccaauuuuuuuuuuuuuuuuuuuugagccaagucccacuuugucgccuaggcuugagugcagugggcacaaucacagcucacuguagccucagccucucaaguagcugauacuacaggcacacaccaccaugcucagcuaauuuuuuaauuuuguguagagacaagcucucacuauguugcccaggcuggucucgaacuucuggacucaagugauucucccacauuggccucccgaaauggugggauuauaggcacgagccacugaaccuggcauguacuacuuuuuaaguguuucuggguugugagauuauagaugaauuuuguuuuauucuucacacucauauguuguuuucuaggcuuuuaacuauguguauauauauauauugccuuugucaugagagacacuuuuguuuuuaagugaaaccucuguuuaguuuuuauuuauuuauuugaucuuuauuuuaauggaaagguaacugugcugguaagcugauagaugauuggaaggaauaauucuugagacuaggaaugcaaaugaaagacugcugggagauaugagaagcuccugaacuagggcaguggugauaggauuggagaggaauaucgugaucaguaagacauaggaauaaaggaaaaagagggauccaggaugacucccaaguuucuggguguuuaaauguaauacauuugagaugaaaguuuggcucuuaaaaaauauucuuauuuggggaauguuuaaauuuagugaggucauuaacaacuucagauuccuuuuauacuucaauucuuuaaauucuauauguugccaaagauccuacuucuaauuuguuaggguuaacaagaagaaagaugauaugucugugaagacauguuucugacaucugucacccuauggauugccaguugauagaccugguugucuugauaaguauuagcugacuccccaaccaguuuauuugcaccacuucugaagcaauaagcuugguugaaaaagggcaccucccaaguagggaaggauaauuuuuaggucaaauuauagaaauugcauguaucccuguuaacacuuccaacaccaacaaaaaaauagacaggaaaaugacccuaccagcuaauucuccauuauaagacuuugaagaaaagguuccauuaaaaacagaaaagaggcugggcaugguggcucauaccuguaaucuuaacacuuuggaaggccaaggugggagaauugccugaguucaggaguuugacaccagccugggcaacauaacaagacccugucucuacaguaaguaaaaaauuacuggaugugguggcauaugccuguggggccagcuguuugggaggcugagguggaaggauugcuugagcccaggaguaucaggcugcaguaagccaugauugugcuauugcacuccagcuuggugacagagugagacccugucucaaaaaaauaaaaccuugaggacccaaauuugauuuaaauuuagauguacuaucugcuuugggagaguuacuuuauuauuauuuaguagagacagggucucacuauguugcccaggcuggucuccaacuucuggccccaagcaguccucccaccuugggcucccaaagugcugggguuacaggcgugagccaccaacccugcccuuaaguuauuuuuuugaucuuuucaugacaugcugugggcaauaaaauaauacagugggugaucuguuguugcaauucaaauauggaguuccuuuuucuuccacaaaaguauuggcugauuucuuucuuuuucuggcugugagcaacagguaaauuaacaugaccauggucuguccccagcgucuugacucagauuucuuaauuugaacuuuuccaucuucuccacuccaagaucacaugacaacauccaacaucaguggauagaaauaauuagaggcuggaugagguggcucacgccuguaaucucagcacuuugagaggccgaggugggcggaucauuugaggucuggaguucaagaccagccuggcuaacauggcgaaaccccaucucuaccaaaaauauaaaaaauuagcugggcgugguggcacacgccugcaaucccagcuacuugggaggcugaggcaggagaauugcuugaaccugagaggcggagguugcagugagccgagauugugucacugcacuccagccugggugacagagugagacuccaucuaaaaaaaaaaaagaaauuuaauaagucacugcuacacuggcaaagaaggguugaguaguuuuaagaagcuuaguugcuguccaacagucuuauugcaucugauucuuuuggugcuugcuuacucaaguagggaucacauagcaugggaaggaaagagcagaucugugauucuguuguuuacaucucagaauugugguuugugaauaguuuugaaauuuuucuuauaguuuugggagaaauuuguuaacggaauuuuuaaggauuauaggacagcacaaaauaauuucucuuguuuagaugcuuuuaauaauaaaaaaaaucuguuaggauacuuuuuccuuuuuuuuuuuuuuuuuuuuuuuuuuuuuugagguggagucucgcucugucgcccaggcuggaguacaguggugugaucuuggcucacugcaaccuccgccuccuggguucaagcgauucuccugccuuagccuucugaguagcugggauuacaggcgcaugccaccauguccggcuaauuuuuguauuuuuaguagagaugggguuucaccauguuggucaggcuggucucaaacuccugaccucaugaucugcccaccuuggccucccaaagugcugggauuacaggcgugagccaccacgcccagccuagaauacuguuuaaaugauaaaauagcugagugcagugguucaugccuguaaucccaacacuuugggaggcugaggcaggaggauugcuuaaggucagguguuugagacuagcccuggcaacguagugagacccugucucuacaaaguaauuucaaaauuggcugagagugguggcacacaccuguaguuccagcuguuugagaggcugaguugggaggauugcuugagccugggagguugaggagguugaagcugcagugagcugugaucgugccacugcaccccagccugggugacagagcaagaccucgucucaaaaauaaauaaauaaaagauaaaauaagaccgaaagauuucauuaugggauagagaagaaaacuaauauggaauuuaagauaauauucuuauauuugaguggccucuuuuuuugagacagggucucacucuuauugcuuuggcugggccacagcggcaugaucuuggcucacugcagccuggaccuccugggcucaagcaauccucccgccucauuguccauacugucuagcuaucuccaugauaacaacaucaucuuauaucaugacuacugacuaaaauccuuaguagcugggacuacaggcacaugcuacaaugucuggcuaauuuuuuaauucguuuauagagaugggggucucccuauguugccgaggcuggucucaaacuccaggccucaagagauccucccaccuuggccucccaaagugcugggauuacagacgugagccaccaugccugaccugaguagccuuuuuauuuaaagggaaucggcauuuguuuauuaccugguauguucugaguaucaggcuguguacuuaaccucacuuaauccugacagcauuccuauaaagcagauaccuaacaauuauuugugaggaaauuaagguucagugacuuuccauaaauuugcuuauggucacacaauccauugagugcuugugccagguuuuaaucucagucugaccaauaccaaaacucauuuuuucuauguauguuucccuuuuagaaagauuuuauuuuuuuaauuuuaauuuuaauuuuuuaacuuuuagguucgggguacaugugcagguuuguuauaucaguaaacucuugucauggggguuuguuguacagauuauuuugucacccaguuacuaagccuaguacccaaaaguuauuuuuucugcccccucccuccuuucacccuccacccucaaauaggccccagugucuauuguucccuagaaagauuucauaaguaaaugucaucuagccuguaaauuauuuuuguuugccagcauuuauaauauagguggucauucuuuaggugcugaaacagaauugguuuuguccuuagugucuggcugucuccaaugauaacaacaucgucuuuuaucaugacugcugacuaaaguacuauauucucaaaucuucuuuucuucuuuuuuuuuuuuuuuuuuucugugacagggucuuacucugucccccagucuggagugcaguggcaugaucucagcucacuguagccucugccuccaggguucaaguaauucucccaccucagccucccgaguagcugggacuacaggcgcacacccgcacaacuggcuaauuuuuauauguuuaguagagacgggguuucaccauguuggccaggcuggucuugaacuccugaccucaaguaaucugccugccuuggccucccaaagugcugggauuacaggcaugagccaucccacucggccagaucuuuuguuuuuaauugaaaacuuauaauacauuucagagauaaaggagagcuauuucagaacuggugcuuauugguaaguuuuaaagaguuaaagucagugaacuggugguauaagccauuuaaucauuauguuuaucauuuuauagauacuaaucggaguaaugcaguuucaacaaaaguaguuuauuuugggguauacaagaauuuuuauucuuuaagcuaauuaauucuaaauuuaaaagaaggaaaacaccugagaagcuugcgcucuuaguguuacuacacagaagucucaauguagcugcaacaucugauuuuaaaauuuucuuuuuucgucuuauacuuggaauauuucacaauaaaguaaaaagaaaaugauauacauccauguaccugcuacuuaguguuaucuuuuugggggacgaggcaagcaaauaaaaauuagagaugaagucgaggcuccccuggguauuuucccccgauccuguucucuucugccccuuuccagaaguaaacaucauaguaaacuugguguuuguugcuccuaugcauguuuuuauacuuuggcuauauguuauguaucuucaaacauuauggaaauuuuugcagauuuuuaaacuuccuaacauuugaauucauguucuauauucagcaauguguuuauuaacaaaauaucaauaaaaauuacuaauuauaacuguuacuauuaauaaugaauauuaauaaaauauuaugaauaugauaugagguagggauugaguuuuauucuuucauguggagaaucagucgucuagccccauucacugugcagucugucuuuucccuacugauggguagcacuauccuugucauacauaauguuuccauuauuuguagguuuguuucugagcuuucuaaucuuuucccuugguuugacuauuucuguaccgacaccaaacuguucagauuacuuuagcuucauaagcaaaguaaaucuccuuaccuuguuuuucuucuucaaaauuuucaucgcuauucuuagcuuuuucuuuuuccauaugaauuuugggaucagcuugucagguucccuuaaaaguuuuauuuuuuuuuaacauuguaauugcauugaauauuuaguuuaguuuggagaaaauaggcauauuuaugauauugucuuccuauacaugaacgugguuuuuccuuagaaauuccagauauucccuuauggucuucaauaguaauuuauaauuguauccaaaagucuuaaaacuuuuuuggcuaagcuuauuucuagguacuuuaugauuuucucugcuuuuagaaugguuggucagucucuuucuuucccucuccuccucccucacuuauucuuuuccuuccuguuucuuccuucccaucccccauuccaaccuccuuucauuuuuuuuuucucucuccuucccucccuuaucaccuuuuaauuuuauauuguuuuggcugacaguucuauuuaagguaguguguuauagagaaaaguauauggaacuuagagucaaaauugcuggaaaugaguccccgcuucguccuucaagaauuauaugauaauuaagucaacuuuucugagccuaauucucuuaaucuguaaaaggagaauauuuacuuuuauacugucuaccucacagaaucaagugagauaugugcaugagguuuuuuccuaauuaaaaauucagugcuaaaaagaguucuuucuaggggaaaaaaaugccaauuucccccaacuaaaaguauagacauuuauuaaaacuguaucuuuagggcugggugcgguggcucaugccuguaaucccagcaauaugggaggccgaggcgggcggaucaccugagguugggaguuugagaccagccugaccaacauggagaaacccugucucuccuaaaaauacagaauuagcugggugugcuggcgcaugccuguaaucccagcuacucgggaggcugaggcaggagaauugcuugagcccgggagguggagguugcugugagcugagaucgugccacugcacuccagccugguaacaagagcgaaccuccgucucaaaaaacaaaaaacugucuuuaaagaagaauaccuuaauacauaaacuuauuauuuugacucuuaaagauuauaacccuuauaccccacuuccuaaaaaaggaugugaaaugguuuaaagggcacguaaacauacacucaccucaguuaaagauguuaaaaauagaaaaucaaguuauuacagugagaucagugcaaauaugauaauuaugagggcuaauacagccauuguaauuaagccucucugcuuucaggauucugugggaauaagguaaauaugauuugguucuauuguuggauguauuuccuccuuugagacaaaccuaauuuuacucccauuaaauuaaaaaaauacuguccaccaagguuucaagacaauauugggaacaauaucugcuacaacaguuucauaagugaaagagcacuuuuucaaaugguuuuuugaaugaccguuacuaaaaaucugaggggaaaacagaaagcagcacucaccaaaacugauuucuuuggaaaaacuaaaccaagguuauuuagauagcuuaugaucuaauuugucaggcacugagcugguuuauaaccuagagcagugaugcuuucaacauuuuuguguuaacacauaugaacuuuugaauacuaaaauuuuugguaauauguugaaacuuccaagggaacauuagauaaaguaauaguaacuauaagguaaccacuaguacaguaaaaaugccuucuaguuacaaaugaauccaaagcaaucucuauuuuacuuaacacuauuaagcacugcagucugaguuugauuagaacuguuuacucucugaucuccucugaucuuuuuuuuuuaauucaggaaccaaaauauuuauauguucuaauauagauauaccaucuuuaacauuggcuugaaauuauguaaugccucuggauuguaguuauuugugcuucacuauacccugucauauacuggcccaguacaaaguucuuucugacaagccuuucuaccaguguguuauuaacuaguuugcuuuguauaaugcaguucugcucucaaauacaucuaggcaaguaaccaaaggaauccuagguuaacuuucugcauuugaaagauguauuuauggaagacugaagcuuauuuuuuauaugguaaggcaggugcucaguuuuuauggggcuuuuuuucccuauaauuuuucaacuuuuuguaaaaagcagacaggauuuaugauaagauaggccugaguucagauccaggcucuaccauuuguuagcugaacaaccuuggaaaaguuauauagcuucucuaccuuagcuuuugucucuuuauccccaauaucucuuaucaugucuacuucauaggacuucagaugugaaguuuuuaaaaauuaucaaacuguaacuuauugauaauuuucugcuuaaggucacucuaacugaggaaccuaccccuagaauuaaaaauaaaugcacaaaauaagcuauuaauaauaaauguugaaaaaagcuauuccguauuaccaguauaaucuaaacugaaacaagauuuuuucuuagaaguaauuuuuucuaaguauaacaaugcuuuaaaauaaccauuauauaaaauuucugacauagauaaaaauuagaauagcuuaaugaaccuucacugaccuguuaccagcuuuaguaauaaaauacaguuuagauuaauccuuuucaaccauauaagauauaaagugacaaggccccuccccucucccaguuguuuaauaugauuuaccugagguagccaccauuaacuuccuuuacacaaaugaaaucaccccauaggugcuguuuuguagcuugacauuuucauuuaacaauauacuuuuuaaaauauguuuuauuuccaugugaguaccuauguucuguggcuauacaacauucuguucucuacaauguucuauauaauauuauggcagcaaaacacaaaagagugaaaugagggauguuuguuuuauccacugcuguguucccaacaccuagaacagugccugcacauaauagaugcucaauacauauuuggugaaugaauuaacaucuaguuaggaaauguauuucuaacuuggaaauguauuucuauuauugguacgauauucuauuauauaauuguauaaugauuuauuuaacuaguagaauaaugauggaugguaggacuuuggguuuuuuucaccuuucuauguuuuuuucccccuucuauguuuuuuucccccauauucucuucagggagcaacuauuaucuugauaaugguggcaauuuaagaaacuacuuugagaaaauaauuaaaauaugaaaaauggauuuuuuguuuuuguuuuugagacggaguuucgcucuuguugccugggcuggagugcaauggcgcgaucucggcucaccacaaccucugccuccagguuucaagugauuccccugccucagcuuccugaguagcugggauuacaggcaugcaccaccacgcccggcuaauuuuguauuuuuaguagagacaagguuucuccguguuagucagguugggcucgaacucccgaccucaggugauccgcccgccuuggccugccaaagugcugggauuacaggcgugagccaccgcacccggccaaaaaauguauuuuuauggacacccauagcuaaaugucuuuccaucuaguggcugguuaaccaagcaugguuccuccuguuuccuuucccuaugaucauuucagaguauaaccauuguuuaguguaggagagauguuaugacuuuuagauaugcuuuuuuucauaaaaaggaauugccuaguuagaauuuuuuaaagauaucucacaguucagcaguuuugacauugcuggggaaauuuuauccagggauacagaagaaacguucauucauuuuuauuuaagcaccuauaaaaaguagggggguacuucuggcaauacaguuggguuacuguuuguggcuaaauaugugugugaacauuacgacauuugaugaaaacagcuucauugagcuacugagcucuccagcugauuuuucuucuuggccuuaaagguuuacaaggcuaagaaucaaucuccucugggguagauggccuuacggauuuuaaauauguguugugauaaaagugauuuuacucuaauacagcauaguacaaguuaacuuccaguaugcagaauugaccucgugaauuuuaguuuaaugaucucaguucucaugaacuugcaaacauagaaaaaaaauaaauauuuuuaaaaaacuuuucuuuuuaaauugugaaaaacguauaugaugguuacagcaaagauuaugcuuuuaugacuaauucauuacauugagucauacauauuaaugauucaaauuacuaacauagcucuauuaaauuaaaucuaccauacaguauacagguauucuguacuuugaaauuucauaaauuuuuggauaucaacucucagaaggguauacuaguaauuugcuuuuacccacaaaaucuucagauuugucaacaaaaugaacgagauugguauuuucacuuuaguuucucagugaaaauaaagaauggguagaugaaugguccaaagagcuaagagagaagacuuaauuuaaacucaaauaaacaugcccagaaugacccucucuuuuucugcccuuccuccugccacaguuagccacuguaugucucagguuuuaggcaaagugagucuucuuaucauggaaacugugaacauucauuaacaacugguuuuacuuugaaacuuaaacagcaaacaccaaagagugaauuguugguauaauccaugggagucuugagauugacgucagaacaccaguacagcuguauaagcauugggaaguauuuuuaacauccguguuagaucaucuuuuugaccuuuccuuuuauguuuucucuuuuuccauuaaaugguuaaaaaaaagagcuuuacaauauuuucuaccaacacuguaaugauauucuuaaaaaaagcacccguacaauuauuuucuuuguuccuuuccccuuugcaacuuuccuuuaccuguaguguuccaaguucugaugggguggccuuuuuuuuuuuuuuuaaauaaaaaguuuguuuuugagaacagggcuagauuugccgaaaaugagaagcuagaaaauaacauauaccccauaggcaugcucagaguccccuauuauuaacauauuacauuugugugguacauuuguuacugaaccaguguuaacauuaauauuaauuaaagucuguaguuuauucagauuuccuuaguuuuuaccuauuguucuuuuucuuuccucagaaaccacauuauauuuaguuugucauguuccuuagccuccucuuggcugugacaguuucucagauuuuucuuguucuugaugguuuugacaguucaaaugaguacuggucagguuucuuguaggaugccccuauauuagaauuugcuugauguuuuucuuacgauuugacuggaguauggguuguuggaaggaagaucacagagguaaagugacaucuucaucaacucaugccaaggguacuuaccgcuaacaugauaugugacuauugaugaugaccuugaucaccaaaauaauguuuaucagauuucuccaguguaaaguauuggaauguucugguaggcauauccuaguuagguuaauugcucugguaauugcuugggcuuuaguuauuaaauaaaucaucauauugguauacugcucauugaaauguuaaauuuuuuuuuuuacaaauaauguguucagaguugagaauuagauuuuuuaaauguucagauuguauuuucaaauuguauuuuugaaauaaagcuuuccuuuccugucgaauucuaaagauuuuguuuaucuaagggaacaacuuagguucguauuuuaaguaggaaguuagagagccuggucaguuuaucugcaauuuaaauucuagacacugagacuuauuuccuucauuuuaucuuuuaaaaaauagacugagauauaauuuacauauaaaauucaccauuauauuauuguuaauuuuuaugggcauaaguauuuauauuuauggauuacaugcaauauuuugagacagggauacaaugcaugauaaucacacuaagguaaaugggguaucuauuaccucaagcauuuauucuuucuuuauguuacaaacauuccaauuauacucuucuaguuauuuuuaaauguacaauaaauuaugguugacuguaaucacucuguuauaucaaauacuagaucuuauucuaucgaacuauauuuuuguauccuuuaacaaucccaacuuccccaaccccccacuacccuucccagccucugguaaacaucuuucuaucuccgugaguucagauguuuuaauuuuuagcucccacaaaugaaugagagcaugugaaguuugucuuucggugucuggccuauuucacuuaacauaaugaccuucaguucuauuuauauuguggcaagugacgggaucucauuguuuuauauagcugaauaauacuccauuguguauauguaccgcauuuucuuuauccauuugucuguugauagacacuuagguuguuuccaaaucuuggcuauugugaauagugcaucaauaaagauaggagugcaggccucuuugauauacugacuuccuuaaguucacucauuuuaaguguguacuucgaugagcuuugacaaguguguauacuuuuuaaccaccacaaccagcauaguuaagauauauaacauuuccaucaccccaaaaaauugucucugcuuucugucacaauaguuuugccuuuucuacuucauguaaaugaaaucauguacaguauguaaucuuucugugucugucuucucugucucuuuuuuuuuuuaaagacagucucuguuucccaggcuggcuggaguacaguggcgcaaacacaguucacuucaggcuuaauauccugggcucaagugauccucccaccucaugcucccaaguagcugagaccacacaggugcacagcaccacaccuagcuaauuuuuuaguauuuuguagagauggggucuuucuguguugcccaggcuggccucaaacuccugggcucaagugcccugaccccugcgaagugcugggauuacaggcaugagccacuaugcccagccuuucuucucuuuuuuuaggcuuaauacuuuucagaugcauccaaauuguuucauauaaugguaguuuguuccuuuuucuuaccauaauaguauuacauugugugaauaagucaguuucuuuauccauugaccuguugguggagguuuggauuguuuccaguuuuuggcuauuuugaauaaaucugaacauuuuccuguaaguuuuuguguggcauauauuuuucuuucucuuugguaaacaucucagaguagaauugcugagucauaugguaaauauauauuaacuuuuaaaaaauucuuuuauuuauuuuuuuagagauggggucucacuauguuguccaggcuggucuuggaucagccuugguuagggauccucccaccucacccucccaaagugcugggauuacaggcaugagccaccacaccuggccuugauuaacuuuauaagaaacugccaaauuguuuuccaaagugccucugucauuuuacauucccacuagaaaugucgaagaguuuuacuuguucuacauccucaucaacacuugguaguaucagucuuuuuaauuuuagucauuguagugggugugaauggcaucucacucuacuuuuuauuugcauuucucuaaugaugaaugauauugaggacuuuucauuugcuuauugaccuuuuguucucuuuugugaagugucuguucaagucuuuuaagaaguuggcuugucuuugucuuauugagagguaagguauggguccuuugucaguuacauuuagaaaauguuuuucuuucuguuuguggcuuguccuuuuauuuccuuaacaaugucuuucaaagagcauaaguuauuaauuuugaugaaguucagucuaucaacuuuuuauuuuguauucaugcuucuuggucccuaucguaaauaucuugacuuaacccaagguugcagaaaauguccucuuaauuuuuucuagaaguuguauaguuuagcucuuauguuuaggccuaugauucauaucaaguuaacauuuguauauggugugagguaaggauuaaaguuugugcguguuuuggcauguuuuccagcaccauuugcagaaaagacuguccuuuucccguugaacugcuuuggcaucuguguuaaaaacuuaauagacugucugugcauaguuguauuuaugguuucuuuauuauguucuguugaucaauaugccugaacauauugauugauuuauuaccuuagcuuuaagucuuuaaauaagguaauauaagucuuccaauuuuguuguuuuccuaaaaauuguuuuggcucuucuagaucuuugcauuuccauaugaauguuagagucagcaugucaauuucuauuuacagaaaacaggcugagauuuugugguuguguugaaucuggaucagaauguggagaauugacaucuuaaauuaggucucccaauccauuggcauaaucuuucucuccauuaauuuaguagucuucuuuaauuucucuauaaacauuacauaguuuucagcauacaggguuugcacaugguuuguuaaguuuauguguuuugagguuauaaauagcauuuaaaauuaauuuuuaauucuuuauuaauaauauauagaaauacaauugauuuuucuauguucaucuuacauacuguuacuaaacuugcuuuuuggugcuuuuuuuauauagaucucuggaguuuuccauaaugucauguuauuaaaaaguuuuacuuucauuuaaaagauguaagccuuuuauauauuuauuuucacugucuuacucauuuggcugaaauguuaaaagaaguggugaaagcagacauguagacaucuuuucauuguucucaaucuuauggaaagcauucaguauuuuaccauuaaguacgauuuuuuuuuuuuccauacucuaucaguuuggggaaguuaccuucuauuccuagcuuguaagaaauuuuauaauuaacagauauugaauuuagucauaugcuguuucuguaucuguuuagaugaucauauggcuuuucuguuuucuuucuuuuuuuugacuugccaggagguauuuucaucugaggcuuuucuuucuuagacuggugauacagugaauuacauugauuuuugaguguuaaaccuaccuggcauucuuaggauaaaccccauuugguuuauccuaauggucucuuuauuauguauuauguauuauucuuuuuauuuauugauagauuugguuuacuaauauuuugaugauuguucuuguuccuuuguuccuaagggauauuuguguuuaguuuucuuguaaugucauugccuuguuuugauacugagacaguguuggccucagaaaauuuuuugggaagugucauguguuuucacuuucauuugucagauguagaauuguuaucucuuccuuuaaaugcuugugauaauucaccagugaagugaguuuucuuuguggaaauguuuucaaccagcaauuaaauucacugcccccugagaguacccacuauucugacuucuaguaccauagacuaauccuuaaacuuuuuuuggauuaauuuuuuauuuagagaaaaguugcauaaauaacacagaaaauucacguagaguucccauauacccuacaccuaguuuuccugauugcugacaucuuacauuauugugguauaucugugaaaacuaagaaaccaaccuuaguacauacuguuaacuaaacuucauacuucauuuggauuuuuccagcuuuuucauuaauggccucuuucuguucuaggaucaaauuuaggauaccacauugccuguaguuuucauguuuccccagucucuugguuugugacaguuucucaguuuuuccuuguuugucacgaccuugccauccccgaggacuuuguagaaugccccccagucugcguuugcugcuguugcucgguauuagacuggguuaugcguuuuuggaaagaauccucuuuuccucucaucaggggugcaugauguccacguggcaucacuggugauguuaaccaugaccacuugguuaagauaguguuugcuagguuucuucacuauacucuguuuuuugggaacacauuacuaaguccaacccacacuuuaggaagggggagauaucuacauacaugguuugaaauucuucuguaaggaagauuuggaucuuuccccacauuuaucuguuuauucagucauuuauaucaguauggacucauguauguuuauuuuauacuuugaguucuaaugcuagguuucuuuucuuuugcuuaaauuguuccaacuuuggcuauugggaagguuuuccgguuacuguuuaugucccuuucauaugccccuauccuuuuguuuuuugaacaucuccugacgugguacuagaagaugcuccaggcucaucuuguauuuucuuugcaucagcuguagaaucagccauuugaaggaacuagcauuccuuuuauuuaggaaccaaaauguaguuacuaggugugcucauugcuauuggaguaucguugcuuuuaggcccucucaggggacagagcuagguaauaucugugugaauacuaacccauguauacacauacaucucuaauuguuucuauauguaucaguuggcauauauguuaaguuaaacaugaguugauauugaugucucugauuauaauccauuaccacaagguucacucuaguccuccuuuuuaaucugugacuuccuugucugaccauaagaaaccuggcuccagccaccccauuauccauccacuuauuuuuucaaccuauguacacaugaaaagcaaauuuagaauuauuaccccauaccccaugaguacaguauuuauguacaguuucuuuugucauuagccuuacaauuucaagucaaaacaccguguuccaaaguuuguuagguaagcuccuuuuucaccgccccuucagugaaguuaugucauacauuuguaaugcaguuaguuucauuugucgcaauccacauuucaucuugggauccucugacguuuugguugauguuagugguuguuguuugguuaacauuuguugaaguucacucuuuguacugugccauucuguggguucagacaaaugcaacgggucauguauucaccacccuaauguacagcgcagauccugcacccuaaaugucccccugugcaucccguuuguagucaaacacucuccucuccucuagucccuagcaacuacuaauuuauuuucugugucucuacuuuugcauuuuccagaguguuguauaaauggaaugauacagucuuuggauuuuuccauguaguaaaauacaugaaaaauccaaagauuguaucgggcuucuuucauguaguaaaauguauuuaagauucauccauguuguguaaauuaauaguucauuuguuuuaaaaauuguuguacuauuccauuguguggaugaaucauaauuuguuuuuucauucccccauuaaaggccauuguaguuacuuucaguuuuuggcauuaggaguaaagcugcuguaaauguccauggccagguuuuugcauggauauaaguuuucaagucccuuguguaaauaccuaagaguaugauuguaggucguaugguaacucuguguuuaacuuucgacugcuuuuguucuuuauagaaauggaguugugcaguaugugcuccuuuuuaaucuagcaucuuucuuuugaauuguuuaugacauuuaucuguauauuuugaguggucauaauucauuugcauuauugauuaauauucuaaugugugaauaaacuacaguuuuaaaaauccauucuacugcagauggacauuuagauagcucuaguuugggacuguuacuaacagugcuguuuaggaaccuucacagacauguauuuuugugaacauacauauacauuucugccuaguuguggaauucgcugguacagcuuuagcugauuguaccaaguaauuuucuggagugauuguaccaauuuauagucugaucagcggauguaguuucuaggugcuuaaugucuucaugaguacuguauguauucauucauucuauuucucucucucucucauugugguuuuaauuuacauuuccuuaaaguugagcaccuuuuuauaugugcauugguuauuuggauauucagaaaaauuaagaaaauuguaaauuucuucugggcucugaaagcauugggguuuggaauaagggguggcuuccauuaggaaaggcaguaagggggccgggcgaggcgguucacgccuguaaucccagcacuuugggggccgaggugggcagaucacgaggucaggagauugagaccauccuggcuaacauggugaaaccccauuucuacuaaaaauacaaaaaauuagccaggcgugguggcgggcgccuguggucccagcugcuugggaggcugaggcaggggaauggcgcgaacccaggaggcggagcuugcagugagcggagaucgcaccacugcacuccagccugggcgacagagccagacuccgucucaaaaaaaaaagagaaacagugucuuugggggagagccagguguuggugaaggcagcguuuggagugcauucugugaagaaguuaagaguguagugguguuugguuucuuguagcaagaguccuagagcagugguccccaacuuuuuuggcaccagggaccgguuuuguuguagacaguuuuucaaugggacugggaggguguucgggggagggcaguagugggaugguuucagggugauucaagcacauuacauuuauugucuaccuuauuuucauuauuauuacauuguaauguauaaugaaauaauuauauacucaccauaauguagaaucagugggaacccugaguuuguuuucuugcaacuugacggucccaucugugggugaugggaaacaaugacagaucaucaagcauuagauuuucauaaggagugugcaaccuagaucccucucaugugcaguucgcuauaggguuccugcuccucugagcaucuaaugcugccacugaucugacagaaguggggcucaggugguaaugcgagugauggggagcagcuguaaauacagcugaagcuucacuugcucaccuccugcuguguggccugguuccuaacagaucauggaccaguauugucuguggcccaggaguuggagaccccuguccuagaguacacagugaaaaaguuugauagagaggggaacaguggaagauuuuguuagauaugucacaugauuaauggaugacuaaaguuuuguuuggugaucuaggaugauagagauguugagacaugaaauuaguuggcuucaaguucuaagcuguccugugugagaaauugccucaucagccaacacaggcuuugacauauggguagcuucguguuucuuaggauacuugggcuggucagaaagugccaagcaucagagaaacugagaccucgguauagguggaggaagucuaaugauagccacagucaguagccuagucugauuuguuuuuagcaaaucuagacuauuuucuuaaucaguaacuacuucuuuaguaacuacuuacaaggcgacugccuuugccaagguauauguucucugaaagcugauucuucauagaucacuaacuguaguuuugagguucugugauuuccuucaaaauucacagaaccuugagcuauaauuuauguggauagagugauuacugggauuuaacuuaaaauuagauguauucaaauguuuuaaggaauauguuuuguaaaacaacauguuuuucauucguuacuuauauauugaucccagaaauugugugccugcaaauugucaaguuggguugaugcuucagaaaaggaaaguagaggcugagucuucuuaguauagcaaugcauuuuuuagagcaguguuugaggcaaauuauuuucgcaaaauuacauggcuucuagggauuagauugcaugaguuugucucuuguuccucccucauucuacuguaagaggccaggcugcuaguuaacagaaugccagacauaaugccuagggcauaguuugagaccugggaagauucacaauaaucaaacacaaacagacagaguagcaugaagaaauuucaauccucccagucuugcuuacagauuuaauuaggcuuauuggggcagaaaauauuuuuccuccccccauguuuaaaucuguuucuccucuacucccaccuccugucccagauucucuuugaagggguaauacuagcaacaaaaggagauuuuuuuuuuuuuuuuuguaaauccuaacuuauuugguuuaucuggcuuuaggaaaaggagcaguaacaacaaccgaauuuuaagguauuugagggacuccauuuuuuggcacuguauuugggaaauucccaauuuaaaaaucaugcuguacucaagaagaaaauuaggguuuuuuuguggcuuuauaauuggaucuuuuuugcaaguauuuuuaauuuuaugagagguauuuggccuguucugcuagagaauuaucagccaaauccuugcuuucuuuauauuauauauauuuuccugagugauauucuagggaaauguauauggaugcuguucucugucuuuccauuagcagcgcaguguugggcuucgaaugaugaugguagaugauugggggugggagaagaggugggguuucuucuuaucaucccucuuguggucaguaaaaucaucugacaaaugccuuuccaaggaugucgaauguauauauaaagaaaaagcuuaggauugcuaagggagugguauuuuggugaggauuucauuuucuucuacuccauggaaacgagccuuuugagcuuuugcuugucugcugauuuguccggugauccagguaaucuacugcagucuuuguuuucugggucguguauaaaauggagcaaaaugguagaaaaauagcuucagugaaagggauguaccuguuaacaggaauaaaauagaaaggaaaaggauauuuuuacauuguucauuauuauuucucacaacagcuuuuaggauuuuuaucauguuuuaaaaaaccuaauuugaccuaaggaagaaaauuccuaguuuugaaaacccgugccuuaauugcuuagcuuuagaacaaagguuuuuacauccagcauugcaaggauaucuuuauucaaaagaauaggaugcagcauucuuauguuaccuuuuuagaacugaauuggcauaaccucucuugaaucuuagagacuuugacguauuauucugugaauugugauuuaauuaucucaugcuucaggaugguuguuucccuuugauacccaagagaccauggaugggauauaggggguggggauuaauauuacagugggggaagggaguguuuuuacagaguaaccuuccuguuuuugcauuggaaacuaaauugaaauauauaaucauuggaaaaggugguauccauggcaccaaucuuaucaacuugaauuauuuuauccuuuguucaguuugugguauuuuugcucuugucagcugaaauguugauuauaaauuugaagaagcugccgaguugcugugauggcacuggaauugcauucugcuuucuuuuucuuuccaauuauagcuguaaauacaggaaccaagggaugaaugugaaaagaaguaauauaaaaugcugaagauauuuuugguuuucucuugaaaguauuuuucauagugagaauuauuuucuuguggacagaaagagcuaggacccuaauuuaugacauuaaaaagcauuuaagugcuacagacuucucuauuuaggaaagacagacugaaaacauguugaagcguacuauggagcuuucaguuaaguugauuauuuccaucauggugauaugaguuaucauacuguuugccacauuuugaaagcuguuugacuccucagaaguauuaacaaauuaacaaauucuuacugagcauuuacauuaugcuagguucuuuagauguauaucagguuuauagucuaguaaaggauauaaaaaacucaugcauaugauguaccauuuuuggugcaagcauauaaguauugcaguguuauauauuuauguacugacauguagguguuuuacauaagcuacuacauuuaauccucauaacaaccuagucacgaaauuauugucauucuuguuauccuaugcacauuaguccaaacaagcaaacaaaaauugucauucucuuuuauagaugagaaaauuuacauuuugagagauuaagugauuuaccauaaguaacaaagccaugaagugaugaagccugggucagucagacucuaaagcucuuuccacuguuuguauaugaguagauuaaagcauuuuaucaugauuauuugacaucacaaauagugaugccaugagugaaaaggagauagggauccuaaucuuuaaucuaugccaagaacugagugauugagcaaaucauuuaacaucgucuguaaagugugaggguuggacuaggcaaccuugguucaugauucuauucaguguaagagauuuucacauauggucuauggaaacaauucucauuacuuuaguguuuuuauuauauuuaguuuccauuacucauccuucauaaugugcuguacauguuggauugugugugguggggggggagggugauagagugcauaucaucuucuaacauauuacauacaauauacauuuauuuauuaagauuauuacugucugucaucuuccuucuucccuucccccaaauaugucacgaggaccuagacuagagccuggcuacauaguaugcaguuauaaacuaauuuuuugaaugaaugaauaggaauaauagacuuguauaguacauuggcaaaauauauaaguaacuucauaauucuuaacaccaaaagauucccugggggccaaaauuauuaaucuuucuauuacagugauccuuuaaggaacuaaguguaagaaucuuaaaaagaagaacaccuacgaaacaaucaaguguagucaaguaaucugaaguuugcuggaauucccccauacaaaauuauugguaguauagaacuugcuaaccauagguuuguuuacccaguguucuauuugaaaguaguuuacuaaagcauuccauauaagcaaagaaaaaaagcagcaaaguuucuuuuuuguuuaugugucacuguauagucucaaaugcuguaaauuuacagugaguagaaaauauucagaccauugagucuuuugcuuaaaagauauuucguaagguauaacauaacguuuacugguaguuuuguuucauuuaaacauuaggcuucuugagaguuuuaacaguuuuauugaaauguaauugguguauaauaaacugccuaugguuagaguauaauuugauagguuuugauguauauacacgauuaggaaacuaucaccacaauugagaaaauaaacauauucaccccaaagguuuccuugugcauuuucauaauuucuccgucccuccaccccuccucaccuauccccagguguacccauugacuugucuuugguccuuauagaguaguuugaauuuucuugcuuucuuucuugucauuauagauuaauuugcaugucuuuuuguaagugaacucacauaguuugugcuuuucuuauguggucucuuuuacucugcauaauuauuuugagauuugucuguauuccuguguaucaguaguucauuucuuuuuauugcugaaugauaucccauuguguggauauaccacaguuuauccauucagcuguugaugggcauuuggguuguuucaaguuuuagacuauuaggaauaaguuugcuuuggacauucauguacaaguuuuuguguguacauaagcuuucaucucuuagguaaacacccaggaguggaauggcuggauuauaugguagguauauauuuuaacucuuuaagaaauugccagacuguuuuuccaggugacuguauuguguuacauucccauuagcaacauuccaguugcugcacaacuucauuaauaguugguuuugucagucuuuuuaauuuuagccauuuuacugugugugugaugguaucauauuguaguuuuuauuugcauuucaucugaugacuaaaaauguuuaacauauuuucaugugccuguuuuaucauccauacuucuuuuguggauugucuguucaaaucuuguuuuuaauugagcuuuuaauuauuggguuguaagaguuccuuauauguuugggauauaagugcuuuuauuuuuuuuuuauuuuauuuuauuuugcgacagaguuuugcucuuguuucccaggcuggaguucaauggugcaaucuuggcucacuacagccuccuccuccugaguucaagcgauucuccugccucagccucccaaguagcugggauuacagguggccaccaccaugccuggcuaauuuauuucuaguuuuaguuuuaguagagauggaguuucaucauguuagccaggcugguuucgaacuccugaccucaaguaaucugccugccucagccucccaaggugcuaggauuacaggcaugagccaccaugcccggccauaaguccuuuuagguauaugauuuagaaauacuuucucccagccuguggcuuguauuuucauuuuuuagcauccucuuucucucuuuaauacuuuuauugagauauaauucacauuuccuugagcaaaaguuuuaaaguuugaauucuaauuuaucauuuuuucuuucguagauugugcuuuugcuauaucuaagaaauauuugccuaacccaaggucacaccucuuugcuucuaguuuuauaguuuuggguuuuacuuuuaggucugugauacauuuucagguagucuuuuauuuuuaauuuuuguggguaccuaguaaguguauguauuuauggauuacaucagauauuuugauauaggcaugcaauguguaauaaucacaucaggguggaugggguaucuuucaucucaagcauuuaucuuuuguguuacaaacaauccaguuguacucuuuuaguuauuuuuaauguacaguuaaacuauuuuuuacuauaaucacccuccacuacccuucccagccucugauaaucauccuucuacuuucugucuccaugaguucaguuguuuuaauuuuuagcuuccacaaaugagugagaacaugugaaguuugucuuucuguugcuggcuuauuucacuuaccauaaugacguccauuuccauccaucuuguugcaaaugacaggaacucauucuuuuuuauggcuaaauaguacuccauuguguauauguaccacauuuucuuuauccauuuguuuguugauagauacuuagguugcuuccaaaucuuggcuauugugaauaaugcugcaaaaaacaugggagugcagauaacccuucgauauccaggaguguccuaaaucuaaggaugugucauauuauuuuuucuuuauuuuuuucuccuccugcuguuccgggucucuacaguguccccuacuccuuuguuuuauucgcacaccuggguagugccuuuccaaucaaaggauaguugggucugcauuucaggucugugaucuuuauguuuagggaaauccguuuccuggucaaagccuaccagacuuccuugguaucacuccagaauuuaacagauuuggcaaguauguuuuuuaguuaaugguuugagaucauaaucauuuccuucaugcuccuccugccuucuauuuuugcuuuuaauauugaggaaugcuaauggaauagauuugcuuuugcucucucccaucuuuaccuggaauugaacacauauuuauugaaggaaugagugguuugcaggaauguugccauucagguggagacauguuucucuuuaaauauauagcuggcaaguugcccauauggcacauagauauuaacugaauuauccacugagcucugggauuaggagauacagauuguguaggauugggaguucuuucuauuggcuuaucuuuuccuaaaacuauguaacgggauaugaauaccuuucuaccuaaguaucuugucauuauacuagaucuaguuuucugagucucacuugugaaagcuuuugguuaacuauuaauaaaaaacuguacaaagggaagaugauaaugguuucucuuguaaggugguaguccagggguugaaagcaaggguucuaguuagacugugagguuuugaaucuaagcucccucuucuacuaguuauauaacuuguauauguuacuuaacuucucagaaccucacauuucucuucaauaaaacaaggcuaaacauuuuacuuauagaauuauuguuaaaauuaaaugaauuaaugcauaaaaaguacuuaaagcagauacuguaaguaugcaaguaaagcuacucaaguuuuagcuauuauuguaaccauuuuaauuguuaauuauuguucuuauagauaauggaugauguguuugaagcuaucaccuagcacaauuucugacuaccaaauguaguuugaggcuuuugaguguuuuucaccuaaccauucuucccaaaugaauauuuuucagggaagcuaaccccaggaaaugugacacaauuuacuguauuguuccuuaccucuauaauguauguuuauucuagcugguucaucucuuccuuauauacaaguuccacagaaugauuuuuuucuaauaagaauuaagaaaccuuuguucugaugaugagcuuauuuaaauuuggguuuaauuugauagaaaauuaagcuguuuccuuaauggggaaucuggccaaucaccauccuccacccucccaggguagaauuuuuuccaggaauuaaauagcucuaucuagcagggucuuccugccuuuggcaguagagcaguacaaaggccacauugagcauagcugcuggggaaacccuuuuuccuucucuagccuauaaaugcuguucugucucugugaaaagcccugacaucagcucuuggaaaaauccaaauacuuguguuagaacaaggcugaaacacuugccugggcagagacuaauggcugaacuauaguucuaaguuuaccagauugccucucaguauuguuaugcuuuaaaaaacaaaacaaaaacuguaaguuucagacauaaucuagagaaauuaggauagaaaggacaacuuaauagcgccucccauucuuugcuaguuucuucuuauuuuucucuuuuuucuaaaaaucuaccuucaagauaaugugaaauucuugcuugaggagugagggagagaaauaauauaucaauauuauaaacuuuaugcaguguuuuccacauauuagaugcugcauaaguauuugauguuugagacaaaauaaacuguaaacagacuguacuuaacuuccuuaguguucaaauuagaucaugauguaaaacucuccagugguuuuccauuauauuaugaauaaacucuaagccuguuucuguggcucacauucuuacauuagcuggccccugucuacuucuguggaucucauuucagcacuacuuuacuacucucuuggucauuuucuaugcuuaagccacagcggacuuuguauuucucaaauacauuaaucugcuuauccuuugugacucuuguacuagcuguuuccuuuaccuguaauucuguggcccacaucuucccauggcuggcuccuucauuuaagucucagcuuaaaugccucuaaggucuuuuuugaauaaacuaaauuaauguauuuagucaaauaauaucuuuuuuuaauagcacuuaccacgauuugaaauucuuugguacaauuauuuuuuuguggaguuuaucuuccuccuguggaauguaagcugcuugagagcaaggaccuuaucuguucauuaacguaaccuccagugucuugaaccuccuggcauagguugguguuuguguaacuuuguauguacuuggcugccuguaacggaaaacacaagucaaacugacuuaagcaguaacgcauuuacuggcucacauaaaaaagaaaucuagacguaggcuucagagauuuuugauuuagggacguaacuaugucaagggcucagaugcuuuccaucuuuacacucuugccaucaaaaucauccucauccuaaacuaguccuuaaagaugaaugcgaaguagcuguuaaggcugcuugcuucuucacucagguucagugggagggagagaaagaaguuucacaucauucucucaagaauaaggaaauacuuucauagaugccaccagugaacuuuguuucuacuuuuauuggcuuuuuuggaaccaauugcuuacccaagaauggaauuacuguuaggccaaaaaggcccaucacuguugcuacagaugggguuggcuugaccugagucaucuggacucugagaggaauaguagauaacugaauaaaaucggaguucucuuaaaaggaaggcugugguuucugggguaacuuauauccucuguaguucucaauaaaaauguauggaaugagugaauucauguaguaaaaauguauugaauugucaggcguaugcucagcaccauaauaguuaaguagaauacaaaaucaaauagaaugugguccuugccuucaaauaauuuaaaaucuagugagagagccaaauuaacggaauauuaaaauuguuuuaaaaaucaguugauuaaaauaauuuaaaagaugaaaaagagaaaagggaaacaacagaugagacaaauagcaagaugauagacuuaaauacauuaguaaucacacuaaagguaaaugguccaaacaccccaauuaaauguauagacuaucagauuagaugaaacagcaaagcccaacuguaugcuacaagaaacacaccuuaaaauuaaaaauacacauuguuuaaaaguaaaaggauggaagaagaugugcccugcuaaucuacauuaaaggaaaacuagaccacauuaauaucagauaaaguagauuuaagauuauagaauaucaacagggauaaaaaaaguaauuucguacugauaaaagggucaauuuaaaaagaagacauaucuaggcauguauacaccuaaugacaaaacaucaaaauucauguaacaaaagcugacauaacugaaaggacaaauagacaaaucuacaaacauugucaguuauuucaguauccguuuuucaguaauugaucaaaguagauaaaguaagcaaggauauagaguacuuaaacaauacuguuggccaguuugauuuaauuacauuuuuggaacauuccagccaacaaccaaauacuuuuuuuuuuuuucauguuugcaagcagacaugggacauuuaccaugacagacacaauucugggcugugaaguaaauuucaauaaauuaaaaggauucaagucauacaaaguauguuuccuggucaccauggacugaaauuagaaaucaauaaaagaucucuggaaaguuuccaaauauuggaaaauaacacaauucuuagucaaaguggaaauaaaaaaggaaauggcaaaguauuuuguauuggaugaaaaugaaaacacaacauaucagaauuuguugguugccauuaaagcauuacauaaaaacuuauagcauuaaacaccuauuagaaaagagagaaggucuaaaaucaaugacaucagcuucuuuuuuuuuuuuaagacagggucuuacucuguugcccaggcucaagggcagugguuugaucacuacagccucaaccuccugggcucaggcuguccccaccuuauccucccaaguagcugggacuacaggugugccccacuaauuuuuuuuaguagagauggggucucacuguguugcccagacuggucucaaacuccuggguucaagcaauccuccugccucggccucccaaaguacugggauuucaggugugagccaccguaccugaccaauuucauuuuaagcaacuagaaaaagaagagcaaauuaaaaccaaagcaagcagaagaaaaaaaaaauagagaugaaagcaggaaucacugaagcagaaaacaggaaaacaguagcgaacauuaaccccaaaucugguucuuuugagaaaauuaauaaaauuauuaaaccucuagccagcugaucaggaugaaaagagagaagacacacauuacuaauaucauaaaugaaagaggugacaucauuacagauucuucagauauuaaaaaaaaauaggggaggcugggugcuguggcucacgccuguaaucccagcacuuugggaagccgaggugggcagaucacuugaggcaaggaguucaagaccagccuggccaacauggugagaccccaucuuuacuaaaaauacaaacaucagccggcauuguggcgcgaaccuguaaucccagcuaccugggaggcugagggaugagaaucgcuugagcccaggagguagagguugcaaugagcugagauggugccacuacacaccauccugcccaacagagcaagacucuaucucaaaaaaaaaaaaaaaaaaaaaaaagauaagggagcauuaugaauagcuuuauggcaauaaauuuaacaauuuagauggaaugugguugguaauuuuauaaauuccaacaauauauauacaauauguaaauauauauuacauauacauaaaacaggaaaauacauaaaauauauaugcacucuguguguauguauguguguguaaugaccggguaggguuuaucccaggagugcaagauugguucaccuuacaaaaaucaggcaauguaaguaaauggaugguaaauggugguaacuauguuucucacugucucaaaggagcuaagcaagagagaagacuggaaugaaccugauggaauuagauuagaauuagagauaucaguaugaacucaugcugagcuuaauauagauacagauauauggauagcuacagaaagaauuauagauauguuguauuagucucuucucacacugcuaaugaagacauauccgagacuggguaauuuauaaaggaaagagguuuaauugacucacaguuccacauggcuugggaggccucacaaucauggcagaaggcaagugaggagcaaagucaugucuuacaugguagcaggcaaggagagcucgugcaggggaacuccccuuuauauaaccaucagaucuggugagacuuauucaauaucccaagaacagcaugggaaaagacccccccccuucaugauucaauuaccucccaccaggucccucccacacaugggaauuaugggagcuacaauucaagaugagauuuggguggggacacagccaaaccauaucauguguauguauaccccaguuaguauaacacauucauuucccugcucucucugcugagagggccuagaaauggugacaucucaguagcagugagcgcacccagcuccuggaucuugguuacuaaauaucacucuccaauaaaauagcuccuuggagaaaugguugacucuaaggcugcaauagggaaaaugcaaguugaaccuagagugccuuauagugccacaaacaagaaagugcccaaacagaagggugagagcaugucaguggcauaaacgggaagaauuugagcaagagaauaaauaacguaguauuggauuagaacucaaagucuaaaauaaacauacaugagcccauacugauaaaaaugauuacauaaauacaugggugagaaaacacaaaucuuccuuacaggaaaauuucaaauaguauacguagauuccuauucccaggagauggagcuuaauccucucagaugcuaguguggauugggcuuagugacuucuucaaagaaaaaaauauggcaagggaaaaauaauaacuuuacagggagacgucgagcaaccacucccuuaaccaaaugaccaaaguuaacauuacuaguguuaagucauauuggugucauauauccucugaugggugaugaaaaggguacuucaccccugugguauuccaaaaauagacccacguauauauggaaaacugauuuucaaaagugcaaaaggcaauucaguuucaacaaacggugcuggaacaauuggauuucaauuggauaucacacucuauauaaaaauuauuacaaaauauauuguagaccuaaaaguaaaauagaaagucacucagcucuuagaagaaaauguagggguaaaucuuugugauuugggguuaggcaaagauuucuuagguaugauaccauaaacaugggcagugaccuaauuuccaaauaaagucccacagguauggaaguuaagacuucagcaugucuuuggagauaacacaauucaaccugcaacaaauauaaugguucccaauuaggacugcuuucauguuuaauacagagaaacugagaaucucuauaugaguuuagugcuuuucacauacuaccuaagaaaugcaucuuccacauuuacauuuagucuuccaauguguugguguugucauuaacaaaauacaaauucuccuaaaaauauuaugaauuguagcuuugggcauuuauucaguuuguggauaguauaauaauugcuauuauguguaucccuggguuuuguuuguguguuuguuuucuacuuucaacacaaauagggagagagucucucucaccgauuucgugccacacuuugucacuugggcauuaaaauaauuuuacccuggcccuuugucuuacaaggucuguugccaaaacaagcuucuucagcuucugcugcuguuuccauaaagauuugacaugaguucauggaauugaucucggggacgaguguguccucucuuuucuguuuaccuaguacccacagaaacuccugucauuucuaguccaaacucccaccuggauuccuuacuauaaaugaauucaucccaaggaagaaaucaagggggaguauagaacuuggguuacaaggauauuuguuauaacauucuuuauuaugcugaaaaauuagacccagccuaaauauuuacaaaagggaacuucuuaauuaaauagccauaucacaggauacuuugcaguuaucaagaauuauuuagaacuauguuuuuuaaaucuuuaucugauuuggaaguucaauauauagaaugaauaaaaaacaaagcagcucugauaugugggaagucuagagccccaucuacacacucccgcucugugagggaccucuuuuaaaccucuagaauuuuauagagcacaguuuaaaaccagcacuguagugaaauauuuaauauguaaacauauguugauauuuuaugaaguuaaaguugucaauauguccaguaugcuuuaauuuuuaugaaaauaaauuuuaaacauuguauacagaaaucuaucucuauuuugggaaagaaugggaauauaugcauaacaaugcuggguguugggauuaugggugauuuuuguuuacuauuuugucuuuaguuuuuaaaaguuuauacguguacuucuuuggacauaaagaaagugagacauuucuucauauugaaaaggcagagagaaccauugcuuuauaggaaacuacaguuuggaaaaacggcagucucauuacucaaucccuugagagaggaauuaucuugaaaauguuauaaaaaauauuaguaacagauuuacuagugucaguggucuuguguguuaaguauauuaggauaagccacauuuguaacagcuaacggagaaaacauaacugaaugucaguguuacacagugaacuuuguagagcagugauucccaauucugagauguuguaagaggaaugucagaauuccuaaaacacucauccuccaaccuuucaaauucagugcuguggugagccauuguuacugauaaggguauaucccacuugugauuucuuuguuuugggucaagaaaagcuuuuguagaagccaguguaaaauggcaugcauauaauuaauuuccucaucuuuuccucauaaaaucagagguccuuuuaucgauggugguuugaaagucugggguauucagauuuggcagcagaaaguguguuuuuuuugugugugugugauaaacuagguggauugcuaauucugauugaggaauucguaauguuugacaccagaaccagagcacuugugaaaagaagucucuuuaguacaaaaccaaaaauuuaauuacagcauuuguuauaacuauagccaauaaaaguauuuuuaaugaaaaagaauuuccgcagaagaaaaugcuuucuauuaaugcagaagguguuauauagaagauuuaauuguaaugauauugguuaugauccguuuuuuguuuuaucuuuaccuguauuuuauauucguauaaccucuaaauuuuacaaauuacccauaauacauuucuuauauaauuaaaaaaauucugaguacagaacaggaaauauguucaaucuuuauuccauuagaguucuacuuggaaaguauuaauauguaagguuuuuauuucuccauaagaaauagaccuauauagucaggcacagugucucaugccuguaaucccagugcuuugggaggcugaggcuugaggauugcuugaggccaggaguuugagaccaaccugggcaacacagcaagaccuggucucuacaaaaaaauucuuaaaaaauuuagcugggugugguggcaugcuccugugguccuaccuacuuaggaggcuaagguaggaggauucccuugagcccaggaguucgagguuacagugaccuaugauugugccacugcacuccagccugagugagagagugagacauugucuccaaaaaaaaaaaaaaaaaaaaaaaaaaaaaagaaaagaaagauaaauagaucuaugucuaguuaauucgaggagaugguacacauuuuuagagcacaugagaacgaaguuuauacuuuucugauuuucuggguuuccuugaugauuuuuuggcaaauccuugucuguuuagcugucuggcauauguaugacugugguugggcuucuuuguacucaaccaaugaaugcauaccaacuguaacaccugaagguaggaucaugaauaaauacucugugauuugggguuaguauaguuuugguuguuuucccuucuccugagauuucagaaauaaaagauuccuauuccugugauuuuuuuggcacacaguaagacauauuugauacauaagauaagucauuauaauuaacuugucgaaucacuuuuucuugcugcagaaugauauuuuuaugaaugccuuagguuuuuucaauaaaaaaugcaaccaaacugcaaauguacugugauuuaaagugguaaugucagaauuuaaauuuugaguaguacucuuuuuuuaaaucauagaaugcucuauguuuauucaaaaaaguaaaauauuauuagacaguauuuuuuauuuuaauuuugcauuuaaauaaaguucucaagcucagacugaaaaguaaacacuguauguuggagccugucucaacgacacuuaaaagcuaagacuuucuacuuuuucagaaguacauuuguaucuuuuggcaaauguguagaaagcagccuguccuaacaaauuuuguucaccuguucucacuucaguuuauagauuguuaaacauuuaaucauaauauauuuuauauacaauauuuaugugaaaaaugcccauccuugauuaaggggauuuuuuucuacucuuauuuuuauuauuuuuaccaguauauucugaaguagagaaaugugaaaugagaugaagauuuaaauuccuagcaaacagaaucaugcauugccccuguuuuauaaguaaugagaucauuuuguagaguccaguuuauuuacauuuguuaaaugauauuaauaucucuuccauaagcaugaauuuggugguuugcaugguguucacugaggugaggauacuuguuuaaguauuuugaggaucucauacuuuccuagcaguucuuuuuacuugguuuucugaagugaauauagucuuuaaaaaaaaguauaagguacuaguaaucagauacucaugaucacaaaugaaagugguggagaaaccuuuuaaggaauauucacaaaagugauaauuuuccagauugucaaugaggaaaugaaagucucuaauaagcugucacauuaauugugagcugcauuucucagucagcaacaacuaauagucaaucuauaauagcuccagcagagggaaugaaaguaauuuagaaaaaaguuuacuauuugauuugucaaaguguguccaggaaguaagagagccuaaccaaggggcuguugugcauguaagcucuucaguaaaaguggugguguacuaagcuauauuuaagaagguaauuugagauuuuauauuacaugcuagugaaucauuuuuggauuuugcaccagaacugagcucuuuggucccugccugucugugguuuguguugcaagguccagaggcuuaaaacaaagaacaccaugggaaauucuccaugagucauuccgucagcuguagcuucuguuuuauaguccuucggauauaacuaguguuuuaaugccagcucuccuagccgcuuuucaugcuuugguucuauaugcuaauaaaaaaguauggcaguauggcuauuguagauaacguucagacuuuuuuuucucccgauuccacaauuuuuaguucuucuaauggcucuaagcuagaccaauuauaaauuguaacuggugaaaagauuuaugacuguuuauuuuguuguaguugcgagguaagcgaguggucacuuaauacuuuugguucugugaaucuuacuguccagagaacuaaagauugaauuagcaguucagcuggagucagcacuaugugcuaaaucccuauacuuaagagcucuuauguauugcagacaaauguccucuuagcuguuuuguuauuuugugaaaaauaauaauaauagagcaaggcaguuuagauucauaucaguuucaaauuuuaaguaccauguuuuaagccauucuaauuguuuuguagaaacagauaaauuaaaaacuugauuuaaauccagcccacaggaugccuuaaucaccuuugauauuuuaaaggagaugaggaaauaauggacuuuuuugcuaguaaguggcagguauggucaacacaauuucacuacauuugaaaaaaaucacuuucccugcuugccaggaaaauuuaaagugcagauuguaaccugaucuuuuuucuuacaguguaacgucugagaaguucaaguauugacaugaauuuucuaugauaccacuugguaaauuaaaucugugguuucaucacuggcuuugaauuauauauuucuaugcauuuuacuuagcuaaaaacuuauuugaauauuuagucuuuaaauuuauuuuuucuuuucugcuuauuugaauacauaucaccaacauucagauuuuauuuuuguuuuucuuaauaguaaauacauaagugguuacugcuugcuaggcaaugcuucuuauuuucuaauuuaauccccaaaacaaauuugugagguauagguagauguauuaguaauuauguuuuagaggagaugcuuaaagagguuaagcaacuuguucaaguucaaauaccuguuaaauuaugaaacuagaauauuaacccaguuacauuuguuucugaggagucuuuugcccccaaggccuugaaauuuuagggaauuuucauuuauagcaaucaauaauacuauucccaucccacccuguccauuucugauuuucaauaguauaguuucugcacugauauuuacaucgucuuacgaugguugagccuuaaaauuaccugcauuguugucugauuugcaauucuuugucuaguaacucuucucacuggaguggguuccaauaaaauggugcuguauuucacucaaaaucaaguugcaguguuuuuuccuccucauuuuaacaucacuaaaaucagaguguaucuacuaauggaauucuugauaauucuaaauuuaauagguaacauucuuugacugcuaauaaaaucuuaaccacuauccaauguaagaaaaauuuguuuaaccaucuccccuucauuucaaccauuccuuauuaagaagaaccaacuacagucucaaaugcuccuuuauaacuaagcccagggaagacauaucuaacacccuagaggagagagaaaaggguaugaauuaagguuugagugugauaucagcauuucuucucauauggcuucagaacacuucucacugaaguauugucaaaaggcucuuuaugcacugaaaucaauaaaagaaaaaaacaauuucuagcaggcuauuuauuauaagcaaauaugugacgacacaaaacuuucugguccuuugcaauuuuuuaaguccaaaagaaauucuguuuaacaauauuaaaggacuauuccaguuacaaaauuguguguuuguguaugcuuauuagaauaauuaaacuugguuaaaauguaagucuuacucuaguauacauuauuuauuggguaaguguuauuuaacuaccaaaucacauuucccucuacacuguaauaacacaucgggaagggccaccuagggcuuuaaaauuagaacucagaauuuaacaaggaaaagguauucugaguugagugaauaaauguauucugaacguuuaaggccuuugguuaagauuucuaaaauguagcugugcuuaauauacaaaaucaaaaguaaaggcaggccaggcgcggcggcucacaccuguaaucccagcacuuugggaggccaaggcaggcugaucacuugaggucgggaguucaagaucagccuggccaacauggcgaaaccccgucucuacuaaaaauacaaaaauuagcugggcaugguggcacgcagcuguaaccccagcuacucgggaggcugaggcaggagaaguguuugaacccgggagguggagguuacagugagcugagauuucaccacugcacuccagccugggugacaaagcgagacuuaaucgaaaaaagaaaaggaaaaaaaaaaaaggcaucuagccaccauaucccagugauucaaauuccugauaauucuuugcuuuauuaaucaucguucuucauuuuggaauuugacuuuuuugcuaucuguuaauagaaaaauacacacacacacauauaaguaaacacaguauauucauuguugaccaaguguccaaguuaucaauaugauauuuucaaaaaccaggcacaguuucauuaggcaccuguaacauuaugucauagucacauacagcuguucuacauaauaucgauccaaaagauauugucaugauuucaugauuagacuacacaguggacagggacuuaaaaauauaggaguuuuguucaccagaauguauuucaucagacuaaugguugaacugauuuguugcuuaugaccuggccacuuuguagcuuucagaccugccuuucuguagcaguugauaguauggauuaucugaucuuccuucccuucugggacaggcuuuucucuuuucuaauucauuuucuuaaucuccuaccuccauucucaaucaugcagaugcuaguuucucccccauauuugagccugagcauuuuuucaaguuuccuugguguuuuacauuucagugaccaucaguagguugauaacucaaaucugcaacuuuagccccaggcuuucuuugagguucuagcuuucuauuuccagcucucugauuacaucugucucaauauucagcaugugguagggauuuugcaaaacuaugggauuaucuuggugacuuuccuagcugaagcagagagaacuaaugaaauagccaagaagguucuugacauuguuacuuaugcauauaagcauauauauacacacauauguacacauauauuuauuugcuuuagcagauacuuuaaaguagaauucaaugauuagagaaaaaauuaugauuuuaauauuauuugagacguucuuaaucuauacuugaaguaguaaguagauuaugauaagcaaguuggacugugggcgugguccuuguucauuuucucauuccguuuuuguccccauuuuuccucuccuuuuucauuaccuuguaagagaaaauagcucaggaaacggguuuacaaucaguagucugggaacuuccgggauucuuuaccagcaucccccuggauguugcagucccugacgcaagcagcauuguuuuaggguaggaguuuuuauaauggcugugaggucgagugccuaagguugauaaauggcaguuguuauccuuugcagaaacucaguuggaauccuuucugucaacuuguauguucaucuguaaauuaagaaacauguucccauucccucccucuccuaccucaacaguuauggacagacugcuuaggaacuccuauuucugaagauuucguggucuuuuguaaagucaguuuguucucuagagcagugucaucuugucccagaacccccuuuacuuacuaccacuacuucuuuguaaguuaacaugcuaucacugauuaggaaagguuuuagauucuuagucuuuuucuauggaucaauuuugguuuaaauaggugucgaagggaauuguaagucagcuuguauuuuggagguuuuguuucuaccuccaugccaaaugaaauguagucauugaaguaucauuguauuauguuuauuucugucuuuacuaauaggcuuuuuuaaaacccuaguuuuacugauguucuuaauaaaguacgguuccuauuacuaaauaaucuuuacauaaaaugccauagguugaaauaauuuaaaagacagaaaucaaaauguaggaugauauuugagaagacuuagauuagcauuuauauauagcaucaaacgcuuaucaagaagcuuccggcaguauucauuuaaaagagagagaaccaggaggaaaugcuguaguucuuucagcuuauaggacccccccagaaaaacaaaacaggaaagugcccuuuguuuucuacuuuuggaagguauuuuuuguaaccgauaauuacuuuaauguuaauuuuuuucuagauaaucuguuauuaaaucuaaaccuaauaauugaggaucacgaugacauagaucaauagugcaguaaucaacacccagauauuuugggaaguagugugaagugaugggaaggaaggaacuuucccuucuaggaaaacagugagaauaauauuuuaauggcaaaauauuucuuuuugucuugauuuuuaaaaaucuauaaaauggaaaguauaucucuucauagagauuucuuuuuuucaagauuaaacgagauaauacauguggaaauaaugcauagcauuugguaagcccuuuauaaauuuagcaauugcucuuauuauugggauuuuuaaaaagaaaagcuauauucuaggacagcugaugguaaaugcacuggcaguuuaagauuuaacaaaguaguuaagauacuuaaacaugguguucaacuucuuauuccuccagcuuauugauucuugcuauuggaaaguuaccauaagauuuaaaucucuuauucugguucaguaggaugaauaaauuuaguaacaaaaucuuacaaguaaaguaacuacaucuauccuuauuuuuucuuuguuucagguuuccccucaaaaaaccuauaagguaaguuugcucaauuacacuucauacucaaguuuagguuauauuuuaauuauaagcaucccuuugaaauuaugguggauuuuugugguuuuugagaauguguauucaaguaauucaaaauuucaaaauguuuuacaaauuuaaaauguaaaagauguuacuuuuucuggaagacagcauuguuuugauaauacuucuaauauaagcauuuaaaaauuuuguucaaaaggauauuuaaggucacacugaagagacuuaauuuugaagucuauuugugacuguuuugaauuaugaguagcuuaggaggugaaaauagaaugcuaguuuuugauguguuuuaucacuugugugacuauaauugccuuuaguuaauguacuuugguacuaguuuagucuuaauuacuuuauuuuuuauuuuauuuuauuuuauuuuuugagaugggaucucacucuguugcccagccuggagugcaguggcgcgaucucagcucacugcaagcaccgccucccggguucacaccauucuccugccucagccucccgaguagcugggacuacaggcgcccgccaccacgccuggcuaauuuuuuguauuuuuaguagagacggaguuucacuguguuagccaggauggucuggaucuccugaccucgugauucgcccgccucaggcuccgaaagugcugggauuacaggcguaagccacugcacccagccuagucuuaauuacuuuaagacagugaagaaaaaaauccaaaauguuaaaauguaucuaugccuauauccaugucuauauauuuauucauuuccaggucuuaaaugccucuuccucaguauuuuugcuuucagcauuucuucuguuaucuuaucauaaauauuauuuaaaauguagguaguaugucauuccuaauuauuauauuuuaucauuuuuagugucagcauaguccaggauccaaugcuaaccuuggcauuucagugaauauguguauguguacauauguauuauuguuauggucuugucacccaaccauuaucugaucaguguaauuggcuaagccauagaaguaauaauaauaauaaugucauugguccuuaaagugguuggcuaagacuucuguggcuagaacuacaucagcaggcuuaaaaugaggcuugccuaaggcugcuuuuuaaauguuaaaccguucucaugcaugcucuauuuaugcagugauuuugaacuugaucauaguauauguagaguuggagaauggguuuaauuccuuuuaggcacuguguuuuuuuugucuguuaaauggaaaugauaguauugaccugugaaaaccacacaaaaaaaauguaagcaguuacuucugagaauaaaagagacuuuaaugcugaauacuauuuuuaauuauuuuaagcaguuuuuauaaucaaguaaauagacuguguauaaccaaaacuuauugaaaaauguaaauuagagaggcuuauggugcuguguaaaguaaacugauuuccugguuuuucuuguaagauccacuuuuagaauuuuaaauuuuuuauucuaaugauuuucuugcacuaagcauuugauuacuuugcuuuaauuuaggcauggaaguauuuugaaccgagagucaccaacagauaagaagcagaaaguugagcgcauugcaucacaugauuuugaccccacagguaaaacacuauucauucuuucaaagaguauugagaguagugaaguucagaauaauagagcuuaagcuacccgaaacacucaggaauaguuguuugaucuguuuuaggacucucacauuccuccaauuauaucauaauaaagccuuugcauuuaguaggaaugcaagcauuuuuaacuuccaacacuguacauuccacuacagaaguaucauuguagaguauauuguaucuuuaaauagugauaauaauagaaaugguuauauaauaauuggagauuuggucagaucaagaacucaguguuaaguugaaucaugguauaagcaguaauaugucauaaaaccaaggcucuaacaacucgacacuugcguagucaucuaaaaauucaauugugauuauggugaauuggaguuuuagauaaaucaguuucacaaauuaaugauggucucauuuuagaguaaacaaaugaauagaaaucccuuucucuucagucaaaaaguauucugaacuuaaagagcugucuuucaaccuaagcagugucgaucuuuccuaggguugucaccuuaacagacuuucagauugaucuccuuuuaaaacaucuaggcuuuuuccuuuugcuuucuccuuguaagcuuacuccauauuugauucauagaaagugcuugguaaucuugcuuuuuucauuugaaacugauauauauuuuuugugcacauacuauuuuauucaguugccugucccuuugacaagagacgaaguaaaucccgcuaucucagauacauaaaaauaauguaucuauuuuuagguauuuuuacuuagaaauauaauuuuaaauauuuaauagagaauaguauguuuuauuuaucuaagacauuucauacuuuauuaguauaaacuccuuuauuuugaaaaaauauuauaaauauuaucuaggaagcacauagauaaucauuuucugcauuuuggguaguagguaaaaugaaauuccaaucaucaauuuaggaggcuuugguggugggacuauguauuaugucacuuacagaucuccaugaagagagaauuuuccauucugaugccuaauuuuguagucauggggcucagaggcuuucauuuacaugauuagguauugucuugccaauaaggucaaaaguuucugcccuauguucagaaaaauauaaucuuguuagguuuauuuuguaucuacaucugugcugugcccaucuccaaagacagauuuaagcaaagauguauacaaugcuucauaaugagaucauuauagcuuuuagugcuuuugucaucucuacaauuaucaggugauauauuuuguauacuauucauguguuguuuuguuugaacauauuuuuauugcacugucuuuucuucgauaaaucuuuaaaauaugucauuaccugugcuguuugugacuauucuaagugcugucaucuguuauguucauacuuuguguuugcacgauuuaacuugaucaugauucauucuuuuuuccccaugaauuuuuccccuuacauugucuccauauuuucuauaucucucuccuuuucucccgcucuugugcagauagcuccuccaagaagacaaagucuaguucagaggagaguagauccgagauauaugguaagcuaauguagcuaauucagccuugcccuuuggagcuugcuucaugguguuccuuuucuguucuuuuuuuccuuucuuucuuucuuuuuaaauaacugcagccuuucuugugucugcugugcauggcaugaucuacugcagggaaagggagccugggguuuuaacguggcugugauguggaagcuuaagguugcuagaaacuaacauuguagauuaagaguaggccacauugcccaucuucucccgucuuguuuaugguaggaaggugauuaucucuaauauguuugggucagguuccuccaaauaacaugaaugggcuuugaauucuugucaucuucuucccacaucucauuugcagaguuuggauuaugaagaauuugaggaauuaagucuuuuccucuaaguauaauacugguguaauuuagacguauuagcaguucuuuggaauuuuuauuucauuuuuuguuuguuuauuuuuaauugccucgucauguggaaaagucauucuuguauaauuuauccacgauggcaaaaauacguaaguauuuuaucuucauagcuugaagaauuugugccuuugagaaguuucucugaagcuuaaucggaaugggaaaauuucagaaugguaccuuuuaaauaaucuuaacaaagagcaaguuuaaccugaguggucaacuuuugcagcagaugauugaaaugcuaauauuucuagacuguguccugucuuccaaagauacaauaaccauguuugugaaguucauaccuauuuuuccuuuuccuuugcaguuuuauuugcccucuuuccuucuuuuggagucugauuaggguuuuguuuugggguuuuuuuuuuuuugguuuuuuguuuuuugagaaaagugaauaagagaggaauuaccuggagcuaagauuuuaaaaauaauuucugaaagacugauaaauuauuucuuuuuuuaggaagauuccaaauuuggccucgaagggaaaucaggucaucuuuaauagagccacaaaucuauagagcagaagcucccccaggugcagauagauguuuccuagcuugauauauaggagaggaaaaaauacaggaauugcccuccccuuuuuaagacauuugauaauucacaucugcuggcacuugagcccauaucagauacuuuuuaguauuaugaaagcucaguguuugguucuaaaccaguuaauucuucuauguuagauauauacacauaguucuuuacuuggguuuuugugaccagugcuuuuucuguguauaccuuuuacaguaguucagcaguaaauguauacugugccuugugacacaucaaguuuacgcuuuuucuuccuuccagaguauuuuggcuacugauaaguaagaacuaccuaauuccuggagacuauauuucuguucuauauaaagagcuuucuauaguuuauccucuccuuaggaacaugaacauuaucuuuauagcucuauucuuuuucgguagccuuugcaguguucuauuucgucuuccucuccauuuuccuagaucugcgauguguauuuagaagcuuguuguaugcuuuggaugaagacuaacaauuuaggaaccucugacuagaaauacuauacuaauauuuuucuuagcagugauagaaacauuaauacuaguucaggcaugccauuggcuugguagugauagaaacauuuuaagugguaauugggaaguaagguguggcuucucuguguguuuguuuuuugagaacccuugaaauaccuuuuuuggaaggaacugaguccacaaguccucaaaaagcacucaucggagggaugaguugauuagaacagaauuagcaugcuaacguaaaucucuuugacauuacaaauauuuuaucaccugugugaauagacgucuuuagauuacguacaguuagcauagaugaaaaagucucucuggggauucagaaaagcuugaaacuacugaguagaaucauagcaacuggugacauucugcuuuaguguagggucuuauuauaagcccacuucaaacuuuagagauuauacauugcuuucucgggguaaaauucauuagcugaguacuuaacaaaaaugcuaguuacucacauauuauuuauuuuaaacuuucuuggcuuuuuuuuuuuuuuuuuuuuuuuuuugagacaagaucucgcuguguggcccaggauggaguauaauggcgggaucaugacucacugcagccucaaccuccugggcucaagugauccuccuaccuaagacuccaaaguagcugggacuacaggugcacaccacugcacccagcuguuuuguuuguuuguuuguuuuuuuaauagagaugagguuguugaaggaaugauuugccaggggaaaaaaaaaaaagaaagaaauaguagagacaaagucucgccauguugcccaggcugaucucugucuccugagcucaagcaguccucccaaaaugcugggauuaaaggcauaagccaccgcaccuggcuucuuagccauuuuuagagcuacuuugugaacuagauuuacuuugugcaucuuaaaaggaaaccaaguguuugcuuuguauugacuuuuuuuguuacauuucugcccagugcggucaguugguuauuuauuccauuuccccuuauuugucccuuucuaccuguuagagucuauuaaacguguauggaugcguuuucugaucuacaauuuuaauaauacuuaauuuuauuaauacuuuuguggguuacuguaggaaaugagagauucagcaagggaauucugaguuagaccauagcugcugcuuaaccgcugucauggugucugaacagauuccugcuaacaguauuugguucaagaaaauaaguuaugucuuuuuaaagcugucuuaguguguucaggccacuguaacaaaauaccauagacugcuugguuuaagcaauagaaacuuauuuucucacaguucuggagguuagaagaucaagaucaggaugucagugugaucaggucagaagauucccuugcuggcuugcagauggcugccuucuugcuguuugucucacauggccuuuccuccguguuugccaaugcccuuucuuuaguuucuaugauauuacaucaaccugguucuuuauucuuuguaauuauuuugucucucuuuauuugauuguuuuuucccuccuguuuuauacauguaggcaugacccaaguuucuguccccaaucuuucuuccagucuccagucuaagugucccauaaauucagagugaccaaacuggaguucaucauuguucucuacagcuggaaaucagucuuccucuuuauuucccuaauucuuauaaugacacugucauuuuuccacucaccuagucuuauauuuccuuaaaguuauauuugacuucuccauuuuccgucguccccuguggucagcuauuugccagguccccuugauucuaccaucacaauauuuuucauccuucacucuuugguuucaaccccacugccuuguccaucauuuuauuagacuauuauaauagauucguaacuuacuuuuauuucaguuucacauugauucauuaacuuuucuccauucuauauucugccuugacuugucagauuaauauuacuaaaguaagaauuuggucauucacuugcuaagaaaguacagguaguuauuaagauaaugccacaauuuguuuccaauuuauucuacucugauucuccuucagcguuucauuuuccaaaacauguuuuggcauucuuccuuugcacaugccauuucuguugucuugagugaauuaccaccuauaacuuagaauccuacucaucuuucaaggcuuaauucaaguacugccuuuuccuaggauugcccagcuacuuuuguuguuucugaauguugacaucuguuuuguauuuaauuacuuauauuuauguuuaucuuuacaucucccauaaugcugaacauauuggagacacucauuaagugaguuuugaaugaaugauuguugagauugacauaggaaguauuuuaguagagaaaauugauggaauaagaucuucacucauccuaauugaaucuuucuuuccuucugaaaaacuugaagauagaagaaaauguaacuuggagacauuuuucugguaguggucugaaagaaugaaaucagcauacuuggaauuuaaggcucuucuugcuggcaagacugugcauuuagaaucaagaagcuucuuaaucaaaggauuaucugaggucuuacucauaaaacauguaugucuggcaccaguuuaaaaugagcuguuuuuaugagguugcacauggcccuucuccacucccuucccugaagcugauucuuaagagcugaaaccuagagaaguuuggucaugaaauaaaauaaaaggugaagaaagacuaaugugcuuucacuaaagucaauguaauauggaagauuuaacagguuaucuuacauguuuaacacuccauuuucauuaauaugccccacacccuauuuucauuauaggaguuauggccuucuuucaggaacaguuauagaaugacacuucauuuuuuuuucacuuucaaaauaugaucauugguaauuaucuauugaguaagaaggaagcagucuuuuuauguugguuuuaagugccacauuguaauaacagaaaaaauaugucuuuuguuaugauaaggaaauaaaagaaauggauaguauuuauguaaauuugauauaacaucuuuacuucacugaugagaugaagcaugauaucagguuuaucagcuucuaggcaaaauaugauuuuuaagagacaggaaauaaaguuuguuuuguaacuagaggaguuauuuugggguagauggaaaaaucaaauuauuauaguuggaauuuugccagggcagaagguuaauuagcguucuuauagaaauguuccucuacuuugcauagucuucaaggcugugauuuuuuuucuaauuagaaaauguuugaguauuuuauuuaaaauuuccuuuguguauaaaauucaaauuuauuuaauaacuauuuagugagcacccauuacaugccaggcacuauacuaaggcauagagauacaaagauauaagugacucuaccuacuuucugguuguucacagucugguacaaaagaauugcaauacauuuugauaagugcagugauagagauaugcacucauuuaccauuacucuauaugcacuuaaaaaaacagcugugaagaaauacucauauggcaccaagaacaaugggacggaagaaguauuacuaggacuaagucuuuuguuuuuuugaaaaacguguuuauuauuacuguuauuuuuuguagagaagaggucuugcuaaguugcccaggcugugcucaaacuccuggccucaaccaguccucuugccuuggccucccaaaacguugggauuacaggugugauccacggugccugccugucaggauuacguuugaaggaaguuuaacuuuuuauaccagucucacugguuuuacuuuuugaacacucugccugugucuaugcaaagugcuggcauauagcacauaucaaaguaauuagguggccuuacagaacucauauucacagauagauacauuuguauggaaguuaugauuaauaaucuuuauaccagaugauaaaggauuuagcaacaaaacaaaaccauggacuauaugaguuguagaaaucagaaaaaguaaaagugaugaaagcugguuuuuggguuuuuuuuuaauuaaugaaauuugaagauugcuauuuuggaguuaugagucuacuuuuaucuuuggcuuucucuguaacauacagggccuauuuucuguaccauuuucugauucuuaaacauugucauuuuuuucuccauuuguuuucaguauuguccugccaggauuuuauguucuuugagaacagaaacuccaaguagucuuggguucuucacagcaccuaugaacugcaguguuaaauaacuaguauggacagaugcucaaugcaaauuugcuaaaacaaacaaaagaaguaggauuuuuguguguguaugucaaaaaggauaguacaaagauaugauaauguagccaguauuggugauuuuaguucuacagaggguggaauuuuucccucugugguagguuaaaacagcuucuggucaacaaauagaauauuucucugaagaaaaagggaaaacauuucauuugauuuugaaugagagggaacauaauagauuugagcauuugaaggacuggauuucugaauuuugaaugguaggauggcuucguuuucaguuaauuauuaccacagaucuaaauuuaugcagacaccacagauagacaggacagaauaguauuguuaauuugaauuuuauagauucugaauugacuguauguguaacacuuuuuauauuggucuacugauuuaaaguacauguuaaaguacaucaaucucacauuagcagguaaauauaaaauaauaaauguggcuaauacaguggauuuggggagaagaaaaaauugaauaggaugugugcauaguucuuuuuccuuuuccucuuuauucuuugucccucaucuccuuuugcuguagaauuaagagggaagguuaucagacugagacuguuaugaauuggagauaagagauuugcuguauucugaaguaauacuaauagguuuucuugauucuuauuaaucuguuaggauucuaggcauauuuauaaaauugacugugcauggugcuguuuuuuucucuccgaugaccucccuuucugagcuuccuuucaucucuagacuugucuacuugucugaauuucauuaauucauaagcaauuuuuuuaaguuuccuucugucccagaauacaugcaagguucugagauaagauugugaugaagauacagccccugcaccuuuggagcauaaaauccaaugaaagaauaaaaacaaauacaaaucagugugaguaagggugauacaguaggaguacacagagggugcagugggagucuguaagaggggcaccuaacuucaguaugcauauuuaggaaaagcuuguaagaagacugauucuuuucuuaaggacguccagcugucucucaucuucuaaagcugccuauaacaagaagcucugcccuuuuaaauuucccuucugucuuccuuacccauccaaaacuacuuuccuuguuugcuaaaaaacaaaacuuagacauaaaucauaauugauccucuuuuuuuuuugagauggagucuuuguugccaggcuggagugcaguggcgcgaucucggcucacugcauccucugccuccuggguucaagcgauucuccugccucagccuccugaguagccugggacuacaggcacgcgccaccacgcacagcuaguuuuuguauuuuuaguagggacaggguuucaccauguuggccaggauggucucaaucucuugacuucgugauccgcccaucucagccuuccaaaugcgcccagccagaauugauucucuuaaggaucauuugcauuaauugauaggaguuuauuaacauaaaaguacuuacaauuguacuaguagcauggauagaggagaaaauccaaggucaaccuccccuuaaucauaauaaaauaauauuuaacguguaggaacccuuaauauuuguuagacauuaagcuaacuacuuuauauauuuuuuuauucaagugagaggugcaaacauagcaaacuccuugacuccaaauacccguuucccucauguuuuacagguguccuguucucugcaggcaucugaaaaaaggucuauuuaagaagcccagguugcuuagcacugcagucacccauauuagaaaccuuuaauucauuaauuuucagcuuuugugaggugaggugggagaauggagaagcacgaauauaguaugaaaaaacguauucaguguuauaauugccuugauuucuaaagucacaguaucuaauuuauuuugaaauuucaaauaacuauaagggagguugugaaauauuuguuuccaaaagcaagcauggauuuuaaaagguuccuguaaaaugcugcuuagucuaauaauuuuuuuuuuuuuuuuuuuugagauggagucucucacucugucacccaggcuaggcuggagugcaguggugcagucucggcucacugcaaccuccagcucccagauucaagcaguucuccugccucagccucccaaguagcugagauuacagguaccuaccaccaugccaggcugauuuuguuuuaucauguuggucaggcuggucucacuccugacuucauucaggugauccaccugucucagccuaccaaagugcugagauuacaggcaugagccaccaugccuggccagaaucucugauucuauuuauuauaugcuagaauuuauaaagaaugcuuuuuuuaaacuugauuuauauauucauauccuauuuuauagguguccuaauuacuugaaggaaguaacacugaacagauaacaaagguugaauucuaauguguuaucaccugaccucauuacaauuuauuguuuugugagaguggugaauauguuauuuaguauuuagaagucucuagaauuuagggguaacacauuuuuaaauguugaaaaucaacuuuauugagguaaaauuuacauaaaauaagaugcacuaauuguaaguguaugguuagaaaauuuugacaaaugacuaugcauacucauguaaacauuaucuuaagaaacagaacauuuccaucacugcagaaaguuccuucauuucauuuugcagucauucccacuccucuuccgugcuucuccccuaggcaguugcuauucugcuuuuuguuguuuuaguuuaguuuuuccuuuucuauguuggagucauguaguguuuacuuucuuacauacugguuucuuuugcuuaccaugauguuuuuauguuucauccauguuuguuguaugaguaguccuuuucuuccuuccuaauacauuguauggacauacgacaguuuguuuauccauucauccguugauagacauuugaguuucuaguuuugggcucuuaugaauaaaacugcugugaacauuuguguaugucuuucuguggacacaaauuguucuuucucuucagaguaaaauuaauggaucauaugcaaauauaugcuuaccuuuauaagaaauuuccaaacaguuuuccagaauguuagcacauucccaccagcaauguuauaauguucuaagaguucuaguugcuccaccucuuugcuaccacuguuuaugauuagccagacuaguugguguauagugguaucucauugugguuuuaauuuguauuuuccugacgacugcagcuguuaagcaccuuuacaugugcuuauuggccauuggucuaucuuuguaauguguuuauuuaaguauuuugcccccuuuaacauuugucuuccauuauuggcuggagaguugcauauaaucuggauacaaauucuuuaucagauauccauauugugaauauuuucucugugguuugccuuuucauuuucuuuuucuuuuucuuucuuuuuuuuugugacagagucucgcucugucgcccaggcuggacccgccucccagguuggacccgccucccagguucacgccauucuucugccucagccucccgaguagcugggacuacaggcacccgccaccacguucggcuaauuuuuuuguauuuuuaguagagacaggguuucacuguguuagccaggauggucucgaucuccugaccucaugauccgcccuucucggccucccaaagugcugcgauuacaggcccggccugccuuuucauuuucuuaccagugucuuuagaauagcaaauguuuuaaauuuuuguccaguuuccuagguuuuuuuucuuuuaugguuuauaaacccacccuaaggucuuuuuuuaauguuauaaaauauuuuguuacauguauuuuaucuguuuucuuuuucuuucuuucuuccuuuuuuguuuuuuuaauacccuaaggucuugacgauuuccuuuuguguuaucuuaugaaaaauuuuagcuuauguuuaggcccaugaucugcuuuaauuuuuguguaggucaugaguucaaggguuaagguucauguuaagcuacaguaggcucauguacucaugaugugucauuaucagcaaaaauagauauguauauacacuguguguauauauauauaauuuguuauauguauauguuuucuaugagccauuguacacacagucuauauauauuuuuuauuaacauaucuuuagcauaucguuugguugguaaaucagacuuauauuuaaaagauuguggcuuuuuguauaaaaaucuuuagaaaaaguuuuuauuuucuauucauuaucuuuguguuguuuuaccuguuuuauauauugacuucggugaaaugcuuagauccugcaaagcugaaaauauauguugucucuggcuaacacagaguucaagaucuucagaucuggucuaugauaaaacagcccuggguacuaaucaggguucuacccuggcaggacauuucuauuccucuggcuggggcccucuuucucucaccuugcccugacaguuuucauuugcuguuuagaagaaacacaaauucucccuuaggaaucagguaaguauaugaaagagaugaaggaacugguugagcucacagauucuuuaucuuuucuauuuuuuucucuuuucuguuucuguuuucuauaagccaggguuuuucuucccccugaacucuuccuuucucuucccuucuuuggggaauaacuucagguacucuguaagcaccuccuuucuuuuuacuguuuuccugaguauauuuucuugagagugagacuggauuucugcagaauuuuccuugagaugcuccuagccccauguccuaagaugguugauuuuucuuggguuaaacaccaauuaggguaccaaaaacucagggcaguggggcagggggagaauuuuuuuacuacagagaaauagcauggaugugaaugggcuuuccuucuagcugucucaugucuaauacuuaauauuuugcaguuugccauagcuguuuuuaauauuggagcaauucuauuauacuccgccagugagaaaacaguaugugugacucugugguguucuuguguuugcuuuguugauggugguuaguguucuuauuuuaccauguggauuuacaugugcuacuuuuuguuucuccagauggaacacaguuuauuacuaauauauaauuauugucuuuuccuuucucuguuuucucuuccuucuuguuuuacacugugguucuugugcaggucuuguucagcguugcguaaucauccagaaagaugacaauggauuugggcugacggucaguggagacaauccagucuucguacagucugucaaagaaggcaaggcauuuuaaaaaacaauuuaucacucaguaaacagaguaagaauagaaaagcuuaaauaauggcaauugccaagaauagaauaauuacauagauugcaggucauguggacuauugugcuagauucgucuaucaugucauaguuacaggaaggaguuuacuccaguugauuuuuuuuuguacuuguuagaaagaaaucaguuuuuauuuaguuuuagaaaucaugugacuccuuggucaugauacuuuauuguccacacaaaaguuucugaaauuucaguuuuccauggcaccacugauauuuuggcaaagacagauuaaagagauagcuauggcuucagaaauaccauuuauuuucccaaaacaacagugauaauauuuucuacugcuguuaccauauauugaauacuuccuuuauguugggugcuauaauuuugagguagacaauuuuuuuauccccauuuuauaggugauauugaggcuuagaguaaagaaacaucaaaucaguccaaggucacacaacuagugaguggcagaagcagcauuugaauguaaagucugacuuuacagccuuguuuuuuuuuuuuguuuuuuuuuuuuuggagauggagucucccucugucaccagacuggagugcaguggcacaaucuaggcucacugcaaccucugccuccuggguuaaagcgacucuccugccucagccugccgagcagcugggacuacaggcacgugccaccacacccagugaauuuuuguauuuuuaguagagacgggguuuuaccauguuggccaggauggucucgaucucuugaccucgugauccgcccgccucggccucccaaaggacagcccauguuuuuaaccaguuuguuauacugucucucugucaggaagaugaucaguaaaugcaaaugaaucacauuuuaagcaauuaauuucucauacagauggagcagccaugcgggcuggaguacagacaggugaucgaaucaucaagguaaggaauaggcuauuauagaauuuacgguaggauuaaaaaacaacauauauuggucauauucugauuuuuuucacuuggauuuuuauaaaaagcaucauacuucuauguaugauagaucuguugacuauacaaacuuauuucauuuguuuuaaaauuaauacuacccuuuacugaaggacguaauaaaaggauugaaaauaauggaggaauauauguucuugaguaggagaguaauucaggguuggaaagaucauuucugucuagauuagucuguuauuaagcaauucucaucaaaguacaaguugaacauuucuaaucugacaccugaaaugcucccaacucugcaaguuuuugaguaccaacaugacaccaugaauggaaaauuucacaccugaccucaugugaugggucacagucaaaaguugguuucaccagguacaguagcuugagccuguauuaccagcuacucaggaggcugaggugggaggauugcuugagugcaggagcugagacugcagugcacuuugaucauaccugagaauagccacagcacuucaaccugggcaauauagugagacccugucuuuacaaaacaaauaaaaccaaaccaaaacaaaaaacuugguuccaugcacaaaaguauuuaaaauguauaaaacuaccuucaggcuauguguauaagguauauaugaaacauaaaaggcucauauuuaaaccugggucugauccccaagauguaucauuauguauauacaaauauuccaaacuucaaaaaaauccaaaacacuucuucugguaccagguauuucagauaagcgauaccugaccuguaugcaaauagaauuguagugguagaugucuaucugauuauucuuccagaugaacuuuauaaagauauaagaaucacuaaagauaaaaacauguuauauguauguguauguaugagaagagauguauaugacucuaaucuagauauagaccuaccaguggaacacaacagagagacuagaaauagauuuugaauucagaucaguagagaaagaauggguuaguuaguaacuauucuuuaaauaauugacuaauuugauuacuuaaaaucaaauuauuacauaagaaaacauaccaugaaaaauaauuuggaagaaauaucugaaacguaucacagaccagauauccuuaaauuuaaagaacacuuuuaaauuauaagaaaggaauaaauauucuaaaagaaaaaugggcaaagaauuuuaucaggcaguucccuaaaguaacugaaauacauaacauauuaaugaggauauggccaaccucacugauaacaaagaagaagaaauuaaaaugauaggugaaaaauacauuuggcugucagaaaauuuaaagauugguaauacacauuuaguauaguuuggguaugguaaaaugacuauucucaugaguucguugugaguauaaauuagguaaaaccuguuuggaugaaagucugugaauauguaucaaaagccuuuaagaaaguauauaacaugugacaagcaauuuugcuuuuaggaacuuaucugaggaaauaaguguacaaaugugaagucguguguacagggaaauuuguacuggcuuuauuacauaacugugcauaaacugagggacagagaaauaaauuauauuccauuugcagcuuuugaaaagaauggauuaggucaguguguaucuuuauugaaagauagcugccguacagugaaaaaaaaguuuuauuuuuuuuuuccaggaaaaagccagucguaauguauaauguuuaugugucucuuugguguguguauacuagaaaagugucuccaaaauuaaaugucauagcuaacaguaacugccucauggggcaggaugaguauacuuguacuucuguuuuuuacacugauauauuuguauuuuagauaacuuggaucagagaauuaaucagaaaauuaauguuaaauccacauuugauaguuuugccuugauuuguuugguuuaauucagaaucgggauaacauuuucuacauuuagccggucugaaaauuaauuuucuuugugaagauuagaucaugguugaaaaacuaaaagcaaauugaauauuguggaaauacuuauuuuaaaaauuauuuuuuauuauuaauuuugacaaauugaugacuugguaauuaaaagcaaagagaucuuuucuauuuguaugagcccuucaccgugaacgauuuguaaaucuguuucauguuauguuuugucauuugucauggugaauaaguuguacuguuuuguaugucaaggccucgguuuauguuuaaguucauuuuguugcugaauaugcccuguagaaucauggugugaaaaugaauauugaaucaaauacauaaauauuuuaauguaaugugauuacuauauuauauugguuauauuauguaugauaauucuugaagucauuuuauccauugucucaauagaauguaucugacauacacuacuuucguuuucuuacaggugaauggaacucuggugacucauucaaaucaucuggagguggugaagcuaaucaaauguaggugaauguuauucuuaguuuuaauuguuuucugaaacccuuaaaguaaggagcagcaaauuuccuguaauaggccaaauaguaaauauuuaggcuauguggacuauauagucuacugccgacucugucauuguaucaugaaagcagccauagacuauauguaaaugaauggguguggcugagcuucaguaaaacuuuauuugccaaaagucugugauccugguuuagccccuuggcuggaguuugcugaucccugcauugaaggaaaaucugaggugaaaacucuuagcuuacuaauagcuaucuuuugucaacuccauuuauaugguugauuauaauauuccugucauucuugguaauauuugauacauauauuugaaagaaaugcaugagucaccugagaggaaggagguugagaagucagacauauggccugaugaacugaaauggaacuuuaaaaaucaucuagcacaaucacuuucccucagauaaguaaaugauuauauaauccagaguagcgaucuucucuuggaaaucuuuaggguuaagaauuugugaucuucagguuugagugaauagcccacuuggacuuaguucucuguggagaaacaggcuugaagcagugggagucugcagcuaaccucccgucacuugcagggucaaagguggauucacgaaccucgagcuggcagugaguuaugggcaagccaggccucagccacucacagggccucaguuuucccaucugcacagggagaagggaagguucaguggcccugugagcuuugcuagcagguggugauggggugggucaucugaaucugagucagguggaaucuuccccaaccugggcuuugguuucauuuuguuguuauccuuuaaccuuaccugcuuuccaagagagauuuuauguuuucuugguuuuuuuuuuuuuuuuguuuguuuguuuuuaggguagggucuuguagaaugcaauggugcaauuauagcucacuacagccuccaacuucuggguucaagugauccucccaccuuguuuuuuguuuuuuguuuugucuuguuuuuuugguagagacaggguuuugcuguguuccccaggcugcugucaaacuccugggcucacccaucucagccuccuaaagcgcugggauuacaggcacgagccacuauaccuggccaagauuuuauauuuucuaauugcuucacauacugaauggaaaauagcaugacaguuauaacagaaguaaagaaagucacaugagaguccaccaccuaaaauauaacuuccuuuuucuuuguucuggccugguuugggccguauguauuuguuauuguaucucuuaaaaaaaaaaaaaaaaagagagagacugcuugaacugaaugaaauuuuuuuaaaaaaggaauuaaaaaaagaauuuaugaucuucugcaucagauuauuccacaguaaaguagacuagaaauaagagauaguuguuugugaucaaucagaaucacuacuguuuuauuuaauucuguuucucuguauuggguggauggacaucuucaaaagaaauuuaauaaacuaacuuuuuucuuggccuuuuuacugcuauguuaagcaacuaugaaauuuuuuaaacuuuuucaucagaguaccagugcuccaaauggucacuuugaucagcguucuuuaguuuaaaagagugcagugaucaaaauuagauccccauacuugaauaaacuugaccacuuauuuaaugagaaugugauuuauaaauuguuaugugcugcauaaauaugguuuauguuaaugaguuuaugccugauguccauugagguguauaaaaacauuucuuuagcuuucuagguuauauuuuuugcucauuccaguauaaauuuuacuuaaaaaauuaaauccugggauucuagcaauaaauuacuuacccaauaguaagggcauagcuaaaaacuuaaaguaaagcauaaaaaccucugcauauccaaaacugauguaaauuugacaucacaucuguaaagccuggguguauguaacagaguuccugcauguccuacuuucuaauguguauucuggauauaauaaaagugauaucaaaucagagcaguuuagaaacagcuaaagaaaggaagggaaaagcuaggaagcuauuaaaaccaaauacauaggcaagugagauauaauagaugacuuucugauagagagcaauaagauugaagagccuuagaaaguguuuauauguaaaauuccuccaaauuauaacacuugugaguauuauacauagcaaaacuaguuuuuagaacaccaaaacacugugaaauaauugauaaugauuuccaugggaggguuaaauugggagacaagugugaaauacauuuaaaaguucuauugaaauaucuaagaaaaaaguuuugccauaucuauuacugacucugauuaugguguuuuuuuuuguuuuuguuuuuguuuuuguuuuuugagacgaauucuuguucugucacccaggcuggcgugcaguggcgcaaucucggcucacugcaaccuccgccucccagguucaagugauucuccugccucagcuucccuaguagcugagacuacaggcaugugccaccacgcccggcuaauuuuuuguauuuuuaguagagacuggguuucaccauguuagcaaggcuggucuugaucuccugaacuugugaucugccugccucagccucccaaagugcugagauuacaggcaugagccaccaugccuggccugauuauggugauuuuugcugucuagauucccgccccccgcaauaugucuacugaauuccuguccauuccuccaaauauuuucuacuaaaauuuacuacuuauuauugauuguguuuuucccuguuauuguggaauauuuuuuggucauacucauuuuguaaaguuaauuuaaaauugcauuuuauguucuagcauauucacuaaacccugccuaguuagugucaucuuaaaauaugaagaucuaggccaggugcugugucucacaccucuaauccuagcaccuugggaggccaaggcggguggaucgcuugagcucaggaguuuaagaccagccugggcaacauggcgaaacccuaucuuuaaaaaaaaaaaacauugcagcuacuugugggggcugaggagggaggauugcuugaacccaggaagucgaggcugcagugagcugagaucgugccgcggcacuccagccugggugacaaagugagacccuaauuaaaaaaaaaaaagaagauuuaaaaaauuuacauuuaagaaauuaauuaaacauagccacuaauagaugguugauuuuaacacuccucuaaauaaagaaaauauauaauauauucuuggaguuauaaauuuuauuugcuuuuaaguaauaucugaucuuacuaguaguaacuugcuaucugaaaacggcaucauucuuuuggauuuuuagggcagucauaaaagagaaaugacaaauuaguuuuuuuuucuguggagacaugauguagcagaugaugggacugucuuacauaacuggaucuuuuagaacuaucgaagauuaaguaguaaaaugguauaaaaaguuucuugacaauguuauuuucccuucccuucccuuuuuccgucuccccaccccaagcugguuccuauguagcucucacuguucagggacgcccaccugggucgccccagauuccacuugccgacucugaaguagagccgucagucauuggacauaugucucccaucaugacaucuccucauucaccuggagcaucugggaauauggagagaaucacuaguccugugcucauggggguaagaauggggaaauuucuuaguuaaaugcucagucuuauaaggauguguuuacuuuauauggagaguuuucaaguauucggcugaugaacuaauuaaauuuaagauuuuagaaaaugauuuacuaauauaaaaauuacauaauaggaaugauuagaauauugucauagcagauuuaauuuaacaaguauuagacaccugccauauguaaaacagugugccacccacagaaauauaguuaagguacucuauguucaagauuauagucaucuuagaauguguacuuuuaggagggcggggauuuuuguuuauuuuguuuacuguuacguuuccaguaccugaaauauugcuuagcauguagaaggugcuuaacaaagcuuuguugauugagauuaagucaagaguauacaaguaacuauaauacaaggcagaauguagacauuaugagggcaaaaaaaaugcuaaguucuaugaggauucaaaggagggagaaagcacauagaagaagaacaauaaauagaaggagccaaaaaagcaucaaauauuguggagaaguagcuaggauuuuugguugguuggugccuguuaaggaugugcauagugggagaugaacuugaaaauaguagguugacuauauauuuugaaaagucacaucucccaagcuaauuuacauguaacuagauaagcaguaagaauccauucaauguuguuucuuuuuaagcaaaagaguacaugauuauccuaggauuauaggaagacuaauuugguaaaauauuauaggguugugaaacaaggagggaugaugggugaugaauuagggagcugucuucauauuucagguaagagguacugggaguuugagcuaugcauggggaucgauaguaaagauccaaaugagggaaaguaaaagauacuauucuuauacuaagacaacuucauuucuccaauaucaauauuuaguguucucuugaauccaguuuaguaaaaaugaaauagaagggcagacauuuccuuguaguuucuuguaagugucaugucugaaagccuguccacauaacccggaaguaaaaaccuaauagguauugauaauuggagccgaggcagaacuuuguaugccacauuuucucuauuuauuuuagcuucauuuugucuauacugguuguuguuuguuuuuuaucuuuuucuuuucuaggaggaaaacaaugugguucauaaccagaaaguagaaauucugagaaaaauguuacagaaagaacaggaacggcuacagguauuaaaugagaaguagggcuguuuacaggccaauaaaaaugugagugggcaugguugaguugguguuuaucagucacaaucaagcagcauuguaaccaaugccauuaguuauauuauugauuaagaauggacuauuucuguaucuuuuuuacauaaguaauuaauucugaaaauauuuuuauaacuuuucaguuauugcaggaagauuacaaccgaacaccugcccaaagauugcuaaaagagauccaagaggccaagaaacacauuccucagcugcaagagcaguuauccaaagccacaggcucugcucagguagcaucacuauuacaagugcuacccaacuuuuugcaggagaauuuucuucugggaaugugucagagaauguugcaguugccuuuuuuaaaguuauuuuucuagcguaggacaacaggauguccuguuaaggauguuacagaaguaaugauuaacaaaaauaaaugugggcgucugauuguuugcuugcucaugagaucacauuucuuuguuccauaauaauuuaaaaaagaauugagugcuuuugcuuugaugugacaaacuacuaaaauguauuuagauauauauauauauuuauauuuuuugugguucauucugccaucuuaaaacagaauggcaguugauauguuuuuaaauaggaauuuaagaauuuacaacaacaggcauugagcuaaauauauggacaagcauuuucuuauuuaaucugcauaacaucucugagguuacuuaugguuguuuuccuccaguuuacauauauacuuagagagaguuagagagauuaaaugacuugucugaggucauauagcugcaaaguaauagaacuggaauucaaacccagucugaggauuuaaaagcacauucauacucuuaaugacuauauuuuuauuguaauuuaaaaauagauuucaguagaauuugcuguauaguuauaagcuauagagauaauggucucauaagaaaaaaaaagcucagcauuuauauguuaaccagacuuacauucuguaauauucagauuugggauauguaaagcaccuuguacuucaucuuaaagcaaaguagauaaauugccuauacauuuaaaauagguaaaagcuguuuuuuugucacuguucccgaguuaaaucugaagggaaggcugcauauucgcaaaagaauucuuugagaucaucuagccuaaucugcuuacuuucugauuuaaaaaaauuauguuauaauugagaaaccuagggucuaaacugguuaaaucaccuauacaaggccauacaguauguaagguccccugacauccugguuuaguguacuuuucauuccauuguuuuuuucauuaccuucagucccaguagcgaugucacauuuugaguguuacaccucaguaauguugacaguuuuauguuauuacuaggcaaauauaauauucuuacccuguuuggacagcaaucuaaaugcuuauaaccuggccaggcgcaguggcucacaccuguaaucccagcacuuugggaggccgaggcgggcagaucaucugaggucgggaguuugagaccauccuggccaacauggugaaacuccgacucuacuaaaaauaaaaaaauuagacaagcuugguggugcaugccuguaaucccagcuacucgggaggcugaggcaggagaauggcuugaaccauggaggcggagguuacagugagccgagauccugccacuacacuccagccugggugacagagcaagacuccaucucaaauuaaauaaauaaauaaaugcuuauaaccugaucuaaaugcuuauaauaauuuauguuauaguauuauguccuagaauuggccauugauugacacucugaagcauuggaagguaguuaacaagaaacuauaggguaauaaccuuuauuaaugggcagacaauauaaauuauauaaauauaaauuacauaaauuaacaaaccauuuuaucuuuuugcuauauuuagaaguuugaacuuacauucuuuuuaccaaaauaucacuugcccugucuuuaaggucaugacauuuuagaauaccggaauuaguaguuauuuauggauuuuacucguagaauuuuaaacauacuugagcauaucagaauguccaacuuuuaguagucuccauguagauuguaguaccacuauuucuuuaugcagcaaguaaugaaaguuuucuuuuauguguuugugugcgcguguuuuucuuucaucuguuuuaggauggagcuguaguuacacccuccagaccuuuaggggacacccuaacagucagugaggcagaaacagauccuggagauguacugggcaggacugacuguagcaguggagaugcuucucggcccaguagugacaaugcagauguaagcuuucaguuuucuaaaucuuuuuucuucuguauucuucuuuacagccccuuucuagauuugauuuuaagugaugugaauuagaggugucuuagcacuuuuuaccauccccauuuuuaauguaccaauuugauaaacagaaaucugguuacuguuauauauaagcuuuuaauuccagaguucacuuuuucccuugaacacccauugccaacuguuucuuuuacagggauggaauuucccagcaggcaucuuguucguggguagagaaguuacuaaugccagugcauuuuuacugaaccgagagaccaacuguugauaucuuuaagagcauguuaauauuccauuuguggucagagugacucagucuugaaucauggggcacuuugccauuaccaagaggaaaaaccucaguccuguuagauaggcuucaguuaauagcccagguuuagugacagcacuuucuugauuaacccagaaacugccagaugaacaugacuaucuguuaagaugauaauaaaacauuuuaagcugaauaugauguaacaccauagacauaugaauaccuaaaagcuaaguucaguauuacuuacccagcaauacuuuguaaauuguaugcagugguaggaauaaugacuuaaauguagaucacccucuuuaaaagugaugagggaagaagucugaacgaauguuuuguaauugugggucaugaaaucaauuuuguggguuguauuucuuuuuuaaaaaaagaauaggaaauacagugcuuugcauauagaagaggugucacuucuugggacuuuuguuacauauacacacaucuacuauuuaacaaugugaaguuucucucuuauugaagguuguuguugggggauuguuuuguuuuguuguuuuuuaaaaaggaagccguggucuaagccaucauucaggcuaucucuugaggcuuaggcccaaugacccaguuccucaugcaaaaaacaaacugaggauuuguggguuuuuuguuuuguuuuguuuuguuuuuuaagguagugauaggagucuugugauuggguuagcuaaagguuuuaauggaaaauuucaauuugggcucaaggaaaaaaugguagucacuaauauuuguuggguauaugucccauacacggugauaagguuuuauguuccuuaguuaauucucaaaacagccuuaugaaguaguacuguuguuacuguaacuuuacaaaagaaaaaauugaggccaaagggaguuaacuaacuuuccaaacuuauucaggcaauaggugaucuacuuccaccuagcuccaaaauaccaguaaucgaaauauaaacaaaagcacugagguuugaaaaugcguaacauuuugagagagcagugagaauuuuagggcaaccuggcauauuaggguuauagauggaauggcuagagauuaucuuagaagccaaaucaugaauccagguuauaaagggcuucaacuuguucuagcaguacauaccgcuuuugggaaugcuuuucguacucuucuuuuuguuuuaguaaugcgucuccucgcuguuuucauggcuugucccuaccaugagaugggaaguuccuugagagcagagggacugucuugucugacuuuauguuuccaaaguguagcaaauuguaggcauucagagcaaaugauacgaaugagaaauuugaauuuuaucuuguauuuagaggaauguuacaauaaaacaugugacuuagaaauauaaccuuauaaaagagugaauuguuggcugggcgccguggaucacgccuguaaucccagcacuuugggaggccaaggcaggccagucacaaggucaggaguucaaaaccagccuggccaacauagugaaaccccgucucuacuaaaaauacaaaaaaaaauuaacugggugugguggcacacgccuguaaucucagcuacugcagagucugaggcaggagaacugcuugaaccagggaggcggagguugcagugagccaagaucgcgccauugcacuccagcaugggugacagagcaagacuccaucucagggguggguaaaaaaaaaagagugaauuguuuaguauagaaauaggcauuccaaucaauuaagacuguuugacauguaauugauacuuaguauuugaauacaugaaaucaaugaauaaagugggcuuuaucuugcaugcagaagagagacaccaucagaaacauaucuguggaaaaugauuugguguaaagagggagaucuguaagaaaagaagacugcuuggcuuaauaggaacuuuaacaaaugugugcugaauggauaauaguuagcauuuauucaguaccuacuuugugccagagguuguacccaaugcuuuacagauacucuuuuuuaacacucauaauaaucuuaaaaaagcaguaucaccauuucauagaugaggaaacugaggccaaauaaauaaaugaauauuguggaaauccgagugagaaaugauaaaguccaagcuaggcuaucuucugaacacagaacacacagguuuaauuucuacaagugucugaggcuaaagauguguugcuuuuagcuuauggauuuccauguuuguuucaauuuuaaguauggaggacccggucugcuuuuguuguuguuuuaacaguacuuugagucgcgguuuuacauuuuaucuuuugaaucagugcuuuuaacuuuuuucauugucuucucauuuuuauaaaauaauuuccuggugguguuugugaaaguucccugcuuuugcuuaccuuggagaaggcuuuaaagaaugcccugauacccaguucucacaagagaagcaacuugguaacaaaucaucaucugaaauucagagcaucuaucauuuugauuuucaguuugugagugauauuuuugaaaaauuauuuauuuuggaaaauuguuaaacauauucaaaaguaaagacuaacauaauccuccucaugucccugagaaccuagucucagcaguuuuguuuguacccccuauuccucacauccuccaaacaccagauuaaaguaaauccaaggcauucguuuauuaauaugucucucucuaagagauaagaaguuuuuaaaauauagcuauaauauucuuauuaaauccuaagaauuaauauuuucucaauacacaauuuuauuaccuuguuuuauaaugaucuuuuuacaguuuauuugauucaggauccagucaaggcuuucauauugccauugguuaauaagucauuuuaagucuuuauaauuuauaauaguuuccuucuuuuuuuuccuuggccauuuguuguugugguuguuguuaaagaaauugagucagauguucaguaaaacaauccauuuucuaauuauauuuucauggugucguaugacauguuccuuuaucuaaauuuucuuaaaacuccuaguuaaaucuacaagucuugaucacauuagguuugauaguuguuauuuggaauaauucauagaugauacuauguacaucucauuauaucacaugaggaugugaauggcugucuuacugugguuguaagcuuaagguguuuaggugauaucaacaugauuuccuucauuauaacguccccugucaagcuuuuuuuuuuuuuuuuuuuugagauggagucucgcucuguugcccaggcuggagugcagugacgcaaucucagcucacugcaaccuccgccucccggguucgugccauucuccugccucagccuuccgaguagcugggacuacaggugucugcuaccaugcccggcuaauuuuuuuuguauuuuuaauagagacaggguuucaccguguuagccaggauggucucgaucuccugaccucgugauccacccgccucagccucccaaagugcugggauuacaggugugauccaccacucccggcccccaagcuuuugugaaauguuuucacaugccauuuaugaucaaaaugccuagauccauuguuuaauucagaguuucaaaaggauauuauuauaauuuugucaguauuucuguauuuauuacauggaguuauguuacaaaaaaugauuucccuuacuagcuaauagguuacccuaaaauacagcuuauacagaaaauguaggguaaauacuucucuugauucuuuucagaagaguuuuuucaggagagaugauacucuuacaaacuccaaaggugacaagugggaaggguauauguguguaauauuuugaacucauagauuucaguaugaguuacucuuuucuuuuguuggugggagcccccucaaauuuucuccuguguucuuuugacaugccccuccaauaucuuugauagcuuucuugcuuuuugugacagaauuauucuaaucuuuuauauaucuuguccaagaccugaaagucauucauuucuccaagguggggcauacauuugaaagugcuguuuucucuugguaacagaaauaucugugauaccaccaagauaucuugcuauaugcauagguaaaauguaucuucccuauuggcacucguuaggucucugguuccucauuuucauugcucuaaagaaugucucccguugcuuugggguguuccucaucuccacaaagugaguuucugugucucauauaguucauauuuuauacagaaguucucaguauuuguggacagcaucuguggauucagccaaccauuuaucaaaauauucagggauagaaaugcaucuguacugaauaugcacagacuuuuuuccuagucauuauccccuagacaauacaguauaacaacuauuuauacagcauuuaugcuguauuagguauuauaaguaaucuagagaugauuuaaaauauauagaagauuugcguaugcaaauacuauaccauuuuauaucagggacuugagcauccauucccccacaaacacugaagaacaacuguauuagguauuauacaauaccauauaaauguauuaaaauccaccuuucacaugaagcgaguaacagaauaguagaagcuuaauuguacucauaaguagggcaaaaugcuuuuagcuuggauagaaaggauaguuugagaagguaaggauuaaggaagauaagagaguuugauuuugacauaaugaguuugagguaugcaguauaucuaauuauuugguagaaaaguaaccuccaggccuggagauuagguaaaauuguuuuguugauucuguauuguuuaucaauauaaaauugaaaaggugagagaauaagugacuugccaaaguaaggaaaaaguagcagaaccaagcauuuuacgaaagauauuuaguaguuguaaauacaaauaugaaauucagaacaauuuuuuuuucacacuuuuuucccucaucuccuuuuggugugccuauugaaaugaacugaagaucuuguuuuuuucauuagagucccaagaguggcccaaaagagagaauuuaucuagaggaaaacccagagaaaagugaaacaauucaggacacugugaguaugaaauccaugcaaugauagugcugucuuuggcuuuccuuauacuuaaaguaugguauagacacaucugauguuuacauauuuuauuuuuuauuuuuuggaaaaaaaauuaaaauuuauuaaagaaacuuaauaaagauuugaauaagucaagagauauuccaugguuuguaaguauucuuagguuccuucauauuugucguggugguaacauaaaauguacuaguuuaaccauuuuuaaguguauaguggcauuaaguauauucacauuguugugcgaccaucacugccaaccaucuucuccaacugcaauuugguacccgguaaacacuaagucuacauuucccccuucccccuagccccuggcagccaccauucuacuuucugucucuaugaauuugacuacuuuagauacucauguaaaaagaaugauacaauguuuauccguucaugacuggcuucucucacuuagcauaugucuucagcuuucauccguguuguagcaugugucagaauuuccguccuuuuugagaccaaauaauauuccaugacauguauauacaccacauuuuguuuaucuguccguuugucaguggguacuuagauugcuuccacuuuuugcuauugugaauaugcugccuugccuucaguuuuuguggguguucaucaagaagaagaauuguuugaucuuacguauucuuaauugcaugcuuuuaagcacucugauuuuaucuucuaauuacauuuauuuacaguuuuguaguaaaagauacaacagcauuuugucaucuuuuuauuguuagcaacauaaggacuauugaaaaaucagagacaucaaaucaguuauaaaaucaaaauugucugacuacugcucgaaacuaauuuauguuguuucaccuaauuucuuuuuuuuaauuuuuuaauuuuuccuuuuuuuaaagagggaguuucgccauguuggccaggcuguucucaaacuccugaccucaggugauccacccgccucagccucccaaagugcugggauuauaggcaugagccacagugcccggccaguuucaccugauuuuuuuuuggaauauuaaagccuugagguuaaagaaaauaauaagaguuguuaaaaggcagaauuguguuuaggagacucaauauguaguguugcaacacuaggaggaaaaacuacagguacauauuauucacucaguuuaaaacuugcggaucuguuuauacaacuucagcuauagccacuauaacugcugugcaaaugacucucaaaucauaggccuacccuucuuugcugaacuccauccagaucuugcaauguuaaacugcuguuagauuuaagccaaacucauuuuuuuccuauuucuuccaaaauuuuuauuccccaauccuauauggucuuuaauuuuaguacuuauggucuucagacauccuguauguauguauguauuuauguaugcauguauuuauguauguauauauguaugaaugagacagagucuuacucuguugcccaagcugcaguacagagguuaacuguaaccucaaacuccugggcucaaacuguguacccacuuuggccucccaaguagcuaagacuauagacacacgccaccacgccuggcuaauuuauuuugguuuuuuuagagaugggucuuguuguuuuucccaggcugguuucaaacuccuggccucaagugauccucccuccuugaccucccaaagugcugcgauuacaggccugagcuaccgugcccagcacccauguuuauuauuuuauauauuaaugccucuguacugccguuuuugugcugaaucuaacuuugugaguugacaaauggaggagcuauugcaugggaaacuaucugacaaucuacaauuuauucuuagaauuuuguuaucuuuguuucuauagcaguguuugugagauuacuugaugauuuuagagcauuguaucagugauuuuucaaucaagagugauuaugccuccguggacauuugacaaaugucuggaaacgcugcagcuggcaucuggugggugcauagaggucaggggugcugcuaagugucuuagaaugcacgggcuagacccuacagccaagaacucucuggcgcaaaaugucaacagugccgcaguugagaaacccugcauuauacauuuaugaaaauuaauuaaaaaugaaaacauagaguucgaugauagccuucaauuauguaucauuaauggaaaucuuggguuaguacuucucagguauauuagccucucugcuaacuuugucuuaccauuucugcucuuauuuuuccuuucuccuauugucuucauucacuuuuucuuuaauuuuuuaauuguaaccauuuauguaagccaacuuuauuuuuuucuguaagaaguuuuaaguauguaugaauuaauaaaagaauguacagaaguguacagaaaguguuaaagucagauaaccaaguguauagugagcaaaggauauuuacuguuuccaaggggagugguuuuuuccccccaaaaaaaacucguuguuguggucuuuuucucugccagagugguacauggccuugaaaauuugugaaccccuacuuugaaaauaaaguacuucaaaggaaauaaacaaaaagaaaucucaccauuuaagugaaccaugucuuuuugauggguuggcuuuauucuuuuucuaaauuugaccaccagguaauuuuucuguuucuuuucccugaauguugccaggacacucaaucacuugucggaagucccucaacccguauagcaccucauauuauuggagcagaagaugaugauuuugguacugaacaugaacaggugaugacuuuuuucuuucuaaaaaauagauuguuacuuucugcaauaucugauuuguugcaaaaaugagcacguucuggagauuaagauaacauuuguaaggauuugaagcuaaaucuuagaaccaauagcuccuuggguuaauugcuuauuuuagcuuugaccaacagaaaugaccuugcuuuuaaagccagugagagaucauuaauauauguuuaaguacuucauuuuauugggguugaguguguuucuuaaaauaguauuuuuaaaaaaaauuucaaaucccaguucauuggugcuauaaaggaauaugauuagcuagauucuuguccuuguauccugugaucuugcuaaauucacuuauuauuucuuggugcuuuuaaaaauaagucuuuuggaguuuucuacauagauaaauauguugucuauaguuuuuauuuccuuauuuucaagcuguuuaucuuuuauuucuuguucuugccuuuauugcacuggcuaggacuuccacuaugagguugaaucagagugacaagacaugcuugccuuauuccugcuauuagggagaaaacacucagucuuucaucauuaaguaugauguuagcuauaaguauuuuuuagaggcucuuuauaagguuaaggguuauuagguuaaggaauacuccugguuugcugagaguuuuuaucaucacuggauguugaauuuuguggaaugagauuauuaugugguuuuucugauugucuauuaauaugguaaguuauguugauugauauuagaauauuaaacuagucucgcauuccuggaaugaaccucaguuggucaugauauguuaucccuuuuauauauugucgguuucaauuugccauauuuuacugaggauuuuuuacaucuuuguugaugaaggauauugguguguuguuuuucuuuuuguaauaccuuugucugguuugauaguuggggguaaugcuggucuuuagaaugauuugggaauaugaaaauugugaugcuaguuuacauuauuauuguuuucuguguucaguauauuuagggauuauacaaauauucuaggauuugucuuacuuaaaaucauacaacuucauuucccaccauuucugcaauuagcccagaagaaaaggauaaacagcuauuuuaugauugggcaaaaagccuuccacugcauuucuagaaauguuagacuguuuuuuacauacugauuuguauacauccgagcuacuugauaaucgucuccuaaauuuccguucucccacaguggucuuucuucuaaccuauccccaagaggugguuaauguucacagaaagagauuccauagcuucuguugcuaauaaauuuuagugaaguuuuuuaaaucuugaauuuuuuauagggagaucaaagugaaauuuggauagcuauguucaauugagccuacuuugcauuuaguauuuguauguuggaguuacugaugcauaaucauuucuuccucuagaucaauggacagugcagcuguuuccagagcauugaauuacuaaaaucucgcccggcucauuuggcuguuuucuuacaccauguaguuucacaauuugacccugcgacuuugguaauauauuuuacaaucuagcagauucagaguucuucuguugauucaugugccauagaacuuuuccuagcuauacaacgagugggcagacuucuuucaguuuuccguauaaagacagauacaaaagauaauuaaaacauuauuuuuaaagacuugguuauauaguaauaacuacauuguuuauggugaccuaccuguuccagacauuccuacucaauggugaccuagcaaauuacauuuuucaugguuccucauuuugucuuuuucauuccuuucuccacuacagcucuguuaucucuauucagaccuguauaaacauaccaauuccaaagaaacucgucgcaucuuccuugaguuucaucaguucuuucuagaucgaucagcaguaaguugccaaguuaauguuguaaucuuugccuuaguacauggaauuauuguccuccugcuuccuaucuucccucccauguuuuuggauuuuacugugcuuucucacaccuguauuauauuucaauuauugauuacucuagacuuuuuuuuuuuuaucauuucuaaaguaguuuaggcauaugaauucucacaguagguuuuaggggauuauauauauauauauacacacacacacacacacacacacacacauauauauacacacacacacacacacauauuuguguuuuuugcaugugcauaauuagagugaggaaaugaaaaagggaauacauauauauuaagacccaaggaauaauacuugaauaacugaacucuggguggccucuuugaaguuuggaggcauaauuuuaacuaaaaaguggcagaaaagauuucacuuacacugaaauaaaugaugauaacguuauauuuugucauuaaaaguguuaauaagguuuuuaaaguaguaaguuuuauuauuagucuuguuauggguaaauagcaccuagcccuuaaugcauacuggauaaucaugccgcaggucccuaguccuuucacauuugcaguucccuuagacgacugccucaugcuuuuucccuccuaaaaccuccaucacuuccuuuccuaguccuuucucagcugauaaccuugaccuuauuguuucucugagaaauuuaaaguauauagaagagaacuucuaccagauguaucaucugcccucauuauaccauaccauguacucuacucuuucuccugaugcuauggagugacugucuuuuuuuuuuuuuuuuuugagacagagucuugcucuguugcccaggcuggagcacaguggcacgauugcaccucacuggaagcucugccuccugggcucaagugauccuccugccucagccucccaaguagcugggacuacagguguacaccaucaugccuggcuaauuuuuguauuuuguagagccgggguuucgccauguugcccaggcuggucuugaacuccuaggcucaagcaaucugccugcuucauccucucaaagugcugcgauuacaggcaugagccaccgcaccuggccuugauuguccaucuuuuauccaaggccagcucugcuccaguuuacaguguauuuccuuauaccuacucaaagaucuuacucuaacaauuauccucccuucuccugcaucaucgguuuuauauuuucuacagauaaucauucacauuagucugcaaauguuguuauuuucccuuucuaaaaacaaacacacauuuuggcucuacuucucccuccaacuccugccccguuuucuuuguaugccuuuacaaaauugucuguacacuuucacauucaauuaccuacucagugacuuuccuaaccaaccuacuuaaaaucucaacccuuucacuuugucacuuuuucuauuauuuuuguccauagaacuuuuauuuaguuaguuaguuuguuuacacagucagucuucugugccugcagcuuccacgaauucaacuaaccaugguugaaaauauucaaggaaaaaaacaaaagccaauaccacaauaaaaaaugaaacaauuuuuuaaaaauauaguauaacaacuauuugcauagcguuuacauuguauuagguauuauaauuaaucuagagauuuaaaguauacagcaagaugugcauagguuauaugcaaauacagugccauuuuguacaacggacuugagaguucgcugauuuuaguauccauggggguuccuagaaccgguaccccauguggauaucaagggaugacuauauuccuacucuccuacccugaauauaaguuuuauuaggccagauauuuuuauucuguuuguucacugcugugucccuaacacugaacaguuccugggacauagcggggucacuuaaguauguguuaagugaauuaguguucugauccuacucccauuguuuaaaauauuguguuauuuuuauuaaaauaauuuacuuuccuaaaaaaaugacaauauauugaagcauguuugaauuuugcauuucuuaagagggcaccaagcuaagucaaaacuuuacauuuugcuacacaugaucuauauaucaauauuaaaguauaagaagaauccuuacacuuugauuaauuugcuaauuauacuuuuaugcuacagcucacauuuauuucauauauacaccaucauacagaaaugagcuuuuauuacuuuuuugcacuugagcuagaaaugcuuuuaagaaaguugauuugagcuacugccugucaaagagaaaguuuuaaaauccauuuuacuuuucuucaaaugaauauaaagagaucuuacaauuuuuagcggugacuuauuuucaaauuuaaaacuucagaucuuauaggauguguuuaaauucugaaauuguaugacuuaaauagguauacaauacaaaauaagcaggaagagguuaagauauuuucucuuaaugcaaaauaauaaaguauuccccuccauuaguuugggggugggggaaaacaacagacugguaauuauuaugcaaauauuauggggaaaauccuagcuaggaauaaguaaauucuaagauagucaccuuauuugguucaguagcaagaacuguagaugguugcuggagauuuaaaacuccaaaaacucaacauugacauucaauauuuucucacugggagugugacauugugagggcucuuaaacuuuacauaggaaaacgauuaggaauauuauuggucuucagaaugagcaucucaaauauaggaaagaaaaaucauggcuauaugugaguacauuuuucauaugauaauauacacauaauuuagguuuuaccuauauugaucuaaaugacauauaacugauuauauugaccaaugauucuaggaagccaaagccaaagccaguauauucauuaagugugucacagaagcauucagucaucuagcuaaacgacuguagacuuuuccuuuauagcaugauccucgggaaaagggcucauuuucaaguuuaaacgauagaauguucuggaguugugaaaugugaaugaauaaaugagcuuguacuugauugugcuuguagaguggguauccaaguuguauccccuuacuuuacagaaguacuuauguacaucuucaaauaucuuuagcguuguuacaccuuuuguuugcauuucauuuuagcaccugaaaguuucuguuccugaugaaaugucugcagaucuagguaagcuuggagcacuaacauccuggagaauuacaucuuaauagauauguagcucagcucaucuguucagguuuuaucugucacauggugacuagucgaucaccugaaucacaacagaaagacagucuauaauacauuuaaagaguaaaugaggccgggcguaguggcucacgccuguaaucccagcacuuuggaaggccaagguggguggauuaccugaggucaagaguucgagaccagccuugccaacaugguggaacccuguuucuacugaaaauacaaaaaugagcuggcaugauggugcaugccuguaaucccagcuacuuaggaggcugaggcaggagaauugcuugaacacaggaggcggagguugcagugagcugagauuaugccauuaacacuccagccugggugauaagagcaaaacucugucucaaaaaaaauaauaauauggcugggcgcaguggcucacgccuguaguacucccagcacuuugggaggccgaggcggguggaucacgaggucaggagaucgaccauccuggcuaacacagugaaaccuugucucuacuaaaaaacaaaaaaguagcugggcgugguggcgggcgccuguugucucagcuacucaggaggcugaggcaggagaauggcaugaaccccggagguggagcuugcagugagcugagaucgcgccacugcacuccagccugggcaacagagcaagacuccaucucaaauaauaauaauaauaauaauaauaauaauaauaauaauagaguaaaugaaaucagaauucugggaugaaauauacgaacugcccugaagaacuucccucuggcauauucuaaguuaauuuguacgaaguagcauugcuauguugccaauuguauguugcccagaacauaccuuuagauaacauaauuccuuucauuuaugaagaaaagagaagaccugagcucauuccugaggaucugcaucgccacuauauccaaacuaugcaagaaagaguccauccagaaguucaaaggcacuuagaagauuuucgguaagcuuagugguagauagaauuucauaugauuauucuaaauuaauuuuuuuaguuaagaaaaaguugcucauuaaauacuuagcuuagcacuagauaaaccauauggucuuauuguuauuaaaacauaaugaacaucuggagccaaaggguuagaguggaacugagaguccagacucuccauuccaggcacuugcaggaucugagcucagugcugugucuaugcuaaguguguuccuuuaagauauuguauguguucuuggagucauugcuucuagaauuuuuuccucugguauccuagaugacauggacccauaaguggaaaagugacauuuuuccuguuccuagaaaccauagcugugaagacugugaugaagcguccccagaaugagguaguuuuucuuuaggcuaccucaggaaacuucucuauucccuucaggcagaaacguaguaugggacugaccuuggcugaaagcgagcugacuaaacuugaugcagagcgagacaaggaccgauugacuuuggagaaggagcggacaugugcagaacagauuguugccaaaauugaagaaguauuguaaguaauagaaguauauguggaaaugcccucucugcugagauacuaguuaugcuugaaguguccuuuggguagguuuagaaaaacugucagauuguguauguggagccguuuauuuugucauaguacuugagaaacuggauuuuuuuuuucuuuuuucugauacuuuuagauaaauuucuuguguuccuuuuucuggguggugguaaauggguaacucuaaaacuucuaaucagugaucaaaaacagguugauuacuuucauuauuuucaauuuauaggccuuggaaauauuucuugccaugaagcauauacaguuggugacaugagggugaaacagauaagguucuuuaggggaucaggguucuuuugguauuuuauucuaggguguggcccaaagcauuuggcucuguucuguuauuucagguaucugaguuaauaacaauuuuuaaggccaggcaugguggcgcacuccuguaaucccagcacuuugggaggccgagcgggcggauuacguaaggccaagaguucgagaccaagcuggccaacauggugaaaccccaucucuacuaaaaaccccaaaauuagccaggcaugguggcacuccuguaaucccagcuacucagaaggcugaggcacgagaaucacuugcgcccaggaggcggagguugcagugagccaggaucaugccauugcacuccagccuggguggcagagugagacucugucucaaaaaaauuaauuaaacuuccauauuucauuuuuaaauuuuuuuuucuuuuuuuuaaggaugacugcucaggcuguagaggaagauaagagguaacauaacuguuuuuuuuccccuagaauuuuaagaaaaaaagaacuauguuuuuuuccuuucaguccuaaauuacaauuuauuucuuuuaacuuacaaauacaguuuguggucucucucugguggcuuguauguuauuugacuaauauucuacuguuguccugaguagaauucucuucucugugcaaugacuaguuaguucuuuaguguuuguuugauuuauuucaauaauuccaaccuugggguuuuggaaaucauuugaugucuuuauucuaccaacccucccuucucagaagucuuaauuuacuucguccuuucuccuccagcuccaccaugcaguauguuauucucauguauaugaagcauuugggaguaaaagugaaagagccucgaaauuuggagcacaaacggggucggauuggauuucuucccaaaaucaagguaagaaugaaauaauguaauagcauguucaggccuuagggcuucuuuacauuugguugcagugucuuccaucaucuuaguauuuacuuaaucagcaaauuaaugcuagucauacaaacauuuauaagauacugucucuguucucaagaaacucaaaauacagugagaaauccagacauauaaacuauuauuagacaaugugaaaagugaaauuagcaguuuacaaagagugcuauuucugauucuguucaugccuuauacuuuccuuuuacuuugccuaaacuaaauacccccuguguugcuacauaaucgucaugaacaucuuuaguggcaguagaguauucugucaguuuguaauuauuuguguuuuuguuuaguguuuacuagauuguaaagcuguaugaguacaaggaccuucuuuauuauuguauuuucaacuguuagcaaaaugcuuaguaaauauuuguugaauggaugaaugaauuguuuagaauaaguuccugguaaaugugcuauaaaacuacccuuugauuuuccaaagcugucagugauaaagaguuugaagaaaacaucuugaguuugagguguacacgguacugugugcgaacuuuuaauuagugcucugugugcauacacacguguacggguuuucauuuacacuuaacaauuucuuugaacuaaccauuagcauuacacuaugaaaaucgcaaaagaaauuuacucuguuacguaucucuuauuuuuuguacuucaacucuagcaaaguaugaagaaagauaaagaaggggaagaaaaagggaagcgaagaggauuccccagcauccugggacccccacggagaccaagccgucaugacaacagugcaaguauguugaaguuugaagugcugcauuuucaguacuccaggcccucuucacaucagaggcuucuucagcuagaaugaauuucuggagaaaggaguuguuaggaugauuuuacugaauucccaauaugccuuguuuccauucagcguuauuucugaacuaaguacccccuauguugcuacauaauugucauaaacaucuuucgugggcugggcguggugauucacgccuguaaucccagcaguuugggaggcugaggcaggcggaucacaaguucaggagaucgagaccauccuggcuaacacaaugaagccugucucuacuaaaaauaccaacaauuagccaggcgugguggcaugcgccuguagucccagcuacucgggaggcugagguaggagaauugcuugaaccugggaggcagagguuguagugagccgagauugcaccacugcacucaagccugggugacacuggagcgagacucugccucaauaaaacaaaaagaaaagaaaaaaaaaaaacgaaaacacacaucuuuaguggcaguauucugucaaauguccguaacauaguuuacuuaccucuucugauucuguuuccauucaacuuguguuuguuaaauuaaaaaaaaaaaguguguauagaucucuccaccacacugaacgucucuuuauacauauuuacuuagucuccauauuucuaaaauuucuccaccucuccauuguacuuuauuuucugauuucccuuucaccccaggcccaauaaagagagauaagcucacuugagauggcugcaggagaaauagggauggugguaccauggggaggggucaugugaugguucuuaucucaggcaguagcacauuugaaaauacugaagccaggugcggugacucuugauuguaauuccagcacuuugcaaggccaaggcgggaggaucacuugagccugggaguucgagaccagccugagcuacauagugagacccugccucuacaacaagaacagccaaaauaagcuguguaucauggugcauguguguagucugagcuaccugggaggcugagguaguauugcuuuagucuggggaguccaggcugcugugagccaucaucucgccacuaaacuccagccugggugacagagugaaacacugucucaaaaaaaaaaaaaaaaaaaaaaagauauuggcaugguagaguggugggaguaggauugugauagugagugucccccacaaugacgaguucucccucaaaugccaugagugccucuuguugagaaacauugagaaggugugaaauuuuuagaggaaguuaaagagauggaggauuucacagaugcuaaccgugaguuccaagguauacaaaagaagaauuugaggaauuaagagauuaggguauaaaaaguugugugaggguguaggaugcuuuggauauugaacaccugagugggagucuuuggcuucuuguggugacuuugugaacaaggauaauuagcaggauggggauuggucuggauggucuuugagguacauuaugaugaugaaggugugaguguugggggagaacuggggugggagcuuacuaagaacucacaaaaauaaagacuucaucuucauucuuacaaaugaacacagcuccaugucucucagcauuccuccucccucuguccaccauuccucuccuucuuuucucaugacccuucuucuuucccuacauccuccucuuccucgcuuucgucguccugccucaccccuccuccaucuccucaucuuucugcucuaccuuccucucccuuucucucuuuucuucuuccuuccuucaucugucugucuguauguuucucugcauaacaauccacuauauauauuuuuuagggucuaccauguuucacacauuuuaccagauucuuuuacauuguccuuuuuugcuuuuagcuaauuugcaaugcagauuauuuuauuuauuuuauuuauuuauuuuugagacggagucuugcucugucacccaggcuggagugcaguggcgcaauuucggcucacugcaaccuccgccucccggguuggagcgauucuccugccucagccuuccgaguagcugggauuacaggcaugugccaccacgcccagcuaauuuuuguauuuuuaauagagacgggguuucaccauauuagccaggauggucucgaucuccugaccucaugauucgcccaccuuggccucccaaaguguugggauuauaggcuugagccaccgcacccagccgcaauacagauuauuaaccaucauuuucugaucaguuggcagagccauggaacuacagaaggcgcgccacccuaagcacuuauccacacccucaucugugaguccugaaccucaggacucugccaaguugcgccagaguggguuagcaaaugaaggaacagacgcuggauaccugccugccaauuccaugucuucuguagcuucaggggccucuuuuucccaggaaggagggaaagagaaugauacaggugagcuauuacuguaguucagcuuaacuaagcaucaagauuuuaaaacaaacacacuaacugaaaaauagaguggcaaguuaaucaagacuaaaucccaguuuaauuuaauuuugacauuuuaauaugcuacaaccaauaagaaaucuaugccgaaugauaacuuaaguucucauuuguccaaaaaaauauuuauuaagcucucugucaggcauuagcuuugucccggauguuaacaugcaauaauuauacacagaugcuugccucaugcagcuuucucucuugagagcgauagucacaaauguaaaaaaugcaaauugugccaaguccaaucaagggaagguaaagggaguauugagggaacuggucaguaguuagaggcagauguggguaucuaaagaagacuuuuuaaaaaucugagauuaacuagagguuuuauuuuucaauguuaauaggaagccagcugaaagaaaggguagaauaugugggagacaguauauaaguaguagaacagaguugugaggagagaggagaugagauguagaguguauguaaaggguaagacuauuuacugagagugagaguucagugagaagagcaagggaauuugaagaguaaagaaagauaugaagcaaucguagguaauugggcaaggagcuuauuaccaugucuucauccuuguuugggaggcgguucaauuucugguggugacaugaucaagaaugaggcucugggaguggucccugaggugccauagaggaggcuacuagggaugaagacggcaaggaaccaagaagccaggaguuugaauagcuuaauauucauggcuagugacgucaccaagugugauuuuuaucauggagaggaaaacugugagccaccagccaaagguuuagcauugcuagaugauugauaugaggaggaagagaaugugauaauauccagagcaugagagccucaguggagcaagagauuauacaggaagacaaggucgggugcaguggcucaugccuguaaucccagcacuuugggaggcugaggcggguggaucaccugagaucaggaguuggagagcagccuggccaacauggugaaacccggucucuacuaaaaauacaaaaauuggccaggcauggugacaugcacccguaaucccagguccucgggaggcugaggcaggagaauugcuugaauccaggagguggguggagguugcagugagccaagaucgugccaaugcacuccagccugggcaacagagugagacuccaucucaaaaaacaaaaacaaaaacaaaaaaaaacgacaagauaaugguccaaaaaucauauugaggaacaagaaggccauucaucucaucuccacccugacauacaccauauaagacagaaauauuaguuucugucucagagggcuguagcagaagagguaagcugcugggaauaggcagguuucuacauaaggccaagaaguacaagugacauuuggagaaaauucuggggauuuugucaaauauggaacucugaagauguuagauuggguauaugcacugauauuucauggcuccugugacuuauuaaaauaaaaacaugguagguggcggaugaacagaaaccauaaagagaaagaaaguagaggaagggaauguguuaucaggaaauaagagauuuuaacaaauacuugggagauugaaagcagacaagaguguaaagaagccaggcaugguggcuuacuccuguaaucccagaacuuugggaggcugaggcaggaggauugcuugagccuagaaauucaggaccagccagggcaacaugaaaagacugucucuacaaaaaaugaagaagucagccagucauauggcaugugccuguaguccuagcuaaucaagaggcugaggugggaugaucacuugauccuaggaagacaaggcugcagugagccauguucuugccaccguuaaugcagccuggaugacagaaugagacccuaucucaagaaaaacaacaacagagaaccacaagauaaaaccauaaaggaagccagagcccacaauuuguuuaaacaguccaagauagaacccagucugcucauuggaacccuggagagacuuugggcucagaguuagcauauguuaugcagugcaggaauaagaaaaagagcaaaaaugaugaacuaauugcaggucuauaaucaaaauaguuauaucagcagcuucuaaucccugaauuacagaguaugagcagucucugucacuuguagacuagaagaaaaaaacagugcucuuuuuuaaaauaauucagugaauuguguagggagaguuaagucccuccgcaguauugaucgcuuggaguucugacauuugggaguccaaagccugacacuaggcaugccggcaacccacugugcucagagagcucucaacugaaacagaccuauuacuauauagcagcaaaagaaagccaagucagcuacucacuuucaucauuaaacacgaacaucauuacucacccuugucagagucaagacguaagauaauauauaaugccaaacauaucagacaaugacauaaagagagaauacaguuaaacagaagaauuuucccuacaagagaaagauaaucugauaauagacaagaacuuaagaaaauacuucuaaauuagguaguauacuuggggacauuaaagaaguuauuaucucuauaaagcaagaauagggagcauucagagacaaaauauuuuuaauacaacuauuaaacacagugacaucuguuguauuaucaauuucugugugauaaauuaccccaaaacauaauggcuuaacacaaaaaaaauuuaucucgacuuuuugguggaugaaggacuccagagcagcuuagcugcgugggucucgguuggagucugucauaaaguugcagucaagauauuagccagucaucagaaagcuuaacuggggcuggggaacccauuucugugcccacucagguggcuguuggcaggaggccuuagcuccucacucauggccuuggcuccuugccacauggacuuuuccauagagauacuugaguguuccaugaaaugguagcuggcuuuucccgaguaucccaaaaaagagagcgaaaaggaagccccaaugucuuuucugacuuagucucuauaggugcacucugucacuucugcaaguuagaaacaagucacuaaaucuagcccauacucagggagggaggaauuaggcuccaccccugaggggagaaauaucaaaaaauguguggguauauuuucagaccaccacagcgaucagaguuuaaaggaaaaaaaagaagucccuaaaauuaaagucaaggaaauauuuuagaguguacaucagaaauaugaaaggauagaaauuugagagaaaagaauuauauagggaaccacuacagagagccaacaucugucucuuucacaaaaagucagcugaggacauggagaagagaugguuaaacaacaggagaaaguuucccagaguugaaaaagaauacccaucuucagguggaaagggcucacugagaaccaucuauagugaaugcuuuuuaaaaaauccauuccuaacauguccuuugaaacuguagugcaccagggauaagcuuucagaggaaaaaaaauggggauuacacugcaucacauuccucaucauaacacuggaugcugaaauacaaaagagccaugccuucaacuuucugaaggaaaaugguuuugaacuuagaauccuguauccauccaagcuauucaucaaauaugaagaaugaauaaagacauuuucagauacacaagguccacaguuuaacuggaauguaccuuucccuuugaaaucauuugaggauacacauucuagcaacaugagaggaaaaauuaagaaagaaaauguccugggauccaggaaacacuggaaacacccaggaaaguggcaaagggcaauucuaaaaugaugguuguguaacaggccaggagagccacugcuccagauuggaacacaagaacaucacagauaagaaaauggggauuuuaggcaguggauaguaugaagcagcagaggaaauaguuugagacuugauagaauuauauaacuuugacagcaauaaaagaaaagcauuuagaaauguuaagaaaaacagaauuguucaggaaaauaagucaugauuuaaacaugaagcaaaauaaaaaguggcaugaucuuuagcaauugaugguguguaagaaagacuuuaauaaauguucuauuugaaguggcccauggauugcaucauuggaccgguaggaaaaaauauauaauccuaacuaguauauuucuuaaucuggcaggaaugauguauauauguauguaguagacgacaguauauauaugucauaagcauucuuucuugguuuucagacuuuuagaauaacccuaccaggcaagcauggaguaguucauuauggcugcagguuagaauauaaauguaaaaaauucuuuuaaugaugcaaguaaaaauguaguugaaagaaauggaagguagaaggaaggaaauacaauuagagggaggauguggacacugaauaccuaaucugacacagaagagaguugagauacuaacuuuuugauagaacaaaaacauagacaugucauuuaaauuuagguaguaacuaauaacccagcuaguaauaaugauaaaacuauuaaacauugggaagaaaugguagaaaagugaaaguggaaaguguaagucaacaaaauccucagaggggaaagaaauagauauuaacuaaagauaauaaaucaugaaaaagagguuauuuguaguuggaccacuguaauaacucacauuugaaaacaugaaaaaggauugauacugggaguagaaaaggauaagaugggaaaauguuguuccucaucauauacucuucugcacugugugaguccuugcuauuucuuacguuaauuuuuaagaaacaguuuuaaaaauuauuuuucugaccaggcaugguggcucacaccuauaauccuagcacuuuggguggccaaggcgaaaggauugcuugagcccaggaauucaagacuagccugggcaaaguagcaaaacccuaucucuacaaaaaaauuaaaaaugagccaggugugugugguggcacgcaacuguaggccccgcuacuuggaaggcugagauggaaggaucauaugaggcugagaugggaggaucaugugagccugagaugccauaauuuuguauauuaaauuuuuaguucuagugaaccugcaguuguuuaaauaagaauguagcuauggauuaggcugaagcuguucugggaacuaauuuuuuuuggugaccagugacuuuauuaaguauuaacacucuucaaaugucugacuuuugucuacaggaucaaagcaaguuggagaaacaucagcaccuggagacaccuuagauggcacaccucguacucucaauacugucuuugauuucccaccaccuccauuagaccaagugcaggaggaggaaugugaaguagaaagguaauucagugaucucuuagagaagcuuagggcauuacuuaaaguuuuuaaauuauaugcuauuccuauacuuaguagcauucuagcacugaagccuggcauggugguauguaccuauaaugccagcuacuugggaggcugaggcaggagaaucaaucacuuaaacucaggaguuugagaccagccugggcaacguagugagcccccacuucaaacuguaaaaaauaaaauaaauaaauaaauaaauaaguugggugcauaaaagaacuaaaacaccauuucagaacucauaacugaaauguagaaagguacucaaauuuucuucaauuuauuuuauauuaaauuauuacaauaucccaaagaauuauuuaucaagcugcuggaguuuaaccuagcuuugaguaucuuugguauaaauguauugaucaccauuuuguuuucauguuacucuuuacuuuccauuguuuuagggugacugaacaugggacaccaaagcccuuucgaaaguaaguaaaucuuaagcagcuuucaauaaaggcgcauuuuaagaaacguaaccuuuuuuccucuaaaguuucauuuuaaaggaaaagaaacccuguauaccaaucuguuauguaguauaaaagaaagcucuuaagaaacacuggucauucaaaagcuguauuuugaaguauguauaaaacagccauuuguaggagaggaugaaauuucagugcuaagucagauucaggaaucugauuagaauuuauuguaauauaaagauuugugcuguuucucauuguccaccuaaagucuucaaauugaauucacucuuuuuucuucauagguuugacaguguagcuuuuggagaaagucaaagugaggaugaacaauuugaaaaugacuuagagacagauccacccaacuggcagcagcuuguuagucgagaaguguuacugggacuaaaaccuugugaaaucaaaagacaggaagugauuaauggugaguguaaucaauuuguuguuguuguuuacaaauacugaguuuugucagagugaauuaagucucucagccuuggaguuugcuucaaaguuucuccuagccuuuuguuuuaaacaaagaggaaauuaaacuggacagauaauccuugaacucaagaaaaugcaaauguuucucugauucuuauugauaauuuaaaaggaaaauguguuaagccuuaaagauauuuaagauucauagcauuauagaucuuaaaguugaaaagucauugcaacaacuaaguuauuuuuaugcauagauuuuaaaugaggaagguaaagcccagggagauugaauucguuaagaucauacagcuaauaacguguaaggaaaaaaauucaguuccuggucuuucuguaucgaagugcaguguucuuuauuuacccuagcauguaugugauaaauguguggcaugggugcuguacccuuuacuauccuuagcaugugauaugaauaaauaucuugucucugacaauacugagacauaaugaaauuauaagccugaccccagaagugaguguuuauaggcaaauuagauaaccaaaaguacuauuauuucuuaagagggcucaaguuaaaggcuauaugauguuggggcuuacaguuuucuuaaugauguaguugugauagguggguauuauuguaaacagcuggauguguuugggaauacacuaaaaaaaauaguuuugaaugauauuuuuuauuugucaguauucaacucucagagccaguauguaggaaaauuucuuggaaucagaaugacuucagagauauuucauccuuucuaaaugauaaauaauuuauuauauaauucauuugcuacuucacuccagcuaaagacuaugauugaucccauggaauuguucuaaguaaggcaacauuucauaucucuuuccuguucagaauuguucuacacugaaagagcucauguucgaacacugaagguucuugaucaaguguucuaucagcgaguauccagagaaggaauucugucacccucagagcuacggaaaauuuuuucaaacuuggaagauauucuucaacuucauaguaagagaaauuagcucugaucuuugccccuaacauuuccaauagagaaaagauugugaguuuaaaauuuuguaaauguacccauguuaguauuccugagauuaugugugagaauguaagauaaauaaaggaaugauuggaacuuugacuagauccuuuuccucacaaucaaucuuucauguacaaugugucaacauagggcuuccagucuaaagucauugccuaaggugaaaaacaugaauagucaaauucaccguugaaaauuuucuaucaauuauaguauauauaucucuuuaaauauauauauccaauauaauaauauacguauaaauguguuuuguaaauaguaguguaugguauauaaucacaugguucgguaauuuuuaggaauuguuuuuauuuuuuugagauggagucucgcucuguugcccaagcuggagugcaguggugcagucuuggcucacugcaaccucugcccccuggguucaagggauccucccaccucagccaccugaguaacugggauuacaggcgugcgccaccacacccagcuaauuuuuguauuuuucguagagauggguuucaccauguuggccaggcuggucucaaauuccugaccucaagugauccacccgccugccuuggccuccaaagugcugggauuauaggcaugagccacugccccggccucaggaauuauuuuauuguuuuguugcuuggaacacuugaauaaguauauaaaaauucuaccuuguugacauuuuauugguugaagucaucuuggacuuuuguggacaguaauaugauguuccucucauuuauaggucacuauuucucuaugacccuuaauuuuuuuaucuuucuuuuucaugucaucacuaacuaucaacaucugcuaacuaaauugaugccuuuuauuccuuuguggauaaucuuggguuucacaggcaugcauugacaaguucaggcuugauuacauccauugccugcacacuuaacacauuuugagaggaucagugaacagaauuacuuguacuguuuaaauucaaguucuuuuugagcaugauuauagauggagucuugagguucaaugaauauuugaugcaaccaccguguauguaaugugcuaguuuccaaaaauguuuuuuguuuagcaccuguuuuucagauagagcuuauaauauccagauguguaagcacuauguccagauuuauauuuaaggagauaagaagcagcuguacuacugugaaaaucgucuuuauaaaaaaaaaaaauuagcuacucuguacuaccaguaauucugucuacacugaauguguuacuaacguuuuucuaucuuuuuaucuuuaguuggauugaaugaacaaaugaaggcuguucgaaagagaaaugagaccucuguuaucgaucagauuggggaagauuugcugacauggguaaggaaauuuucuguuucuuuuuaauauuuuuauggacacuugaugguuagauucaaguugaguaacuaaccuuuccaaauaugcaaacucauccauguugcaaaguuaaugcaaagcugagaaaggucaagcaguagauuccauuucaagaaaccaccuguuuugcucaucuguaagaagcagacccuuauccauuaaaagucauaccaugagauugcagugauucagucacaccuucaggcuccacuguaauccuaguuuuuuugcaguuaccucuuccacugaagucuugaaccccucgaagucaccuaugaggguuggaaucaacuuccaaacuccuguuaauauugauauuuugaccuccuccugugaauuaugaauguucuuaauggcaucuagaauaaugaauccuuuucagaagguauucaguuugcuuugcccagaccaaucagaggaaucaccuuaugaaauauauuucuuaaauaauaagacuugaaagugaaaauuacuccuugguccaugagcugcagaauggauauuguguuagcaggccugcaaacaacauugaucuccuuguacaucuccaucagaagucuuuaagugaccaugugcauugucaaugggcaguaauauuuuaaaaguaacuuuuuuuuuuucugagcaguaggucuuaacagacaugcugucaucuaggcuuuguuguuucauuuauagagcacagacagaguagauuuagcauuauucuuaagggucccaggaauuucagaaugguaaacaaucauuggcuucaacuuaaagucauuggccccuaacaagagagcuggccuuucuuuugacaugcugaagucagacauugauuucuccucucuagcuaugaaaguucuagauggcaucuucuuccaauagaaggcuauuucaucuacauugaauaucuguuguucaguguagccacuguaaucaauuaucucagguacgucuucuggauaacuuacuauagcuucuacugcuauaucagcacuugcugcaucacuuuguacuuuuauuuuuauggagaugacuucuuuucuuaaaucucaucaguuuaccccugcuaccuucaaacucuucgucugcagcuuccuuaccucucagccuucauagaauugaagagaauuaggggcuugcuuuguauuaggcuuuggcuuaagggaauauuguggcugauuucaucuucuuuauacagacuaauaggcuguuucacuuuccucuuguucauuuguucauuggaguagcacuuuuauuuccuucaagaauuuuuucuuuguguucacaaguuggccauuuggcguaagagccaaaucucagcuuuugacaugccuuccuuacuaaacuuaaucauuucuagcuuuuaauuucaagugagagauaugugacuccucacuugaaccccuaaagaccauugcagcauuguuaauuggcccaaauucaauauuguugugucucagaauaaggaggcccaaggaaagggaagagaguugggggaauggucaguugguggggcggucagaacacacacaacauuuuuccauuagguuugccaccauaugugggugcaguucauggugccccaaagcaauaaauaguaacaucaaagaucacugaugacagaucaccguaacagaguaaaaugaaacagcuuaaacuauuaugagaacuaccaaaauguggcacagagacaugacaugagcacaugguuuuggaaaaacggcaccaacagacuugcucaggguugccaucaaccuucaauuuguaaaaaauggaguaucugcaaaguacaauaaaaaugugagguaugccuguaccuguaaaaaguugaggaaaagcagaauggugguuuguaacugucacauacaaagcguuaauuuagaagaaggcauuggccagaaaucauaaaagcaaaaaucauaaauaggccuuuagauuuuacucuugcuguuuaaauaaaaucauuuuggaaaguauuuuuccaguauuguuuccuuaagaucacuuuacauacacagacaauccuugacuuacuaugguuccaacuucgacaguuuuuuuacuuuacaguggugggaaaguaauacacauucaauagaaaccauacuuugaauuuugaauuuuaaucuuuuccggagcuuggcaauaugugguauguuacucuugaugcugggcagcaacagugagccacagcuccuggucagccaugugaucacaggguaaacaaccacucuacaguguacuguacugcuagaugauuuugcccagcuguaggcuaaugcaaguguucugagcacauuuaaggucagcuaggccaagcuaugguauuugguagguucaguguauuaaaugcuuucucaacuuaagauauuuucaauuuuugaugguuuuauuaggauauaaguucaucagaaaucaaggaacaucuauacuuaaacugcuuguaaaacuacuguagaggccgggcgcaguggcucaugccuauaaucccugcacuuugggaggccgaggcaggcagaucaccugaggucaggaguuuaagaccagcuugaccaacauggagaaaccccaucucuacuaaaaauacaaaauuagccaggcaugguagugcaugucuguaaucccagcuacucgggaggcugaggcaggagaaucgcuugaaccugggagguggagguugcggugagcugagaucgagccauugcacuccagccugggcaacaagagcgaaacucagucucaaaaaaaaaaaaaaaaaaaaaccaaaaaaaacuacuguagaacugcuugaguuugggggcauuauuuucuuugguaaacccagcugcuuuuuguaguuguguggugcuuugauugacuaacaugcuaaaaaugcugccagucuccuuguuaaacauguuaaaugucauauucaucauagaguaagaauacaaaauuggagugaccuauuaaaauauugcuuuguauguguccuacuugaaaaaauacucugaauuuaucuacaaaugcgcuacaggcgggcuuuuuacaaaaugccuuuauguacaaacuuuugggaauauggcuuuaaauggaagauuauauggaaaacaucuucguaaaccauaaagcaauuaucuacaaguauagaggcuguauuaaaaaacaauguauuugacuucuacgagcaccuacuaguaaaucacuuuuuagguguuuaaccaucagaaaucuuaaaaucauggcacaugcaaacuuaaauuuacaaauuaaaaaacauuagugagaaguauaauuuuuagcaaaagaauucauaagcucauugaucucccccaagccagcuccagcugcugcacaggugaaacagcagugauuuaauuuuguuucaacacagaaaacuuacggccugcccauggucauaguggguuuuauacugaguaagaaggaaugcuaguaugccaaggauuugcuucccagaguaguaagacaguaguuguuguaaaggcuucaggguguaagaaaauuaaauuuuaggccagauguaguggcucaugcccauaaucccagcacuuugagaggccaaggcaggcggaucacuugaugucaggaguucaagaccggccuggccaacauggugaaaccccaucucuacuaaaaauacaaaaaaaauuagccaggcgugguggcacacgccuguagucccaacuacuugggaggcugagacaggagaaucacuggaaccugggaggcggagguugcagugagcugagauugcaccacuauacuccagccugggccacagaaugagacugucugaaaaaaaaaaaaaugaaaauuuagucucagucuucaggcauuuuguaucuuauauucuccaaaugucagcuugucuguguaauuuauaaguaacguaggcugaaagguaauagguugugauaggcuacaagcaagaaaacauugggacugggcacaguggcucacgccuguaaucccagcacuuuggggacaccaaggugggcagaucaccugaggucaggaguuugagaacagccuggccaacauggugaaaccccaucucuacuaaaaauacaaaaauuagcugggugugguggugugugccuguagucccaguuacuugggaggcagaggugagaaucucaugaaccucagaggcagaaguugcagugagccaagaucaugccauuguacuccagccugggcgacagagcaacacugucucaaaaaaaagaaaaaaaaaagaagaagaaaacauuggaauaugaucagaaaaggucugguugugucaagaucagaccuuuuuaauggagaaccauugauauuccacauagauaugcaguucuguguauuuugucacuugaaauauugaaaggauucugguugucugucacuuugucuggcuuguauaagcucaguuucccauucucuuuuguguucuuugcauucuuggcacaguucagcggaccaggagaggagaaauugaaacaugcugcugcuaccuuuugcaguaaccaaccuuucgcccuggaaaugaucaaaucucgucagaaaaaggauucucgauuucagacuuuugugcaagugaguugagugagucauguaagaaaaaaaauaaggcaaguuuuuaucaauuaucagauaaacugggggaauucugacuaagacuuuuacaaagauuacaucuguguuaacuuuuuuuuuuugagacagggucucgcuguguugcccaggcuggagugcaauggcacaaucucagcucacugcaaccucugccuccuggguucaagcgauucuccugccucagccuuccuaguaguuaggauuacagguacaugcuaccacgcccugcuaauuuuuucuauuuuuaguagagacgggguuucaccauguuggccaggcugggcucgaacaccugaccucaagugaucugcccaccucggccucccgaagggauuacaggugugagccacugcaccuggcccacguuaacauuuuuaaaagcaauacauuaucucuuaaauuccuggaagguacaaaaaugacuuuggaauggugaagaauaauaaaaaauauaugucaggauuaaaauacuuaauauagaaauccacauugccacgaggcuuuuaucaguaaacaaccguaugcucuauuaagagaauauugucaaagcaugagaauggguuuauccagggaaaaacguaacagcagccacacucauugggguauaugaauuaaggguugguaaacuauggccgacagaccauaucuagucuguuaccuguuuuuauaaaguuuuauguaaauacaaacauggccgcuugacagauuucucacaguuguugugguguguggguaugguuuagcagguuccucccuugagaguuugaccaggcugagaucacagcgucagcgggagcugcaguuuucaucugaugcucgagguucucuucuaagcucacugguuguuagcagaguucauuucuuuguaaauguauaacugagguccuaccuugcuagcuauuggcuaggaaccaguuucaacuccuagagaacagagagaucucugccauauggccccauuaggcaguuuagagguggauguuugcuuucuuccaggccaguaggaauguggcuuucugacacagauuuguuuuaaaggcuccucuaaugaaaucaggcccagccaggauaauuuccuuucuuaugaucucaaaaucaugugguggcaaccuaaucauaggugugauaucccauuguaaucacagauuccaaaaauguucauacucaagggcauaggauuacacagaguauuuacacaagaggaugggaaccuuggaggccauauuagaguucuuuacuacacagagccuuguucauucacuuaugccaaaacaguagagcugaauaguugugagagagacuauauggccugcaaagccuaaaauauuuacuaucuggcauuuuacuaaaaacuuugcagaccacugguauagaugagcuggcauacucgacugguuauccauugugcauacuuggaauggcagauaacaaauuagcuaaccaauuuugguaggaaugucaaucauaggagaauggaccuagauuuucugaauaggugaagauaaaacuguuucaacacaaggaagcgauacguagagcugcuuauggaugcuuucaguccuuccuuaaacagauaacaagccauucauuuaguaauagaggcucccuucccccauuaugugauuaaaggagaaagcagaaguauauuguggcaaugauauaucuuggcauuuuuuaaagaucuugauuuaauaaccagaacugugaugcauuaaacccucacggugaauacaugguacauguauaaguucaaauaagaauuacagauucacuuauuucacuuuaauuuuaggaugcugaaaguaauccacugugucgucgucuucaacugaaggauauuauucccacucaaaugcaaaggcuuacuaaguacccacuucuguuggauaauauugccaaauacacagguacagcauuuucacugaaauaaaaagcuuaagaacaacaacaacgaaacacccaauauccuguaaauaauaucuuacagcguccugaauggaguuggauuuccaaauaguaugacaagauuuucuuuuuuuuuuuuuuuuuuuccuuuuuugagacagggucucacucagucuugcaggcuggagugcaguggcacaaucauaguuuccugcaaccucaaacuccucggcucaggcauuccuuccaccucagcuucccgaacagcugggacuacagggguacaccaccacacuuggcuuuuuuuuuuuuuuuuuuuagcaagggucucacuauguugcucaggcuggucucaaacuccuggccucaagcaguccuccugccucccagagugcugugauuauaggcaugagucaccauacccagccaagauuuucuaacaagauaugaucuagucuucuucgggcuguuugauauaauguacuccauuaguagcuuuaguacgggguauaucaaacuaugaaucauagaccaagucaugcucacugucuguuuuuguaaauaaaguuuuauuggagcacagccgugcucgucuguuuauguacugucccugauugcuuuuacauuauaacagcagagucgaguaguuuuaucggugcccauuuggccuacaaaguguaaaauuaucugguucaaccauccuuguucuagccugcaucauuuuugcuuugaagaagguucauccuuggcugaagagauguuucauggauaucuaucaaugacuuuuauuaagccaaaucaaugcgguguaauuccaacucucccguuuugaaacaugaaaugaaucuguuucucagcugagcuuuagguucuuauacuuagcucucauuaauaauuuaaugcaacugaaaucuuguuucuugugccugagaauuugaaugcauaagcaggaaauuuuaaauuaugguaccugguaacaaaagugguuuacacucauacauauuaauuuuuacacuuuaauauaucugcucaguguaguuagacugugguuuggaggauuauaauuuugaauguucugauuuuggucuucuuuguauuauagacaugacauagccucaauacguuuugucuuguuuuguuuuguuuuguuuuguuuuuuugagacggagucucgcucugucgcccaggcuggagugaaguggcacaaucucugcucacugcaaccuccaccucccggguucaagcaauuccccugccucagccucccgaguagcugggauuacaggcgcacgccaccacaccuggcuaauuuuuuuguauuuuuaguagaaacaagguuucaccauauuggccagacuggucuugaacuccugaccucaggcaguccgccugccuuggccucccaaagugcuaggauuacaggcaugagccaccuugccuugccgccucaauacguuuugaugaauuucaucuucuuuuaauguaaucuauuuucuuucuuuaaauauaaucucaaauucaaagaaacuuguuuuggaauuauuuugaauuguguuauuaaaaaauuuuguuuaacaaguucacuggacauaauuauguaggcuaugcacugugaaauucugaggggagaagggauuuccauuuauauuauuuacaaaguaaaugagaccugcccuucuggaguguauaguauagugguccugguacuucacguaaagcaucucuucuuggauuucggguucuguacugugauuucuuuuuaaagauuagaauuuauguuuuaaaguccuguuauaagaaguuuuaccuguccaaagacugcuugaauugagacucugacagaggcuuuaagcugguacaaaaaucuucaaggucuuaauaugcucuuaaaaguauugaaaugaaaugaaaucucauuuacauauauuuuaugguuuuuugcucaguucuuuuacauuuuggauuucuuucccauauuuagaauggccaacagaaagggagaaggugaagaaagcugcagaucacugucgucagaucuuaaauuauguaaaucaggcugucaaggaggcagaaaacaagcagguaaaaaaggaaaacaagaagguacaggaugacauugggagaacauuaaauuaauauuaccuggaaucugugaaauaguuguuaaaacuaucauuaccuaauggacagggagaacauuuguuuacuguucgcauaguaggcaggucaagaucaaucugugauagaauaucggaguuguauuugacuuuuugaaacaccucaagcugcuuguuugcucuuucauuuaucucuucauucagcagauauuuauagaacaucuacuguaugcugggcauaggguacagaguaguugagaaaaugagugcaauaucugcccacacugagcuuguuugcuaggaggauagaaaggcauuuaacaggauuauagugcaaauauuuuguaucaguugugauagcuacuaucaaggauaauuucaagaugcuacgauauauaacuauggggccuagcuuaguuuggggauguuagguggugccuauuagagaaaauuuucuugaggaauugacacuugagccaagcucugaaggaugaguggaagugaaccaaaaugaugugaagggugcaacccuagagguagaggcaauauauaccaaaguccugacggaaaaagaaagcauggucuguuggaagaauugaaaauuuacaugaguguggaucaugccuaaaaagcaaagucagaguggcauaaaaugagguaaaguagaccaaggccaacucauaaaggcccuagagaucagguuaaagauuuugauuugucuucuuaagugcaguaggaauucagcauagacaaguaagaauauaguguucagauuuucauuaucugaacuaguacucuauggagaaugaguugaagaagggugguggaugaaagagcccauuuauuaaccucuugcagcaaucuaggauagaugauggcagcuuagagaaguuggagaaguauuuagaagguaaaauugacaggacuugaugacugauuugaagaaggauuugaaggaaaagugaugucaagaauaaacccccagguuucuggauugcauauuuggauggacaggaugaguggagaagccccacguuuguggggaagaugaugaggucacucugggauaucagguagacaugcacaguaagcaguuggcuguaugggcccaccucuaagaggaccauguugaagauaaaaauucaagauugugagcauacaggggcugauugaauccgugaacacggauguaguuucuuaggagcugaguaugauuacaacucucuuggugaggcuguagaaaaacuaguacuuucagcugugcuguucagaguguaaaaugauaaaaccccagaggguuauguagcaauauuuaucuaaauuaaaacucuguagguacccuuauaucuaccuuuugacuccgcaguucuguuccuagugauuugcucaagagaaaugaaccauauuagaguucuuuacuacacagagccuguucauuuauguauuaucuguggcuacuuuuguuccaaaacaguggagcugaacaacugggagagagauuauauggccugcaaagccuaacugacauuuuacuaaaaaccuugcagaccccugguauagaugagcuggcauacucaggcugguuauccauugugccugccgggaauggcacauaacaaauuaacuaacuaacuuuaguaggaacaccaaucauaagcaaauggaccuagauuuucugaauaauaaaauauaucuuuaucugaagauaaagauauacccacaaacagacuuagaccagaaugcuuauagcaacuuuauucauaauagcgaaaagcuagaaacagcccaagaauuuaucaacagaauggauaaaccaacugugguauaguuauaaaauagaaugcccugagugauaggaaaggaauguaccacuaaggcacacaacauggaugaaucucacaaacaugcugaguggaaaaaaaacagaugcaaaagaguacauaccuaugauuccauuuauaugaacuucuaagagagaccaaacuauucuaugguaggaaaaaccagaaaacugguucccauuggggaugaggagguagaaauuaacugggaagaaguaugaggaaacuuucuggggugaugguaaaauuuucuaucaugauagaaguuuagguuacacaaauguguaagcacuugucaaaauucauggaacauacacuugaaauguguguucuacuguaugcaaauuuuacuuuuuuaaaaagaacuguauggauguuuaaauguuuagagguaaaguguacuuaugucuguaauuuauuuugaaaugcauccaaaaaauaagauggacugauggauagagggaugaauaaauagauauaugauaaaacaaauagagcaaauguuaauuguagaauauagaugguaauauauagguguucacuaugcucacucagacuuuuccauguauuuggaaaugauauugugggggaauguacauacccuuugauccaacaguucuggaaauuuauccuacagauauccuacauggauguacaaagacauauauuuaaguccacuuuauuacaguauuguuuguuacagaagaguugaaguaacuuaaaugcccaucaguaaggcguaaugaaauaaauuauaguuuauucagagaguuuuacauccuguagucauuuauaaaaaaaugaaauaacucucuauaugugcuaauguggaacaguccccaagauauaagucauacaccacacacacacacacgugggggaauacguauaugaauguauucuaccauuucaaugaggaauacauauaggaauaccaaaggaaugcauauaugaauauauuaugcuaccauaucuuguuuuaaaaaaggacauauacacacaacaugcacaaagacaagcauacuuauauauacauauauaaauaaauacauaucuguuugcauagaauuuuucucaaaggcuacccaagaaauggauauuagugauugcuucuuuagggaaaauugagggggguggggcaauaggacaagguuagagggagacuuuuuauuuuuugccuuauauagccaucugaauuuuguacugugugcaugauuuacauauucagaaaauaaauauaagcuaauaagagaccaaugacuuugaaaagaagauugagaaagaaaagccaaagaggcaggaggaaaacuaggagaguauauuaucaccaaagccacgggaagagagugaguuuucaguccugucuagcauugcaaagagcucaguaaaauggagauuuuuuuuuuuugagauggagucuugcugugucgcccaggcuggagugcaguggcgugaucucggcucacugcaagcuccgccucccagguuugcaccauuccccugccucagccucccaaguagcugggaccacaggcgcccgccaccaugcccggcuaauuuuuuuuuauuuuuaguagagacgggguuucacuguguuagccaggauggucuugaucuccuaaccucgugauccaccugccucagccucccaaagugcugagauuacaggugugagccaccacgccuggccaaaauggagauuuuaaaugccaaguuugauucagaaauagagaggucauuaaugaccaaagcacuaaccuugguuccacccugccuaauuuucagcgccuagaagauuaucagcgucgccuugauaccuccagccugaaguugucagaguacccaaauguugaagagcucagggugagagauggucuaaucauaauuuaaaaaauaaaauaaaauuugcuaaagaccuggcagguaauuaacaucucagugggaauauacgucaccugaaggaguucuuguaucguagauuaucuguauuuaugauuuuuuuugcugccuuuuaaaugcuugaucuguaugaaauuaguuuuucauuagaggaauaucuugcauaaaacuguaauauuacaugacagcaauuggcaggagacuaagggacacuaauuauuauaaaauuuaauuuuauuguguucuguaguuuguuucagacagggucuugcucuguugcccaggcuggaaugcaguggugcagucuuggcucacugaagccuuggccuccuggacucaggcaguccacccaccucagccucccuagcagcuaggacuauagguauaugccaccauacccagcuaauucuguguuuuguaaagacaaggucucgcuguguugucagguugguccagauuuccugggcucaagugcuccuuucucagccucccacagugcagggauuacaggcaugagccacuaugcccagccuguguucuguaguuuaaauaaggguaggacuguuugguaacuuuccagaucauuuaauaacacaagauagcauacuauuuucucaugaggcucuucagaagcauaaaaguuggaaccauuacaggaacgauaguaaaauguuuacuaauugccacuucuaguaugugggcuuauguguuaacuuuuucggauuuuaaguguuuuuguaccauuucacuagguggugguuuuggcagauuuauuugguggcuguuaaaauagacuuuuaugucauauauuaauacuucgucaacaagcacguaaaugugcuuauuccccuuagcuuccaaagaaugagaguuuucuagagcugcuaauacuaaaagaugauucucuuacuaauaaguuguuaauauuuagaccaagucugaguaguaccuggacuuuucaugaguacuauuucuuagaacuuucuuugaaauuagagccuuggaacucagaagccacuuucuuauagacaagcauauguaccaugcucauccaguuauucauaggaaaauuaaaggauacguugagaaucuagugacugaauguuuguaacuugaucuucauaaucuguuaucaucuguuuagagugagguuugaagauaguacuccugaauguucuucugcaagauaccuuuuccuuuuuagaaaauuguaugcagauuacuuuaauauggcuuuugugccauuuucaagaacugacaaauagcaauaaugauaguugaauguaaaugguguauuuuauauuaagaauuucuuuaaaagagacuguauuauauagauaaucauguuacugagugcuuggaaauuauuugugcaugauuuucuuuauuuugccagaauuuggauuuaacaaaaaggaagaugauucaugaagggccauugguuuggaaggugaauagagauaaaacuauugguaggucugauauugucuuuuaguuuuggggagaguggcaaaagggaaggaauaggaaaguuuccuaugacaaagggaagaggagagaaccauucucucagcaguuugcagugcuaccucguguuauuuguacauuuguagaucugcuuguguuauuucauuauauguaagauguguuaaauauucauuuaggaauguaguggagaacugauuuaguccuauuuccaucauucuuauagucuagugagucuuuguaugcuuuguaagcuuucuuuagaccaguacaucuuaaacugucugugaugaggaaccguuuuuguuuuuucagaaacaaggucuuucuauguugcccaggcuggagcacaguggcuagucacagaugcagucauggugcacugcugccucgaacuccugggcuuaagggauccuccugccuuagccucccuaguagccgggacuauaggcgcacagcaccacacccagcuuguuguuuuuuauuuccuauuggucacagacugacacuucagugaaauaaaauaaaaaugaauuacugaaaaugaaauuuuaaaagauaauauacaagucaauuuuuaaaauuuuguagcuuuaacagaaauagaauuccucuguugaaucauuauaaaguuaaucaaacgcgucuccauuucuguacuuaccauuuuuuucugcacuuuuauuucuagauuuauacacguugcugcuggaagacauucuuguauuguuacaaaagcaggaugauagacugguuuuaaggugucauaguaagauucuggcaucuacagcugauagcaaacacacguuuagcccugucauuaaguugaguacaguguugguucgacaaguggcaacaggcaaguauguccacugaaggauacuaauuuccagauucauugugaaguugcauaagauacucggugcugucucaauaacacaaguggcauagagucuugcuauuuuuauauucuuaagcaaauuacaugaaauuuacugcuuagaaagagaccuaagaguuuauaccccaaaguuauuagggugucucgauucugugaacaguuuucugcauuugaaaauuuuuaugcuauuacuuugguucuuuauguucaaaucauugauagaucccaaugaaaagccuuucauuuagggugguauguuuuuugauuuggugagaaaaaaaucaaaaaccaaagagacggauguaguguugauuaaaaaucaaauuugacuggcaaguuauauuuuaacucuauuaacaacggggucccuuuuaaaacuuguuaguuucaugguggcaaaauaaauuugugaccucuuuucuccacuacucacugaauauuauuaacuaacaacuuagcaaaagugcaguucaaaauaaaugcaaaagaguaauagcauuuaaucugguaauuuggauuuauuuauuuuuuuucuuuugagacgagggucccacccugucacccaggcuggagugcagugguacaaccuuggcacacugcaaccuccacaucccaggcucaagcaauucuucaaccucagccuccugaguagcugggacuacaggcaugcaccaccaugaccuggcuaauuuuuuuguuuuauguagaggcaggguuucgccaugcugcccaggcuggucucgaacuccugagcuccaagcgguccaccugccucggccuccuaaaguacugggauuacaggugugagccaccgugcccggccaguaauuuggauuuuugacaugcuuuuagcaaaguuucuaguaaauuauuguggaauuagugcuaauucguauaaucuuuguuuuauugaaguacaauaaauauaguacaauaaauacguuaauaugguaaguugcacaaauuuuaaguguacaucuugaugaauuuuaaaguaaauauauguaaccuuuaucuaguuuaaggggcagacuauuucaagacccuaaaaacaucccucauggccuccccaggucauaguauuagaguaaucuuguauuguuuuuuccagauaacaaagcuuuauucgucauuuccaugucagacaauggcgcucagauuuaugaacugguggcacagacaguuucugaaaagacuguguauguaucagauauggcuaccuugcuauagcuaauauuuucauuaucccaagcguaauauuccauaaacuuaacuuuguuuuuauaauguauggaaaccaagcacuuccucuguacucuuuuagagacguucuacuaugaacuuguucuuuuuuagguugaugccuuuuauuuugauucuauucugaaaguuuauuuccuaaagaaaaaauugugcaaaaugucaagugaaguuuuuuuaauguguccauagauuucucuuaagguauaguuuuggacucucgccuuaauaguguguugccaaaauaaagauauucucuggcagaguggguuuuguuguuguuguuguuguuguuguuguuguuguuguugguugauuugguuuuuguuuaguuuugcuuucugaguauauuuaaaggauauuucuuuuuucuuuuuuguauuuuggauuucuuuccaacuuucugaagcuggcaggaccuaaucugucggauggcugcaucagugaaggagcaauccacaaagccaauuccauuaccacagucaacaccuggcgagugaguguuccuuugcauuguaguaggacuuauuuuauguuuuggguuggaaaagacuaggauaauuauuauguuuuguugcgaugauguuuagauaccucaggaagguaaaaguuuuuuuuuuuuuuuuuuucucuacagaggagauaaugaugaagaagauccuucaaaauuaaaagaggagcagcauggcauuucagucacugguuugcagaguccagguacacucuucugaagaguucaauggagaaugugcucuauuaucuguuaaaaugcuggccggaugugguggcucaugccuguaaucccagugcuuugggaggucgagauaggcguaucaccugaggccaggaguuagaggccaaccugaccaacaugacaaaacccugucucuacuaaaaaauacaaaaauuagccgggcauggugguaggugccuguaaucccagcuacuugggaggcugaggcagggagaauugcuugaacccaggaggcggagguuacggugagccgagaucgugccauugcacuccagccugggcaacaagaccgaaacaccaaaaaaaaaaaagaaaaaaagaaaaaaaagaaaauaaaauaaaaugcaaagaaacuuuaauacuguuugguuuaugcagguuccagcaucagagauucaguuuaacaaacuuugccuuugagccuucugugugucaguauaacacuguucuaagugauguguauuuuucuuaacagaugaucucuguaguuuauggauuguuuuuuuuuuuucugauucuucccugaaugcuucauguuaaaaguuaaaagcuuuguuuagauauagucuaccuuuucuauuccauuggacagacagagauuugggauuagaaucuaccuuaauaucgucaaaaccucagucucauucacugaguaccucugggaaaucagagguacgugaucuguuuguggcugagagacaguuugcaaaggaacaacauacagaugggacacuaaaggaaguuggagaagauuaucaaaucgcaaucccagauucacaccugccugucucagaagaacggugggcauuggaugcacuaagaaauuguaaguuuuauucauaacuuauuacagauacuuacuaaguaugacacucaugugccaucccuaaaguauguggauuuaucaaacuccacuuauucuucuaguucuauuguggagauuauaguauucucuacaguggcccaugccacaggcacacacacacaugccacucuguuagcuccccaccccccugccugguucagaaucacuguuaaaaugggaggauagcauaucucucaguuguauugaggugggaaaaaggcugagaacaauuucuuuggcuggggagaaccacuugaaauuuuuaaaccagcguaugacuaaagguaugaaaaaagauuaaucuggcugaaagcgguggaaggauuugaauggaaagagguauggaaugguguacuuacuaaauaagcuauuauaauagucuggccugagacuaaaagaguuuggacuagaauguuaucagaaggaauaagaagaaacugagaagucaucaaaugcuuaaaauaauugacuucuuugaaugugaggucaaaggaaagggaauauuuagagauaauuucauuaaucuagucagaaauaagagucagaaaaggacuaccacugcuucccccaccuccuuccauuguacuuucuuuuuucuuucuuuugauuugguagaauuauaggcucaguuuuaaagcaugucaagauuaagauaaugaaugacaaaacacuaaaaagugaguaacuagcaggaaguuagaguuuuaggagugaaacuuuagagagagguuaggaagagauagagaugugagcaucagagccaugagacuuccuggcaucucucaggaagugauuguagagcagaaggacagaggaugagagaccuaaguggaaccuguugccuaaagaaacaugacagacauuaagcuagugaugagagcagagaauugguuauuuaaaaccuacaauauuuuuuauaccuucuccugaauuaacagucuuaauaauuucugaugguuggaauaacauugucccaauaacucuaucauugucugggugaccucauagcauacacuuggcccauucaaaauuaaauugguucuuauuuucaguaaauguauguaucucauaaaauuagaggaaauaauaugcauauagugucuggaucuggaaaaagcagaacuuuuuuuuagcuuuuucugucuagcuuaacacagccuuucaacauucuuaagaaguaccuuuaggguauuauucuaguuauauagaagaaaaaauagaggcaugauauugguuauugaggaguucuaaauaguaguaucucccuauucagaaugcuuagaucuuuucaaguuuaguuuaacguuaaaucuucucuaaaagauggugcuuuauuucaucuucaaaacaaaauggaaaaugauuguaugaaguaagaugauuguaugaaauuaauaauuaacauuuuaauaugucauuaaaagauacuuuuuaaagauagaucauugguaagucagcuaauuuaauucuugcagccugagguuauaguugugaauauguuuuuuuucccccuccuuccuaaaucguuuaguggguuuguugaagcaguugcuggugcaacagcuagguuugacugagaagagcguucaggaagacuggcaacauuucccaagauacagaacagccucucaggggccgcagacagacagugucauccagaacucugaaaauauuaaggccuaucauucuggugaaggacauaugcccuuuagaacuggaacuggugacauugcaacuuguuacaguccacggacuucaacugaaucuuuugcuccacgggauucagugggacuggcaccccaggauagccaggcaaguaacauuuuaguaauggaccacaugauuaugaccccagagaugccuaccauggagccagaagggggucuugaugacaguggagagcacuuuuuugaugcccgugaagcacauagugaugagaauccaucagaaggugauggagcaguuaacaaggaagagaaggauguuaauuuacgcaucucaggcaaguaucuuucacacuuaaacuuugauuuugauuuugaucauuguuaacuguccuguauuuugaaauggauguuguauugguauccagguguguguguguguguguguucacacaugugcaauauuuauuccuucauuugauaaauacugaaucuacucuguaccagaccucaucauaggugcugggagauauagcagugaauaaaacacagaaaaaucccaucuucucaugaagcuaggggaaagaaggaugguaaauaaguaaacaaauaaauagacuucaggaaguauuaggaagaaacauaagucagacugaggggacggagaguaaugaaggcaaacagggugaucagggauuaggaccuccgaugagguagcauuugagcagagaccucaaugaaaugagggaauaaagccggguggguaccugggagcuuacuauuccagcagagagcagaguggggcagaggcuuugugucaaagagcaagcuuuuuguggugaucgaacacuggaugagggagacaauggcaggagauggggcaagagaggcguuuggcaggggaagugguagcaagaucauuuaggcacuguaguuuccagcuuuaaacuuuugaaaugaaauuuuuuggaaauuaccaugaaaguuugcagaguuuagcuuucaucugaagugaggaaauucugauguaccugaaacuaaacucaggaauuaauggcuuuucccucucuuaauaacuuuucaaguugaaguugucagcacacuaugcuauuucuguuuucuaauggcagcacuggucuuaucaaacuauucugucucuauccauaggaaacuauuugauccuugauggcuaugacccagugcaggagaguuccacagaugaggagguugcuuccucacuuacccugcagcccaugacaggcaucccugcuguggaauccacccaccagcagcaacauucuccucagaauacucacuccgauggggcaauuucaccauucacccccgaauuucugguccagcagcgcuggggagcuauggaguauuccuguuuugagauccagagucccuccucuugugcagauucacagagccagaucauggaguacauucauaagauagaggcugaccuugaacacuuaaagguaccucauacuuccacauccauaggacuugguuguaagaaacauuuagcagaggggaagaauagggugaugaaaaugcugaugucaauaaacuuguucagguucuagauuucuuugacuauuauccaugaauaggccuggguaaaaaguugagauuggcauuguuuaucuuuuucuuucuuucuuuuuuuuuuuuuuuuugagacggagucucgcucugucaaccaggcuagagugcaguggcgugaucucagcucacugcaagcucugccuuccagguucacaccauucuccugccucagccucccaagcagcugggacuacaggcacccgcccccacgcccagcuaauuuuuuguauuuuuaauagagacgggguuucaccauguuagccaggauggucucgaucuccugaccucgugauccgccugccucggccucccaaaguacugggauuacaggcgugagccaccgcgcccagucggcauuguuuaucuuuugacuaucacaagagcagaaaaaguugcagcucugugaacuguguguuuguaugggugucuaaguuuaagaaccugaaaugcuucggguaguuggcuggccucugucagacaugaacaagaagaugagauagguaggguuuauguaguuaugaaucuaggcugagaaaugcuaugacuuucuguagccuauuaucugugacucauuaggugacauuggcagcuucccaaauccuaugacagauagaaauuggcuucaguggcuccuguaaucuaaaaacauggucaugcaugggauuuuuguagauugguaauugaagaugucacuauugcaaaacugacuuguguggcaauuuccaagagaaagaccuaucuuaaaguuuuccaucagaggcagggcacgguggcucacgccuguaauuccagcacuuugggaggcaaggcaggcggaucacgaggucaggagaucgagaccauccuugcuaacacggugaaaccccgucucuacuaaaaauaaaaaaaaucagccaggugugguggugggcgccuguagucccagcuacucaggaggcugaggcaggagaauggcaugaaccugggaggcggagcuugcagggagcugagaucacgccacugcacuccaaccugggugacagagcgagacucugucucaaaaaaaaaaaaaaaaguuugccaucagaaaacacagcuuccagagcccaaacauuuuccucaugacaucauuuacaccagagacuugagggguagauuuaaguauccuuagccuuugaguuaaagacuggucucccuuaguuucucuuuuaccuucauauaauugauuuuucccucuucauguuacuuauuuuauguaguaucauucuguagcugaugagauaucgacaagcccauugaggacaggucgguucuuauauacagucauguguugcuuagcaauggggauauauucugagaaauucaucauuaggcauuuuuaucuuugugugaacuucacagaguguacuuacacaaaccuagauagaauauaucuuuauuuacauagauuuuuucauauggaaagccaaaucucucaacacuauuacugaauauuagucauuuccccuaccugaucagcaaugccauuauuaagugccacacaccagguuucuacaugugcuccauaauaaucuuuuuuuuuuuuuuuuuuuuuugagacagucuugcucugucacccaggcuggagugcaguggcgcuauuucggcucacugcaaccucugccucccagguucaagcgauucuccugccuuggccucccaaggagcugggacuacaggcaccaccaccaugcccagauaaauuuuuuuuuuuuuuuaaauggagucucggucugucacccaggcuggagugcaauggugcaaucucggcucaccgcaaccuccgccucccggguucaagcgauucuccugccucagcuuccugaguagcugggauuacaggugcccgccaccacacccagcuaauuuuuuucuaucuuuuaauuuauuuauguauuuauauuuuuugagacagagucuugcucugucgcccaggcuggagugcaguggcaugaucucuccucacugcaagcuccaccucccagguucacgccauucuccugccucagccuccccaguagcugggacuacaggcgccugccaccaugcccggcuaauuuuuuuuauuuuuaguagagacgggguuucaccauguuagccuggauggucucgaucuccugaccucgugauccgccugccucggccucccaaaguguugggauuacaggcgugagccaccgcgcccagucccagcuaauuuuuauaauuuuaguagagacaggauuucaccauguuggccaggcuggucuggaacuccugaccucaggugauccaccugccucggccucccaaagugcugggauuacaggcgugagccaccaugccccacccauaauaaucuuaagggaccaucaucauguaugcaggccgccaugucuuuaugugcugcaugacuauagcucaugcacaugaugacgggaccauguccagggugacuccugggggugggagaauugcaucuaugguuaccaccucuacuuucuuuuuacaugggaaaauacuaaguuauuccuucaguggagaaauugguaaaaggaaugaaauuuacuuuuuucuucccacuaaugaaauuuuuaaugaugaaguuaauauuuuugaaauuugggggcuuguaccuguaauguaaaaagggcuucuuuucuguuuucugaaguuuuuguuuuguuuuguuucauuacguuugaauaaaaaaccuauggguuuuauuucacagaagguggaggaaaguuacaccauucuuugccaaaggcuggcuggaucagcccucacagacaagcacucagguauguaaaaguuaugaguuccagacucuagacuaaucauccuacacugaaugaaaugacuuaucauacuuugaagugaaaaccuucugagauuccauuucucuucugucuuuaaagaacugccuguuucuaaacaucagauaucaagcggaagcucaugccugcugacucuacucuucucuaagaggaacugcaguugucaguucccauaccauccccucuucucucucuuuucaccuuuucaaagcagaaggcagagcagugggaagccugguaaaucacagauucggugugaggcuuacugguacugcugugacucccuaguguggaggauuuggccuuauuggauguuggugcacuugccucugcugacaguguggcuggugucuccccugacugcagauggauuuguguucccugcagcaguuuauacucaucugcuuacauacugauucagaaacaaagauugaaccacgcccacagaugucauggguauucuuugcaauguuaguauauucuuuuucuuaauaucauuuccauguaucuuuauucuucucagauaaaaguuagagccgcauguccuggaggugacugcagguuguuggauuuggaguaucggccgugucucaccacauccuggcuccaguguggaugcagagagagugugacagaggaucugccugugaaccaccugggauuagucaagucccaaggugcccagagugggacuaguucuucacaguguggcagcugcacuaaucuguuugugagggaauauccauucccucacucuacucuccucacuaucggaaauucauuuugauucagaauaaaaaccaaauguauagagcuuuggguguaggauaugaaauuguacuuagauuuaagaaaaagagaaaaucagauguauuuauuugacuucauuccguauuugaaagcacauuuuaauuuuuauuugccuuguuuuguuuuaauugaguagugagaguuuuagaccuuugucuuuaguacacccaaggaucaacugcuccugaagcaaagaggucaggauggaguaugcagaaguuggguagagagguuaagaagaggaggaagugagacggggaagggaggagcaccuugcuucacuauacaguauuccaagcucucugcuguccaguaggcugcuucucugagggucaccucaaagguaugcuaugccguguggcucuuaugugcccaggugguguggucagagaguggaugggcuuccucccgcccugaggcaagcaccucuucucuguagcugggaucaaccacaauuaauaggaauccucaacauacuaaauagcaggcacuugaaaauggguguguuuucuuccauugucgucuuuucuauugaggguugggauuugggugggagaggaaagcaaauuuuauuuucuugacuauaaauuuguuauucuugguaucauuucauuuuuauaauuauacauuagacauuggcacuuguguaaaacugucccugcagauugagcaggaaguaaaaacaaauggaaaugcuucggauaguggcagggguggggguugcuaaggaaagggugggaugggaguggguaaagaguuugggaagguuaucuaacugaaucacuacugaguugaaucauggcuaucauuagccacagguacugcugauuauaaggccaguaaaauuuuaguaccuggagguuugacucuaauuuuugcacugauggugccaaagggcccugagucaaaaggauagccaaggguggaguggaaaaagauauggugaaggcagaacugcucacaccagcuccagaagcacguccucugacuucacugccgcagcucuuuccacacggggccgugauugacccuaaaaauugcagaccagcacauacacuggacacugcaggcaagguguugguaacugccugcucuaggaugaauaguagcguuagcagcacccuacagaggguaaguuucagaauuguaauuugagaacuccuucaauuauauugacuuucuuugguuuuccuugugcauuagguauauauuuuuugaaguauuuuugccaacuaaaaugaagucuguaaauucuguuaauaaacaaggaguucauccguugcucacaucuuucauuggugcccucugaacucuguggguugcuaggauguaauuuuaaugcuucccugcaguccaaagaugauuuuuucaccacaaaugguaagggaugcccaccuacuuuuauaaacaccacugcaacuuaacaaguuuauuuaucuauguccagauuucuguuucuguccuaaauugaucuguguuuuuagguggaucaacuuggaucuuuagaccucaucuauaaauugaaauuauauuuuuagucauaagccaaguacaaucuaacucagaaugggauuaaaaauuuuagaagcagaagcuaauauauaaaugaaguuugggauuuggaacuuucuguaucucuuaggaggaacaaguaaaaaccaaaugguuacauugugcugcuagaaauaaugucauucucaauuaaaaggguuacaccuguagccacuugacacuaacaccaucgagggcaauuaaucaggagaaaaguaaauauaaaaacuuugcucuuaacgucacacacuacaggguaauuauguaauucucuagcacucaauuaagaagcuuguagguuagcaaaauuucaguuucucuaguucagccagugucuuguccuuaguaauuauuugcuuucccugcaguucaauuucuccuuggaacucuaacaggacuaacuggaaaaauacuuugaccauagcucuaguacuuccaaauaaauucauaucuagauuuucaaacaaagccccaagaugaagucuaauucugaaaauaucucacaauuuuugaauguucuuuuuaucuuaccgaccuaacuucucuuuucccucccaacuuggccucccacacguuccauuucauuuuggccauuauagucacauccguuugacuuugguugugacaucuuccuuucaggaugauggaauuagaugcagucugucuuugagugagacuggucaccaucagaggaguuuuuucuaagugacgugacuagaaguugaaaucuacuucccugcuaaagggcacaggggugguguacaaagaaagcuaccuucccagagcaagcaggcugcauuuuagcuauggaagugaccugcugugacacugugcucucuucugugggcuuaaugguuccuuugcuaugaaguggcaaauuacauguagagugucuccuuccuuuucagagaacaguuaaucaaggcaaaucagcaagcccccaaagugcuguaauuuaacaucaugauuaccaccuucgaagcuauauauuuugcauacuuuaaaaucaccuaacuuggacugcuugaauuacauuggcuuuuagaaccgaaauuguaacuauguauuguauuucaugggagguauauuuuaugagcuuuuuggcuuucuuuuuucccacagcaacugccaaugaaggaugaauccccuuuuuaaaaaguuguuguuguuguuguuuauuugauuuugaguuaggagggauaauagagaaguccauuuaaaaauuauuuuuagaagcuaaagaaaguaauuaugcuuccugugaauugucuuuuacuggcaucuuuguuuuccucuuugauguuaguaaauuugguguaauacguggggcuuccauauuucaaaguggaagcuuucuucucugaagucgauauaugguuuugaauuacuagagcuuuggucaguauuuccuucccuauaugucacagagggcaccacugagaacugcgugcauaggaccucaaaauacaaaauuagcagggccucacagucagcuuccucauggcuaguuuuucccccuuauauuacaauuuuuguuuuauaagucauuuuuuuccugauauuuccaccacuuuucagagucaucuacaaaauuuuucuuuccucaagaaaagaguuccuuuugccuuauuccuuaugccuuccccacugguauugaggguuuugauaauaaauugguaggaaaaaaaaguaccuccuagaaggaagccuuccccaccauuuccaggugccaacugcuaagcagauauauuccaaaaaugguaacugucaugugcacacuguugguuauuuuuaauaagccucuuccuacuagaacauuuuauuuuccuuguucaccauacaaucauguacucuuuaacagaaauugcuuuuaaaaaauaucuggaacuaucuuuaaaaaaacuuuauuaauaaucauguauuuuuacugaucacauuuugaaaugccuaaaagacuuuauuguucuaauuauccagauguaccuuuguaaaauagcucuuuuaugaauuagcugauaaggcuguauguuucuggaacaaaauauuggucaucuaaaaacuuucuguuuucuggggucugggaaaauagaaaauaagauuucaaauauuaaauaagcuuaaaggaaccaag

SEQ ID NO: 21454 - RNA, 5791 nt, Homo sapiens
auccugucuguccgaacccagacacaagucuucacuccuuccugcgagcccugaggaagccuugugagugcauuggcuggggcuuggagggaaguugggcuggagcuggacaggagcagugggugcauuucaggcaggcucuccugaggucccaggcgccagcuccagcucccuggcuagggaaacccacccucucagucagcaugggggcccaagcuccaggcagggugggcuggaucacuagcguccuggaucucucucagacugggcagccccgggcucauugaaaugccccggaugacuuggcuagugcagaggaauugauggaaaccaccggggugagagggaggcuccccaucucagccagccacauccacaagguguguguaagggugcaggcgccggccgguuaggccaaggcucuacugucuguugccccuccaggagaacuuccaaggaggugaggagugugugaacgcaccuguguuggagcacggugucccacucuggcggguccccagggccugagcagcagcgauagcccugugacaaugugaagggccacagaacucuuguauuccagucaggggcaaagaguggagacggaaggccuguccuucugacaagcagccccuuccacugucugacagugggaggucacccccacuguagcagagggguggggggcggguacugccaaggaggagcuuuggagugauaggcggggcaggccugggacccuuggucuuucccaaagggugguucccuuucgaaguugcuauuccaaagguagcagugaggauggcacacauuuauguagccaggccacuccuguuuguccguggaguggagaggagccacccuccugcccucucagagguccaggugugcucacuccuauuugggaagagagaaggggcacagcagcccugcaggggccccuggcucugcucguguuucugggcuucugcugguagggggugccaccuucccguuugacccuggacuuucuuucuccacugcccacuuucacccacugggcagcucaggggagggguccuggcaggagccacagggcaggaggguccaugccuguccaugcuguccugggagugucuugagaugccccugggggggccgcccuguaaucauccuccucucccccuccccacuggcucgaaggcaggacucgggaggcuucaucagaggacucuaaaggauuucuggggauucuccacuuuucgacccugacccaggaggaggaaggggaaggaugguggugcugggugggaguggggauggugugugcuucaucccccucugaccgaaauccuaaucuugucucuagaucugggggcugcagcguuguguaccugucacccuuagccuugcugcuuugaccuguauugucuguucugacccuccugagacuggaagcuggggguaggggacacacucuccuuccauccuguuccucaggagcccagcaggggugcagaaggggaaggcagacaugagggcagguggaguggggguagaagcagggccagagacagaagguggaugccugucugggaugguggugcaaaggcugagacagaggcugggguggauggaagccaggaugcagggcuaccaaaaucaccuggucccagcugacuuggggguuuggaccacaguucuuugugcaggaguccuugggugguuggggagcgggggugggacacacagggugaagggagggauuggcuguuuguagcugaacagcagaacagagcacucugccuuuggggucucuggcaucacuggcagggagagggguggcugggccaggagcccaccucauccccagugcucagagaacuggguccucagaagugguccugcccccacuuuacacauaaggaaacagacgcaaggaggagagggaugcccaaugacgggcacuucgaugaguccgugugaacucuguuccgugugagcugcugcgcgcucagggaaugauugugagaagcggguggaggcuggagugggcagcaaagaacugacauuuugaggucaguuuuucacuccuuggucaagggcaggcucucucccuggucauuaccaggagccuggcuccgggcagcaaagaacugacauuucgaggagcucugcuaagggccaggcaguaugugagggaguucacagacaccgucccauuuucacagcccucugagguugguaacauaacccccacuucacagaugaggaacuccagcccagaaagccugucagcccugagaaaggaagggcagggcaucgggcugggcagcuggccugggaccaguggggugugauaguguuggcucugcuucccgcggguggggugccaguggggaggggucucaccagagagggagccgggggagugcgcuccugcguccauccucagaccagcgugucccucccaaccucugaccccucugaggccaggggauggguucggcuuccuuugguaccucuuuuggaagucucuucagacaaacacuggagagaaggcacagcacccuagggugacaucaguggacaggucaguuuccuguuccuguucccagccaccccugucugucugcccagggaccuaccugccuggcccacuccugcugccaccccucuccaugagugggacuccugagcagugccaggcccaggcccucaggguggcaguugcuggauggggccaggcuucccauucccuggcaggcagacucuuggcucuggaagaucccugggggacucugacuucuugguuacucaggcuacuccguaaggguagccuuacgagagcguaagggcaugaggggaagucgauggguagaccaggugucucugauuucucugaggaaaugcagcuucuuugccaagaacucuugggcuuugguggcuucgucgcccuugccuggggugggcgaguuuuagucucuucagcugcagaccagaagcugagcugaccugaaaagagcuggaguucuggaguucgggcuuccaggccagggccugcuucugggugagagugggagguaaugguugcuugaggcagaggcaguaaacccucacacccgcagcuggacaaaggcaccagcuggcuguauucugugggggcaauguggcuucuggaaggucucuccaguggcucuguagcuggucuuggcaaagaauguucuagaccaaggguugucaaacuacagcucaugggccaaauccagccugcugucugcuuuuguaaguaaaguuuuauuggaacaaagccauguucauuuguuacauauugucuauggcugcuuucacacugcaacagcagagaccauguguccugcaaagccuaaaauauguucugucuuauccuuuacaaaaacaguuuacugaccccugcucuagaccuccaaagaccugguauccucuuuccugguguucaaguucagagaggugucuggaguaggggcugagccuggccuggaugggcagugcugugacaagugucuaggauggccggguauccugcacagagcuagaaggcugccuggcacgggugaaagcagagcugcucccugacccucugccccucccuccuccacccuggccugcuuuagcuuuccccagacauggccaacaaggguccuuccuauggcaugagccgcgaagugcaguccaaaaucgagaagaaguaugacgaggagcuggaggagcggcugguggaguggaucauagugcaguguggcccugaugugggccgcccagaccgugggcgcuugggcuuccaggucuggcugaagaauggcguggugaguggcacccugggcuagggcgcuggggggcuggggugugccacccugugaguccugggccaaucccugagcugacugcuaagcugcguccuaugcccuaugccugguagauucugagcaagcuggugaacagccuguacccugauggcuccaagccggugaaggugcccgagaacccacccuccauggucuucaagcagauggagcagguggcucaguuccugaaggcggcugaggacuauggggucaucaagacugacauguuccagacuguugaccucuuugaagguagagaggaagaggcugggggaggaggugggcaggaggacagggugcugggacagggagagggaaugaccagaauaugccacaacuaggggugugcuugcccgcacacagcagggaugggauaugccgagaauaacacgccacgcucacagggcccacugagaggccucccuugaauuggggacaacucuuggcccugguuuggccauuuuuuugugagagacgggggcaggcccuggcuuggagucuuguuuauacguucuugauguucaucuccucucuccugucuucucacaggcaaagacauggcagcagugcagaggacccugauggcuuugggcagcuuggcagugaccaagaaugaugggcacuaccguggagaucccaacugguuuaugaaguauguggcccccagggagcuugggucuccgcauggggugggagguggcuuguucuaaggagcuugcgggaaggauuaggggaagcagauagccaagaaaggauaaagugagggucugggauggggaauaauggguccuuaauacuccuugaccccucccuuuccacccuccugcgcucagucucccuagccuaugaggcaagcuagauuagggaaaaaaagugcaacaggaaggcaaugggauugggcuaggacguaacagagggaucagaaaacggguggaaaacacacaguucuaccaagucuuuauccugguuccuccucuucuaggaaagcgcaggagcauaagagggaauucacagagagccagcugcaggagggaaagcaugucauuggccuucagaugggcagcaacagaggggccucccaggccggcaugacaggcuacggacgaccucggcagaucaucaguuagagcggagagggcuagcccugagcccggcccucccccagcuccuuggcugcagccaucccgcuuagccugccucacccacacccgugugguaccuucagcccuggccaagcuuugaggcucugucacugagcaaugguaacugcaccugggcagcuccucccugugcccccagccucagcccaacuucuuacccgaaagcaucacugccuuggccccucccucccggcugcccccaucaccucuacugucuccucccugggcuaagcaggggagaagcgggcuggggguagccuggaugugggccaaguccacuguccuccuuggcggcaaaagcccauugaagaagaaccagcccagccugcccccuaucuuguccuggaauauuuuugggguuggaacucaaaaaaaaaaaaaaaaaaucaaucuuuucucaggccuggcuggcagaguuugauuugcccuggucacuuuuguuaugguuucagaucugcgcaggggacaggcaggcaucucgggcuuguauguguuccuggcugccguccucugaaggacccuucaugugccaagauuccaggacagucagauucuuucagaggaaacaggccauagaacaggagagugaaucuuggggaccgaagggaaaaaggagccacucagcagcaugcaguggcuuuggggagacagaggaaaggagagauugcgaguggcagaauuguuuggaagguuuuuauuuuggaaaagcugugcagaaaaaaauucaagaaaauguugcugugaaaagagaaaaacaaaucuuaagca

SEQ ID NO: 21455 - RNA, 330790 nt, Homo sapiens
cagucugaggcaggugcccgacauggcgaguguagugcugccgagcggaucccagugugcggcggcagcggcggcggcggcgccucccgggcuccggcuccggcuucugcuguugcucuucuccgccgcggcacugauccccacagguaggugugggcaccgaccgguuggccccuaaaucuccgaaggcaccccaguagccuuggccacagaggggggaaacguuuccaugacaaccuccccccacuuccuacauccgaagcggagggaguguggagaggaaacucagggcugagagggaaggggcugagggcaucugugagccccuucuccccugcccggcuaagugugaaugagaguccccagggauggcugcacccacaccuucucuccccggcuuggcgcggggugcagaguggagugagaauggggggcccgggggcuguaaagcaugggggaaggggaugguucaaagacaaccucaacccuuccggacccuucuaaacucgccguucuccccguaacuugcagguccucccaccucccagggcuguccauucgcccccaccucuccagagggcccccccaguucuccauccccgaagccuccugguggcugacucccagccgcccgcggcgugauuucuccccgguccccaggacauccccagacuugucugaucuccccugccccuucccccaacgcgcucugccuuucuccccuguccccaaacugcacgccucucguguuucccuccggccguucgcagcccuccgcccccucggcucugcugcgggucuuuuuggcccggcuccaggcggggaaaguuccccggcccggccccgcggggggggcggccgcugucgccgccucugcgggaaggcgccgggagcccgcagcccgcccgccccacagcguccucugccacgaguggggacacgggauuucccggcugcccguucuuucggcggcccgaggguggcggagggggcgucgcggccucugcggccaggcgggcacccugcgggccuccgcgcgcucccugcgugaagagcagucuugggaauuugcccaggggcggcucugcacgcccggugccuucccugaagacaccgagcacucggcuggagcccgauguguggcugcccgugugccgggcgcguuggcgcggucgggaaagaagagggcaguguuugcuuuugcuaacaaaagggagccggagcucuuccucagcggagaggccggcugugcugcacccagccucccuucccgccaccucgccgcgcuuggcagccgcgcggcguccucuggccccugcugcaggcuccaggcgggcgccgggaccgaguggcacggggccgcggggugcgagcggcgaugcaggaggggaugcagcagggcucugagccugcaaagccccuccuugcagcuccagagcugcaggacccgggagcaacaaguggcggaggacgccgagagcucagcccccaccugcggagccccaggcccgggcgggcacagcguuggggccacggugcugcuucaggggcgccucuccgcuugggcugugccuuuuguuuacacgcuagaggacacacaguuauguaaacaccgcaggagacacgcuguaggagacgggggaugugugggggugcuagcuugagauuugggggacgccggguuggcugcuugcccccaaaauaggcuugcaaaggagcucggcuugggaaaccuauuggggggcgucuggcagcagcgucaauuccagcgcugaggguuuuuuuccuccaugccacugucuccggauguuguuuauguguuuuuccucugugaauucuuaauuuaugaguuacgagauaauuggguucagccgaugccggugugguuacaacuucauuucaggugaugccucugacuggauggguucaauaaaauguuccugaaagagaucccucgugcugcugcauuguaaaaagcgccagugucaguuaaacgugagcgugaguaaaggcucgguaacuggcgcauaauagaggcaacaauagacuuguauuggcugcaaaaaaaaaaaaaaaaaaaaaaaaaaaagccggggggcgguggaaagcuguggucggggauauugcuuuuugacuaaaaaugggagucgugcaaugacgcuuggcagcagaaguaggauuagauuaugccuccccugucaagacugcucauugaaggcaccggguaguagcaacgguacuauauuuguaacuaucucgcggugagaaguugccuucccugcgagggauauaugcugacuuaggagcggucuggaacucaaccgugcaugucaaagcuacaugaaaauucuguugccaguuaccauggaagcagcuucuugcucuuguguacaucccuguuuguaugcugguuaucagauuguguucaaauuagaaaguaauuggguaugauuuguagugaggagaugagaugacuuucuuaauuuuuuucucuuaaugcauauauauauauuucguggugaguuugagaggaggucuuggcucauuccggggucccauaccccagggguaaauuucaggugggcaccaagggacuuuuccuccucaguucuguuuaagcuuucucagaggccuccaguucccacucccaggguuaaagaaaccuguuggugcaucugacuucauuaggcuuguuucguuuacauccuugcugggaaagcgaauuaggaccaucgugcguggguccugguucuguuuucuccuguaacugaagccauccaucccccgcagaaaaucuccucucauuucuccugugauguuuggaugaaauggauguuaaugaaaugcaguaaaaauggguuugcuuaagcucacuccacaguguuaaucacgccuguuauacguucaaggugcaugcaugauguuguuuacgaucccgagugaaccaguagcugaucaccccccucuuaucauuuucaggauuagagaagauggcugguggaugggggauuuaugguggugaugggaaggaggggggcugacuuuugcuugcuuuggccuguuggggcuugcaaaccggggauagagacuuuacaaaagugccgcccuguuauuguugccuuucccugcaucagauugaauagccgcaguagggacuugcacuugucugugauagauuugauaaaauaucccucauuaaugccacuuuauauuuacagugugucacuggagacgcacaaggcuucauuuagugacuugugugacgagacaagcuugcauuauuugccugggacguuuuggaggaacaagagacccauugagcaaucuuuugaaaugaacaaauacgaaaaagggggggaauaaaagagcaggcaguucucuggaacaaagagcuuuauucauauggauguuguacaugcuuuauccaguuuuccccaauggcccuccugguaaaggggagugggacagggaagacgccaacaggcaggacacuuucguuuccucucucacuuccugacuucauauucuuaucggaguugguccccggcucacugccugcucaucucucuccacacucucuaaaaucccagaagguaacggauuccugggucuccacagagagauugugaaauccuuucuuccagcucuaaauuucaacagaagacaaugcuagcuaccuguugagguugauguuguuggaggauauauugguugaagggaaagagaugucacuuuucuaugacaugugucaagaagugguugauagugaaugucagauugguaagaugucuugcaauuauaacauuagccuuauuauuuauuuggaaagaaaugcugugaaaaccagcauccaaaaauuguauucuuauugauggugcucuuggaguuuuuagugacuuuuucccacaccugguacauuuuagucucauacauaagugaauuuuuauuauuccuuggccuauauugcuaaaugauuuuuaggcuuuaaaaauugauaagauugcuaugaauauaaacugucucauucucuugggauuucuguacgugacauuuuaaugccuaauuggucacuuagaauuuacauuuuagaaaugauuuugugugugugugugugucuguuuuuagcaaaaggugcauuuuaauguggggauucucuuaaauugggccaaacuaaucaaugcuauaauuugaauggaaauuuaccagcagaugaagaaaauucaaaauaaauccaaaggauucaaaugcuguacguuuuucuugggaagaauaguuuugaccauuaugcugggcauuuuuaacugaaaauccagcacagaaaggagaaaucacacagcgacaucuguugcagaauugaaaauuugcugcuuugaguuggaagcaauuagucccauauaagcaccuaaugguaucaguguguguguguuuguguguauguauaaguagugauacaaauacauacauauacauacuuauauauacauauauaugcacaggauacaaaaacuugcccacauacaauauucauauucacauuaaaaauuauguaauagaaaauguaacauuuugggacuaaagcuguuuuuaaaaauauuaccuuuugaggaauuagagauucuuauaaucauggaauuuuugagaggggaaagauauuagaaaucaucuggugaaaucccauuuugaaguaaaguagccgaaggccagggagggaagaaucuuacucugcaguugaacuaaggcuagguuaacgacagauccuggauagggacaggucccuugauguccagccaguggaccuucuguuccgccuccuggcaaggaugccuggucagagauauggaucaugaauagacacuaucuuggcuaaaaauauuuuguauuuugaaggcagcaagauuaauuguugcucuagguaauaaacccauggaucagaggagugaccucugggaagaaaggaccaguucuugguaauauugucuuugguguugacaaaugauccugaaaccucuggaauuuauuuggcagccgcaacagaaaugucauccaaagcaccuucauaggggagaaaucuggauuugugucauuggaauaagucugauaugcaaaaaccaggcuucugaaggcucagauuuagauuucuacaguuuuuuauuugucuuuucaaggauuaauauuagcaguagaacugguucuguauaacuaaggaaaaaaggaaauguucuuaagaacaagaacagagcuugauuuucuuaccaggaacuugccucuuuucaugaaaccaagaaaaagcugagaauuuuuuuuguuguuuuuuaaagaaaaaaaaguuuuauuuucgaaggaugacuuuuuuuuuuacauugaucagauuuuucuuuuuucccauuuuauuauggaaaauuucaaauauguauacaaagugggaagaauaccauauuuaaccaugcaugcaaaucacccaguuucaauaauuauccaccccuggucgcucuauccccucugugcuucuuccuuuccucagauuacuuuaaauaaauccugaacauccuaucauuucuuccauaauuacuuuuagaaugauuucuaagauacagccccucuuuuuccacuccuuaucacaguauuauuaucuggccguacgcacaguauucucaccuggauguaccgaauuuuugccuuagcuuuacugaggaagagagaaugaaggcuuguugcaguuggugaaagcaaaggcagaggccagagaagcuacagcacgauuauugcuucuacugaggagaccuucuccuaugguuugguuuauuuugagcaagguuuuguuuggaucggauaagaugaguuuuauuguugugcaaauacaguuguguaaauaugcaguaauuguagcuagucccucaacuguggcgugcgcuggaaagcaccguuggcgagacuggccauuuccaauuguucccauaaugauuaccguccaugugaggacuucuguaggaaaggcucauguuaguuugaugacuaugagauaccccauucguauauuugucuuuaaaggccuccaugguauaaauaccuuugcauuuugugaauauauugcuuaaaauaaaaaugucucuuuccauuucgaacuggcuaagugcuaauuucagccgcuauucuguaacugaagugaucacaaaaugccuucuuuggugugggaaacucaugcaucaggcuguaaguauuugggccuuauuuuugugggaugguggugaaggaugguggggagagaaaagguuacuaccuuuacuucuuaauauuugcuccauugauuuaaaaugugaauuuuuaacuucagcuagaaauguuggaaugcuucaguguuaauuucaaaaagucuuugguuuuucugaaaauuguuccguuuuccaagguucaugaaaugugaggguuuuuuuuuuuuuuuuugaggcucuuucucaaaaauuucauuaaauauggacuauaaaucugaagcauuuaacauuugguuuuuuuguuuccagacaaacagggaauuaugcaugagaugauuuugagggguccgaauggcccuggacaggugaaaaccugcccccugcaccgcccccucugaguugaccaggccacaagaaaagcacaaaggaaugccuacauucacgauuuggggagcaccagcaaaaucgaauaaaaagccuuaguuuggaaaccaucaaugaaggaaggaacccacuggaauguuuguaauuacaaguggcaccuccuuguuuaaauuucagaagccacaguuucuuuuucagagauuuaaauugcaggcucuagccagcagcugcuguugugguuaaugggcaguuucucuuugaagaucuuccaagugcugguucucaaaagcuuuggugcaguuggccuugaacuaggguuagaaaaaagggcgauguagauauuuauacaaaugcacagcucaaaugacguguggccuuuauuauuacucaaaagaaacuugguguuaagguugagaaaaacccagcacugagaaaaaccuguuaugacugacaggugucuugaaugaggugauuaucuuaagggagauaaggugggagaaauuuuuucuuuuaguagauguuuuacuggaauacaggcauuugaccuaacauuuugaucuagguauuucagaaauguuaaauaggcuugaaaugaaagugcugugauauauauuuaaaugcuacucaguguuugaaguugauauuccagugacauagacuuuuaaaaaugccuagaauaaguaucuugcucuuggcagacuuccuugggaagguaggugcucugauuccucguuggcuguccagcacuggacugcagugucuaguuggaauugaguuaugccgucccuagaggaggugggaagaaucugccugaaaacaaaggguucuccaguucccugacucccauugucugugccauaucuccacuuggcugggauuaaccuaaaaguuaacguuuaaaaaauuugaaccuuuaaucuuuuugcaguagguaucaacuuuucucaaagucuccauuauuaccaaugacaccauugacauccuggucuccaaggccccuaaauuuggagucuuuuuuccccuccuuagcuuuccugcuugcacugaaauaaaauggggcugauuguuucuaagugacauucucuggaaacaucagugcccucuccaaacuguguuuugcuaacaggaggcuccuagccaguucccccuacucuaguccucugcuagcuacugcaauucuaauucuuuucaggacaggaucauaacauuucccauucagaaaccuaaucucaaauucuuacuucuugcaucagauucaaacuccacacuguuuugucuuuagguuguucuuccucaauugcucucccacucccucucuauugcccucauuucuuauuacuuuucagcuuaauccugaugggacuggaagacugaugauucuccagugaaacugaggaagaaagugguucugccuaucagccuucagcugguuaccuuugcauaaaauacucucuuuaucuuuuuucccuuaacuaacugucuugguuuguagguguaggauggcugauuucucuuugccuacauugagaauaaacaccuuccuuuuacaucuuucauuuuaacuaacacauacuuaccuaaaagguaccucaacccacaaguuucuuucuugacuucacagguuuauacaugauuauguuucuugaugcuaagccaaacuguguugauauuauggccaugauuuucgugaaaauuuaaaacaauacauucaugaaaauguauugucuccauuugguaguuuguauuugaauauggggauuuccuacagcaugaaaauuguguaauugacuaaacaaauuacaagcugucaaaguaagacuuucagacaaaaagugaaguccuuuagaaguaggaagacuuuuuaagggucacagucagagggccucauguggaacugcugacuuggggugaaugagauuggcuccucugaagaugauccaagagauaccaccaccuuagaggaguauuuggugcuugugucuggugcguguaguuaccuaguuaccagaaaauaauaaauaaaauaaaauaaauccuaaaaaaucuacccagagagauggaagggaagugcuuuaaaacccaggccuuuauuagcuaguguuuucaacacguuugacuuugggagcagagcugccuggcuaaaugaaguuaccgccaucagucacugccaggccagcaucgggacaggucuaggaauuuaguuacauuuugcauuuugguagauaacauagaggguggauuaucacuggcucaagaaacaaaaaaaugaaaccuuucuuucucagucuaccugcuaaauuuguuaucguaaggaucuuuucaaagccuuuaucugggagcaauaucugccagaguucuuccuuccuuuuuugcuugccugacacccuucccuucagaguucaguucuugcuaguagaaaaaggcuaugcagcaugauaauacagugauuuuaaaaguugauuaucuugaaguauuuugggacaguuuuggggaauggguuaugugguauauauuuauuuggcucuuugcugaauauggcuguauaaauccagccuccuggauguuacaagucauccccuugauuucuucuuuugaauaaaaaaggagcauugcuucauuuuucuugcagaaacccuuauuuaaacaaugaaaacuucaaagauagggagaaaaaaaccaaguuaauuuaguacuaaauuacugcucaaaugguuuuaucuuuuaaaagguucaaguagagauuagcuuaaauacacugaauuucacuuuuccuuguacguacauaucuugugagcaaacuucauugugaagagcucucugucuucuuuaguuuuguuaguaaucacauaauuguuaguugcuguuuauuucccuuuccugaagcaaaucucuccaucucugggccagguuggcaaguggaauacccaguuaagauuacaggauaguaaaacccagugcuuuaaucaaacugcuuacuuuacaagauggcaaaaauaaaauaauauauaugaacacucuuaaguaggaaguguuuucugccuauuuaccuaucucuauuuaucaaucacuuuuauuaaaacagcaauaccuagugguggggguuauuucucuggcuacugcuaauaauaauaacuuuuguaagucuuccacauuagggaauacugaaaaagaaaauacuauguaaaaaggauuaauucaggauguacucagucaucucuaaggugaaacugaagaacaccgugacagcaagauccuaacuggaguugaauguuuuuugauaaguaaauggaaucauuuuguaaucuuggggaaacugacaaugauuauaaucucuaauuucugggucuucuaauacagaaaggacauauuguuucaugcaguuuuuuauauuuuauauacuauguuuaauaaagaaaugguguuucuguagcuaacccauaagacauuugguagaaaaaugagcauuuaaaaaugacuuuaaaauugaguaucugcuuuuauaccagacacuguguuagguucaucuuugucuuucagaagguucuagucuauuuuucccucaacuuuuauuucaaaaaauuucaaaaccacaggcaacuugaaagaagaauacaaugaauacuuguauuuacuuuaccuagauccaucaacuguuaacauuuuccccauuugcuuucucucucucucucaauaauguauacacacauacucaucuuuuuucuucccuaagccacaugaaagcacauugcaucaugaugaauacuucagcauguagcgccuaagaauaaagacauuuuccugggcacacgcaauaccauuauuacauugaaauuauauagucuauguucauauuuccccaguuacuuuguucucucugcugcagaaucuaucagagaucacacauuggauauggucucuagucucuuuuaaucuagaaccauuacccugcuugccaccuguuuuuucuuuaaggaguuuuuaagggguaucuuuuauggcauugacauuuugaugaauccaccugcucuuuuguagaauguucuguaguucuacaaauuguuugaucauuuccucaugguucaguucagauuaaacaucuuuugcaagaacccugcauagcugauacugccaacuuccuuguaacacugccucaagagggacauaauaucaguuugcccuauuacuagcuugauccuugguucaagauauaaauuuaguuacugaguguaggugaauuuguaggguucuccauuuuugucccuuuauaauuaauaaguaaccuuguguauacauaucuugugagcaaacuucguugugaagagcccucugucuucuuuaguuuugagccugaagaucuuguucucuaauggcccuuuacuuaauggauugagcagcauugguaaaccuugucugaaucaaauauuauguccgugguuauaaaacugugauuuucuaauucuguaauuccucuacuuggguagaggcauuucugaauaaagaagagcuugccuucccuacucuucccccucuuuuuuuuuuuuuuuuagaaaauuacaauggguucaguaugguauguuucauuaccaucggauuuggccagugggaaccccuucagaguggcuccuguauccuuuuaauauauucucauuaauuuuuaagcucuuuuguauuucaugucacaagaagauaucuauguuuacauuguauuuuccugcccccauaccuggaaucaguuauuucuccaaggaauccugauuccuuuuagucaaagaaugauauuuagacagcggacacaucuaagaauugugcucauugcuacugacuugucauuguuucuaaacuuuuccgugagcaaacaaggguguguguguguguguguguguguguguguauaaaauauccuuugucucaaaaaaaaguuauaugugaauuuucagcugcauggggguaggggcccuguguucaagggucaacugugugaguguauuuuaaaaauguuuauucauuuaaaucacaaugucaugcuaauacauucaauuccagucuaacaucugaggguacuuucucuccaucucccauuccuuauuuguguuuucuuucucccauggugaaaacucuguuucccagugauagcaacgucuuuuuaguacaaaauaguuuuggaauuacuccaccaagaccauuguagacaacaaaucuaccaaguagagcgcaggauuuuuugccacucuuuuugucuuuaaaauagaucccacugaggguagaugaguaucauguucacaaauuuacagauuaguuuuuuuguguguguguuauguaucaauagguauacaguuaggaucauuuauuucuguuuauauuuuguuuuaauuucuuuccuaucauuguugauuuauaauuugaacauauaacucauuaacguggcucaaaaucaaaacuguccauucucauuucguucccuauguuuuuuguaccauucccacccaacuuccuauaguugccaauuucauacauuucuuguauauccuuucaauuuuuccuuuugaaaauauaaugaguaguguucuauucucuuaaacuuucacacagccuuuguuaauaucugccuauaauauguauuauuugacaaauccuagguucucguauuuguuaugaugaccuuccuccucauuuggcuguauuuuacuuuagaagccuuuuguuuuuauuuauuuaauuauuuauuuuuauuuuacuuuaaguucuaggguacaugugcacaacgugcagguuuguuacauagguauacaugugccauauugguuugcugcauccauuaacucgucauuuacauuagguauuucuccuaaugcuaucccucccccugccccucaccccauuacagguguaugauguucccugcccuguguccaaguguucucauuguucaauucccaccuaugagugagaacaugcaguguuugguuuucugucuuugugauagguugcuccaaaugaugguuuccagcuucauccaugucccugcaaaggacaugaucucauccuuuuuuauggaugcaugguaucgcaugguauauaugugccacauuuucuuaauccagucuaccauugauagacauuuggguugguuccaaguuuuauuccaaguuuggguugguuccaaguuacuauuuucacuuuucucccauuucuuccuuccaaguucauaguuuuacuuggauaguggaaggaauucauuuuuuauuuucuuuuuuuuuugagauggagucuugcucuguugcccaggcuggaguacaguggugcaaucuuggcucacugcaggcuccccgccgccagguucaugccauucuccugccucagccucccgaguaggugggacugcaggcacccaccaccuugccaggcuaauuuuuuguauuuuuaguagagaugggguuucaccguguuagccaggauggucucgaucuccugaccugaugaucugcccaccucggccucucaaagugcugggauuacaggcaugagccacugcgcccggccuuuuuuuucuuuuaauucaucaaguuacuugcaagaaaauaaggauugcccuuuucauacaauauaacgugucucugauauuuaauaaccaugccuuaccuugcuucugaucggcugucuuuuuuuaacccuucuccuuauccaauaaguuggcaaauaaaugccucaaaccccaauucuuccaacuuuuuuuuuuaauugcaguauaauuuacuuuuaagugcacaaccaagaugucuuuugcauuuaaaccucagacuauguucuaaaagugccucuuggacaucucaguccggauguuccaguuaucucaaauaauaugaaugacaaaacagcaguuauauuuagugucuguauucaugaucucauuuaauccucacugucacccuauaguuaccacuguugccccauuuuacagaagaggaagaggagaggacaguaauaggucccuuguccaagaaacacaaaugguaaguaucagaaccaggaucugaacuauaucuauguucaaaacccacaguuuuaaacacuuaacugcauuuuccuaaaauucaagacgucuaaaacugaacuucacaucuguucuggccgggcaugguggcucucgccuguaaucccagcacuuugggaggcccaggugggcggaucacaaggucaggaguucgagaucggccuggccaauauggugaaacccugucucuacugaaaaauacaaaaauuagccgggcguggugguaggcgccuguagucccagcuacucggguggcugaggcaggcgaauugcuugaacuugggaggcggagcuugcagugagcugagaucgcaccccugcauuccagccugggcgacagagcaagacucugucucaaaaaaaaaaaaaaaaaaaaaaaaucuguucuucccacaucucccucuauuccauguuuccuauucugaugaaggguaccaccauccauccaaugaguuaaauaaaccugggaguccucauagagaauucccuccuuuguuaucaucucccccuauauuagcuauagguccugccugucuucauuuuacagacgaggaaaguagacuuacaaugguauaacagccccuuaauuguuucauuuacugcuagccucauuccuuguaaugcauccuuaacacugauucuagaggaaucuuccuaaaauacaccuuagaugucacuuucuugcucaaaacuuuaaauguuuuucuuggcacccuaaaggugaggcuuacccucuuucaguguguccugcaguguccuucaugcuuggccucgccggcucuccacaccauuguuuuugcuuuaggacuaccagaguaaauguguccuggaugcaccaugcucucccaugccucucugcuuuuuauaugcuaccuccucuaccuuaagcaccuuaauguauauggcuaguuccuacaucucucucaagauucaccucaagcacugcauucugaaaggaaacuuccaugauuacucaggcugguuagguaucuuuucuuugaacccuucuucuguacuucccuaagggcuacuccuaacuuaucuuccuccuuccuaucaaacagacuucucugaauggccugagucucuucuauaugcccgcuacacauuucguccaacuuguuuccaccaauagacauguccuauccucauaccuuccacguaggcauauuuaaaucccauguauauguaaagaccgaaguccaguguuuuuaagucuuacauaauuucucagcuugaauauguuuuccuuucaacuucugucacaacuucucuaaccauuucaugacauuuaacauuuuuuacacaauuugauuucuaauauguauauauccuauccuuuucauuucuuauaaauacugguuguugggauacagaauaugccaaggccuuagugucuaugaauuuaauuuagugguggucuuauuaucagcuuuuuuagggcuauaauucuuaguugaaguuguuuguucucccauaaugaaugaagagcuaucaacgugccugacuuuuguaucuugaaggaaugacuucuaguguguuuguucauacuugguuguugggcaucauuaaagagauuuagucuagcaguccagauaagagaaucucuuuccauuuauuuaaucacuucacaguccugggauaccuagacuuugagucauugcugaggcuauaucgucacuuuagaguugaagcaacaaaccaagaaacuuaucucugaggucaucuguuccucuucaccucagcuuucaugagaggcuugucuuaaaacugagauauauauauucuuagaagaggcauggugaacauacggaaauuuaaaccucaggguaacaguuuuccuuguacaguaauaaagauguaucuggagucaguggcuacaggaucaaaaaauagaucacaguaaucggaucaaaccugagaaauggcuuuuugcuguguuuaaaaaaaugacauggguaaggcagucuguuuuguggcgaugcuuccacuauuugugugacuauacagucugugaaauaggacuggcaaaguuaagcuuauaaaguuaauugccuacaacugaucuagcuuuaaacagaaaguagguuuccuuuuggucuuguguagaagaggggagagauuucauguguaggcagagagaguauguguuugcuaacauuaccuuuuaauuuaggagaaguuuggaguuuguucuuuccugugaauauagagguggaaccacucuaaccagaguuuauugcuguaauauuuuuuaaaugcguuuguaacacugauguaucugugaccuugugaaggaguuuuugagaggaggggguggcaagcccuuuuucucacugucauaagugaugccuacucaauaacucuaacuuccugacauuauugggagggggaggagggccucucauaacuuguuuuuguaugacuuaguucuaaaguguucccuucauagucacauccauccauuuagacuucccuuuucccugccuaaggcuugcauccagccuagucuguguuugguacuuuaaaugcuuugaauuauggagaaucuuaguauuuuauugaugcuugccuuguagcuacauagcucuauauugucuuagguuacacagcuugcauuucuuaggcauugugaguggauuauugcaauuaguugaaguuuugagaggaaugcuaugucuuccuugauuucuaccaagugccauauucuuuuucuugguagauuuuuuuuuuuuccagggauugccuuuuaaaggaccuuuuaaguuagaggcauuaaccuuucuuuccaucauaacucucagcagauauaucuuuuucagcaugaccuacugucaaguaaauaaugauuugauggcaauguucaagaaaaauuguaucuuugaaauacaaauuuuugucagugucuuaauguauaguauaugauugguauuauccaagaagaagaaaagaugaaucaauuucuucuagaauuagguggcuaaugcuucaagcauccuauuuaaaaacaauuacauguaggccugucggcaggauugcuuauuucauuauucuggucauuugcaugaaaacaaguugaugauucuuuaaccacuguucaguuuucuuuuccuuuugaauuauuauuccucaagcauuauauuccauucaugcaacagcaugaaucagaucuagaaaguuagaauuucagacuaagauaguagcagauuuuuuuucaccuuuuuuaaccgaaaaugaucucccauuuucauauuaauuuaccugugauuacaucucuuuauccuuguuucauaaggugagugcauagaguuauguuuuaauagaauauuuuucaagguuuuaggauuuuuuuaaaugaggucaucaccuucaagauuuugaccugaacuuuucaugaacuaaaggagcaagaaaaagauaaauuuuuuaaaaagaugaauauauaauguacuuauaauggaauaacugaucgaaguuaaauucauuugauaacguuuaucuggugcuaguucccaaagcacucuaccauuucaacaagagaaacuccauguucauacauuggaucucccccauaagauucucuuugaaaaaaguguuuuacuuuuuuaaaaaaugguuuaaaaaccacuggacuuaaugaaucuuucaauuuccaaacaacaaggcuggagcaaaugaagccugguuacugggagagcacaucagggcuaagaccaaagccguaggcaguaacaaagaauacuuauuugccugaccuuuccucucuucguauucuccuugggguucuggaaggugggacuguggccacagcagagaacugguucaggagcugagauuucagaucacgggcaccucuaucuuuccauuagagggauauaaaggagggagcuagccuggaguggggaugccuagaaggcuuuccauuuaaacaaagucucgaaaauaugggaaggauugcuauugagaaagaggugagaaggaaaggcauuccauguugaggagaaccaugugaauaaaggcuuacagguaggaaaacuaaaauggcuagugagagaugggauuagcaacagauaguuuggggccagacuguggaaaaacuuugaaugucagguuuaaaugaaauucaaggccagguacuauggcucaugccuauaaucccagcauuuugggaggccuaggugggaggauugcuugagcccaggagcuugagaccagccugggcaacauagugagaccccgucucuacaagaaauaaaaaaauugcccggugguguacaacuguaguccuagcuacuugggaggcugaggugggaggauugcuugaaccugggagaugggggcuauaaugagcugugauugcaccacugcacuccagccugggcaacagagugagaccugucucaaaaaauaaauacauaaacaaauaaauaaauucaagaggucauuggggagucuuaaauuuuuugaacagugaaguaacaucagguugguuuuuuaggaauaugaauccugcaaugauaagaaauugagagguucaugaguccuacaaugauuagaaauugagaggaucuuccauuagaaauggagagauugguuaggaguauaauaguucaagcaagacaacaaaaacuugaauuagggcagugaaggaagaauaggagguagaauggagccuccauugauggcugacuagagaauggggauugagggaaaacaaauaauagaaaugaaggugugcuuugauuuuggacuugaaugacuaggagaaugacuacucuaaugaacaaaaauguaaauguuauauguggguuuaguaagggaaugcaaugaacuugguuuuggauauguuaaacuugaguuaucacuggaacauucagguagaaauguuuagaaagcaguuugaaauaagaguuuaguagaaagguugagagcagcgcugcagauacagauuugaaagucaucugcaaagagaugugucuuagcguucucacacugcugguaaagacauacccgaaacuggguaguuuauauaaagaaaaagagguuuaauggacucacaguuccaugugacuggggaggccucacaaucauggcagaagacaaaaggcacaucuuacauugcagcagagaagagacagaaugagagccaaguuaaagggguuuccccuuauaaaccaccagauuuugugagacuuauucacugacaagcaaacaguaugggggaaaccgcccccaugauucaguugucucccacugggucccucccacaacacgugggaauuacaggagcuacaauucaagaugagauuuggguggggacacagccaaaccauaucaagaugguagcaaaaguuuuacauuaugcuuuuauuuaguuacuucuuuaauacacauuuauucaaaggcccagugugugccaaucauuguauuaggugcugaagacaggcagaaguguaugagagauccuuaaggggugcugcagagagguugaaucuuaaggaagguguguugguaacaagauaaacagccugugaugaaugccagaaaggacuagucagaggacuggaaguuaaaguuguggaagaaggagggagucaguaccagguggaagaugggcaggauugguguggggugaaagccuguuaaccaaggugcagaagaaucaucgaaggugaguguauugucuugaaagugaaugaacucuggggaagagguuauuuaagcaaauggauucgacuuagagauuuagccagucacaaagcuaggauauggcaacaccggaacaagauuccagguuguuuuuucuuuucuuuuuuuuuuuuuuugagacagagucucgcucuguugcccaggcuggagugcaguggcauaaucucggcuuacugcaagcucugccucccgguuccacgccauucuccugccucagccuccugaguagcugggacuacaggcgcccgccaccacgcccggcuaauuuuuuguauuuuuaguagagaugggguuucaccguguuagccaggauggucucaaucuccugaccuugugauccgcccgccucggccucccaaagugcugggauuacaggcaugagccaccgcgcccggcccagguuuuuauauuggaguccauuucucacuguagcauaccaguacgccaaauugugucuuuaccaugguauagggaacuagaaagagccaguucagccuguccauauuauuuaaaauguuuaauuaagauacuugaaguuguuggauacagagaaacuuaauaaaccucacgacuauccuuguauuucacaugaccaauggcagcuuuggcaggcuuaagcauggagggaggauagauggaagcuguuuuucuggacaugugcagcuuuuaacaaguaccaccagagagcaaaaacaaauccuaguguagcacagggagcacuuuccggauggcaggaagaaucuaggucagcuuaauggcaacuccuauucuuuagguagauuaauguuugcccccugguuuucagcaugcuguacgacauccagaaagacugugcaugguuccuuagcccauauuaguuaguagggggucaugaaugaaauugaugugugggagccuuuugauuuacaguugagagaguguagcucaggccuaauguggaaacaugcugaguuguagucugcauuuucuuaacuccuuuauguaaaggacacauccuuguggacauuuugcauguuaccuuuaggagaugacuggucuccuauggguaggaugaccaaaaagugcucaguugaucaguagagcucuggaaccugggcuggcuaguuuggcauccuuuuucuggcuaugccuccagugcugucuaauagaacuuuugugaugauggaaauaguccauaucugugcuguucaguauaguaaccacuagucacgugugacuauuuaguacuugaaauguggcuagugugacuaaggggcugaauuuuuaaucuuaauuaauuuauaggucaguagccauguguguuuaucggcuaccauauagggcugcauagcucuagacuaaaaaacauuuaaaaagccaaauucucaugcucaucgguauuuuuaacuagugagaggagguuggaagaggguugaguuauauugauauucacuccaaauuuaguagguuuauauugaacauuggacugagcuauugugggcuugugaauuuuucuugacucuccucuugcuuuucaugucuaaaagccuuuggaauaucuuaauaguccuuuccucauuugaagaauuaccccuuuuggccuuagauggguguagcucaucuagugcauagauuaauagcucuagcuuuguccuuaggaagguaaaucuugaagguuacuguuacaugacucuacugccguaugccaauucacauuguuauuuuugugugugugugaugcugaaagugagugaaaugugaaaaaaacauuauucauuuuaaauaguuuugacugccagguuaaugcaacucuuaagcagagcuucaugaggucuggccauaguaacugcuuuuaacuugauuuaaaguucuuaaacguucugaauugcuucaccuaaucuuuuuauacugaacguauaauuuucagacucgucuuuauuuucaaauccauaacugacagcugcucaacaccucauucaaauaguuuuaagaguuuuagagaaaaguugggacagacuggauuuacugacaucaguuggauugagauauuguggauuuaaagaugauagagaaggagagggaaaaguaugaaauaauuauuccguguucacugcuugcccaaugacagugauuuaaagccuaauaacuaacaaaacugagagauggcagaaggacauuugaauuaacuuccaaaucuuaauauaaggaaugaguauuuucuuugaaaacaaaauuuucauguguaguccuauucguuuuauuauauuuuuaaaaauauuaaugcacagaaaugcauauaugccaaaaccucacuacaaccuuuuucuuggcguauaucuuccagauucugugagauugucagcuccuuaaaggagcuaacucuuuaggggacuccaugaugucuagugcacagcaaacauuuuccaaacagaauuaaccaucuuauaagagaaacacguuuauaaauaccucuacuuccaaugacaaaugaaaucaucuugugauucaacucaagaaggcucugggcuacagugaauauagagaagcuucaggaaguacuguuuaagaguuaaaauuaaugugacuaaauuuuguccucauccuuuugagaaaaugcaugcaugucuguguguguauguguuuguguguguguaucacuuacuaugugcuagacacugauaagcacuagguuuacaaagaugaauuauauaggcucucuuccaucaaggaacuuauauuuuagauguuuuugcaggacacaguaaaaauaacaauaccaugugccaagaaccauaauagauauaguucaggagugcuguggaagcauagaagaggaaugucuaacucacuauggagacuuagagucaggaaagacuucuagggggucucuugaguugagccuugaaagguagguaggagauagccagauagagacgguauuagaggaguuuuuccagguagagagauaaugggcggaaagacaaaagcaugggggauucugggaacugcagauaguuugcuauggcugaggggaauagccuuugaaggagcaccaaaauaugaagcuggagaggguacacaauugucaaaucauacaggaccaacuugguaauaaagagaagucuggguuuuauuccauggagagugucaaugaggggagcgggagggugcaggacgaaucuggaggauuagagacucagguaggagagcaguuagggagcagcuguggaaggccagcugaaauuuugagggccagaacccagguaguugcuaggcagcuugggaggaaguugguuucaggauauguuuaggaaaguagaauuucauaacugaucaagagagugggaagaggaggagucuagguuaauggucagguucuggcuuggcugccuaaguaggugauggguguaguaacuaagacaggaaauuuagaaagcagacaguguugggauuaaagaggaugugcuugacccugcagaaguugagcuggaggcacauucaggugaagauaccuagcagcacucuguggcacucauuuggagacauggccauggaugagaucuccuaagaagaauguauauggaagaggaagagaagcuaaggacagaaugucaggaacgucaacaauuaaagguaggcagaagaagaugaacuagugagaggagugaagaaggggcugucaagagacuuugaggaaagccaggaaagccuuuuguuuuggcaucuaagaaggugagugagccacagugucaaaugcuacagggaauucagauaagauaagggaggccaccauggcuauagaacuuagguauucauaggggaccucuaccuuacaauuuuagugcagcagugagugugggaaccagauggcaaugcguggagcaaauggaagugcagaauaggaagcaugcuguagacacauguuugaagaggcuugacugguaaagguagggugagggagaaggggacuggaaauaaggagguguagaacuuagagaaauuuuaaaguauguauuuuuuugaauuagggaggugugagaagguuuauauauaucauaaaauaagagauauuacagagggagaugaaaaauaggaaagugagaguugaucacugaccaucaagggccaugaugaggcucaggaggaggcauuugcugagaggggugggggcaagagaccauuguuuucuucugagguggagauaaugggcaaggcuuuaagaaggaggguggauguagauaagauugcacccugcagggcugaggccuggagggagggagaaccuucuugggaaaguaggaucccaugcuaaaccuguugauggugagauggagcugugcagggugagaaacugggaagguuugaaauguucucccuccaggagaacucagaaauucuaggaagcaaccagcugaggcuggaaacauuacguugcagugacccaaggccccuugugugcugauuauccuugucugagcagcagacugaaaugucacucuucccagagaccagucugagauguccuugauaucuuccuucccuuucagagggaaggcaggucaauguaucauggaaauuuagagcugaaggggacuuuagagagcacacagaacucccucaucuuguaaaugaggagaccagcucagaaaagugaaugacuuauucaaguggauccaaggccagggcuaagaccaggccugacuugcagcucaggguuuucuuuguuguucccuugcuaccuccuugauaaggauuauuaguaaaucccacucauuauaaaugcucuuaauuucccauuuuguacacugggaauucuacaccauuuucuuucucuuccaguuuuuuguuuuguuuuguuuuucuucuuuguggaguucaagcagguauaacaguauucuaggaugcuaaaaauaaauagacuuagguaucuuuucuuaaguggagaugauacuggauuagaugagaauauuauuugggaccuguaaaaagguaaaacuuaaaugcugaaauguuuggaauuucuguucuuacaaacuuuauaauuuuaaagauaaguagauuuauucacacauuuuaaaauucuuucauuccauauuucaagaggauuuacuaggugaugaugccacagcaaagaauuuccauaucucuccuguugucuguugagaauugaugauuauauuaauagucucuccaucuagaguguuaagguuaauauuguuaacuugugaaugcuucuuugggaucuaccauccauguccuuagccuagacaagaacuaagaagcagaaaauagaaugucuuuuggauaaacacagauuugguaggagugauuuaguuuggagcaggggaaccuuaauuaauuaucacuguuuauaauacauuuuuccccuuuguuuccaagaaugagaauaguucagcaacacaauugauaaauaaaacauaaaaggacaguuaugguugcccugguaacuauauuucucagcaaguauuuuguuugccaugaaauguguccaggguuauuuauuggaaaucagacuccaaaugucaugacuuuuuguauuugaauuucuuauguacucauuuaggagggacaauuuuguacguuuuuuuggguuggguucugaagcucuaugugugauggggauccuuguguguuuuucuuuuuuuggaagacaaauaggaaacugugauuacagugaaucuauuuaagaugaauuuccaagucuaaagugggauuuaaaaguauuugaaucauuuuggggauacaugaaauuucuuaaaacuggaauauuuuaauguagaauuugaacauaagauacuuucugaucaaugaucaggaauauguuaacauuacauuuugacuuaauuccuaugcaauuaauuuugaguagaauaaauuauucucaaaaaagucuuaaagauaaaaaucaaaauaauuaagcaauuagagcaauugccacuucuagaugauuuaugguagugugaauuaaagcuaagugaauaauuuuuuauacguuuauuguauucuuuuacccccaaacaaaaucacuucagucuacagacauaguuuuacaagugcacaaauauauacguagaaagauguaacugcugcauagauuuuaauagcaaaaaauuggaagcaauccaaauguccaucaguaagggacugguuaaauaaauuaugaucuguccauacaauggaauacuugguagccauuaaaaagagugauguagaucuauaucuacugacaagagaagacuuccaggguguaucaguaggugaagaaaagcauacuguagaacacuguguaaguauuuuauauauaauuaaucuauaaugcauacuaucuaauuggcauauucauuuaaaaugugaagaaucaacagaaagcucuuaacaauggcuaucucuagagagugagauuaugaaggacuuuuacuuucugaguuaacuuugcauauuguuuaaaauuucuguagugaauuuggguuaccuugguaauuagagaaagagagaagauacaaagcuguauuuaaagggucuaaaaagaucaguugaaaugggugugguauguaaauacauuaggcuuugcaguaaucguuuauuuacucuuuguuuuugucuagauacauaggaguuuaaagagguauuuauauuuaugucuuuugaaacaucauacagauuuuuaagccuuuucuagauauuuaccccuuuuuuucuucacauuuucaguuauuuucugaauauauccuuuacuuuagauuaucacuuugcaagguaaccuguuuuauuuacauuuuaguugcuauugaguaugcuuugauggacuuugucuuuuguuuaaagcauuauugcuggccugauuacuagauuuguuuuauuuuaaaauuauaugaucuccauauacaauaccagaagauuuaggaauuuuauguauaauuuauaguuuaaaaguauuugaaugauuauugggauacgugaaauuucuuaaaacuggaauauuuuaauguagaauuugaacaaaggauacuuucugauuaaugaucaggaaugcauuaacuuauuaccuuuuugacuuaauuccuaggcaauuaauuuugaguagaauugaaccucuuauccaaaaccucuuuaaaagcauguuuccacccuuuucccaaggacaagaauagaauggaaucuguauucugcaggauuucaucuggaugcaauuuucuagauucugccuccauugcacugaauguaaaguuuucuuguguuuguguguguuuggucccaggcucugccuggaccccagcugcagcagcaaucuggagaagacacuucuccagugcagccaguuuguuuuuuugcagaggagucaucaaugcaaauaggauuaggaagaaaaugcacauggucuggccguuuauugccauuuucaauguauaagcuuaguuuguuagcacacagaguggagcagaaaucacuauuccagacccuugcugugaaguuuacuguuucaauacagugaugauaucuguuaggagaaagcuacaaagugagguagacuuuaggucacaguguugacauuguggauauauuuuauggaucuguugacuuaaugcaaguuuagaaaacaggcuuacauuuuuaauuuucuuccugucugcuuugguuacaugaagcuggauaggcaauuccucuucuuagaaauaaccauuggauucuuguccuugggaagagaauggaaauagccuuuaaagagguuuugguuaagauguuauuauaccuuggauaagauuuaaggcaguguuuaauuuuuuuuuccaugauccaugcaacuguaugcacaauaaauuuauaugguguauuuauccuuuacugcauucuguguaccuugauuuuuuucuucauugugcucucauauuuccuuuccuuucccuuuccuaucaauccaaaccuauccacuauauccuguccaccuuaaucugugcaccauccuauccugucuacccuaugcuauccugcccuauccugcccgacucuguucuguacucuucaguucuagucuauuucuuuucuuuuuuuuaaagaaaugcuggauguggcccauuauauuuauuuuaagauuuaccauuugaaaaucauugauaugaagguggcagauuauaauaaauaaaauuaccaaagggcuuggauguuauguauuucuugagugucaucugucucuuucaguggacgucagcaugcuguuaacucucaguuauuaugugugccccauggcuuguuugcuggcauaguaggaugacaaaguuaaguaccucauuaugagauauauacgguuguugauuucuaaguuaucguucuuccaggagaguuuuuaacuaggaagucuuuaucacccugauucucuuaucauuguguaaauguugaguagucuguuuguguauccggugaugcuaauaaggucugcauuuucuuaguguaaauuaugcccuacagaauguuuaauucuaggaucauguucuccuaccacgcagcgugcuccuggcccccuccugcugccaucuccugaugcaugcagagagcaugcaaacccauuguaacacuggacuaaguaacaaaggguuuccaccucuaaguuaagauaaaccugccucagaggaaaaacaaacaaacaaacaaucaaacaaacaaaucaccaaucauucuaguauaguuacaaaccacauggaaaugaucguggauuaucuggucuuggucaucuuuuaguuuagauacuuuaguauugacuuugaccaagauaauuuuauaacugaauuuuaaccuuuguuuuuauauuauaaaauuagaauauaaguuauauucuugagacucuugagaguacagauacuauauauggcuuguauauauuguagaagccaacucugugccaggacauaauugguucuugauaaauauauugauuuaauuugaaugugaauugcauauuaaauacugagacuuugguaauaccauaauaauuaaaaauuuugcuaagugcuuacuaugagcaaguuacauucaucauuucauugaguucccacuacuauuuuauaagagugaaccuuuuugcuagcaguaauuuuaauuuacaccuuuaaggauuuauuuuuaaauuuacauaaacugaaauuuacuuuuuuuggguagaguucugugaauuuugacacaugcauagaauuguauaucuacuuuacagugguaugauuaccacagucaauauacaguuuccucacucacccggauccccucauggugucucucucuagucaaaccuccuuccaacugcuaaccuuuggcagccguauugaucuguuugccguugcuauaguuuugcuuuuucuggaaugucauauacguggaaucauacuggaugcaauuuuugaauguagcuucuuuuacuuaauauauugcaucugaaauucaucaguguuacucuauguaccuaucuaucaguuguucauuucuuuuuauugccaaguaguauuccacugguguauggauguacuauagucuaucccuucauucacagaaggacauuuaggcuguugacaguuuuuggcgauacgaguaauguggcuauguaucugggugcagguuuuuuugugagccauaaguuuucauuucuauuggcuaaaugccuagaaguagauugccaggucauuugauaaguacagguggcucuccauauccaaagguucugcaucuguguauucaaccagcuucagauagaaaauauuugaaaaaauaaaaauucuuagccuaagguagagaggaaaaaaaauaaaauuaaaauauacaacaauaaaaaaugauacaaauaaaaaauauaguauaacaacuauauagcauuuacguucuauuagguauuauaaguaaucuagagauuuaaaguauacaggagaguaugggcagguucuaugcaaauaguauaccauuuuauauaagcgacucgagcaucugaggauuugggugugagaagggguccuggacccagucucucaugaauacugagggacaacuauacauguuuaagaaacugccaaacuauuuucuagagugacuguaccauuuuguuuucccaccacaauauauagggauuccaguuucucuaaauccuugucaacacuauauugucaguauauguguguguguuuaguuguagucauucuaguaaguauguagagauaucucauuaugguuuuuuuaauuauuauacuuuaaguuuuaggguacaugugcacaacgugcagguuuguuacauauguauacaugugccauguuggugugcugcacccauuaacucgucauuuacauuagguauaucucuuaaugcuaucccuccccccuccccccaccccacgacuggcccuggugugugauguuccccuuccuguguccaaguguucucauuguucaauucccuucuaugagugagagcaugcgguguuugguuuuuuguccuugugauaguuugcugagaaugaugguuuccagcuucauucaugucccuauaaaggacaugaacucauccuucuuuauggcugcauaguauuccaugguguauaugugccacauuuucuuaauccagucuaucauugaaggacauuuggguugguuccaagucuuugcuauugugaauagugcugcaauaaaugacuacugauguugagcaaguuuucacaugcuuauuugcgauaugaauaucuuggugaagugucuauucagauauuuugccuaauuuuuuuuuuuuuuuuuuuuuuuuuuuugagauggagucuugcucugucacccaggcuggagugcaguggcgcuaucucagcucacugcaagcucugccuccuagguucacgccauucuccugccucagccuccagaguagcugggacuacaggcgcccaccaccacgccuguauuuuuuguauuuuuaguagagaccggguuuuaccauauuagccaggauggucuugaucuccugaccccaugauccgcccaccucggccucgcaaagugcuggauuacaggugugagccacugugcccguccauauuuugccuauuuuuuaaaaacuaggccauuuucuuauugucaaguauugagaguacuggguauaagccuuucaugagauauaugauuugcauacguuuucucauagacuguagguuuucuuuucagucucuuaauagugucuuuugcugguucuuaauuuuuauaaaguccaguuuauuaauuuuauauuuuauggguuguguuuuugaugagguaacuaagaacuuauugucuaacccaaagucaugaagauuuugucuuguuuuuuuuccuaaaaguuuuauaguuugagauuuugcuuuuuggucugugauuuaucuugaguuacuuuuuguauaaaguauuagguauacauugaaauuugucuuuucugccuauaaauguucauuuguuucagaagcauuuguugaaaagacuauucuuacuccuuuuaacugacuuugcaccugugucagaagucaauugaccauauuuguguaguucuguauuuggauucuuucugauuaaagcuugucuaucuuucugccaauugagguaguuacuuuucuuuuugagacaggaucucacugugucauccaggcuggagugcaguggcggcauaauggcucacugcaaccuugaacuccugggcccaagugaaccucccgccuuugccucccgaguagcugggacuacaugugugugccaccacgccuggcgaauuuuuuaaaauuuuguagauagggggccuugcuauguuccccaggcuggugucaaacuccugcccucaagcgauccuucugccuuggccucccaaaguguugggauuauacacgugagccaucaugcccggccugcuuacuuuuuaaaccucagauuacugaugaggaaaaggagucuuagucaaauuaaguaccuugccuaagaugauucagcuagcaaaugauugcauuaauacuuaaacuagggcgaguuuucugacuaugaaacuugugcugagaagcuauguuagcaccuguucuuaccuuaguuauuuugcuucugguugaaauguuugguuuuaagaaacugaacaguaugguuuuggaagaguacauaugacaaguagaucacagaaaauuaucugaaauaagaaaucuaagguuuuuuuucgcuuucuaggccauuaauuaccagacauaauuaauuuucaauaucuuuaacaagguauaauauucuuuucuaaauccaagguagcuguauaucauuuuucuuuauuuuaaauagagcaacauaaauauauguuccuuguacagcaaggaaaggauguuaggguuugugcaugugagaacacagaugggcuaagagugauuugcauccagagggcucaugcaaggaacuugguaagagguuacagagugacacuacuguggcagugaauaauaaauuaacauuucaauauuggcaaaccggagaauuuugaagaaugucauauuuaguuaauuucugauuauuacaaacuaagccuguacauugauuuguuaauaacuaggcaugcaugugcacgugcaugugcacucucucucacacacacaccccccccuauauacauauauauguuuuuugaggggcaucuuuagugauuucagccuggguacucuguucuaauauaugcucuuccuucugagaacccauuuacugucacagauccaacuuucuuccaaaggcaaaugacuccaaacccauaucuguguugugauccacuguuaaacuuaauuucccucccugggcucugacaucuacuuagcuauaggauacaauuacuaggaugaccuuuugauauugguaacuuauacacaaaacugaguuccguuucuccucauccucacaaauaagcaaccauucucaguuuccccuuuauuuucuugaagauagacuugcucuuuggaaccucagaaucauuuuugacucucucuuucugggacccugguguggucaaaucuguagucaauuucugcugauugucugugccugguugguuuggaccuagcuccucuuuccccuugcagugccugccauggccccuugcccucuucuuccucccuugauuuacguucaccuuuuuaaugccugcuagcuucuguacaugaacucuuugcaugcccaacccaaucuuucuuguuuuaugaccacuggucuugcuauucauuccauccauggugucuuccuucucccccacuaucucugcagauugaaagcuaaaguauagcucacugccaucucacguuugaaacccuccaguucacuccagucaacaaacuccaucucuccuccgaucucagcccauauugugcccaggccagcagcgucaacagaaucugggaacauguuagaaugccccacuccagaccugcugagucagaaacucuggggguggagccuagaaaucuguguguaacaagccuuuggggucauucugacaccagcuaauguuugagaaccaguguacuguguaaacccagauucacauacucagugugaaaggcugaguagcccuaccucucuucagcccacuuccauugcucagccucugugagcuuuuucauuuugaauaccugcaucuccuuuucuuagucacuucuaauuccucauuuaaaaugucagucccaaaauucacuuccucgaggcagucucaguucacuguuugagcaauaggugcuugguuuauauucugcucuuuucuccuuguugaucauguuuuucuguaaggacuuugguugacugcuguauguauguucuguccuuuugacagacauguguucccccaaaauggcacaggcuauauuugguacaaauuuuuggucugucaauuucacuaauaggucggagaaaaaaaaauuuaacugucaacacagcaaauaugucccugaguagaaaggaaaauguacaugaauagccaagaaugaagauguuugugcuagggcagcuuuuggcuaugucuuaggcuacucaggguauucauuaauucccucuccucugauguuggaggguguccugguuaaaaagucuggggcaccucugcugacacgaggaaagggagcacguacugcagagagggggaccaguuuugacuucgggguccuucacuucuuccagugauugauucccauuguuugaccuuaguuuccugauaaaaaauugggauaauacugucuacuucauaugauuguuauauugcaaggauuaagugagauuugguagguaauguccuuguacaaucccuguccuacauuaggugcucuauaaaugguagcuuuuauuaacucuaccaggacagcacacuuaaagaaaaaaaucauuccacaaaagcaguucuauuugcugcauaguaggcccuuaguaaauguauugaaugauauauauauauggcauuucaugguucuggucugugcaaauguccuaauuuguacagggcuucaaguuuuagugcuuuauaauuguuaaugaaugguaagaaauauuacuugacuuuuugacaaaucuauugcauuucuuaaaaauuuuccauucaacuuuaguuuuaauggaugauagcuuacuuucuaauaguaucugaaagguuuuuuuccaguagaauaaauuaggcugguuaaaugggcuuuuugacacaaugcccucccaagaauguuguuucauugccaauggcuaguuuaaucaguauuauugaagacaguuucaaacuacucugcuacuugguucuuuauuuaguuuuuauucuuuuccuaacacaccuaauuaauggaacuguccaguggucuaacauggagaaggagagaagaugacauuaugaaaaguuuaaucauuauaauagcagcuaacguuugucuggcauguuguaguuuacagaauacuuuaacaugcauuguaucauaucucacaguguaggcauuacuauuauuuuuauuuugcugauaagaguaaaaaguaggcauuacuauuuuuuuauuuugcugauuagaaaauugcugcucugcuuaaugaccaaggucauggaagcagaagguaaaauaaaagccccagggcugggcacgguggcgcauaccuguaaucccagcaauuugggaggccgaggcgggugggaugaccugaggucaggaguucaagaccagccuggccaacauggcgaaagcccgucucuacuaaaaauacaaaaauuagcugggcaugguggcgggugccuguaaucccagcuucucgggaggcugaggcaggagaaucucuugaaccugggaggcggagguuacagugagcugagauagugccacugcacuccagcuugggcaacagagagagacucugucucgaaaaaaaaaaaaaaaaaaagcccagaaguugaggauaguaugguuauguaaaaguuucacuuccucaugauuaggaaaagaauaaaaacuaaauaaagaaccaaguagcagaguaguuugaaacgguuuaaugcauguagacaauuuacaguuucaugucauccuaaagcacugccucccacagcuuauuuauguggaacaagagacugaccaccugguuucacaccuugauucugccacuuccuuucuacaugaucucagucagguuguucaaucucuuugagccucagucuuuccauuuauaaaauggggaaggauaauggcauccaccucauagaguuguuguauuaaaaugaguuaauauauguaaaacuauuagaacaaugccugggacauagaaggugcuagguaaguagguaaaugucagcuauuauuauuuuuuauagaggaguggcugaagugcuuuauaugaaaggugaguauacuuagccauauuuauaauuagagaaguagaaaucagagcuucuauaagaguucaauagugcagaauguauauuuugcaucuuagguauugaugugguguggcuguguccccaccuaaaucucaucuugaacuguagcucucauaauuuccacguguugugggagggacccggugggagguaauuuaaucauggggguggguuuuuuucuguacuguucuuuuaauagugaauaaaucucaugacaucugaugguuuuauaaaggggaguuugccugcacaugcccucuugccugcugcauguaggacguaacuuugcuccuccuuugccuucugccaugauugugaggccucccuggccauguggagcuguuaguccauuauaccucuuuuucuuuauaaauuaccuagucucagguaugucuuuauuauuagcaugagaacagacuaauacagguaucaugcccuagucuggguuuuccuguagacuuauguucauuuacuaaccuugggauaaaugaaaauuuggagcaugccuguaugauuucucuuucuaaaaacucaaaacccacaaaacuacaguaaggugcugucccccuuccauuauccauagacccuuuugccuuucuuaaaaaacacaugcacagcacucacacagacacaccccuguaagacauaagguaccuuggccauuuucaugaaacuguuguuaauuccuuucuuuaaaauugaagucuuuuaggauuuuaacaaauauccuauucaugaaguuuugucuguucuuuucuucuggauuucacaacucaccuguucuaggagagucuucauuauuuuggagaaggcuucaaaucuacuaucuucaagcuuuuuucuuuccagugcacccgucucaucucauguaacguggugcugggaauauaagacugagauugugaugcucacaguuuuucuucuuuguaauuuucugugucuugauuuuuucccccaaugaacauguaucuauuucacaaaaucuauuuuacuguuaaauaaaauuuugguaaacacuggaaguaggaaauuaaaaugugcaaaauuguaaauuaucauuacaguuuacuuaucuuucuuguagauaccagauacagaaugcuuuuguuuuauuacaucuuuuucuauaugcaaaccguaagcugaguguagcaccugguuaugaaauuuuguacuuauagaauauauucacuuuuauugguggcuauaaucaagaugaaaugcuuuucuuaauaauuaauguuaagaagagaaauguaaacuuuagacaacuuuaugacuucucuccagaggauguauggaugugacuggguaugugauuuaaaaaauuuuuaaaguucuuuggauuuuuuuucuuuuguuuaaagguccuuaggcguuugccuuggcuugcugaagaguaaggagaaaacccuguaaacucauucacucagaauaggaugagaguauuguagauuucuuuucuccuuugagacaauuuuaaaauuacaauggucuuagccuaaguggucccuguuacggcuucucucuuuuccaugcucaacacagccuuugaggaggggcugagggacacgccaccuguuuucaaguguauuuauuucuuuaugccuuaauaugccuagugcaucucagaauggaaauguccuggaaauugaacagcuucauaguuggguggccccaugagcauuuaggaaauauuuugugaaacuguuguggucaucuuguguacugguucugguacuuuaauccaucauuuugggaucauagcucuucugaggaaagagcagccuugcaccuucaagccuuucuaucuucaaucaguuggguuugcguauucgagcucauuccaguucaugauuggcaguuuuuguguuagguacccacucugaaguguucccuaucguuuagaagguagaaguagucaucagugacugaagccuaauuuagauucuuaaaucgaaaucauuguugaagaauacugcuccuccacuacagacgucuugugcauaucaugagugucuucaucagagaacaagcucucacccggucucucauaauauaaaagcauuuuuaaucccucuuaacaggugcugccgcaguuuauuuauaacuaaugcauuaaaaugaaaaauacugaaaggguccuaaguggaagguggcuauugaaauauugccauauuuaaauuauagaauuuugucaggcugauuuguggaaaggacgagucaauguuggcugguaagugauguacucacagguuuccuguaaguucggguggugcuuuccgcaguguauauaaguggguugugcaaaaucugagaccuacgauucaauugauuuuccuuugcauaaucauaaucauauucauauuuggucagcuuucaugcucuuugauauuucugauccuuaugaagcaugacaaauguuagaacucuuuuggccuucuagacuuauugcagcacaaaaacucgagauccuaauugaaagaauuuugaagaguguuucauuuaacccuuuucuuccucguccaaauuugaucucacacauggggaagguaaaugcacaccuuaauauuggugcaacauguuauucugaagacacgugcuaaacauuugaaagucuuguugauuuauauuuccaccauguuuucucuuuccugaaaaaccuuagccagcgacugaaguaguuggguuguauuaauggauguuuauguuguccugugacagcugguuuugcuaauuuguuuuuacagggcaguuuguaguaaaugaauggcaugcugaauauuuuacugagauuucagauuaucuaaagaauauuuuccgguuuacuaauugguagauaaugcugaguacauugauguugacaugagcaaauggauuuaaaaugauuugaagugagcuucauuaaaagaugcucuaaucacagccagcaggaaaugucaaacuaguucugccuucauucacucugguggacaggaacuguugcagacuuacgaugcuacaagucauugcaguuuugauuuuggggugccacagggugggggaaaugguggaaguuuuuuuuucauagcuuuuuuggcucaucaugucuuuaccagaaacuaaauaacaaauuacuaauuaccuguauggcuaaaugaacauucucugaaaaucauagucacauugcuggagucuuauaauccauuauggguugaauacauggaagucauguuuguugcucacucugaacuagaagucuguaaauuacuuguuauccauuuuagcagaauucuauuauagaauuaaagccaguggugcucaucaaaacauuaagaaaaaccuaggcaaaggcauuccaaauucccagguuaaaacuuacaacacugguucuacuuuuccugccuguaaaaaguuauagaggcuguuucaucaaaauugaaugcuuggggaaaaaaaaucuaagggaggcagauucugaaguaagucucuucaggauuaaaaucugucuuuuucugauaucgacugugcgacuuugugcaaguaaccuaaccugccugaaccuucguuuucuugucuguaaaauggggauaauaauaucuaucucaugaggucaugggacuaucuuuauaucuauaugcuuuucaugguagaagguacuugguaagggcucuauuaguguuagcuauuguaaccuaaauacauuuauuuccuucuuuuaauaccuggggaaagguugugggugucauaugccaagacauuaacuagacaucuuauuucuacugauuguaaguuuacuaaacaccucucaugucacucagaacagagcuaucuagaaccaguaaguucaucauauggagcuuuuuggaucuaggauauaaugagacuagcccaaauucaugcaguaaguuauuggguaaucuugcugcaguaaucuuguuuuucucuuugacuguuaucaaaaugucuuuuucuucaagcccggauguaguaugcugagguaguagcacucauaggcagagaucaacggcucuaauuauuucacaauaaaaauaauaugaugcaggagucuguauaaugcuaaugaaaucuagguacauggcaagcaaccuguucuuuucagcuuccucauuagcaucagauuugccuagaugcccagauaagugguuguacagguuguguauauuuuaaauagcauuccucugggucagcccaacaaugcuguaaacuugaugcccaguagauaggagugccuccuggaaauuucuugaaaacaugguaccagauuaggagaucgauaaaggaugcugauacuggcauagaauguucuagaauaacugagcaacaucuuuuaagugaucugguauuguugguucaaagcuucuggcuguauuacauauaaauuuggccuaugugguugagaagaaauugcccuacucaucuauucagucaggguucugcaagacaacuguaaauuguuuucuuuuucucuuuuuauucccccuuaaugccacaguguguuuugaagagggaagagugaaaaacaaaaaaguuccacuugaaugacccuauuagcuuuacacugguuucuguaaaccaugccagaaauauaauaaucuaugaggucuuugaguuuaggacacagccucuguugacaaauauaaaaaauggcacaccagacugcagauguggauuguggguuagucuggccuucccucaucaauggggaaauggagcuuaagucaggcuuagaaaaugagaaaaaugcuuaagggacaugacuaaugucuccaacgugcaguacacuacauaaaccuauuaugcgcuuuaauuuaauguucuccauaaagauucaggaccugucaguagaaggaaagaaacaagcaauccaucuuuagugaacugugaauagacuuuuauauuuuuuaaaauacacacgcaccuauaacauacuuuucccuuccuucgguuuucuccacaucugauccauuuccugucuugaacugccacuaccuaggcugcuuguggauuguuuuguucagugaaauaagacuaauguguuaaauauuuaacauugcuaauugguucaauguaaaggaaaagggaauagaugcagauugucuccagucucugucagcagacuucagcaaacaagacuggaaggucugaauugaagauguuucaucucagggacuuaaaggccuaugggauaauauagcauuucuugcaaguggcaauugggccaaaauugggagaaaaauuaauuugcaccuggcagcuggaaagcugaggaucuauuucuauagaaaauuuggcugcaccccgcccccggcccaaaaaaaaaaagcuuuuuguuuucaggcuccagguguagauugaaagauaacaaaauggaugugacauuuuacuggucuuaucuccuuugcagguugggagcguuaaaacacuuagcuguacuucacuaaagcaagcugaaauuugcagaugauuguaauugaugaguaaggaaguagaaaccccacugggucagugagaauuuuuccauuaugaaaacauaaccuuucauaggagaacccaauggcagugaaaugucagauaccuggauuuuuacaaaggaaaggaaggcaaaucuguauuguuuccuauaauacaauucugaaacaggaauguacauauauaucucauucucuuuugagguuguuuuguugucugcugugucuaggugaaaagaacucacagugacaucaguuuuugcuuugaauugauuuuuucuuuaaaccagaggugaauggcaccuaagaaauuauuuaaaucaggauauaaaaauauuauauguuuuaacaaauguugacauugguagcuagucugagcuguucuuuuuucuggaggaaagacauuaguaaacugagguggggauagaauuguuucaagggcuguggucagaggugucuaagugcugaaaaaauaaguuugaugaguuaaagcagagggcuuccagagugggguccauaggaucaaucaauagccuucaggagguuggugaguccccagaaauaacaugcaauauuuugcaugcauuuuuuuggggagagucuguguuaaaacuagauucuuaaagggguagagaccaugcugaaguaaagcuacuccugccagcuaucuccaagugccuauuuuacaggagcccaugagcucuagcucaauuuauuucuccccuuucuucccagucaccauccccuucccuagugggcaccuacuacuucaucccucuucauccugcuucauccccuuuccuucuuucuccccuuucuauucuugaucccacugccuuucuuauguguggaccuuuuaaaagaggauggucuaggugcuagccauauagacugccacgcaaacuggaagggccucucuuaaaccuuccugccuugaaagucagggaaauaggcucccagccucugccuggacagaacaauuaagucuuguugugauuauaacccuuaccucguugauauucagauacuuuucaacauaaucauguuuuucuaaugucccuuacuuuccucccuccuccuccuccacaucaaaaauaaauuauuuguggaauauuuaauagguucauggggcucugcucugguguuaucuguuuuaauucugugugagaugagaugcggcacuugucagcagaggccgcugaugaugucgguacaccuuacugagcacaggucacgguggccugcaagccagauugggugauucagccaaaggagcgucacucugucgagugggagaacucacagauaacccgaggugcucacauuuagcccuguauguagugcaggugauaugcaaggcgguuccuuuccgguuuaacucucgccucuuccugggcugcuuuucagccauucauuuguccggcggaagcagucagcuuucugaaauagaucacgauuuaauugccgcugccuccgcuguacugaaaugaaacuuucgaaggucaccaagcaucaguggcccuuaguuaagcauuaucuucuuugcccgccccacaguauuuggcaccauuaacuucuguuuccauuuaaaaauuccuccauuuguucugcagcacugccuguaccucuuuggauagcauuauuuggcagcacuugggcuagcucuuuuuucucccucuaccggcuaaauguuucccaguguuuuguccucgguuauuugcuucccuuuuuccauggguucucuuugguguucuagaucuuauucccucucacaacuucaaguguugcuuuucccuacagcccaacuuuuuucuuuucuuuuuuuaaauuccugaacugcauugucaacuaccugcuguuccugcuaccccugggagucccccugcccucucaaacuucccuguuuaaaaaagagcuuaccuccaacuauucacuaucucacuucccaagcaaauauacaaauauacucaaaauacaaaaccccaaauuagaaaggcugccccuauggccaucaccaaaaagcaagucccucaacagguucauccauauucauuucuuuuuccuuucauagcucaccgccguucaccuaggcagccccugaaccuaaaucucugcagacaucuucaucuucuuuucaugcuucaugugcaaguaguugccagaucuuccugaccuugguaauaaaacauugccuacauccggacuuccuuuugcuuugcucagggucaguuucuuauucccucauggcuguggucuauaccauuccccguuagcugcucaccuguuuuccuaacuugcgauucuccacaguuugcaguuucucaccuuuaagaauuuuguucagcuuuuaucuucucccauauccauucuuugagauauuauuuacccuuuaccuuccuauaugaagaugacaccuucccugacaaccuuugcuuuaucucaacuacauuauuauuuuuugugagauguauacuauccaauuauguuuagaguuuuaaaucacccuacuaaaccacaaauauugacagauugggagcuuuauuauauauauacuuauuauauaauacaaguauguguguguguguguguguuuccauuuccauugcacaguaccagguacacguuaggaacccaguaaaucuguauugaaugaaugaaugccuacacugaaauuuuacuucagguugguuagcaggcuuagaagaucucuuccuacuaaagaucuuuugcuaauuguuuuuggagccuuucuauuuagccaugcaaauuagcauggguucauaggcccagaaccugaaauaaauuaauccguacuugaaaggaacaaggcuguggcuguauauggauuucaggaaaaagaaaaauggaaaacauugagccaguguccaguugauauaagugcuuccuuguguuuuuuuuuuucuuucuuucuagugcauaggcaguauaaaguuacuuuuaccuccagugacccaggccagaaucauggcaguacugucaccagagcugagaaaagggagaauaagagguacauuagagaaagaaaguaugaugcuucaccauguuaauuacucaauaaauaacuuuuguuauuauuagggcuguuauuaucauuucuaguuccauuauuuauugccacuuaaaacaauucuggugacagugcauuuagagaucuucagagaaaauuauguaaauccaguagcgaaagguuaaugcaugguuuuuggcccaaguauuucuauagcccuugguuacuugugggagaggauuuugucaagcuaguaaagcuguguguaguugaguuguauuguuuugggcuauuuguaaauauuguauugugugacauacuucuagcaccugaaaagccuggccuuugggacugauuuuaagagcuguucacguugugugaaccaauacccauggccaaagggaaaagguuugcguuagagagcaaacugaaauuaaaagggugggugugcgguguccuucaacccuuguguagacuagcugugcggcagcaauugcugcccagaaguaagacugagaagcuuacgauagccuaaaccucaggagaggggguuuggaagguaggggggcuuucucuagaaacagaaucuuuuuugugagucuaccugccaacuagaaaaaaagggugcuagguguucagaucugcuuugcagguuccaaagcaccuaaguacauuuucaguuccaaaauuuaaauccuguuugugggaaaucaguagaggguuuaauagaagcuuaaacaaauuauauauaaacacacagaaguagucuggccugaguauggaaaggccagaaagucugaguguuauggugaaguaguaggagguaauuuauuuuuaaaauuuauugaacccacugaagcauaagugugugaggauaagagaaaaccauaugcacauaugguccagaaugaaauucuucagauuucugagaugguugcaaguagugacuaaaccauuuugaauuaacuuugugugugaaagucuuuucaauccuuccaauuuagucucuucagguucacuagugguggaaagaaucaacugguccaugccaccauuagacuggacugccagcagggaaguaagagccuccuuaucuuugcucagaguaugcucucucucuuuuuuucacuuucuucucucuuucuuuucuuucucucucucucucugggaagcaaaggggaugggugaagaucucuacauuucuuuucuugagagaaaggcaggucugagugaaaauuuauucauagcuuuuucauuucucuuuggaaaauguaauugugacauuguagcuauaaauucaauguuuaaaaaguauaaaacucuaucaagggaauagaauauuuucaccuuaguuauuugugaaaguuaggccuuuuguuggguggggagaacacacguaauacacugauaguagagaguaaucugcaguaagaucuaaucagaggaaaaucugaaggaaucagaccagagacagaucacugaccggaauacagaagugcauugugcagcaauaacacuccuuuccauucauuauugcaguuauaauuauggaacccaacauauuuaauuggcacaguguacucuucucuggugaauagauugcauuguuccuguuuuaaaaacccuuaugcaucaugaauccaugcacauguugcucuuuggcucucgagagguuucuuuguuuacaugaugagugauuaaccgaauugugaagccuugcuaugcguuguaugcaaagaugaagugaaaagggguaucuacucuguucuaacuuugaagggcuuugauuaauuuaaaaaaucuauuagaucuuugugaggauguaugccuuaacuuagaaauauguaaauggaaauaucaguugaguuugauaucugggcuagucuuuuaucugauucuggaggaccuguuaauggaaauuaugucuggugggauguuauugguacaugcauuagauuacaagccacagaagugguauuccugaagagguaugugguuacugaaccccuagaaaugagaucaaugcuaaauguggauggggggaaaacacucuccccuuauauaggacuuuccaguggauuccagggacuuuugucuagcuugcaagauaaaaugcuugcauggacuaggggcaggguauaauguaauaauaauaauaauaauaauaauaauaauaauaauaauuacagcuaacauuuaggaauaccuacugccugccaagcacccugcuaaguaaacauuuuacauuuauugucuuaucuaauucucaccccuauucuagugucuacuauuauccucauuuuacugaugaggaaacugagcauuggauagauuacauuuucuuguuugaagaucacacaccuaacaaagcugggaugugaugaucucaguugcuuuucacuuuugcugcuugcuguagaacauauugguaaagcauagcucauuguuuuaaagccuuuauaauuauaguuacguuguuccucacuacauaugagcauuuauacuuuugaaaauuaaucagagcucaguguaauuagagagagagagagagagagagagacuuuaguaucccccaaacaucagcuuauugcuuccacagcugagacccacaggggaaagagaagaguacacccauaaauauuuucuguaaacgccacagguagucaugcugcucuuggaugcaaaaggucucuaguucaauuuccugcuggaauggauucuucacaaauaaggauaaucccucauuuuauguuuacucacauguauuccuucuguauuccauacuguccacauugggcuuugcaguuuuuauauauucuugccagaaugcacuuauucauuagccguuuuuauuaguguuacgguugagaugacauuuucccauucuaaacuccaauuuucugugacuuuuaauuuuacaaaacaauuaccuaucaggcugaaacuccuuaggcugguuuucugcucagaaaggagguauaggggggagguuuuaaagucuguuccacuuuucuuggcagccuagacauuuagauucauguaagugcucuuuaaauaaaguugcaauugcuuaauuauuuaaauaaaugggagcugaauuauuuaaggauuugcuggcaagacaaaagguucuggguuuucucuccuaccccucacucagaauuuucagucccauuuugugcuggcuaacuaagaaugaauuucucauuuguauuuugauauaucugcaaauccagcaacaucuuuuggaguucuuacccuggcuaaguccauggauuuuaaaagucaaguuugaaauuuuagauuguauccaaauacuuugaguaaugucuuuuuauguauauuaugguuaaaaugcacacuuuuaccagauucgacuuaucgagcaccucuaaugugcagaggaaaacagcagaguggaaagaauacaguuuuggaauuugaaagacuggauuuggauucugacucugccacuuauguggcucugucaccguugcaaaguuauuuacccuuucugaggaucaguuuucucuuuuguaagccaccucuuaggguuguggaggagauuaaggaaauguauguagaagcccuuaauauauaguaccuggcaauuaguaggcacucaguaugugguaacuaugaagucugcacuuagguacuauguuaacaaucaggaauuaacagguggauaagacagagguuccuguccuuacugagcugauagucuggcaguggcaaagcauuuuaagcagagggaacagcaugaucaacaguagguuugaaaucuagaaagugcuugguuauuugggaaccuguuaauguuccagugucccuaaucuuaacauuaauauaauuggaaauauuacauugauaugguguuuuugagguuuauaauacacaugacauacauuauuucacuugauccuugcaaaaauccuauguggcagacagggauuacugucucuauuuuauaagggauuuuagugauuuacccaaaaucacacagcuaguggaagagccaggauuaaaguccagguuuuuugcauuuccuauccagugcucuuucuacuguaacauucaacuaguccuaugucuuaucuauauauacaagugcuaagccuuuaaugauaauuuaaugagacuuuuauaauguucuuuuuacuuaaacauuuuuacucaaacucaucugacuuaagauaaaauuauauaaaaucaaauugagguuguacuuuagccucuguauauaugucacuugugacuguaauuaaaaaaaaauuaaaguguaguuauucuccucccugacccuaucaaguauguagaaucuaaauguuaccuccuaauuuuacuuuauaugcaguuuuuuuuuuguaucagugucuuuuaaaaugucuuacagaaugguuaagucacauacuuuuauguauauucauaucugguaaguaugcaaguaauugccucaucuacccaguucuuacuguuuaucuccuuuaauggcaauaaugcaucuuuggguguauuaucuuuaagggcccacauuuguuuuacuauacuugauucaaacauguuggauccuugcuggaaacuauuaagauuauggcuccuuuaccaucauuaauuuuaaaaaguuaagugcucaggagagaaacuaaucaccucaggacaucaacuuccauucuuuuugcucuuuagaacugugccacuaugccaguuguaggauguucagcaugaaaggcuccacuucucagagggaacuuauuugaacccuggaguugcuucuggaucccgccaguuauuggcauuuccaaauaagaaugcagagcacgcaacacgcugcugucaacuugaucuuugaauacaaaguuguggauagaaaugcuaaugaaccagcgauuugugaaguacuucaccauguuggccacauagcaaauuaacagguucuuuccucuuagggggaggagcuuuugaagggacugucucuuuuuguuuuuuguagggaaguuauuuuaaaguuguuuuguuuaguuagggacaaggcucaucaggugugaguguuggcuacucuggccacagaacaugugugacuuuccuggcauauucagagaauuucuuaagaaacuugacucuacuggaaucuuuuccacaguugcaauugucacugaacauuccaggggcuucaucuacauuuugaguucuuaguacauuacuauuuagagauauauaugggcauuuucuaccagagaccaauauuucucucucucucuauauauauauaugauuuuuuuuuugccuuugaaguaccucuuuucuuagagauacuuuugccaccacccuccacuuuuuuuucuuuuuuucccaaaacucacugaagacauccaaagaaauacaugaauuuuucagugggaguugcacgugauuuuuaaagcaucuuuuaugcggucuuuuaaguuucuguuuugauuuugcaauugguuggaaacgaaggaaaccucaagcuaguagcugaugagauccaacaaggacuugccauguuaauaacaagaaucugaaaaaagaaaagaauguaucugauaaagagucuagaaaggauucacugccacuccuuugaggcuuuuuccagucucaccuauuagagaaguuauucacucuaucauuauggauugaaggaagguuuagaaauuuccucuccagcacuuccaagaaggugaaaguucuuauuuuaugggcuggcaaggaaacugggagagaaagggaaaugauuucuuucuaaaauaccagaagauagggugccacacuugucccuuaagauagauggacagauauacaauauaagcuccuguacgaggcacaucuuuuaggaugaaauugacugaagaauugaucuuugaccaaauccuguuugccugaccuaaaaugaacucuuggaaagaccaaagccuuauuggcugcaccaagagaagauaggaccuugcccauggaugggagaauccuggccuuuagucagagacagcagguauguauguuaaguccauuugguuugccauuuugccaguagcuuucaaagaauuuggaacuugauaugauguaggaucuucacauuuuaugagauuacaaugaaacucuuuugacccuauagcaaaaccagcuuuuaagaggaugaacguauuuucaaaaauuuagcccuacaguaaacaugaaauguugaaagagaaaugucugucuggcaaauugugauucugucccaagaggaggaauuuacuuccauuuugauuuaccuggcaggaaaguaucuuuugcaggcacuacugaaguuuuucuuaaauuccucugcuuugaauugugucucugggagcuauucaucuuugucaccuguuuuacuucugcuauuuuuagccaagugccaaagaccuuacagcuuccucaagugaaagauaaagaauuaagaucuguuguaaacaaaagcucaucacuuuuuuuuuaugcugcaagagcucccuucaaguuuuccuuagagucaacuuuaauugcuuagacuuagacucuccaaaagagagaccuuuguuaauuuugcuuccaaauccaugaagaggcaaggcuuuguuuuuuuuuuguuuuguuuuauuuuuuuuuuaaagaacauuuuagaaaaaaugaccaaugaaugaacuucucuuucaucucuauucucaugucaaaugauaaggcauaaagcaaauggaggaccuucuagaccuagaaggauauaucuuauaagugaauccauucccaaaagugccagugcuuguuuagcugagucaguuaaucuugacacuaaggaauuauuacaguguuuaaauuucauuuuuuagguuguagcauggcaggaaauacuugaugaggcucuaccucuuugacuuggauuugugauaagaaaguaaguuuugggagggcgaggugggcagaucacuugagcucaagaguuugagcccagccuggccaacaugguaaaaccccgugucuacuaaaaauacaaaaauuagcuggguguguuggggcaugccuguaguuccagcuacucuggaggccgaggcaggagaaucacuugauccugggagguggagguuuuagugagccgagauccugucacugcacuccagccugggugacagagcaagacucugucucaaaaacaaaaacaaugacaacaaguaaguuauuuggccuaacucauagccacuucuggagaaaacaguucaaggcacauagcccgugauaagugcugcuguuucuuuucuuuucuuguuuuuuuuuuuugguuuuuuuugggggcgagggggguauaggguuucacucuugucacucaagcuggacugcagccuugaucuuggcucacugcagccaugagcucccaggcucaagcaauccaucucccaaguagcuaagacuacaggcaugcaccaccacacccgacuaauuuuuguaaauuuuguagagauggaguuuuaucauguugccuagguuggucucauaccccugggcucaagcggucugccugccucagucucccaaagugcuaggauuguaggcaugagccacugcaccuggucgagugcuuccuuuucuaugaggccagaauguuucuaucacaccuagacuaacuaguaauguaauuuuaucuaccugguuaguuagauaaaauuuaucuaauuauauauauuuauacugcaaagcauuacaugcuuauagguuuggcuuuucuuucaagaaagcaaugauaccuccugaguauuuucuuccauccccaugucaaucacucccacccuuucuccuuaaaaauuauuuuggagaccaaaguauaauagauuuuacccagaagugauauuucucaccaauguaaacuuuguacuuuaucucuuaaaagguggaaaaaaaguauaguaaaauauuacauaugcacagagccuagagauuauauuuuauucuauuauucuuccaaguugaguuuugugcuggucuuauuuuuaucucuccaucuauguuugcagggcugccuguuucccccaaguguuaauguaaacacauuuuauuuugagacagaucagcucacuucccucuggaaauccaucccuauaaugugguaaaccucaauauaacucucugguccgaaugacauuucauaacuguguacaaaucaaacauacuguugauauuaaaugacaacuuuuaaugccuaugucaacaauucacuuaagucucauuucauuaaaacgcuucugaucuggggagaagcugcuugucugaguagauaaagcacuugacuuucaccucuaguuuccggguuaaagugcaguuggugagcuguaauucaaauggauuuuauagguucugggcuaggagacuggaacaaaagucugguucacauaaucagaggaaaucuugggucaucugaacaagugggugucaaaaccagugauuuucacuuuauuucuuguguaagugagcuugucuuuguggaugauucccagcccccccacccccccaccccaccaccccaccccgcuggccccgccaaaccuuagaaauuuuaaaaaagaaauuaacguggucaagauaguuaacaaguaaauggaguaccuucuagaccugggaggacauaucuuguaaguuaauccauauucauuccuugaauaguucucccucgguuucucuuccagaaguuacagccagcuuuggguccuccauucuugccuugaggaaauuuccaaaaaguuuuuuuuuuuccccuccagccccagaugcucuccugacucuuuccaggacucucuaggggacuggcuuuugaugguuuccugaguguaauccuaauuccaccgguguuuuauacauauugacuccucugauuguuucccuguaguuaggaaagaagcccaggcugguuaggaaccuccucuuauaugccuaaauuagcaaggaaaacuguuucccccauuuccauggucauggugucucuacuucaagaacaaucucuguggggauugcucaugucuuaaacugaagccaaugacuacacuauaccuguuaaguggucuguaggggauguuugaaugaauaacaguaguugcugcugcuacuuuaauaaugucauaauguuuuuguuucauacaacuuacugaaguuuaggacuugugcacaaauugcuaccuauguccuuuuucgccugggaccuccuacuuugugagcccucagcaaauguaggauaaucaagaaggggaaauuagccuuguggcuuuaacggguaucuucaaauggcuacacgugguaaaacccugggauugugcugaauucuuacauaccuguaucaaugcagaaagacccucaaaaaaauuacagcccuuuccauaguggaacaaucguaauauaaaauaaguggcuguuaggcuucuuucaggucuugauaacuuaggcaaggcagauaauuaauacaaccaagaugacaguugacuauaauuggcugcuuauuaugaaguuuagacauuuuccucccuucuaucucugggagaaggaaauugcucuagcauauguguguagaagacauaaaacuugcuacagcaguauuuuuauuuccagauuauucuuaaagcuauuuaaaagucaccacagaaugagcuuuacagaagcaauguaauggcuccuuuagguuuuuguguaaauucagauaacugaaauguuagccuugauugaugauuaaaaaggaaggagguacaccaaagcugauggugagcucuggauacaggauaaaggaauugggguugugggggaaagaucucaccauagucccuuaaguucuuuuauagaauuucuguugugauugguaacguaaggagcauuugaaagaugaucguuauuugagaaauguuucugaacuagaaacuugcaagcuuugaauccuguuaauacucacuggcaaugauagccauuuuccauuccaugagaucacuuuggaacuugagcauaauuuuauuucugcuucacaguucuuaaaauccuguuuggaaaugucauuaggaggauaagggauguaaugaaaaauacguuuucucauguaccaaaucaaaguguauaguuauggagcuggcuaucuauacugaacaacaguuaacaaaaugaauuggcugcuuuccgcauuugaaguuguauaguguaaaauucaaugaaacguucaauaacuggaaagaucacaucagcaucaaggaugcauuuagcagguuuccuccuaccauauuacuaagauagaagcacaguuuuagaacuaggaauaaaggcuaugaaugaaguuaaaaacugugggaggccuggaaguagaaagauaaguaggagugacugggccuggaaacuuggauuuggaugcaagugaaggaaacagaaagaugggccugugcggaccaguauuuuaugauuggugcucuugucaguaucuuccacugaaggcugaaaguuauuucuugaaacuagcaccugucacaccccuccuuaaggcaaaggaccuuauuuuuggugguugaacuugcugggucaaacagaaucacuaugccugauucucauguuguauggaaagacauagggaggggugaaagcagcuuuuuuuccauucagcguuuuuagcagguuuuuagagugaggaguuauuccaugagugaaugaauggaaugaaugaaugaaaaaaaaaauggccagguuuguuuuucuuggaaagguuuuauuuccuauaaagagauauggcauaauuguguuuucccuggcauaaaaugaaaaauaaaaucuagcaaaaugcauacuuaagggaugugugugcacauguguaugucacuauaauauauaaugagacuguugaacucucuagaauguuuggaacuauaaaguuuagcuguuuugaaauauuccucuguuagacauuggcuuagggaaauacauguuuucguauaaaacaccgaaagcauuuucgguggcauugucgggaaaugcaccuugccuucuaaagcaguagaugcaacuuuuaagaaugcaaauuugaaaaacugacaggggaaaauuacaagaagcuuacauauucuugaauuuucuccaucugaguuuuaaguaggcugguguuaggcuggagcugcuucugauuaugacucuucuagggggaaaacacaguuuuacaggacugaccuuaagugcaaaauggauaguaauucaaagcccugagggggcuuaagaaaugaagguggcuuauugguuuuggcagggaaaggguugucugguaagaccauugagccucuuagcugaaaaugcugacaaguugagcagagagcaucugugcuauaccaagcacaaucauuauuuucauuggcaaaauguauugcucacaguuuuggguagucuguccauuuugucaguaauuuaaucuagguugaaaaaggcaugggauauaaaccgcuauuguugagcaucccugcaggcauaccuggcagguuccauuccaacuuuuaaugaggagucuugcuuuauguugggguccgcugguggcuugcaauaucuauuuuggggcguuuuaagauggggguuagcucuugaaauuggacaaggugccugcauaaaagaugaugagauauuuuuucccucuuggucucugcuccuuguuaaauugguaauuaggcgagacuuucagacagaaguaaaaauacagaugacaugggauugugucuaaggugauagcuuuucuuucaugggaagaauaauccugaggauugaaauaaagaauuugaaguagaaacuuaauacauuugagaucuucuauauuuuuauaguaauuuuauuucacaauaugugccaauaauacaugacaccuucaauaauguauuuuuauacuccuuuacccaagaauuaagcugguacauuugcaagaggaggaaauacauguugacuuugugauauugcuaguaaccccauucuuuuucuuuucuugggaguggcgcuccaccccaccccacccccuccuaccccccaacacacauuaauggguuauucuuggcugggaaauguucuguuuucuauaauuuuucaaaauauugcaguuuaugaguugaaaaaugagaaaaaaugguuacuacuuaauuuuuuaauguuuuauauauuaaucaauuugauucuuuagaucauuuugggaauauccuuggcaagaaaaagcaggcauuuucacacauuguggcauugucuuuaggucagacaagcaaguugcagaaagaauuuucuaagcuguguguugaauaaggagacaguuaauucugaggcagcccucauuuuuuuucuaaucagauuuauagcagaaacuauuggaacuaacuuauucacacuuuucccuaacuuauucauauucuacuuauaccauauaggaauuuugauagucaaaauacgcccauauucuaaucaaaacagaaugagaaagggaaacaauugccuuuuaagaauagggaugagagguacucaaucauuuauaguuauucuuaugauaugugcuguuuauggaauacuguaugccaggcacuggucuagaaaacuguauuaaucugugugcagucgagagaggaaccacacaguaauuugaauagggaaagcuuacugugacucguuaacuguaacaagguauuggaauaaugagggacuugcuaguaagaaguaaagagaauuguaaagaauguagaaacagcagaucuaaugagcaaccauuacccugugcuaagaaagagcaccuaagaaagaacaccuuucccaagcugagauccagguaguauuggagaggacacagcuauggcucacuguggcagagaaguugcuguggugcugugaaacuugcuggaauuccacccucuaauaugcuggggaaaaccauucaugagaaggugucucuuuggaggcacucugauacaaaauugucugaggagggugccagcaaagcuaccagccaccguuugcuccuggcugcucugcucugcaggauccaggcacuggggaaucuguguguaccuggagauggaugcuagagaagcucaguucuguguguaccuguagauggaugcuagagaagcuucagugccuccagcaccaucuacugauaaagauuaaccuuguguccgaggguaaaggaaaaacauuugaagggcccagauccauuuucacagagcagacaaaaagggugauuuugaagcugagaggcaauaaacugaugaugggcacagaagucuuugcugcugcuuuuuuaauccuaaagagacuagaaguagugaaaugggauuauauaucccauuuuacaggugaaaagauuucuuuaagcuuacagagauuaagugacuuguucagggucauauacuuaauaaauggcagguucacauuucaaaauuagauuugcuauuuucuaaggcccaugucuuuccaucagccuuuuuggaauacagauacuaacaagucuagaaacuggcaguugugccauauguucuugucuagguauuauacuagagaucacuauuuauucauuauuuaguucacuuccagcugguccuacagaugaggggaguuaugcaggugaguaccuguuauguuuguaccauauaucagauucugaaacuuaaaggaauaguuuguaccuacuuuaguggagucccugaaaccucuuuuuuucuagcuguaccuuagcuguguuauuaucaguuacaguucaggauucauaccuguuugcucauuuggcagcucccaggggucucaaauuggguucccuggaggguaggggcagacgaugauggauccugguuuuuuauuugaaauguuacuuuuucucaaccuagcuucucuccucagggauaccccuccaggacaugcaacccuugguugucuccuagucgaggcugaggguacagccuugcucuuucgaaagagcaguggcccuuuuaggcuacauagguuuaucucacuuuugaguaauagauucauaccucaaauuuuuguaaaagaagugucauuuucauacugauuuacacuauaacuuuuagaacuccuuuaucacuugacuuugggugaguuacuuaaccucucugggacuuaguucuuuuauccauucuuuaaucuauaaaggggaauggccuuuauaaagcuccucucaucuuaaaaacacucagugccuauuucuaguuuaacaucuuuuggcagcaguuccaaacacgugagccuucaguugcugauccugucccuggcaaguaguugcuggauuacaaauaaauggaaggcagugugaugugcuagugagaaugugacuguggacucagacccaaaaggguuggaaucuuagcaccucagaacuuaguaguuaugaggccuuaggugaguaauuuauuuuucugugucuuagccuuuuccuuugugaaauaagaacaacaaugccugaccccuguauucugaugaggaguaaggaaaaugauaauaauauguaaagcacuuuguacacuugcuagcacauaguagguguucuauaaaugauagauauuauuauuccccaugaaauuguaagcuccuugaaggcagggacucugucuuagucauccuuaaauuacugguaguacuagauaucuaacaggcacuuaguaauaucacccuuuugaacugaaggaaaguccuuuccaaguugaaucuuuauaaaguaaauacuuuuuauguaaauaaucacccuggaguuuaucuauuugauaaguuuggauugcacauauucuucugucuuaaagcaguacauuguuauaauuguauuaccucucucucucguuuuuucuuuuuugacaggucucacuucaucacccaggcuggagugcgguggcacaaucucggcucacugcagccucggccuucccgugcucaggugauucuucuaccucagccucucaaguagcugggacuacaggugcacacuaccacgcccagcuaauuuuuaaauuuuuuguugagacaggguguugccauguugaccaggcuggucucaaacuccuggccucagguaauccauucgccucaaucucccaaagugcuggaauuacaggccugagccacugaaccuggccccuuaaauuucuuguuaguaacuuucgggcuacacgguucuuugauuuuuuuuuuuuaaacaaugauugcaugguauaauagugauaguauaacauuauuauggauuuacuaugugcuagucauuauuccaggcaauucauacuuacuaauuucuuuaauauucagagccuucucauuaccucuauugucuauauaagaaacugaggcacgagccaguuaaguaacuggcccacgguccugagcuguaaguggggaaguaguggucuguccccaagccgacugcuuaucacugcuauguuauauugcuuaguucaacucuaguuuugagacacuuuacuagacagagguuauugaugaaaacccagucaaacccaaaucagccugagucuagaaugaaagggaaggcauauacuucaggacagguugacauaaaucuauuuuuagucauuuaaauacauuuuugagaauugcuuucccccuuccaaauacguucugagaucaggaugagcaaaagccaaacacauauuuuuuauguuuugagauuaaaacuguguuugucacuauguuauagucauuaguccccuacugugcuucacacauagccucuccucaccccuccacgugccugcccccugcaaauaugucacagcaacaacaaacuuuagcuuuguacaucccaucuuccuuacguagaagcuaugguugauuucucccucuaguguuccuaaucugcuuacugaccuuugcuauuuaagcugacuuuuaaacaugaggaagagaggcgaauugauuuucuacuaguaaugugaaaaauuagcgauuuaauuucacaauauuuguaaauaagaaaaugggaccaauggccuagucucagauuacauuauugacuucccagaaguuguccucuagccccuaccucuagucguguggacauacagaacagagaacuauggaaccugaaugaaguguauguucagaugccaacagaugauuccauuucucccuuuaguuuaguaacaacauuauuuucacuguucggaaaaagauuggcuugguagacguaaggaaccacuuuagucaguguggauaaaugaaaaaacacaagugaucagcuuucaucaugacaaauggaaacugucauuuaauuuuuauccccaauuauacagcuccaggaccaauuuuucagguggaauguuggagccauuaaaaagaaauaaguaaacuauaccauauuccaucauuuuucuggcagcuaaccaaugaucuguagccuuauuacauguacguuuuuauagagauauuuuucucuuaaguuugcagaaggcuuuauuaacucuuuacugauuucuucuggaaugcauuuuuccaaaugaauuccuuuuuucuuuuuaucgcugaguguugguugggauuuacuuugguuuucucuggaagcuauacucauuuucuucuuuuauguuuuuuuugauuacuagaauugcauggagccguauuucuuuaauuccaacugaaguuauauuagugguccuaauguugauuacagacuauguuaauuuggauuucagaaugugauuuauuagaaauauaggacacacaaaaagacccgaccaaccaccuuuugucuccugccuuaaagugauacugaaaaaguuggguauccccaaaagucgugcucccauagcaguuuguccguucuucuaauaggucauguuguaauuugccggacuucaucuucauguuccccaguaauuugaaaucuugguacuguggauaccuuucuauuuggcugaguuaucuuugcauccacaaauuuagcagacugcuuggcacauacuggguaugcaaaaaauguuuuucgaaugacugauucaaugcuuuuuaaaauuuccuuuugggacuauuuguaauuaaaaauuauuuaacaauauugaagucuagucucuucugagaacacuaaaacccuuuacaauuauguguguaguuuuauuuauuccauauagaaaaauuuuacaugcaguggguagccuuugaauuuuccaggugggagaaauugagaucaaagguuacuaaugauauuaagaacuccagagagaggcaaugcugugauuggaaccauugacuucuggguuccaagcccuuuuuucuccccaggcuacacagcuuugggucuuucugcuuauuguacaaucugccauuacuuuuauuaucaaaaaaugucacugauuuauuuuugauguauaauuaacacagagagugguggugagaaugauggucagaagaucgguuguuuugguuuuggagaagcugguuaauggaugaggucuauuagcuguguagaucuauguacagauuuuuuuuucucccuugguguucaaauccuuuccccuucauucaccuaauuaguaauucacaggagccuuuggcucccagcccaagaauauuuguauuuacucgacuuuagcuucagaauaaacuuaauuuucaaugaaagagguacugaaguacauuauaaacaauaaggcaacauuuucuucagauguaugccuuggcauaugcuuagaggagaaaugauacccucuuguaucuacuuauaaaacugucaucugguacuguugccauuagaauaugcaaguaagcuuauaaacauacugaugaaaauggauucuuuuggcugggaaccuuguuaaguaaaagguguuaaaucauguaucuuguccucaggggugguggacugaacagcugcgcuuauccuuauuaaugacuguagucuccuguuucagaagcagcaaauagccuuuuguaagaguuguuauaauaucaagaguuacuuuuagucaagcucuuuacugggaauauuaauauauagucuagcuuggcaaacagcaaaaaacccuagcaguuugcaaaugguuuuccuaguuucuuucccaggagugauaggaggaguaaacucaaugaaauaaacacacguaauugccgaucugucauaaaucauucuuugugguagguaucuacuuuuaaggcuacauuaggucuuccaaugggagaagagcucucggauuuggcuaauguaccugcacugauggagagaugaugauuuucugucuauucgcuugugacauaaaugagaacuucucuugugucauuuuguuggggguggaguguugggauuugggauuggucagucauagaauugcagaguuagaagggaccuuagggauuggacucaguauaguacaacaucccaaagcuuuagagugagcccuuucauuuuggguagcuguaauauuagaaugcuuuuucauauauuaugauuguauuuauuauucucugugauguucacucauuggucccuugccuugcuucccagggucuaauccuuguuugucaccauccaucuagugugacauccuugacugugcaugcccuugacucaaccuggcccucucucccaccacuuagcacaugccuuuuaucuuucuguacuuuuuauauaccauauuacauuuccuugguguucacuuggcuccaugcugaacugaauucugugaagguagggaucagaucguaaugcaucauagaauuuugggugccuaguacaaugcccaguccucaauaauauacauuauugaauguguauuguucucaucagcuuaaaauagaacuaucauggguuuuuuuuguuuguuuuugcuuguuuguuuuuccuauagguauagcuguuaggaugccugauuacacauugaccauugaacuuaagaucaguugaaacucucagggcugucaagaguugccugaugcaggguuuggggaauuguaaaauaacggaaggggcuagaggugucccagaacaacuucucauugauuucagaguccauauuucuaucuggauauuagccuguagcauccaagugauuggcgugaguaagucaguaccuugcucauuuucuauaaaguuugaucauauucacaaauuuaauagcauagugauaaauuucucacacaaaaauuccucaauguaucuuuauuucaugauagaaaaccaccuacuguuuccaagcagugagcuuaaucuuuucuucaguguuuuugcaguuccacauaggaguuacaguuaucauuauuaaaugucuuggguagaggugaaacagcauucugguuuuuuguuuuugaaaucuguguuugucuuauauucaauaucucugcaaacuuuacacauuuuguauuugaaugguuaaaacuucaaggcuauugagucaucauuuucauuggugugucccaucauuucugugagauacaacacaccccacccuuuucauggaaugggagaagcccucagccagcauguauaugauuucuaagccuauagguacaagcaugagcaggcaggacuucacuccuuuggcccucgucauuaguuuuacuuuuuuuuuuuuucccagaagaaaaaacaccauguccauauugcuaaaaucagugauugauaaaaucuugaacuaaacuugacauagguuucuguacuugaagaagaggugguaggaucaccugaacccaggaguuugagaccagccugggugacauaaugaggucccgucuccacacacuauuaaaaaaauuaguuagguguggugaugugcaccuguggucccagcuacacuggaggccaaggcgggaggauugcuugagccaaggagguugaggcugcagugacucacguucaugccaguguacgcuagcgugggcaauggagugagacccuaucuuaaaaaaauaaaaauaaaaaugaaugaaagccaaagcgacugaguauccacaguuuucucagauacucagaaggaaaaugucaagaacaaggauaaguugggugauuauucaaaugguggccuguggguccuguugaaucuaaugccucccucuguggauucagugguguuuccuccaaacuccccuuagcugucuguguguacuuaauacaugaaugcuuauauaugaggaggaacaguucuuaucucugaaguaguaaagcaucuuauugcauuuguuuaaugacuuugagaucuaucugguaaacuccagguuauaauuucuuucuuugaauuugauugauuuucucauucaaauauuuccggaaguauuuagugaccaucuaucaugugcuaugcacaaugcuggagauugggaaauaaugguucacaagacagauaggaucccuguucaagagcuuagcaucgagugggaauacaggcaaugaaacaauuacaguuuaucacgugugguaaguaaggauagggaaagccucugucaggagaugaaauguuugcuguuuagcguauccauacagugauuauguauucugagccaaaauuagagcacaaaagauaaugccaaaaagaugauuaugccaacuaauuuuuugccaagaccauguguggauggaaauuuuaaagauacaguuuggacauuaaaauauaugaauuucugggacauuuaaguaauuuaugaguauaaacggguagaauauuugaaaucaagccugcccuggcaaauccuggauaaauguuugcuguacuuucugguuucugccacuuguagagcugaauuuauggagcuguuaauucagggaacagauuuuaaaaagaaauuuauuagcauauaauaaaagcauaacagaauuuauuaaaagucugauuuacuuuagaaauucugagcccuacuccaauguuuugaugggaaaaaauaaaccaggaaaaaugagcaauuguucauguucucagugcagauauuauuaaaagaccuucugugcuacuggaguguuauggauucucucucucaaaacaccacuuggcugugcuuugucacuaaagucgaccugacaauuucccguagauaacucugaaauggauguacauucaugacuuugcauaauaauuuaugccuucaauauugcuguggucagcauguggacaucucugcaaaacauuaguuaaguaauugguccuuuucagcugcagucugucaacagcacacguccuuugaggccaugagaaaauacuugcaaugcuucaguguacucaucuaugcaaauuggugauucaugggccaacaagggcaggauagaggaacuaggaggcaaagauguuugaaguaauaaaacaguugcuaaaacagggugggauagcuaguauaccuccucccugcagucaagacuauacccaaaccaucugagauggacaccuaucuaggcucuucuugaaaugccaugacaugaaacguuuaggaacaggaauuucuucuguauguccauaauauuaucuuugccuccacuuacccuuuuacauuuugggccaguuuucucuuuggugguaauggauaccugguuagccuuuacuuaugacaucauuuuacuaaaagcccuuugcuggaaguaggucugggggcucagaucgcauguuucaaaagucuuuuugguuugggugaaguuuuguagcugcugugcguggcagguagaagacccagugcaccccucccagaguggguucucugaugauaaugcuucaccuuuaagauugcuugacaggauuuaaccacauaugcaacaaaucaaugcagucuagagaacagaugcacuugaucuauauuguuugucuuuuuuuugacugaugcaggcaaaagaaaccaucagauagcuucucgguuaauauagcuuuguucugaaaaggaggcagugauauauuugaggaugcauauggccaaggccugaaaugagguggauacuuaccaguugggacaacauauaaucaauauccaacuaaagcauucuauaaauggaccuuuuuuuuugaucaaaccauauuauguaaaaguucucuaacaguuuauuaguaucauuagaaaauguagccuacuaaaaauucuaaaugaucauuuuaaugaaagcugugucauuugugaguggcacuugccuauaaauuuuucuagagcuaugaaaauaaguuagacaagaggccaaugguuuuucuuucuucuauuuuuuuuuacauuucccaaagcucugugaacagcucugacugucugauuuguuucaucguugccuuccacugccuguagaacaucuguuggaaaauaaugcuuguccugucaguuuccagaaucagcagcaaaccgaagugugcgcacaagguagaugucagcauuauacugcugcugccaccaggcuacugaaagacagaauuaauccugggcugguaagauucauuaaaaauaaaaaaagaucuggaaacccuauucaggaauagaaugcuuaucccaaaauggaccaagcagaacacaagcaaaguggugauuuugaacuaaaggcacagauauaggaugauuauugccuguuauuuaguggaugacucuuuguucugagacuagguuauacuguuuugcuggaagcucacaacagaucaauaguaauuuuguuaugggccagaugucaaaacagaaaugugcuuucaaaucccacugacuugcugugacaacuaguaugcuaaaauacauucgcucagcaaucaggcguuacacggugcuccuggaguucuguuuucuuucauguggagccuuaaagcuacguauuguuagcugaguuucccugauuuuguaguucuuucucuauuacauauguaccucuuuugguugagaauagaaacacuuccucaaauucuccccuuuccucugccuugauaaugagcuggguguaaagucuacaccauaacuuccuguuacaaguaucauuuuuaugguaauaaauaaaaucugugguaggaaaauggucacgaagaaaagcaaaccagcaagaagcauguuauuuuuuuaguuccucuguaguccaacuuuggaauuuuaauuuuggucuggugaagauuugggagucaaauguuuugugaugaaagauaauuuaagggauguugauuugcccaucgcuuugguaucuucccguuucuccugcuucugugaaacuguugguuaccuaaugucuuuuggaugagauuaggauagcaugccauagugagaaaaugucuuccugcgcugauuuguuuuuguagaaauaucccaaauuaaucagagggaaacaacuggcaguuuuuggcugaugugguuuggaaguguaauuuuaaaugguguuaguuucuuaaguccagagagaauuggacucaugucuugucuaucuaggcccagcugucuuccccguuuucuccuuaaaacaggaaaagaaaaagccuuuccuuuucagaccaagaaaggauugaacaagcucagaauuauguauucaauaaugugauaagaguuuuuuauuccaccucuggggcaggucuugcauuucuuaccauuacccuaucuuuuguaguagaaauaucucuaagugagaagaaacauuucauccaagcauguaaguucucuuagaacuuauuacucugcuggauuuuguguauauuagucuauauaauucuugaugcugcucagauuucucuaacagacguuuuacucacuuacaaaaagaauuccuuggauucuguuguucuuuccuaucuguauugccaaugcuuuucacagaacuuuguucacuuuacucuugucagcuucaucaguaaaaugaacagaguucaaaucagauuaaguaccuucuguagcagcuuucauuuauuuacugaccacuggaagaugccuuuuuucaacaaaaauuaaauacacuauugcugcauuccagacuauguuacaaguggaagaggauugcagauuaguaugucaaagccccacccuuucagaaacuuauacacauagaaggcacagcucucauaccauaccauugagguacaacagaggaugaauuugcaugugucugcccucauucucuuaguugauucuccugauagcuaagugcauaaauugccaaaucaugggagagagaagcuaaccuguccacugagaauuaaguggacagaguaaaccacauauuuuguuguaauuguuauuaccucagcuguauuuucguacaaaagaaucacaguucaugacaagggaacguggaacauagagcagagagucaggaagagaaugccagguggguccccccaaaacaaaauccaguaaauuaggagggggaguugaauaugagaauugcaauuauuaucugagagcaaagcagcaaagaaacucaagaaggugaauuguguuuucaggaacacuuuuggaaaaaccucuagauuuuucuuaaauaaaaauaaaaucuuacauaaaaaucuauaaaagauaccagaauuagaaaaaaauggagaacuugggauccuuuugcuucuuuacauucuauguuggacauaaagugagcauuacuuuauguggggaauauguauguauguguguauuuauauauucuaauuuauuuuaacagggugaagugggucagugaguaagaugcaauagaacaguaguuaucuuugucaauuaaagccccugucaccauggcguagguuaguguaagcucucuugcagagugucuuuguagagauacucaaguaauaccauguguaguuuugcagagauuuuguagguuucuuagauguuuaccgucgugugcuaagcuuuuuccaagccaaaaaacauugaucuaggccagauacuggcaaacuuuuucuucaaagggccagauaguaaauauuuuaggucuuguaggccauauaaucuccagcaaaaucacucaggucgguuguuguaaugcaaaaacagccauaggaaauacauaaaagcuuggcucuguuccaguacaacuuauuuuauuuuauuuauuuuuugagacggagucucacucuauggcccaggcuagagugcaguggugcacuuggcucacugcaaccuccaccucccagguucaaacgcuucuucugccucagccuccugaguagcugggacuauaggcaccagcugucacgcccagcuaauuuuuguauuuuuaguagagaggggguuucaccauguuggucaggcuggucucgaacuccugaccucaagugaucugccugccucggccucccaaagugcugggauuacaggagugagccaccacgcccagccccaauacaacuuuuauuauggacacugaaaauuugaauuuaauauaauuuuuaugugucaugaaauauuauucuuuugauuuugaucaagcauuaaaaaaugugaaaaccauuccuagcuuuugggcuggcuuugaccuguaggccauaguuugccaaccccaguuccagacccuuuacugucuaugcuuucuaagccauauuguugcuuaauuggaagcuuuaccauaucauaauuaaauuugguaguaacugugugagaaagugaaacauuuacaauaauccuaagagggccaggcacaguggcucacgucuguaaucacaucacuuucgggggccgaggugggcggaucaccugaggucaggaguucaagaccagcuuggccaacauggagaaacccugucucuacuaaaaauacuaaaauuagcugggcauggugguacacgccuguaaucccagcuacucuggaggcuaaggcaggagaaucgcuugaacccaggaagcggaaguuguguugagccaagauugcaccauugcgcucuagccugggugacagagugagacucugucucaaaaaaaaaaaaaaauaauaauaauaauaauaaaauaaaauacuuagagaacugauacaauugucagaauucaacucuccaggaaaacuccuacagagaguauaguucauuccauuuuauuuggggcugcgguacgaauucucaguggccugaagaguggcaagggggagaggugaaaaccagccacaggaagggcugauggugaccaaguccuugcugaaugccuacuacacccugacgcugggguaagggcuguacccagauuaucucccuuaguccucacaagauuucuaugaagugagaacuguucucaucucuguuuuauaaaagaaaccaguccugguggguuaagaaacuuguugaagauagcauaauaaauggcagagacuagauuucaacccagucugucugacgcugugagguguguagucagcgucgggcaauguaagucaguuggcugauuaacugcacuuagcuuggugccuugcauaugguagguccuauauauguauuacuguuuugucuguagcaaaaggggaggguuggggugaaguaguauuaaagcauuagggaccaaagaguaugauaccuucguuagaguuucaguuggaucuuguaaucaaccugugucuuaaucaagccagaauaugcuuuugggaaccaaagaggagugauaaaaaaauaaaagaucagagaaacucaugcaguuaaaaauguggcaagucauagacauggggaagccagugugaaaguccuuacuacugagcucaugaagcucaugaacuuccacuugacggccagagugucauguuucagaagacuagaggaaauuuuuuugacuuacugccaaucauuuacauaaacuuaaaagaucuuagcauuaaaauuacuuauuugaagugcuggcagguuaauaaauucagggggcuauuugaaacauugucaaucuaaaauguaauccuauuaaaauaauugaguauuuucugaguggagaauucccuuguccuccuguccaaggcucacaagagaacaacauaaaaggcauccuaaaauguccucugaacaucauugaaccagccgacguguuugcacaguguaaugcucuuucgcaaagaauuuccucagcucuuccacuuuaaaaggcagaaaucccaacauaauggcaaguuuauucuaauaugggaaguggggauuauauuugaagugauaccuuauauagguccugggaaccuucuuggucuguuugugcucauuucuguaugugauugaggauccuguguaacucaaaacaugugcguuugcuuccuucuguuccuuucuugggcuccuuuucauccagcagcuuggguuaccuugaauuaaauugguuuauggcaugccguuuucgguaaaacucccugaaagaaauggucacauaacucaaaaagguuugcccuuggagugauuuagucaugcuggaugauagcuaaggaggcuuauugacuuugagcucccuuuggaaccaaauucagaaagcugugcacuucuguggcaccugugagacacucacuugaauagagcuacugagaaaagcauuucaguuauuggcauuuuuccuaaugcauuuuguaugugucuauaccacagggagaaaugugugguuauuguugaaauauuaucugcauggcuuuguagaagaagaagaagaaaagucacuguacagcaaucagcagaggaagucucauagugugugugugauguuuggguggggggguggucugugucuucccccaccaccaaaacuccaaacagcuguguggcuguauuuuaagacuuugugacuuacacaucuauuaaagggaucuugaacuugacaaguuggauguugguaaccaugauuuggaaugcuauuuaaauacgagcauuccuuuuguucaccugguugugacuaggaagauaggccuugaucauuugaguaacugugcucugugaauccgagaggaaaacaaacucucagaagugcauaaaaguuaaguuaauuucuuuuucuuuguaagccgauagacucuuguuuaaauacaaauuuguguggacagauuuucguuugucaugcgugagcuggguauguugcauuugucuaaagggagcaguuuuaaguagguggauguguaauacccguaggcuaucagaaccaccauuucaauaaaucccuucucauauaacaaccgugcaggaaguuuggguaauugauucuccugagcaauacaaauauugaaauucuuaauuauuccaagugaugggcagagcuacuacuuuuauauuuuaaaaaauucuguuuauuauucuuagguguucauuaaacacuuauugaucagcagucuacagccaggcuguaggcuagaugcugagaugccaagugggcaaaagggagaauccuugaccucauagaacacuaaggaaugcugaucccacauggauaauuauaaugcauaaguucauuaauucaagagauuuuuguuuauuuaguaugugcuagaugcugggcauuggggagggaaagacuugugggauggggagaaagggacaauggugagcgaaagcagacuuggcccucaugcuccuuauggucagggaucaguuauuaaauauauuuagggccgggugugguggcucacgccuguaaucccagcacuuugggaggccuaggcaggcagaucaugaggucaggagaucgagaccauccuggccaacauggugaaaccccaucucuacuaaaaauacaaaaauuagccaggugugguggcgugcaccuguagucccagcuacuagggaggcugaggugggagaaucacuuaaacucaggaggggcagagguugcagugagccgagaucacgccacugcccuccugucuggugacagagcaugaaucugucucaaaauaugguauuauauauauuauauauaugguuuuauauauauauaugguauaauauuuauuaaccaaacagucacacaaauauacaauuguaaaugauacaagugucauggaggagaagcccaugguacaaugaaaucaugcaccaaaagcauuugaucugaucagguaggccagggagggcuucguggaggaagugaagauugagcugagauaugaagggcuggugugaccagguugaaaaagacaggaagaacuuuccagagggaacagggugccuuaaaggaauugaaagaaagccauuagcuggagucagagaucugggcagagaggagagaagagguaggaagguucagacugcuuaaagcccuucagguugugugaaggacugggggccuuguucuaagaguuauaagaagccuuugagggucugaagcaauucaugagggguaacaugacccuagauguuuucuggaaaaaaaucacugugguuaccuuguagaggggcuugaguggcugcagacagguacaaagaacuacugucuggacaagagguaacaguggcuuguauuaggguggugguggguuugagcguaggcauggagagguagguggaauugaaaaguguuauuuaggagguuaaaucuacaagcuuggugaugggcuggguaugggccguuaagaagaagauaaggauaauauaguuaugaggccauauaaaugacauaccgacauuaaauaacacgaaauaauccuuauuuugcgucuucaaaguuaaacuuugcauauauuuuacaguaguugucaaucuguuuuccaguuuuucugguacuuuuuuugugccauuuaggaaggacauuguaguucuuacccuuuuuucuccuuuuaauguaauuaagguggugaaaguacucaguugcaacucuaauaagaagugcaaaaagaagcaguuccaagccagaagauaauaucaaacuaaaauauuuccagcaauaucagcaaaauguaaagacaauaucggaaacaaacauuugcugccuccuaccuucucugucgauuuuaauucagaaaauuuaagugauuuuucucauaucgaaaaugaguuaaaauacuagagagucuuuuauuccuuauaaacuaagucagaguaauuuauuuuaucuggaggagaguauuaaauuagcugucaaccgugcuauacagguggaugguaacuauugaaugaaaugaccaaaucucugguccugcggcauucauuuuuaaucucugcuuuccauugaaaaaggcaaaacaugaaauauugagauaauaguacuaaaacuccaaguaauugcuuuuguuagcucaacucauguuuacucauauuaauuacugaaauuugauaaccccuuuguuuuuuacuuagccugauucugaaugcaguggacagagcuauaaaucagguaggugguucucacuaaggcaggacucuuuugcuuugauguuggcagcuuaaggcuaauucuccaagcuugauagguuuauaauucaagaagaugugauuuaauguugauggaauuuauuuuugaaacacauuauaggaagaaaaccuuucaaaguaacaaaugaaguuuugagguaaaucuuaaauaaauaaagauugucaggaucucuaaacgcccagcguuagcuaucucuauaggauaguuccuccaccuuuagcuggagggaaauggcuggaggagaaugagaaagugaagagacaagauguggaagcuauagagccuuaugaauaagucaugcauuuaaagacauuacuuuuuuguaucuucuccucuuucuaaauuuacuugacauuaccuucuuuucauaauguuucauuugcgggguuccuuacaaguuauuuuuccaaagguuacccuauuugguaugauuuuuuuuuugacauuuaauuugcacuauaggauuguagaauguggagaaauccuggguucauuucuuuuuccaguuugcugauacauaaauuucauccccccucacgcccucaucuuauuuguaacacucauccuuucaagaggaguacaugccagacacugcuccgggucugggggauguaagcagggaacaaaccacacugaguuuucucauggacaucccugcuuuggacacuacuauuacuaggaccaccuaaaaucacauuaucuacuucuaauuuuuuauuauuuuuuguaaccucauggcauuguuagcucaguagagcucagcagagcuuagugcauacuguuugaagaaaauuauucuaaaauauaauacacaauucucugccuuugaaaaacaauguuugauuucaauguuacuuaaauaaaugacuucggcuucuauuuuuuuuuuuuuuucugcucuugugcccaggcuggagcgcaauggcacgaucucaacucaaccucggcuucccagacucaagcaauucuccugccucagccuccugaguaguugggauuacaggugcccaccgcaacgcccagauaauuuuuuguauuuuuguaguagaaaugggguuucacuguguuguucagacucgucucgagcucaggggauccccacccgccucagccugccaaagugcugggauuacaggcaugagccaccgcgcccagccaggaucuuuuagaauaauaauauauguugcauauagacuguuauauggguuuguuguuuuguucauucugcauucagagagugcuauuuuuuuuaguucucagcaauuuuuaauaaaucauuuuuuucuguuucuuugcucucugcuuuuucccuuuuuaaaaauuuauuuugauuuuauuguaguuuggaaaucaagguaaccaagauuauuagaagugugugaaaaguauguuaauagaguaaauggugacagcucgucauccuuucccaugacuucaguagcacuuacauggaaccaagacauuugagugacuuagauacucccuuguagguucucuggcacucuggagaguugggcuugccacguacugggccucaaacgugagauguuacugaaacuaucuuguccaaaauauuuuccugugaaauccuuugaggcaguaaccuuuuuauugcaacauaguacgauguuuuauaauuuuauccuuucuggauuuccuagucugcucauaugcgcacacacguacacacacacacacacacgcacacacacacugcuaguuuuuuuucucuauagcuaagcuuuauugagugaaaccuuuaaaaugauaucucuacauucugucagugguauauuaagaauuauaacaaggcaagaaauagugaaaauaagaauugaggagcuuauagacaauugcaaggcuucuagacuggaugcuagguuacaugaacacacaacauauugauuuggggaauaagagcuauauauaguuuagaugcaagcuaugacagauggggguucaugagcaacaaaucugaugacuucuaggcaucauuccaaacucuuaaaaaaaaauucaccagaugcaaggacucuugccuuucuuaaugaauucuuuuuuauauaaaugagucccauuuauauauuuccucccauggccaauuauccugagggcauuauaagaauuaugauuuuauuauuauuuuuccauuuaguggauguauugccacaugguaguaggguaguuacauugguaaaguugacuuuuuucuaaaggaacccauaaauaucuagauagcaacccagaaaugucuagauauuuuaaaccuauauaagauuacaaucuaaugauacguuuuuucauaaauauuuguaccuuugucuuugcaaugcuuuucaaaauuaucucuuuuggaggagguagaacagguucaucuaauagcccuuugccaacauuuggaagacucagacauauuuucuuuaguuguggacauccccuuuaauuacauucuuuuuuuuuuuuuuuuuuuuuuuuuugagauggagucuugcucugucgcccaggcuggagugcaguggcaugaucuugauucacugcaagcuccgccucaugggcuuaaggauucucuuaccuuagccucuggagcagcugggacugcaggcgugugccaccacgccuggcuaaguuuuuguauuuuuaguagagaugggcuuucacguguuagccaggauggucuuuauuuccugaccuugugauccacccaccuaggccucccaaagugcugggauuacaggcgugagccaccgugccuggcccuuuaauuacauuguacuucauuauuaauauauuuucuuuuucuuuaauuucuguuugucgauuaauacaugaauauauuccccuuuacaaaauguuuuagauaaugcuaaagucuccacugaugaccccuuauccauguuagcuaacuucuguauucuucuauguuugcccccauaucuaucaucuuaucugucaucuaucaucuauccaucuaucuaucaucucuacuucuagauagaggcauaaacguaaaauccauagaaacccuaugggacagcauacguaguaucauucuguccucaucauucuacaccugcugucuucagccagcaguguccuagaagccuggccauguugcuacgugcugauuuugcuuguuccauuuaaaugcugccuuguuuuuucuucagcacacauauaccucuguuuguuuagcuguuccccaauugauagacauauggguuguuugaagauuuuuccucauguaaacuguucuucagugaagauucuucugcgugucuccaugugcacaugugugagaguuucuuuaggauacacacccagaaauggcauugcugggccauagagggugcacauuguaaauuuuaauuuauaucugcuaugcuuggcugcuggucauuuuaaacuuuguuucgggaacuagguuuuugcuuuuuuuaaugaacagaguugaaccaaguaauguucuccuauggaacaaaacuaaagaucguuucauuauauccuccuguauuccuguggcauuccuaucugcaccuuucauggaguuuuagaacagauuaagugaaauuuguuaauauacaugccaggaaacacagcaaccugucccuggcucuugucuuacccaucacaugccucuuccugcuucaucuuaguucaucccugugaauggcagagacccaguccugucauuuuaacggaaauuauccaaauuuuaaaaagaaccaaaaugagcuaaaccauccaagcuguggaggggcccagaggggguaaagggggaagcaggggagggugggugaagaagagaguauuauggaugaaacucaacuggugcagcagaggaugcagugagugaccuugucuuagcggaaagagaguaaagggugauucuccagccacagguguuucugcgcuaaguacaccuacaagaggaucuggaggcaaaauccuuugaacucuugcuucucagagcacagggguaaaaauaaaaggggaaaggcuuucuuuacaggcuaagacuuaguuaaggccaguggucaagcuacagugugcaccccacuuccccuacccucugaagagauggggcagcccuacucugggugacauggaagcgacugaaaucaaaagucucugugaaaaaggggccgggggucagagucugguccugugucuuguuacuacuacuaauuguaauuaguuucuucaauuuuauaucaucugugagagagaucauuuuaacccacuggcaagaggcgauauaacauuuuucuagcauccacuaaucauguaggauaaaacauuccugaagcucaaaagaaaauucguguuugggagaugccuggugcugcugcuaagauuuauuuucuuuuuaaaaugucagugucugcugccuuuccugcagguagcccuccugccuccuugucaccugaguccuucagugucuuaggucgggcugcaucuguucccgcagagcguucccuuccuccagcagaaagcugguuuguuuggcugacagaugggguucccgcuuuggccuagaugcgccuaguuaaaggguuucuguuugaagcccacaggugaaggccaacuccacacagaccccugcuuacaaaguucccuucauggucacguaaagcaguaaggaaguuuuuaauugacauugucuacuguuaagagggcauaguguggacaucuuuugagaggguuuacuuugucuuucuaugaagugucaagcuauuaauucauuggauaaugcaguggguuuggaagagagguacauauuauuguggcuuaucuuuuagaaacuccgcacaucaaaauccccucagaagcaacaaucccacaaaccuauguugcaaucuaacccaaagcuuaaacuguuugagugauagguguaguuaaaauaacaguauuuaaugcccaaagcacauuaaauuugggugaagaggaugcauucugcauaaugccuagagaugucucguuacgaugcgguuaccuagcaacaaguggaaacuguaugaaaaugaggcgcuuaucuguuguugaagugggugcaaugaaacuuauuacgcuagccuguuuggcuuggcauguuauuaaaaucacagcuaauguggaaagaacuggagccuguucucauuugauacagaagcacuguuaaaugcugcuacuguaaaauggcaauacuuugguuaggaaaauagaaacucgcagccuccuuaagcacucaacauugagauguuagaguuugauuuauauuaucaaagacuuauuaauaaaagagcggacagaaucuguaguggugacuuaagaagcagccaguuauuuagauuuuuaaaaacauucagggagccauuuaucguuucaucuauaauaauagcuuaguacggcccuguuucuuguagccaaauugucuuuaucugcugagcuuauugaauucuaaccacagucuucuuaaguuuguuuaauuuacagaaucggggugcauugucaugaucuuuaaagguucucuuuuugucuagucacauuaaaacaaucugcacauauuuuauacuauauacugaugcauauuuugaugggaauagaaaaucuucuuauccuuacuggaucauggguuuuguuguuguuguuguuuguauauauagaaaaguguguuuucuggcugggcgugguagcucaugccugaaaucccagcacuuugggaggccgaggugggcagaucauuugaggucaggaguucaaaacaagccuggccaacaugucgaaacccccucucuacaaaaaugcaaaaauuagcugggcaugguggugcacaucuguaaucucagauacuugggaggcugaggcuggagaauuguugaacuugggaggcagagguugcagugaacagagaucucgccacugcacuccagccugggagacagugcgagacuccaucucaaaaaaacccaaaaaacaaaacaacaaaaaaagaaaaguguguuuuccuacagguuugucuuacuacuucuuuauguauaguauauguagcuucauauggaagucuaacuucacuacauuaaaaacaacaaggucaaacugagaauucuaccaaaauauccucuguggguggccugugauccuaacaugauauagcaccuguuauccuagagaugaagaaaaguucaaguacuuucugugcuugucagagaccugugaugacacacagaaaucuggcauacaggacccgacucuguuagcuguauucugacguuacuucuggggcuuuggaauguguuuauguguagcagauggagcuauuaguuagcugugcuaucuugaagaauugcuuucccagguaaucagcucugcucauuuaggaugucguuuccccaccucgauaugucagcucaagaagcaggaaugauuaauugcugcaacuggacagugcacuagaauaaggggaaccauccccugguacucccauucaacagggaguuugaagugcuaugaggcagagcaaacaagauggaaacgaugaccaggaugcuuccugaagcuuaccugucaguauauagaguugcuguggcaaccugaagauuugcaauucauaggaagaguagagcgagacaaaaccuuaagucauggcugucauuacaguggaaugggugccaccaacaccuggcaaccucuauuacuucaacuuguuucuuuucacgcuuggagaaauaaaaugcauaaaagauuaauaugcauaguaaaccuuuugguaaaacauguauguguucugcauuucagaugaguaaaaacuucaagaguuccccucuacuuaaaucaauauuaccuaauaagguucaaagugagguuaccaucagacucuugauaaaauaagaacuaugaugcaaggauaaagaaagcauauucucuuucaaauuuaaaaaagguggggggauagauaacaguguauuuuuaaaauuguugccccuccuggaaaugcuuauaauguauuaauguaaauuaugugcccucuuugcagcuuucucugucaccaugcauaguaaggagaaaguuaguucuggguuuuguuaggucuaaaugguucuuuuccauuucuucuuguuaaguaacggguguuuuaaguuucuccuggggcaaguacaagccauagagaugaauguuaaaagcacuuaguugaggauuaucuuucuggaggggggaaacucaaauaacaaaauuacugugguuuguaaauacggucacaucauguaugcauguucugugauuuugucacuuaauggaaauguaggauuuccagcaucaaacuaacauuacaauuguccucuucagguguucacucgaauguugaagguugauggguauguaaaucaaaacucauuuaaauuuuauccaguuggcacuaaggccucgacuuuugucuuugcucuauuaaaaaugcacaaacauuaaaaaaaaaaacagaccguagcguuuucuagguuuauauuuuacuguguucaguaacuuucuuuucauuuuuuguuguaggagaaaguguuuuccaaguauauauuuuaaaaacaguuaaacugaacuucgcuugggguuuucugacaaacagaaucuugaaaaucuuccguuucugagugucagaaaaauguacaguuucaauaaaaucauagcagucaguuuccugacaggugcaucaagucuagaauuaaaucgaaaggacugauguguuaaaaacacauuaaauauuuaauguuaaagaucagcuuauaguuuuucucuuauguuuucaaagggcacagcgaacuaucugugcuguuccaaagaguugcacuuguaaaagggucuauucaauuuagaccaggauccagaaauguagguuauggcuaagaggaugagauaacaaauagauguguucagcuucuacaacugacuugguaguuuaguggccauguugucccuguugagaugggaaagcuuucugauugguauguuacagcucaccgcugcaucaggcauuucuucaaaccagcauaguguuguaauuggagaucaucuucuugaagauggagccuuuuauuuuuguggcuuucuggggaguuguaaugccugccuguuuuuccuuuuaaucagauguuugagagcugcagcuucgggucaaacgaacauauucacaccugauuuuuacaguauuuuuucagcaacuugaguauuauguuuaaauggaaaacuauccugaauaguccccuuuuaggaaauagucugucugagagcggcauuuuccagcauuugguggauuugagagaaggcacugacaccuguaauuuguaacccaguuaaacucguuuaucuugccuggacacaccuguggacaagaagcaagcugcugauuuuaaguucagcugcguaauuuuacuuguuugcucagauguccuuuaauuuauuuucuggggaccugaugacaguagcaagauuuuaaaguuaauugcuagauucaaggacaagucccaugaaugggcuggaagcauacccuuagggcauaagccugugugcggaucugugacaaagcccuaauuuugaguuuauguaaucaucguaccgaaauauuuaagaugggaaucuaucaagucuuaucuguugagacgugaucccuuuuauaucuggcaggccucaugcaacaaauuuccuuucuuuuaagugaucuccaaagcugucaaguucauuugagugaacugugcuugagagaaacauguacaauuuucucuggcaauggcaugcugcugaugacauauuuuuagaauuagcuuuuucucucccccacccuucuagaaacugaacuuuuauuuaagcucccugcuguuaacauuggaaagaaaguuuccugugccaauguuugcccaaauggaagaaaauguuugcauuuuguaugcaguguucauaaacuugaugagucuaacaguuuggcaccgcuggugagcgcgucugcuuugaguucugaagggcaggcagaaauaguguagugaagcacugcagcuacugugaaaagguguggcugagcugcuguguugagaugcgacaggucgagaauucagaauucauuuuuccuagugcuuugaaggucaguaguuaagagagacaucucccacuugucaaguaguuguaagcaaaagaaucauuucuucccucauucauuugguuaagguuagcugaaacacuggcuugcuuugauuucucugggcaagauuguuuuagcaaggccguuugacucucuguuucugugcuuuugguuuuaguuucaaagaucuugccaaacuuugccagggcgcauucuggucuucaaacccuuuguucugaaagcuggugccaccaaauugaauaaugugcaacauguuauagacccacuguagaaaauaauugcaguuuguuuuaacauuaaguuaaauuuuuucuguaugcaaugcaaaggucaaggaaaaaggcauuaaaaaacaucccugcacaagugagucauuugcauagaaaaugcuccacuggaugauagaguaugaaagcaguagggaauuaacugguaaguguauggcaaaugaccuagccaaggauccaagcaagaaugauuuguuccaagaaccaguguaagacgauuuaggaagaugcacuuuucuuuggcccucauccuacagcagcauugaaucaggagaacgaaacagccuuggcuuuguucaucaucaguaagccaagaagaucacggcaugggucauuaagauuuacagcucaaauguaaauaauucaggacccacaaacaauaauuaaaaaaccaacugcggcacugcauguagucagguccucugggccucuuugaaguaggaaccucuccuguuuuggcuggagaccuguccaucuggguacagaugguuguaagagcuuuuuaaugaccuuuucuaaugcuggugaaugugucuuuggacaccaucguaaccaauggaugaggaggguggaaacagcaggaugguggcagcugaggaauuaaauguccugaauuuguuagacaucugcagaaacaugcaauuuguugggcagaaaauuguaaacaaaacagacugagucaauuaucaauacaccugugacaccccgggaugccagcuuuggcugacagcuuuuaaccagcugaggagcaggaggaaguucacaaugaucaggagcaagucaauuccaaguuuucugcuauaacuuguccccuugcuuguguggugaucuccuguguggacacgucuuuccuuguuacacuauacacauuguucuaaauucuaagucauugguucuuaaccagugguauguuucagaggagcuuaaggagaaaaggagcuuaagaaauaugccugcuucuaggggcuuuugccuggagagucuaauucaguaguugugggacccugggcaugugcauauuuuaaaaagcaccccagguauacacaccugguugagaaauaaucucacaugugucucaaguuaacaauggaggagagcaugagguucuggaccaggucaugagaaggcucgaacugaauuuauugaucaagaaaucaacucauuaugcagauaaacauucagagcuugggcacagucaagaugaaaguggcuaaggacaaaaaugugucccguugauuaauuucuguagaaaggccacugacuuuggguuuggacaucagccacuuccugauuuuagcaucuguucccaacucuggauuuucccauuuaagguccauucugucaucguguucacccaguuuaacuaaucagauuauugagucucaggggcucauuuucggguucacggucaaagauuucuuaauacuuuagagaauucaguuaauuuccuacuuuaaaagacaagaugggguauuggcuuuaugaaccugaaaacagagcuuucaccaacugggagacuuuugcaaacuggaaauaucugauaauuguaauuuguaauaauuguuaaauguaguuugaacuuaaagacucaaaaggauuaugucucuuuaugguguguuucuuaaaggcaggggaggggcaucaaaagggucacaaacaaacuuuuuggauuuuuaaagaaucuucuacugggauugaagaagaggggaaaaggaagaaauguuuucuaaaguuacuuguguacuucagaguaugauggauugaacacuguugugagaagggaauguggagaggugacccaaacaaaggggcagucuauuagaagcaaaugguuagaaguuauuaggaacuagagaaaagcaaaaacuguguaauugugaacagcauaaagauggguugaaagaggaaggaaauucuaaguauaaaaacuucuaaguggucuuucugggaaguagcauaugcuucuguagcagagcauagcaaaauuagagacccauuuuaguuuuugugaauacauuuacauuuucuccccuuauugaucaucaccugucuucaaaaaaaccuucagugugcauucauuuaugggacccaauuaacaguucagauuccuuuuccuuucuucuguaauauuuguauucuaaauuaugauucaaugggcucuugaaucuuuuaucuuuaguagacuaugauguuauauaguuuauguaaauauuugucuugacgugcuuuaaguacuugcucuuguaaagucucacauuugcauuguuuuauugcagucauucuguguaaauuaaacccuaaucucuucaauucuauugucaaggccucacucuuggcuuggguguaauggagauaggauuugguugguccuuuaaugugguauauuuaauuuaauuuuucagguagugacaaacauugggguuugggcuauaggcucuuugacauuaauauguauaaacucugaccucaaauauggaacaguuuaaaguguuacacugaaugcaauuugcagcacgaauuuuuuuuaaauauauaaugugaaauaguauuucugguccagauucugcuguagagcuuagcugaagcaaacccccaauggcuuaugcuuuccugaggcuaauagaauuuuuuuggaagccuguaaggguaguaguuugauauuuaucucucaguucucauguacuauaggauuuuucuaaauauagccaucuugacuguaaauagguuacaugaagcaguagacuaguagacuggccguucuuguuaaguguaauaaucuuaaccacuugcguguuccacuccccuuauacccucgggcuauacuauuaaagaaguuucauuuucuuuuucggauuaucaaaauauauagagcauaaccauugagccacaagugacuuuugcauuccaggaugggcaaggcaaauguucucucucuuacuguaagaucacacuuuguugaagaaagacaucuuuuaaugugcaaaagguaaaagaggaaggagagcaaaauuuuucuucacgucaaguugaauuauuuuguuauucauuaacauugcuucuuauccgcaucugaauuagauguuauauagucagacccaaaccauaaugugagguaaucagauccacacuauaauauaauaaggauaaaugcaucuucacuacaggugucguuugcuuuagggugacuuguauguuaaaauuugaauuaaaucuaucaggcaugaucugcaguagcccccgcuugcccaugguuucacuuuuguugguuucaguuacccauggcaaacaugauccaaaaagauuaaauagaaaauuccagaaauaaacaauuuauaaauuuuaaauggcucgcuguucugaggagcauaaugaaaucucaagccaucccacucugucccacuggguugugaaucauccccuuguccagcaucuccacaccguguacgccaccugccugguggucucucacuagccgucuugguuaugaaguugacugugagguauuucagugcuuaugcucaagucaccuucauuuuacuuauucuguuuuaugauugguuauuguugucagucucuuauugugccucauuuguaaguuaagcuuuaucuuagguaugauguauaggaaaagacguaggauauauggaguuugguauauccggaguuucaggcauccacugggggucuuggaaguuauccacugaggauaaggaggacuacuuaguuagguacuuuagcauagucaugaauuaguuuguaaagauucaccacaaguuucccguaaacggugagcucccuuagucauguaaugcaugauucaauuaaaaauguuuugauuugcauuuaacuuugcaggaauugacugucaaggugauauaacaguuuaaugagcuacugugggaaauuguguaguccccagccagacaguuuucaagugaguugaaaucuauuuucccuuggaugguuaaagaaagguauauauuggcccacauuucuuccuaaaugucuccuccucuccuguguuucuuaaacacaccuauacuuccauauugaauuaucauaaaaucucuguuuacauuuaauaaauauucaucucaaaagccccucaacuuacugaaaaugcuuuuacuguauugguuuagagacuguucccucuuuuuaaucucuacugucaauuaaauucagugcccuguggcugauucgauucagucuaaacaauaauuauaucaauaguuugaaaaagucaaaauauuauuuagagcauuuucuaauuuuccuuuuuuacuagcuggucaugucuuguugcaugccugaguuuuuacacugugaguacaauaucuaucuguguguguguguguguguguguguguguguguguguauuuaauccuuacaacugaccagcaugaaggggguuugaggcuacagucuuggaugguaaacucaacaaguuaguacugugacuguaugcugagucugaaaauaagccaucuagguuuguguaggacagaauacuaggauaccaggaugccagaugaauuuaaauaguguagugugcuuuaucugugcuuguucugucugugcugcuuaaauacugauaaggagagucuacaagaauacuagaugugauuugugcuacuugaguuuacuguuacccagcagauuuauucauuccauguuuacaaucugaacaguucacuucauaucaggguuuagugauucugaugggcuaaaauagaaauauauuguuucauauuuuuuucacucuggagauuuaauauaagaaagcagcggacaauuggccaaagauacucagcuuugaauaugauuccugcuuuucacaaaaauaugucuuugauuaucuuuucauaaaugcaugaccuggagcuaaaauuuucugucagugucuucuguggaguuguauauuaaugguuugacuuggcauuaucagcggaagagcuaugccacuacaguauuuaaacugcaugccagacauggcagcugguacaguagauaauaaugaauugaaguuuucacaagccuugugguguuuucuuaccauuguuuguuuucgguuuuccuuuuguaugaacacaaaaggaguaggaugcaccaacuacagugaggcagauauaaggucuuucuacccuaagaucaccuuggccuuuucuuucaugcagcuucuuccaggaaggcuacuuugauuaucccacuuagaaucaaagucuuuuuuuuuuuuuuuuuuuuuuuuuuuuuggagacagucucacucuguugccugagcuggagugcaguggagcaaucucagcucugccucccagguucaagugauucuccugccucagccccuugaguagcuggaacuacaggugcacaucaccaugucuggcuaaauguuguauuuuuaauagagacuggguuuugcauguuggccaggcuggucucgaacuccugaccucaggugauccacgugccuuggccucccaaagugcugggauuacagaugugagccacugggccuguccagaaucagucuuuuuaaaaauuuuaaucguuccuugucuuuauaacuguucugucauauuccuuauuugccuugcauaugucuucucuuaacuuuugaaaacuuguaacucaagcagacucuuuaaaacaucucuuuuuuuagguuuuagcuaccggccauaggaucuaacaggugcaacaaauaaucaguauauaauauaugaaugaugaccacuuggugaaauuaacugucaguuauauagagaaagggugaugaauuuaagaauagccaacauuugguuagccauuuauagauuagaaauugcucucauauguguuacuucguuugcucucauguguuaucucauaauaguacuaugagguagggaauaguucacuuuccagguaugaaaacugucagagguuaagagauuuucccaaagucacugcaaccacuccauauuuuaacugggauuugaaaccaauuuuucaagcucaaaacucuucccucauuagaccacucugcuagaagauauauaugcuaguucuuccucauccaagucuaaagucguagauccuuuuaaaaugcugauccuccuuauuaggggauaauugaugccuagaaaaggucaccuaagugaaucuacuuaaaucaggcaccggaauuucacaguaaauagagaaaaagagauuugcuugaacuucauuguggaagugaaacuaauaaugaggaauaccuuuuauauuuaacaacauuuaaacuauaauugcaucuaugugccaauucuuagaaugagcaagaaugaaguguugauuguuuuccagggcaauuuuucugacaaguuggaugacaaaugccacaguguccuucccuuuauuguaaguguuuagccugaauuuauucuugugacuuuuccguucuagugguucuuuggucuaacuuuacuagaaacucuuuggcucaugauuuggcuuguuauucaagcugucuuaucaucacuuucauugauuuuaccaaauucuguuccuuugaugagauuuacaaauuuauuauuuauuauuuuuuuuuaagaguugcacuucuauauugcagucuguuuucuuuguauaugugguauagaaucguccagagaccuacaaagaauauaacucuguggacagagauagacuguuguguuaauuuggguggggauuaauuuuuuaagugguuucuguguuacuuuuaugaugacuuuggccuucuaacuaugggggcuuaaaugaugaauauuaagauaacuagggcucccugaauuaguaaaaauaucauauugauguucuuuacauaguugaaguguuggguguuuuuuuucuacuccgcaauuaucuacuuucaugaaaauaaaaguccauugggcuaaauauaauugauguaacaaaaaauaagcaaaugguucuagaagagggcuucauuuuaaggcagcauuugccuuaguuaacagauuaacaauuguaugcuuuguguguguguguauauacuuauuuaagcaguauuugcauaaggaauuauuccuuaugagugugauaucaugagacugaugguggaaaucagcuugagauuaauuuuagcauaaugguuaagaacugaacuggagccgggugugguggcucacaccuguaaucccagcacuuugggaguccgaggcggguggaucaugaagccaggaguuugaggccagccuggccaacauggugaaaccccauuucuacuaaaaauacaaaaauuagcugggcaugguggcgugugccuguaaucccagcuacuccacaggcugaggcaggagaaucacuuaaacccuggaagcagagguugcagugagccaagauugcaccacugcauuccagccugggcgacagagcaagacucugucucagagaaaaaaaaaaaaaagaacugagcuggagccacacucccugggauuuuguccugucuucacccuuuacuaccugugugaucauguuucaagucuuguaaucucuccaugcuagaauuuucuuguguugauaauggagacaguuaucauaucuuccucauagaguucuuucaagauuuuaauguacaaagugucuagaacagugccagacacauaguaagcacucaauaaauguuaggaguuauugugauuugauuuuuguuuaagaauuauuaugaauauuauagggguuuugcagaagaaggaaaugugaagaaaacugcuuuaaguuggcaugagaauguuaagucuucuguuguuguugucaacgaaguaauaaucucagaaauauuuguugaaggaaaaaccuaaguuugcuguugaaugauauauaaaaaacuaauaauauuuuugagcaaauauguuuaggucuucuaaccauuuaaguguauuaaaugcuucuuaugcacacccucucuucccuccugugucucuuuauucccagccccacuccuguggguaaauaaaccagauauuucuuuagguuuuuacgaagaaaccugaaaguaaauaauuuaauggcugaaugaaaugguacuuuuaaaugucuuuucucauguguaaauacagugaaauugcagugagaauuuaucuuucaguugauuacuugcuucagguuuuaggagugauggugacagaugaacaguaauugaggugugaauaaaauuuuggaaaagauaaaugauaucauuucuuguggaaaauauugcauucuuccauuauggugcguggcuguuuauuagcugucuuuaguggggaaagacccuugaugcuuguaaaacaccuguaguuuuaaauuggcuuaggauagauuaaugguaaaugauuagagaccucacuggauugacaaccacauugcauuuguaacuccagugagguagucggcacaaaaguggcacagcccuccuguggauuauuaucucucagggaaagagagaaguacagucuuacugcuaaaauuugucuuauacuaaguuccuuauuuuagaauugguuggaagauugcauuguuuuccuucauauagacaagcaauuuugaaucauuuuuaaaaagcagauucaggggcugugcacaguggcucacgccuguaaucccaacacuucaggaggcugagaguuucacuugagcccgaguaccaggcuagucaaggcuagccugggcaacauagcaagauccuaucucuaaaaaaauuuuaaaaaauuagcugggcaugguggugcuugccucuagucccagcuacuugggagguugagguggaaggaucaccugagaccagggagguagagguugcagugagccaugauugugccacugcacuccaaccugggcaacagagugaaauucuguucucaaaagcagauucaaaauaauuuuuuaaaauacuuaaauuugcuucauaaagcuguuuauaaaagcagauucaggauucauuuuuuaauugcuuaaguucgcauuauaaagcuguuucuaugcuuucucacaucaacuuaguuuugagaauaaaaagcauauauugcuaagagugaacuagcauauuuucaagcuuuauguguaaaaaaaaaucuugaagucuguuauuagugguuuuguaaaaauuucuguuuuuagucuugucaagaggugcuucauaaaaaccaggcaauuagaaugaagggaauuucagucuuaaguuauuugaguucaaagccuuuccuguguuuuaauuuacuuuguauuuguuuuuaucaaacucugguccuauuuggagaaauaaaaccacugacuuagggaguuccagcuuaccagugaggguauuugaaauuagaggccccaaaucguugauaacugagauugugccauugcacuccaaccugggcaacaagagcgaaacuccaucucaaaaaaauaaauaauaaaaaaaaauaaaauagaauuuccacuuucuuuggccacaaagaauuguacuuuuuucuuaguuguuuauuuuaggggugaaauucagucagagacucuacagggucccuacuggguaggccuucuuuugcuguuuagauuucauguggcagauuguaguaaggcucuccuaauucuuaacauauuuccaguuuuuauuaaguuuaaaaauuuaugccuuuccuaucauuccauaacuaaauauaguaaugaaauuuuaucugaagucaggaacauuauccaaaucugauuugauguguguaggguacugcacauucauugagugguacagauuguguuaaaugggccugaaauaauguucaggaaagagaaucacuuucuguucuucuugacacaaacaguuugucacagacaugcauucaucucccuaucuuguuaguguagucguuauauuuuucauuacaaguuuuaugcaaauccucuaguuuuccuugauuagguuuacaugaauacauuguaauuauagacuggguguuauuaauauaugugauuaaacauguaauuaauauguguaauuacauagagucauggcagagcugggcucuaugcugauuuauuguauaggugcugcuuacacaaagacacaguuaggauuuuaugcugaauauuuucucacacuguaaaucuacggugguuugucaccaggguauauaugcuuuuucauuuaagaauccuuuuuauggucauggcagcaaauggauuaugauuguuuuuuacuguggcuauaucaaauacuccacccagagaacccauagaagaaaaguuugucaugguucuguguaugcgagcaacacugcuguaugccagccacacccuggaaugcacagauuuuacucauuuguuuguuuguuuauuaaauguguuaagcuccauguuaaacucaucuguuaaauaaccuuuuucucuucugucucuuauguguuugguuacuuuccuucuuagcuaaauuucccuuuuuuuaaacaucgaagagcaccuuucugcuuuuuuugccgucaucuguaugucauguucuuguccaucucaucauuucacauuuuuuaaagcucuguaaacagacauaaugcacccucugcuuccuuuucagcauuuauucuguugcucuuccccccacccucccauucugccucuagacuuuguuuauuuuucuuagagaggaauucuaaauuaaacaaugcaagaaaaugaaaauggcaaggguacaacauuauagaggacuaaaggggaauagaaguaaguuacguuauugaaaucucagugugagggaauaaugaggauaacacagguuaauuuuccgauguguccuuuacccacauaauuguccaggacauagauguuaucggagagaagcuaagaagcacaauuuguaagagucuuaaaaggguaauagaagacacacuuaggcuuagcaucguuaaugggcagagagguucaggucauaguugauuugagucugcucaaaacauugugcagcauguuguauucaguguucugguuaggauguuggggauggcccaagggcccaauaacuaacaguguauaauuuugauuugagugcuuaaguagauauguuuuccugaaaaaacaugagcaguaaagguugacuuggauuuguaugcggcauguuuccaagggggaccugggaacagauguguugucuguucugaaagcauugggaugcauccauguuuugcguacagacccccuucugucuggugcacucugcccucuaaaagcuuccugaauugcuuuguaaacaaggcagcuacuacagcugcaacuguuggguuuggacuuuugccagcuugaaauuuaucccugcccuaaugcuauauaucugggagcaggcaguggaauuuuuuuuuuuuuuucuucaagcuuauggaagcauuugcugaggaagaucgucuugagggucaaggaacccagauuccuuaaaacugcaugcauucuccguggauuauuuugaccaccaggucagauuucagcaccuuuccugaacuuuucuccaguuacuuaguuggguuacugcuucauuaaaaacccauaauuccuaugucuuuuaucuuggugggccacuuggauucaagaggacuagauucagccccuugagugaaugaaugaagauuguuucucaacauuccuuucuuugguaugcuaauauuuaacaaugaaagaaaagaaagacaaaacaaaacaaaaaaaacgaaaaauaagggauaaagugaagaacgggaauucuuaagaaaucuccuuugaggauuagcgcuaccuggcaguugcuaaagugacucugugcugcauggauuuuacauugucuuuguguguuauguagagagguguugugaugucuucuuugagugccugaaaugccaguguucuuguagaaauuggaguugugcuuuauuauauucuugacuuguugaugaauuuuccauuuaagccucuuucuucuuucuuaucuggcuuuugaagucuccugcacagguggauuccuuuaugccuucucacuagaucaggauuuuaaaaauguucauuguucaucucuucauauacguuauagcugccugggcucccuuuuugaccuccuugggcugaugaugugugacaugugacacugugcaacuagaguugguauuugccaaucuguaugcuuuugguuuauuucauauuaccggauuaaaacgaaaaucuauuucauuccaguagcagcagaaagcacaaaaucuugagguuccugccaauauucucuuuuuggaacacuaucaaaaauguaacuuuucuguuggaauaaguauuuuucuggccaacaucucccccucugccccuggcuucugugugaugaaauaacauuggcuucuuuuagcucaagauuuggacuauuuaggagcccuuucacauaagaaauggaugucuuaacuaauuuucuuggaguagaguugauuaugaauaaguacuaggaggaggggcuauguagaaccuuuguaauguaauauggcauaguaaaagcaggacuaaaugagauuucucaggauugggaugggggcauauccuuccuaugucaugugauuuuaggucaguaaccaacacaguugggaacuucuccacagcuuuuggccgcuccacaucuuugaagagugcuggccugcauagugggauagaaauccaggccuucauugauuuauuccuuuugguuucagucccagaucuugaacugugcagggauuuaaacugaucagggacagccaacuagcuguaguauaaagaaaugagcuguugugcuugggggaaaaauuguuugaagaacuaaaaaugacacauuuccuuuaggcagaggaaaguuaauacauuggaguguuacuauuuuuuaagggggacgucauuccauucucauuuccaguguucacauguaaaaauaagaaagaguggggcuuuuguuuaagcuguugccaauaccaacauuuaccaccuccuuuagaguuuuuuuuuaaaacggcucuguuugacugaaaauuugcuuagggcugaaacuugaaacuugucauuuaguuucugagccuacaggcaaauuacuaccaccccccaacacccagcccuuuuagagcaagaagacuuuuuaggaauuugauaauuaaggagcuuuuuuggcauuuaaaauugcuuaccuuucuucaauacacaaaaacucaacucaacucugccuuuuuuuuuuuuuuuuuuuuuuuuuuuuuuuuuaaaugacagggucuuacuuuccuucugucacccaagcuggagugcgaugguauggcucacugcagccucgaacccccccaggcucaggugacccuccuuccuuggcuucccaaguugcuaggaccaaacggcacacaccaccauaccuagcuaauuuuuaaauuaucuguagagacagggucucacuauguugcccaggcaaucuuccugccucugccucccaaaguguugggauuacaggcaugagccaccguuccuggccaacucugccuuuacaugauagcucauccuuucgaaguuaaauuugaaauaaaagugguccucuuggcuggauuuuugaaaccuuccuaauguggaauaucagauuguugggugcauaucuaggcauuuuggcagcacuuaaugaaaacaaaugcuccagccuuucuauaccaagaugcugcuggcccacacaccauaccugugcuuugguucuuucuccuuauggugaugguagauuugcauugaacucauccagcgguucagcuucaaagaccaaaagccaagguuagggaaccauagaacuaaauuauuuugccuugugaaauuaauauuucagagaaauggauucauuguuaacauuaucaaccaauagcacccgcagucuuggaaaaguucagcgaagaggugaauggggucuuuuuuagccuucgcccaaaccucuguagcaugucuauggcuagaguauguugaucuuucagguagugaaucauuacaguuaauccuggugaaauucagcagcaaucacacuuaauacuuuagugugauaugggaaagugccucucuuguacauacacccgacacuagaugauuacauuuuaccaugcuucaacugugggggcauuuuaugacuauauaucacuuuuuuucuuuuuuuuuuuuuuaagacagaguuucacucuuguugcccaggcuggagugcaauggcauaaucucggcucacugcaaccuccaccucccagguucaagugauucuccugccucagccuccugaaguagcugggauuacaggcacccaccaccaugcccagcuaauuuuuuuguauguuuaguugagaugggguuucaccauguuggccaggguggccuugaacuccugaccucaggugauccaccugccucggccuccgaaagugcugggauuagaggcgugagccacagcgccuggccauaucacuucuuaacauacaaauugcuuaguaauauauaaccuaauauuuauucuuuauaaauauuuuauuauuuauuauaauaagguauauaauauuauguaauuauauaaguauuacauuauauaauuauaauguauaaauauaauauauaauauuuauaaauauuuuguaaugcagaugccuuuuaaaaguguauauuucacauguauuuauucuuuaaauuuauuauggaaaugggauuuuguuaguuuaaucuucaguaaaggcaucuuaaaugaucuggauuuuuuuuaauuguuuuguuuuaaaaaucaaaccucuuuaaaacaucuuaacaucuuuuauauauucuggggucuagcauacuccagagggauuugguuaaaauuuuucugaauagaaauccuuaaggaagcgagugaauauaugaauaaugagggaggaaguauuuggauauuuuuaaggaaacaaaaaggcagcccuaauuuuagcauauggggucuaaagauaccauuuacauuuuuauaccaauauaaagucaaggagaaaagaaauauccccaugagaaaacugaagaaaccaaaguuaagcaaaagcuaauugaagaaucauuuaagaguaaaggccuacauuuuaugaugcagaugccuuuugaaguuguauauuucacauauauagaaaagcuuauagaaccacgccuagcuuugucacaucuuaacacuaugccguguuuggacguccucucucgugucugcccccucccucaccuuacuccuuauccuuccuccuaggauugaacuauaauccugaauuuacuguuuaucaaucccauguccauuucagucaucuuccuacgaacauguuugucuguaggguguaguauuuuugcauguuuuagauaaaauauuaaacauaaugauauaaaugcuguuaugcuguuguauucugaaauuugcuuuuuaccuucauacucauuggugagauucaucuugaugccuguggcucugguacacuuauuuucacugcuauauauauuuuauguuuugugaauaucgcuguuuauuuauuuauucuccuguugauggacucuuucuuguuugcaguagacuguuacauccagugaaaggaugaccauucuuauaugugucuuucugugugccuucuacuuuugaauguggguaggaauuucucuaggguaacaccuggaaguggaguugcuuuggacaucuuuggcuuucuuggauaaagcucucccacgugauugugcucauggcugguagcauaggugcugugggagaacucucauagcuucguaucuucuucaauuccaguacugguauugccagaaaauaaaauuuucauugauuugaugguagugaaaacauaccuucuuguuuuaaucugcauuucugcuggacacacuggcuugcaccuguaaucccagcuacuuaggaagccgagguaggaaguuggcuugaggccaggaguuugagaccagcaugggcaacagcaagaccccgucuuuaaaaaaauaaaaauaaauuagccaggauugcaugccuguaguccaagcuacuugagagacugaggugagaggauugcuugagccuaggaguuugagaccaaccugggcaacauagugagacacugacucuuuaacaacaacaaaaaucugcauuucacugacuuguaagguugagaaucauuucacauuuauuggccuguugaguuuucucuucucucaguuuccuaaugccgaauccuuugcuguuuuucuauuggauuauuuuguuuugucuuuuuuuuuuuuuuuuuuuuccugaggcagggucuuguucuguugcccaggcuggagugucucacugcagucuugaccucgggggcucaagugauccccgcaacucagccucccaaauaacugagaccacaggcgugcaccacagugccuggccuucuugauaauguggaaauguggaaauucuuuauguucugaauacuaauccuugcggguuauaugcaauuaaguauauggcuuguuuuuuuuuauuuuuauuuauguuauuuuuuguuuuauaaaacuuuuauauuaauuuuaaugcaggcaaacucaaucuuuuccuuuaugguuuugcuuuuugcuuauuuaaaaagccuuuccuacuucugaggucauaaaagguacuuucucucccuuucucuuuuuuucuucuaaaaguuugcguuuuacuuuuguuaaccuaucuggaauuuuuguguaugauaugcaaaugggccauauauauauauauauauauauauauauauauauauauauauuuuuuuuuuuuuuuuuuuuccgagacagauucuugcucugucgcccaggcuggaguggaguggcaugaucuuggcucacugcaaccuccaccuccuggguucaagcaauucuccugccucagccucccaaguaucugggaguacaagugugcaucaccacacccagcuaauuuuuguauuuuucauagagacaggguuuuaccauguuggccaggcuggucucgaacaucugaccucaagugaucugcccgccucagccucccaggguguugggauuacaggcgugagcaacugugcccagccuaauuuuauuuuuuuucuaugaggauaucugguuguuuccaugcugcuuugaaaaacacacauaaaaaaauacuuuuuuuuuuucuaaaaacugacuuuuguuuuugaaauuuuaaaaccaauuugaacuuugaaaaacuaauuucaggccgggcacaaugucucaugucuguaaucccagcacuaugggaggcuguggagggcagaucacuugaggucaggaguucgagaccagccuggccaacauggugaaacccugucucuacuaaaaauacaaaaauuagccagguaugauggcacacaccuguaguccuagcuacuugggaggcugaggcaggagaacugcuugaacccaggagguggagguugcaguaagccgagauagcgccacugaacuccagccuguaugacagagggagacuccgucucaagaaaaacaaaaaaaauuaaaaacaaaaaaauuaacuauuuucagacuuaccaaaaaaaaaauugcaaaaacaaugccaaaaauucccauagacguuucaucuagauucuccaaauguuaacaucuuacauaaccacuguagaaccaucaagucagaaaguuugcagugguucaguacuauuaucuaaucuccagacuuuauucaaauuuucuuaguuguucucacuaacaaccuuuugcugcuccaggauucgauucaggauuacacauugcauugacuagugaugucucuuuaaucugugacuguuuuucaguuccaccuuugucuuuuaugaccuuccuugauaguuuugaagaguacuggccagauauuuugaagaaugucccucaguuuggauuuuuuugauauuuucucaugguugaauuuguuaugcauuuguuugcaagaaugugauuuguguccucaguguaacguaugaggaagucuauaauacccauuuauccuguuauuggcaacguuaacuucaaucauuuggcuaagguggugucugccacguuucuccacagugaaguuacuguuuuucucuuuguaauuuuagcaugcauucuuuccuaugguguuugcuaaaugauuucuauucccaucauccuuuccacauuuguuaguugcaguucuaucaguaccauuuauugaagaguccaucauuucucuagugaguuauguuuaccucuguacugauuuauaaaucuacuucuacaucucugcuagcaccuaacucccuucauuuagaguuuuauacccuuuugccuucucaccaguaacauacaaaggugcuauuuccccucagccucauaaacggaguauguagucaaacuuggaguuuugccaaucugaucagugaaaaaaaaaauguuaugucucuuauuaugaauaaaguugagcaucaguucacauguuuugagccauuuuugcuuauucuucuguauacucccuguuuauguccuuugccuauuuuucugugggaaugcugguauuuuucuuuuagauuucuuagaagcuuuuuuguuuuguuuuguuuuguuuuguuuuugagacagagucucacucuaucgcccaggcuggagggcaguggcaugaucuuggcucacugcaaccuccgccucccggguucaagcuauucuucugccucagccuccugaguagcugcgacuacaggcacgcaccaccacacccagcuaauuuuuguauuuguaguagagacaggguuucaccauauuggcuaggcuggucucgaccuccagaccucaugaucuguccaccuuagccucccaaagugcugguauuacaggugugagccaccguaccuggaccuuaggagcuuuuuauauguuaggcauuauaauucccuugucugugauagguugcgaacauuguuuuuccaaguauaucauuugucuuuuggcugauggcauuuuguuuuauuuugcuaugcacaaggguuuuuauaaaauacauuuuuauguacacaaaguuauuuuuuauuauuucuggaucugccuuuucucuaacuuuauaacagacuucaaguuuucuuucaaaaguuauguggguuuuuuuuuguggggguguugggcuuuuucuuaaaaaagacuuaauuuuuuguagcaguuuuaaauucacagcaaaauuaaaaagaagguacagagauuuccuuguccccauacaugcauagccuucccuguugucaacauccucuaccagcgugguacauuuguugcaguugaugaaccuacacugacacaccguuaucacccaaaguccaugguuuacaucaggguucacucuugguguuguccauucugucgguuucaacaaagguauaaugacacauauucaucauuauacaguauuuucccugccuuaaacaucaucugccuucugccaguucauuccuucuucccuuauaucccuggcaaccccugaucuuuuuguuguuguuguugcugagauggaaucuugcucugucaccuaggcuggaguacaguggcacaaucucggcucgcugcaaccuccgccucccggguucaagcgauucuucugccucagccuccuguguagcugggacuacaggcgugcgccaccaugccuggcuaaauuguuguguuuuuaguagaaaugggguuucaccauguuggccaggcuggucugaaacuccugaccucgugauccacccgccucggccucccaaagugcugggauuacaggcgugggccaccgcgccuggccaaccccugaucuuuuuacugucucuguaguuuugucuuuuccaggauguuauauagcuggaaucaugcaguaugguugcuuuuucaguuuggcuucuucauuuauuaauaugaauuuaagguuccuuuaugucuuuucauggcuugauagcucauugcuuuuuaacgcugaauacuauucuauugucuguguauaccacaguuuguuuauugauucaccuagugaaggacauuuugguugccuacaaguuuuggcaauuacgaaugaagcugucauaaacaucugcgugcggguuuuuguguggacauaaguuuucaacucuuggguaaauaccaaggagcauuauugcugaauuguaugguaagaguauguuuauuuuuuuaagaaacugccaaacugucuucaaaaguggcuguacuauuuugccuuccugccagcaguaacugagcauuccuacugcuccacacccuccccagcauuugguguuauugguguucuggauuuuggccauucuaauaggcauacagugauacaucauuguuguuuaauuugcauuucccugaugaaaucugauguggagcaucuuuuuacaugcuuauauauaucaccagcaaauaagcauauauauauauauauauauauauauauauauauauauauauauacacacacacacacacacacacauauauaugauacauauauauaaaagauauauauuauauauaugagagauauauauauauauuauauauauauauauaucaccaccauauauauauguaggucugauuuugacaguauucugauauauaaugugaaguaugaaugcaauuuaauuuuuuuccauuggcuguccaguuguccaaauaucauuuauuaaaaaggccaucuuuucccacauugauuugagaugugacgucucaucauauaccaauuuucuauguauacuuuuuucacuuucugagcuuuuuguuuuauucuauucuguuucuucacgcagcaaaaccacacucuuucacuuguagaagcuguauaauauuuugaaauaucugguugugccugccucuucccuauccugauguagaacacagacacacacguacacuguuuuucuuuuuuagguuuucuugguaauuauuuggucuguuuguuuuuaauuuguuuaaguuuuuauagccaacagaccuaguuggcaucuaaguagcuagcauuucuuugcuauuucuagagacuuucuuugccaccuaguaucgaccaauucuuuguugauaugucauuuauucugaaaaagaaugagcauuuuauauaggcugggugcagaauuuuguauguacaucacacauuucuggaaauuuaaaguuuuugugggcuucuaaagcaaauuaugcagcauguguaagauucagggauauccuacagccugcucucaugucauguucaucauauaggucaguggguagaccgcagguggacugugaacuggcuaacgcuaugugaaagaggguuucuauaugugauuuuucuggagagaagauacaugaauuuuaaagauguuuuaucaucacaaaaaguuagacuguuccagguaaaggugagaaaaaagacuggaauuuaaauacucuguuaaaaaaagaaugaggauggcuuugaaaaauugaaagaugaaaaaaaacagcucuuuuuauacuauggugcucaggauacauugacuauaaaauuaaaguguguuuuaauauauuaguagguaaaguuucugagaggugaaugucuacauuuacaauaaugguguuuucucucauauuucuuuuagguaagugacaaucuuaugcuuggauacaucagcuucaaaauggauggauuuugaggguuucauuccucuucucugaugcuguagcaguaagucauacuucucaugugugcucuguucuggucuggucugggccaggggauuggcuugacaaaagaaacuagauaauuucuuguaaacacuuugcuucuuuuacuugauauacguguuuuguuaagaacucuuuguauguguagucucugagauugcacagaagaauaaaaggaccagcuuccaacuuucaagaagacuggauuuucguaaggauacaacagaaagaacuuggguuuuggaguuguauuagguuugaauuucacuuuuucauuacugugugauaacucaguuggauaucuuuuucuucuucuauuuccucauuuacucaauagguguaauaauaacuacguaucagauuguugggaagauuaaaucagggaauaucuauccuuaucacagugcuccaauauauagauuuuguugcucauuucuucuuuccagcucuaucccauggcucagaaagaaacaacaaugucuagaacauauaaaaauagagacuaacucucccuccuguuaucugaagggucuuuggcugagauucaggaaaucuuggagaccaggcaccaaaggauuuuguaaaggaaucuguagugggucuaaguaggcacuuuuuaaagcaucagccaucuucuugaaugucauagucacauuaaaagagccuaguuaaauguggcuuagauauuguuucacaaguggccuuaguggaaucccuguaaauaaauauguuagaauauuagguugggaaaauauuguuuuguuuaaucuaaaauggaauuuaaacaaaugacuaaagaauguaagcugagauuguuugaucucaugugauucuuuaaauaauugucacauuguuguguuuagaauuaucuagcuaucuggccuaguaaacagaugagcaauauucacugagaggggaaguauauacaauuugguuuggaacguggaagagaaccaugcuuaaguuggagagacacaagucagaaaagucagggggagauucaggcauggccauuuuaguucauauggcucaaauaccucuaauccaguggcauaaggccugacaagaaauguuccucucuaaggagaugcuggggccaagggagacuacaguucauugcacauucagagauuaaaauaucuccaaauuaguuccagugaaucauuuuaaauuauuuuaaaagccuuuuauauuuuaaucagagccuauucacgaccaguuaauuuggauggcacguucuaaaauuacuuucccccaaugauguguugugccacugccauugaaugcagaaaccucacggaagaggggauuaaggaaauuugaaaguaccaaggagcuguugaucuuagucaaguguuuacugguuuaugaguagauuaagauuucguucuugucaucugauuuggaugggaaaaugaguaaugauacucuuguagagagggugagugauuccauaggaugccaaaaguauggcgaugugcccauuuccccaaauauucagggaagacuugaugcuguggcauugcugcaguacuuucuucaauauuuggauguagucucuggguuuagggagguauuguuuuaaccaucuuugcuagucucaaaauuuuuauccaccauuuuguuaaucuguucuacaauuagcaaaggggugcaugccuguuaagaguuccaacuguaugguacacuuccuagucauuaacguaacugauagaguacaaugucucuauugucauugagaauaaaaaaaugagcuauacagaucauguguugguucaaguuugacuuuuaugcucuguuauucucacuucaaagaugaugagacugaaacucaaagaaagaagaccugccuuggguuacauaucaguuuagugauggaacucuaggccagcgcuuuuacugauagugaucuucacucucugcuccucuuugacuggggaggagccuugugcuuagcuguacuauucuacaucuugauacauagacuuuucauuuugugggagaguagcagcaaguccuuggaaguuguucauuuugcaguuagcuaagguagaggggcugguaauguucaguuuuucuguaccauucuccugauauguuggcucaagauaccagaaucuaucuuggaauguuguguauuacccauuaguuaccaaucuucugcuggggaagaauauaaauaggagaaaaaagagauggacaggaugaauuuuuaaauuauagcacugaguaacaacugcuagucaagaaguuuuuggcaguuuguuagaaucucauuuuaaagcaauaacacacucagaguuguauucaaacacugagauaaaugcaucaaccuaaauucaugguuuuguuuuuuuccauguagcugcuaauuauugaacauaacgaggcuuauucauaauuucuuuucuccugcuugauagccauaauccuguauuuaugcugcugucauucccaugguaacagacuaaugucugaagcauaagauuauuaaauacagcacaguacauuaaaauaaugcuaagguuuugacuuacagagagacuuucacacuggggcaaacuucaaaaaaaaaaaagagaacgcuuauacagaaagcaauuuacuuggccaguaauguuuaguauucccauagcuauuauggcagagauuuguuugaauuauagccucuuccuucccagcccaucaucuccuuuggcuuugcagccaagucuuaaucugguguuuaugaugucagccuguugccaugggaguuauucugucacagauguauugugacuucacugcaggacagaagcaguggaaaauuuaggaugaaauagaacaacucuaaaguuaaucuccagcauaucuguuuuggaaaagaaguauucccuucaccuuuaugugcuccuaaaaauaaauaaauaaauaaaguuaguuaaguggugacuuguugaagguuggccaacgaauauuguugaaaugaccaaaaugccaaaaagccagcacuaaggaaaaaauguuauguagcucaacccuggcucucugaagaguggucaagauuuauguuuuuaauccuaugcuacaguaaugaagcacaaccaugucuguagcacauaaauugauacaccauuuuuucugguuuucuuguaaaggacuuucuucuaucuuaaaucuaauguggucacauucacaaggacacgcgcccuuugcuuccaccaccaaugacaaccacaucuuuauuauucacagacauauguggaggcccugccaaacugagaggcaucuuugaagucaaauuuuguagugcucauagcacguuagcauuauggucccucaggggccccuucaucaucugguaucugggacagucucccauuuggauggcauaaaaauaaucuagguucuuuccuagggaugagagauuucuacagaguuaagcuaaguacacaggugauccugugugcaugaugaacucuuugaaugucaugaaccaaugguacaaauggaaugcauguaccuuaaaucauuucuuuaaaaaagaaauacgggacagaaggagaauaaaaugcuauguagcaacuaaaaucuuuuggacuauguuuaaauaauauguaaaauuaggaaauuagcuacagugagucuuuuuuaaaaaaaguuggaauuacaggguuuaggauuuuuuucuugcccucuucuuccauguuugaacuuaauagagaguuuuaauauccuuccccuuauuaaaauaaaccauuaaaguaggcaagguuaagcaaguucacauuucaaacaucuccgauugcuggcgauuugucacuagaaagcugugguagucaccuuggaaucugcauaccuuuuuuuguguuuaugagaauaaucugucuucugcucucucacccaaauccuucuuaaaggacuggggcucugcuguagaaacucaugucagcauaauaugccauguaccucuauaaugauuuuuuuucagcauuuuguugagccagcuucagaaacagcagugaguauguguguaaaugauuugcuuuaaaaagcagauguagauuaaugcauugguuuaguaauuuuuucccaacucuuuccuuuucccuuuaucuuuuucucccccuucaguucucugggauaaucccaaugagaaaucugaaagaagguagaagaauuuguuuguuuucuguacuuuacgucaaugauucccaaacuuggagagcaucaagaaauccugaaugccugcugucacccccaaagauugugaucuaauuguuugggggugugguuugggcuuuggcauuuaaaaaauaucuuuaagugauucuaauauacagacaaguuugcuuucugcuuucuauauaugaauagcugaaaauugaacuaucaaaggcaagucuaaauaucacacguguauuugauuuuuauaaaucuguugugccccuuccuacuuuaugccaagucucauuuccucuguauaagaacaugcuauaaaaguaaucaaucucugacccacgaauuuuucccuuucuuuuggaaugaauaauggaugaacauuaauuaucucuagcguuuuguuuuguuuuuuuauuuucuacuuuuuaaaaaaauuggcuucaaaauuuuaggaaauuuugcaucaagacuauaaaacaaagucauguggcucguagggaaaucaacagagcuccuguuucagaaacuugauuagcacuggaaauugaacuuuaguuuuugacauuggguuccacacuaugcaccaucucuguagugugcucagucugcaugcagauuguuuuccuuaagcucuuuauaaauaagaugacauuaaaagaauaguuuaaucauguuuucguuuuucaauauguaacgcuagagaagacgagaaguagauuucuucaucucauaaaacaaacuaccuuugcaauaaaguucugacuaaaacuuaacccggcauuuuuuuuuucauuuaucuugguuauugcuuuucacaugucucgugguucuuguaaacaugauuuucccucuggagcuagauagaaagcuaaagucauaaaggaaaguguugguauccaagcaucuugcuucugauguuuagccuuaagaaauauauuugagcuuaaaagaaaaguaauagguuugcuugaauuuucuuacuuuuccuucacauucucuuuuacugcaucuauggauagcucuaauacuugcuuuagauagagaucugauguaauuuuauaaagcagugcuguaagaugacugcaaaggauguuaauauuucuguugacacugccuuguagauuuccaaugagcaugugcagauguuaagucuguagaucuagaucuguaagcacaaccauugucuuuguucuaaauguuugaauuuguuuuagauagucaaaaugauuacucuaccuguacauacuaugaaaaagggcuucccuaagagcuuggguaguuuuuucuucugaccauccagaaagguuuuuuguuuucuuuuuuuuucuucaauaaauucagccuuuucauagcagaugauuuauuaccguggucggugacucuguauuuggcugauuuauugaaaaguccauuuauuaucaguaacuuuaguuuauauucaugguaaggacagugcuaaugccauaaugcuuuguauuuucucauuuuuuucagguuuguuccucuuucauagcuauguggauuaggaacuaaaacugaaaagaucccuugucaaauuucagauugaauuuuaagauacaaauuuuaaugagauaauuuuggaaugaauggacccuauaagguuauucagagcuguggauuuuuuuuuaauaggggaauaagaaugcauucuguuuuuaaaaaaugcuaccucuauguuuuuuuuuuuucagauacuguuaacauuugcucuuuuuucuaauacuuuauuuacuaagacuucauucuucuguuugauuaaugacaaccccgaaaaguauauuuuaucccaacuuuucuauuaagucuuucuuuccuucagucuucugugaaaucuguuucauuuaaaauuuuuuucuaauucuaaagguagaauaucuuuauguugauaaaaaagauaauccauaaaaguauaguuuagaggauaaaauucagcuauaauccuaccacucagagaaaaauauucuugauauuaauauuuuucaccuuccaugcauauuaccaugccuaguucagauuagacucuucuuguuuuuauuuauuuaauauuguauuauuugcagucuucugucuuuguaaauauucuucaagcauauguuuuaaagacuauauaauaauuaauuuuguggauguaucauaauugaaugggcuauuucuccuuuuuuuuuuuuuuuuuuuuuuuuggaagagauggggucucgcuauguugcccaggcugguuugcaguggcuauucacaggugcaagcauggcauacuacagcccugagcuccuggcccaagagauccucccugggcccaggagccucagccuucugagcacaugcgaacuacaggugcacaacuacugugccuggcuuguuucaccacuuuuaauccucuagauuuuuccagaauuuugcuauuguaaauacugcuuucaugaauaucuuuguauuugaucuuugccucuauuauauaguguuucuuugcagguuucacaauugaaauuccugggucagauaaugguugucuugauuuccuuccuccuggcuggaaaugaccaucucaccacauggucauuuguguuugggaaugcgaauguuaguuuuuaaaguaucugauaauuaugcagaggaaaaauauaauuuugcuuuaauuuguguuuauuugcugucagcgagguuguuuuccuccaaaaguuuauuaaccauuugguuuucuuuucaguaggguuuuagguucuuuaacccauuucugaaucaauguuuaauguguacguauaugugugucugugugguguuuaaucaauguaaauaggcuuuuuagaguagagguaauaagccuuuauauguccuauuauaacucuuuagaaauucucugccuaauuuuugccuuuucugcuugaauaggaaaagcuuuaagaaaucauugaacuuaaugaaugauucauuuauuuaacagacacuuauugaguaucuauuacgugccaggcacuggaguaaauagacaaauaucucccccugcauagaacauauauuugaguggggaguaagaaauaaacaauuaacacaauaaaugaacaaauuguauaguauuuuaagaaugacagcaacuauggaaaaaaauaagcaagguaagaaggacuaggaguacuagggaaaggauuacaauuuuaaaugggaugguuaggacuggcuguaaugagaauaugacaugugaacagaaacgacuuguuguuuuucuuguauagaaauauuuguucuuuguggugauauuguuagugugggccugauauuuuguuuuuuuaauaacacagauuuaauucugugcucugugggugaucuccuuuuuaggauagcuaaaaugaaucaccuugguccagagcccugcuguacacuguugaaggggucuguaaguugaucuuccugucugcaugcaugggcgggaacucugccuuuaaucaggcuccaccagcuguagcaccagagcacugaguuuguggccuuuguaugucagaaugugcauagcuguaagagaaguuuugucagugugaaucugaggguggagugagauuucuucaccaccuggugagaaauaaucugucuugcaguaagugcuaguguuguuuuguuuuggggaaaaaggaaaaaacauuuuucaugaugcagguguugaaauuucuggauuccucucucccucccgcauccuccuccucuucucuuuugccuuuuccuccuucuccuuuuauuucuacuucuuuuucuugcuuaauuuuagaauuugauucuguugcuggauguuauuuauucucuggcauaaccauugcaguucguuuuuggagcugugcuccacggccauucacauuuuagaauggaacuguguuguuuugucauucaucacucaagucugaaagaccauuguaaucguuuugcugauaaagaacaugaauguaaagaagaaauagugguaaaccagacagcccugagaguguguugucuugaaaaggaacaugagaucacagagaaguucuuuauuuuuguucauuuaaauugaugaauucuuuaaauuguaugucuaauuguacucauuuuuuuuauaguuuaaugcagacagguuauaagauucuagacgcuaauucacacugauuucuuucacaaguuaggagacaauuguugauucauaaaacaugagaggaacuuuggguaauugucgauugcaugacuauucugugcauuucuauugcuuugcuaucggcagucauuaaauggauucaauuugaaaucugaaugagaaauuaguguauucuuaugaaugugccucacauaaguuuuaaaugaaguguuugacuuuuucauacauaucaacuuggcaaaagaauuuuaauuauuuuauuggcugaguuuaugagauucauaguucaagauuacucaaaccaggguacauuuagaaauaaauacaauuaaaugcucacaaaugugaaggucuuaaacaggaacugagcuguaauaauuguuuaaucuagaaacuuccucuuuuguuuugcuauacacuauucucuuaauacucccacccucccccaaccuuuuuuuuuuuuuuuuuaagaguagccuaaccuuuugcuggugacuccgggaaccuauuagaaaaugaaugguggugcuguuucaguuuuccuuucagccuuucaguuaacuaaacacuuacaucugaucauugucacuuaguuuuucaaagcacagguguuuucucuuacccuucuuucucugccucagucucuccccugcuuuucuccuucucucccucuguccccuacuucucuucuuccuauauuccucuacacuuccucucuccuucucucucucgccucccuuccucccucuccucccugccccccaacccuuuccccuucucccucucucucagugaauaucaccauuucccaauauaauugggcuuguccaguucgacuuguagaauauuggagaauuucagcuugaacauauacucugagcaggagugguaagaaaugugacuguuuagcucaaaaauuaauagcuugaaaucagugaagccacugucacaugcuccaucuuuguaagcaccacugcuuuuccuuuuuucuccugugacauggggggaggugggaugggaggguacacaguaaucccacuauccucugauggcucagaauaaggagaaaagaggcauuaauggcucaugaauguguggaugcacaacucuaaauaaguaccacuuacgacugucuccuaguaugacuaugacuucucuguuuuaguucccaucuuugagacuacaaguagcucagauucgauuuugauagucgcacauccacaguauaauuuacuuacauaacagguguuccugaagauaaguaaauguaacuuauuccuacuaacuucuauaauuuaaagaauaaagcuucuuuuguauuauauaauuauuagauuauauaucuaauuaauuauuaguagaagagaaaaaaaaucauccaugaaccaucuccuaggaacagaugaccaauauugauaguuucuuggauuucuuuauaggcauuuuugucuaagguuuuuccuuuuaucugccuguuuuacuuaguugugaucaugcuauauguaucaucuuuaguccuguuguuugcacuuaauaucaugucauguguuuucaauuguuauaaacuuuuguaaacacauuuaaauacugcauaauguucuuuggaauuuacauagcauaauuuaaccauucuccucaguuuuugaaaacuacaugugguauuuucaaguugcuugcuuuuauaaacaaugcuuugacaaauaucuuugcacauaugacuuuuuccacauugaggugauauuuccagaaauaaaguuaugagauuaggaacaccguguauguuauuuuaaauucacaaggcugugugagugaagacauuguuuuguuugucuguuguuguuguuuacauuuuuuauuuggaaaucguuucaaacuuacugaaaaguugcaaaaauaguacaauguauacccguauucauuuuacacggauucgccucuuauugacauuuuguuccauuugcuuuaucauuugugucugugaacucucccucugucuuuuucacuccuuccuucuuuaucuuuuucccuuccaucuuucucugugcauuuuuucugaaccauucuaggguaaguugcauccaccaugucuuuuugccuccaaauacaucagaguauauuuccgaagaauaagauuuucuuauguaacuaugguauaauuauuagcuucaggaaauuuaacauugacauaauacuuuuaucuaaucuucugucagcauucuccauauuucaguuuggucaguugaucuaaugauauccuuuauagcaauuuuccucccuacagugcaagauccaguccaggauuacauauugcaucuagcuguuaugucucuucaaucuacuuuaauggggaacaguucuucaggcuuucuuugucuuuugugacauugacauuaaaaaauauacagaacucccccaccucuuuuauuuuuuagguaaaaaaguuuugaguuugauguuuugucaugaugagauuaaggcuguguauucccaaccagaauaauacugaaguaacauguccuucacuauuauucuggagauuacacuauuacauccagagguacccaauguccuucuacccuuuguuggugauaguaauuuugguuaucugaucagggcauugccugauuuuucuacuguauaguuacuauauuaacccuuacaacuaauaagcaauccgugggaaggcacuuuaagagcaugcaaauaucuuguuccucuucaaaacucaccccuuagauuuaacaucuauugaugauccuugcuugaaccagucuuuucuauggugauuuuccaacuauaacacuucaucaaccuuuaccagucaguaguuagcauucuccuauaaagaauuuuucuauccauucauccacccauccacccauccacccacccacucucauugucugucagucugucuauccaucuaucugucugucugccugucugucagucguauugacuuauagacuccccuuuuuagugguguauaguucacuacuuuucuuaauuauuuuggugcucaaauuguccuagauuuaauuggugggggccccuuuagauugucucuuguguucuucuaauaugcucccaucauuuucucagcacuaacuuuuucuggugugagaugugcuaggcuuaucuuguccuuucccugcccuagcccuguaaucaaccauuucucugaugacuucuguuuuuguuuuuuggguaguuuuguuuguuuguuuguuuuuuuuuuagaggagaaagguauuagaaaccaauauuggggugcuaggugugcugcuuacuaacaggguagauuugauucuaggccuuuuuuaggagacaggaaaaauaauauacacacacaugcaugugugcauacacaagcacauauuuuaggaauugugaguucacacuaauacuuccaaguucaaaccauuuucacagagaaugcuuaucuccauucuauaauguauuauucuuccacagugaaaacccugcugccuaacacauuuguucauuuacucaguccuuuaauacaucuaaaaauagauucaaauuaugucacccauacuacuacagaaaaagaccuacuaaaaaguucaggacauguuuucccuccacacuuucuuagaauaggguagauaguaaaauuuugaguucguaacuuauauuauucuuuuucucaccucucuucauagugguuauguuuuuaauuugaaguacaauuucccuuugcuucauuuucccuuugcuucauuuuccuuucaauuuuagguuuuuaucuuucccaucuuuguuuauuaauuuuauuuuuugaauauguggaacacuaauaagcuuuccaaauucaaaacucuguauaaagguauacugagacauguauuacugcuagaaguuggucauuuauuuauagcaaaugggguucaucucuucaaguuuaaaaugaucaacuuuauuuuuuaaucaagcauacuuauuagauauucaaagagaagaaaagcaacccuugauucuugugaccagccuuagcuuuuuguauaguagaaaauaagagauguuugguucacagauaaggcaagugacaggcacuucacgacagaggcuugcuuagccccuuugucuguguacaauggguuauguucccugcuuccauacacuguugcuacuugguuguuguuguuguuuuuauauuuuacuucuugaugcuagcuuacuggugauaaauuucauuaguucccacucuucuaguuuaacuuugaaaacaucuuugaauaguggguauaucaacuauaugcauuuuucaaggguuaagcucuugaucacauguugcuuugguugaauguuugucuccuccaaaacucauguugaaacuuaauucccaguauggcaggcaguauugagagguagagccuuuaaggggugacugggucaugaggcucugcccucaugaauugauuaaucuauucauggauuaguggauuaaugaguuauagacuaauagguuauaauagaaguguagaacugguggcuuuauaagaagcggaagagagaucugagcuagcggacucagccccuucaccaugugaugcccugagccguccugggacucugcagagaguuccuucaaacaagaaggcucucaccagauguggcuccuugacccuguacuuuucagccuccauaacuguaagaaauuaauuccuuuucuuuauaaauuacccaguuucugguauucuguuauaagcaacagaaaauagacuaagacaugugucuuuguuuuuuuaacaauaagacuuaaaaauacauuuaauauaaaggcugacauauauuccagcucugcauaggauauaaguguuccucccacuuaggguuguggucagauauauaagcuuucuuuuuuaauauuuggaauuuauggacuuugcccaugcaauagucucauguccuuuucuuuuucaaaauuacaacggguuuguggaaugauggacucacaacaguuaauccugaaugacuuaaugaacugccagacagguuaaggugaaaugguguucuaggacagaucuugauuuguagaauuaaggguggcaacaaacuucaaaauugcuucuuucauuccagcagguaauuuuguuagagguaacucaaguaaucuuaauaucugaauguguucaguuuuauccuguucuuauacaggaaaucccaaugcagggaagaaauaaaguagcuugaacaccaaagauacuagaaagguagagucuagggagcugucagcaagcuuugcuucuauuuuuuauacuggucaguugugacuuuuguuaagucaaagaacuuagaaauuuagaugaagggaggcugccuuugugcagccaguuagcuggucugggcagucaauuugaguggugaaauuaaggcuuuaucuacuuauauuugggaggaauuuucuggcagauugcaaaaucuugauuaaguuagccccaguuuaauauguaccuguggcgggcuuuuuuuuuuuuuuuucuuuaauccuuuacauuuucuuguuauaaauuaugaauugguccacuucuuauuagacagacuuuguauacauuccaaggcaaacauaaaguaaaaaucauauuuucaaauauguaauagaauaauugagaugauucucagaugcaugucccuuaguagagucauagugaaggcauuugcuggcuggcuggaggcauuguuuuauugucuguuucaacucuugagagaaaugaacagauggagaccuguauuagaaguacucacacauagaaaaagcuuuggaauauuuuuagcauuguacucaggagcagcaaauccuauuuccacaauuuuguguauuuguuaguguguuaucuuguuaagccuuuuuucccaucugcauuuaaugggucaguuguuucuaacuuguucuuuugaaauuuuuaauugaaaaucuguuuuuuuuuuuuuuggaaagcacauuuuacaaauaaaggcuguucagcuagguggcuaggugguaaaaacuaaaaugaguaugaauguauguuuucuguaaggguucugaaaacaauaauaggaucucuuuaagcucuacuguauagggaggcgagugauccaucaaaagcacagucuuagauuugggucuucuauuuagauuaggaauguuaagaaagauggaugguaaaugucuuuuagcuguauuguccccaaaacaugaaaugaaaucuaaagacucucaaagaagguuucaauuacacuagcaaaugacuugaacaaggauuggguaaagggaggucacgggccaguggaaugccaguuguggauuuauauuguuuaaaaugaaaacauuauuuccauuaaccccuuuccacuaacaccuccaccagaguuauuuucagacuguacguuuguagguguuagucauacuugauagaaaugccuuaucacaagugugaauugcacagccuuuccauggguauauauuuuuuccuuguccaauacacaauccaggguuucacuuggcuaauccucuagagagguacuggcaucccuguguucuucaaacuugauuuuaaaauguagcaguaagcuacccaguugcaaagaagcauuuguaaauguuuuaauuaaaaacagaaugaauggauucuguguugugguuuucugugauaacagccaaucgacugccaaaucacacuguguacuugaguuuagggagggaagagucuagguuuaagggugacucucaauggauuugcccuuaacugucaauguggguuugagugugguuuuugcccucucacugcaaauggagaaaagaguugguaagcagaagaugaagcauccuuuuaaugagucggcuauagugugcacucagggcagacacuuuaaaagagcaccauuaauuugaauaaaacaggagaagguagguacuuuguacauccauaaagcacugaaggggauaaauccaauuaucuguucaauauuuaauggccaugaaguuaaaaauuuuaaaggcaguaccucggagacugcuuagucaauucuguccauauuauuuuugacauucaaaagucaagguagaauagccauauugauggcagugcucaucacguuggucugccgauuuaguggcagugacccugggauuuguguuucucuacacagaugaagaucaguugcaauuuuuuuuuuuuuccaggagcucuuagggaaaccuuaggaucuacugagcuuccaaccuguuucuuucaguccuuugcuauuggcucuugcuaugaaagguaauuaaggaugauuaacuuaaaaauucagaugcaaaagaaccagaauaaagaucagccauuuggguuaacagaagacaggggauuuuaauaaaaucuguguuucagaaauuccuaagaaacucuguuagagacucucuaaaauuccaacccaauuuuuauaaacuuuuuugcacugugcauauuuucuaagcaagucauggggggaaaagauaauuuuuaaagucugccacgucugucuguucuacagcuguacuuagccacugaugcaggugggcauugcucugugguucaaaggcagcugaaucauaaagcuucuaagaaaaucgaugcuguagcgacacuuggaaugaaugucaguaugacagugauuuuugugauauggucuugaagcuuuauucuucuugccuauuagcuaauacaggauccuaauuagccauuaacaugcucuuaccuuguaugguccaaacuauagaagcauaucucacuguauuucagagaauguaacugcugguuaccuuuucacuuauucuguuuuauguauuuccuuucgcauugaauauucuccuuuuguacauuucugaaauagagcuguacgcuuccugggcauggauagcauucgaucccuuucaacauagcuucaguugccuguagcuaucuaccuguuuauuuaucuaaacuaauacuauguacagauaaauuuugacaugaugcagguuuacuguuaaaauguuauagaagaaucaugcaggaagacaacuuuaaaauagauuaaagaagcaaaaguuaauacauuguaugaguuaggagaugauaauaagacuuuuguuuuaagauaugucagaguuuuaagaagggcuagccuauugugagagcuuuuaaggagucugugauuuuccuugggaauacauguaaaguccuuuucuuuuucuucccuauuuugcuacccauuucccuuuaaagggagacuugguuuguuucacucuauuuucaaaugcaaauucagcuuauucuugucacguguaccaucucuaaggaugauacuugcugaagucuaaaacuauuuagcguuccuggaucuuacaguuuuaaguagauuguuccuuguuuugcuccaagugucuugagugauuuggcuguuaaaccagcagaaaccuuuguuuucuuaguuuccuauaaaggaaauaaaggugagaaaauaaugauuuccuggauaauucaaagagaagauuuaacauaaaaucucuaacaugccacuauacaaggacuugcaaaucagcuuauguuacaacucagcaugacaauuguuaaacucauuuauuuuuaaagagcuuuuauaugugauacauguuaaaagagccaagaagagagggacuuuuagcacuguucuucuugaauauaacauacauguuucugaacucuuacuugggguauuucauuuguuugcucauucuugaucugcacagcccuuaagcuguaagcuuuuugaggacaggaaaccucucgugugcauuuuauauuccuagaauguauuuuuuuuucuugugugacuuaccccggaucuuuauauuaacaguauuauuauuuacauaauauuucucuuuaaauugguuuaccuuuuuacccaaccucaugcaaaucaguauuagccaugaaauuacagguuuguugggcuguaucuucuuuuaauacauauuaauauuuacauuaaaauccuaauuauugccacacacgguggcucacgccuguaaucccagcacuuugggaggccgaggcggguggaucacuugaggucaggaguuugagaccagccuggccaccauggugaaacccugucucuacuaaaaauacaaaaacuagcccggugugguggcgggcaccugugguccuagcaacuugggaggcugaggcaggagauggcuugaacccgggaggcagagguugcagugagccgagaucgggccacugcacucaaacaugggugucagagcgagacuucugucucaaaaaaaaaauccuauuauuagaacuuauagauuuuuauuuguauaccacuuaaaagucaucucaugcaucacacuugaggaauggugcccuagcauagccuugcacauucucacauguagucacuauuuguuuaauuguggaggggagggaauaagauuaauguacuucgugugucagguauuguuuucaauaguuuacauaugguuucucuuuuaaucccuauaacaaccgaaugagaaagaugucuccauuuuauacauaaggaaagugaggcucacuaaggcuuagugacuuucccaaggucaaauaguucaguaaaaauuagagcugagcuaugaaccuagguuuaucugauuucaaagcuuguacuguuuuugcuacauguuguggacucucagugauuaguggguuaaccuugugcauuacugucugcuuuccuguuguuauuccucuguaguuagaauagaguugacccugaaugguauuuacaguuugucaucuuguucuggaauugcauuuugcacagucuugaaaguuguuguuaccaccuucuuuuuuuuuuuuuuugagauggagucucacucuguugcccaggcuacagugcaguggcgccaucucggcucacugcaaccuccacccccgagguucaagugauucuccugccucagccucccuagcugggauuacagguggcugccacuaugcccagcuaauuuuuuuguauuuuuaguagagaugggguuucaccaccuuggccaggcuggucucgaacuccugaccuugugauccaccugccucagaaucccgaagugggauucaggcaugagccaccuugccuggccuguuaccaccuuauuuuuaagguuuguaugaaagggaaccucuuagcacuacuaagaggaauauguuuguuuuggauuuuuaaaaaguauugcuaauuaagaguuuagacaaauauuaagcuucuuauuuaaguuagagguagcuucucucucuguaguuguuuuucauuuuauguagccuaaaucauguuauacuucagagaugaaaccuggagaugauuugauucucauccaaaaugagugccugaguuccauuuucagcauacacguaugaucaucuagcuauugcuugauuaccucuaauuaugguguucucacugucuccucuuuagcuauuacuaaaaaaugaaagagggccucgacagccauagucuuuuaaugcuaauauccuaguauuuaaaaguugcaagggagccuaauguuugcuuaauuaauuuauuuauuuuggugguagagaauagaaaaaguuguaaaaauauuguuugccuuuugauaaauucagaaaacauuuucuauuuccccuuaaaucacuugguuuccaucucagauaaucauuaggguuucauuuucauucagcuggauagcguacccagagaugguuuaaugggaucacguacacugauggaugguuuaauauuuugaagauggcacacaguagcacuuuuaagagaauaaucaggacuggcaugcgagggcugagaauugcuugaguucaaaaaucagagcuaguguaagugcaguuuuguguaacuucucuucggcugccaacugaccauuuuauaauucuuucuucccccgauuguauuuuucuugguuuccuguuugacuuauauuccaaauucacuuuacaucuuugaaauuauggaaauaaggaaauagaggaacuguauuucuuccuuucugaguguagcaucuggaugcucugguuuuaaacgcgaaggggcuguaaacccuaggaauacaaugucuuuuaaggaccggaacuaguacgucuucagaacugacuucaaauaguuuauuucaccccauugaucugaccuauauguguugauuuuuauuauauagucuauacuguagggggaggaagagccugcaguuuuacuauuaccucauaaaauuaauuggugccuaaaacaaauaguauuaaagauacuguauuuuauaacauaccaagaugacugauauaguuucuguagggaguuuuuguuuuucuguguuugugucaauaaacucauaaaaucugcagaaugaaaugagucauaaucucauuuuuacuaucaaaaagugaaguugagcagaagcaugaccacguaguuccucccaguggcucaaacaaguaaauaauuuaacaugucuucauaacacaggguuuugcuuauaucaagaaacacaaucaccaccccuucccuguucaauguaaggggcuuagcuuuauuggagucaaaaaaucuagugcaguacuuugucagucagugaauauugugagcuucuuuauuuucccuguugcuuuuuuacacaaaugugggaaauguugguaucacaagaaaaucagacuacauuuggucuucuaaaauguaacuccauuguccccaugcuggacugaauuucuuuuuaaugugcuguuuuccucaacccaaccuuucuauagggaagaguaguaaguuuauugucaguauuguggauauuuuaauugaagauaaacgaguuuucuuuuuaaaugucuucaguauuacauaucuuuaguuuuauuauccuaauuuuaguagauuggcaaagccagauaaucuuagcaacccuaaccugauucagcauucauuacugcugcuaaaucaaauaagaccuggcuaauagaaacauggcuugugcagccauucuuuaauuuaauuagaauauuauacauugcauugcacuuauauguguauaccagagacaaaacuugauaaucaguuuguaagcacucaugcuacaucaucuagcuagagacauuuaucauuuauugugaaaucuccucuuuugggaaccucuuuaaauuacuaaauaucaggauugcuugaaggggugaagauggggcuagcucacguaaugugccaucaaagguuaggaauuuaggucucauucuacuauagcaaagauuggcaaacuuuuucuguagagggcaagguaguaaauauguuaggcuuugugggccauacggucucuuucacaacuacucagcucugcuguuguagugugaaagcugcuguagacaauauguaaacgaaugagcauggcuauguuccaauaaaacuuuauuuauggacacugcaauuugaauuuuauguguuuuucggguguugugauauauucuuaagaauuuuuucaaccauugacaaauacuauuccuagcuuccaggcucuacaaaagcacauggugagcuggauuuggaucacaggccuuaguuugcugaccccuauucuguaguuuccuuucuuacuguauuuuaguuuucuuauuuauauauuuauguacuuauugacuuauacuucuuugaugguuugcucuguauccgugcaguuuuccauagugcaggaaauguggauggaaugaauuuuccugucauucucuuaucugacagucucugcuugauguggcaaaggagaaucagguguucaaccuccaaugagaguaauuucugauaucaguugguaguugcuguuuaauucucaaggugcagacaagguggcggaauugacuuaucucauuuucacauucugggagaugaucuguuaguccugaggaugcugucaguuuucugguauuacucucccugcguggucauuaacaauagcagaguccauaaauugaucccagguuugaauuguaaguuguuggcccugaaaacuuggugaacaaacuugcugucaguguuuguauugauggaaauagucugaggucagcuucauuacugcacccuaacugucucauacauuguccguugauuuuucgguuguguugcaagaggguucuuguuucagacacuugcuaccagacauauucaccucaaauauuuacaguacaaugaaucauucaaacuuaagguuggcagugucuuuuugaaaugguguucaugaaggacuggguuaauuuaucagauacagauuuugagaaguuuuuuucucuuaaagcaaaaguucaauuugcuaauaaaucaguggcaacucugucaucugacacauggauacuugucucuuucacacugaagcuugccacugguaucuuuugcaagaguggacauauucuuaucuauaaaguauuuucuagauucauucagaaaaaaauaaagugagaauacuaguuuccuucuugaauaauggaacuuaaagauaggccuagguauaugaauuauuacuguugcccauuuugaaugacuacugagcuuuggcgauuauuaucagcuuauuucuagaauuauuuauuaaguagggaauuuuauucauugucagauuuguaauuuuagcuaaguucugauuagaucaccuugugguuucuugcaaacauuuuuaguccuuguuuugugucaucaugaaagaaaauuuaacaaaaagaugcauacuugcuguaacuccugggcauuuuuauuuauucauuuauuuuuaguccugugguuucucucuauaggugauuggaacacaccagaccucucagaagcguucugcuguuuccuuccucccaguaagcagauuauuugcaagugacuugaaaauaauuucaaguauuggagagcuuucuucucagccacccuugccaauguuguaggugaugcacaaaguucuguaggucagcuugaaaucaucaugcuugcaaggaaaaaaaaauuaaaauugacuucaaaggacaacucugacacggucaauuaauaauuaaaacaguuuuuuaaugagcuaugcaauuaccuguaugucccuggagaugaugguuuaugguauuauugcagugcccuuucuuuagucauggcgcaugacauuuguaauuuaaagccggcuagacauuaaagugacagaacuuucauuaaccuugucuaaaguuugcugaugacaaaugacuuauaaaacaugcuguugucaaaauauaccacauauuuaaguaccuuaaaaguccugugggcucugagaagcuauggagacucagagagacaccaagaccaccaguguccuguggaauuacuugacagaauccccgguggcuggcacuauuucuuuguacucagguaagugguaccugcuucagacaagagcuucauguacuuuucauggcucucugguucagguagguuucccacggguuuuuauaccacgugacacgauucucucaaucagugguuuaugacuauugaauaauuucuucuaaaccugcuuugauauguaaacuuucaagucuuuagaagcaguuuuauuuuuucaucuugaaaccauuuagcaauuauguuuugauuuuagcuuuuuuuguaucuuggcuuucuaaauucuuagcccucuguuugcacuaugccauaccucucuuuugucuucucccuguauuugaaauuuucauuuuuuguagaaacuauguagaaacauccucuaaucuuaaaaaauuuucucaucauauuucuuuuagaagaauaucuugaaaugcuaccaagggagauauugcagguggauauccuuuuauguuauaacaguaauaaauauauaguaauuaacauuaaugugcagguauuguuugccaggcauuaugcuaagaguuguaucucauuuaauccucaugguagccagagcuuauagcacuauuuccccauuuacaaauuugaaaacugaagcacaaaaagauuaaguacuugcuuacugucuuauagcuuguagaugaaccaggauucaaaucuugacugacaccaaagauauuauuagugaccaccaagcaacauggcuucucacuuuuguuuuuucaaaauaaauuacaaguuugcuaucuggaaagauaaaguauagcaaacuucuaauuuauuuauuauuuaauaauuauaaccaccuuuaauuauuaaauagaaagaauuguuauuucauguuugugcuaugcaauauaccaauaaauauaugcuggacagcauaccagcaaauaugaauuuaauauuguaaguugaguauuuauagcuuauucgagagacuuguuaagagaaauuauaaccaccuuuuaacucaaguggcauaugauagauauuucauaaguauuuccuauuauuauuauuauuauuagcauacucccuacgugcaauauaucuugauucugucaugggucuauguuucaggauugguuccaauauaauuagagacuacaacuuuaacaacacauuguuuuauuccauuugguuaauguccauaccuuucuuaaacacuauguaaguauuauacaucacaaaguauuaaauauugucaucguaucaaauacaucucuguguucauauugcugaauaguagucuacucuuaacuauuuuuuaguugaaguauaacaccagggagguacacauaguguaaaugugcagcucaguaaauugucgcaaaaugaacacccgaguaaccauuaccgaggucaagaacuuugccagcagcaccccagaaggcuuccucauggccucucaaaauuacugcgcuuccuuccuccccagugauaaccaggauuugaacuauaaugccauaguucuacauuuuuuuguuugcuuuugcuuuugacauuuuaaaaacuucuuauuguugaaaaugucaaacacacaaaagcagagggcauaguguauugaauaucauguucuuaucacucaacuucaacaguuauuaacucaugaccaauauuauuucaccuguaaucucacccacucccccaaccauggaucauuuuaaagaaaauuauagacauuguacuaucuuuccaucaagauuucaguauguaucucuaaaagacagggauucuuuuuuaaaaagauaaccacaauaauauuuucuuaccuaaauacuuuuguaccaacaauauccaggcaguauuaaaauucuguaauugccuuauauuauuauuacuuugaaaaaaaccuuuuuauuuguugagucaagagucaaaugaaguccgugaguauaacuacuugauuagcacgccaaguuuuucuuagccuauagcuucuucaucccuuuuuucucccucgaaguuuaagaaacuggacugcuugucccauaauugcccacagucugauuuugcuuauuaugucuuccugauguuguuuaacauguuuuuuaaaaauuuuuuuauuucuuauuagucaaauaagucuaugagauucagucuuacuuuucuuuuuugggguaugggaggguauaaaggguaagaauacuucauagguagguauauaaugucuguaccuuuuuguaugcaugugaugucaguaaccauuugaagaucacugcguagauuuauucuuucagugagggcugcaaaauggugaggaucuuauucugccauuccuucauaaagagaaacuuccccuuaucauuuaacuuaagugcaauauacauagaauggccagacaaaugacugauucuuuaccuuuauuuacugauuuucaaaauaauuaguugguucucagcacccuucaaagguauuuaugaaaguuuuguuuugcuuuaguauuauuuugaauuuauaggguuaaacaugcuucaauccauucaauuauuauucuuacugaugcucaaauuauccugcuuuuggcuaguggaagacucuuuuauuaugaccccagaaucuuugcuaauauccuuuucugguugcgauaagauauuccaggcucaucuuagaagguuuuuuguuuuguuuuguucuugccucaaaccuggaaucagcuauuucuccuagaagcucauuucuuuuaguggaaaauuagaaacuauacucuggucccugggaugugcuuauuccuacuggauaggucacuguuuuuagaucuuuuuaguguacagaacuaggcaauguauuguuguugucuuaaagauaaaauguauaaggacuccauuuugacucuuccaauucaaauucaagacuacguagcuuucacuuaaaaucauguauuuguguuuucauucaugcaugugaaaaauccugacaccagcauuggagauucuuaaacugggauacaucauacgcacaguaguuucugggagguaaagcuuggcaucugcauuuuuaacaauuuccacaggugauucugauacucacccaaggaugagaaccacugaucuauuuuuuacgaacuauuuuauguuauagauacuuaaauggaaccucccauuuucuucuuagaaucccccuuuucuuuguugauuguccacauucuuucuucuucuucuucuucuuuuuuuuuuuuuuuuuuuuuuuuugagacagagucuugcucugucacccaggcuggacugcaguggcaugaucugggucacugcaaccuccaccucccagguucaugcaauucucacgccucagccaccggagcagcugagacuacaggcgugcaccaccacacccugcuacuuuuuuuauuuuuggaagagaugguguuuugccauguuggccaggcuggucuagagcuccugaccucaaguaauucaccugccucagccucccaaagugcugggauuacaggcaugagccagugcgccuggccaagguugaccauauucuugaugagccaccuguguacaaucugaauucuuuucuuguuuaacucauuggucugugcaucugacaguaaaguugaguuauuucacuucugugaaagccaggcugcaguuaucuuugaccgcuugaaaugcuaaaauacaggugaaccucacaacuaaggcucugcccaaggccagagagagaauccucccucauugcuuugagcagaaugccugguacuggaguagauuugcuuaaaggcaacucugcauuugauaaaauaucagagcaauuuauguccuuguacccuuguuccuuuucuuuccucuuaggcagaaauguuaauugacaaucaaaggaguaacaggugcauaccugaauucacaagccuuuggggcccaucuugaauacuucugcagauccaggccugguuuagguuaugccuucuuucauccaugcucaccugagaguuccaguguuuuccuuguucuuguuucugcauucagaguucuaaaauuugacucuggcuggucauuuuaucacuucucucucuuagaguagacuauagaucuauaucugaacauuuagcuucuaauugauuuguauugauaauaggugaaaaagaaguuaauuagccuggaaaugacuacaccauaagaucagacuuugguuaaaaauuuaaccacauuaauuuugauaaucuuuuacauucauuuaauauuagcuuuguuuuauguuaaauuugcaaacuuucacauuuuuaucaauguucuugagagggaggcaaagaaauucucaauuuaugaugcaaaauggaacuucaggucaauuauuugaccucugugauuuagaucacacaucuuauaagugggggagcaacugcucagucugauuccugguauuuuuuucuguuauaaagcacacucuuaaaaagaaagaauucaaaguugcuuccaaaaguacaauauaagaaaaauaauuuuaggaaaggucaaaaaugauuagaagaaggaagugagaauucuguuaauuuagucuggcuuugagcuuucuguuuguuagccaagacauaaagggaaaacuuuggcucauagaauacuuaucugauuaaagaaagcacaugaauuugcauggaguacagacuuuuuuuggcauugaauucugugaagaauauauuauaugaucuuacuaggggauaucuguaacaaugaauuauaccuucacugcuaauuuuguaaaagauauaaaaguaaacuucaaaugagcauuuuucuuacucuucuuaaccauuaucacaugaacucauugccaagguuuuagguaugaugauaucagaugaaaagguacaagauauaugcuuaagugaagcauuuacacuagguuuuaguguugaugcaauguaucuuuuuucauuauuuuacuuuuaaccuauuagucuuuauguuuaaagugauuuucuuauuauaaguauguaguugggucuacuuaaaaaaaaaauccauuagcugggcgugguggcaggugccuguagacccagcuacucaggaggcugaggcaggagaaugacgugaacucgggaggcagagcuugcagugagcccagaucgcaccauugcacuccagccugggcaacagagcaagacucugucucaaaaaaaaaaaaaaaaaauccagucugacaagcucugccuuuuaauugcguguuuagaucauuuacuuuuaauguucuuacucccaugauuaauuuuuaaauuaucuuacuauuucuuuuuauuugucucaucugcucuuuguucuccuuuucuucuuuuucugucuuauuuuguguugaguauuguuuauuauuccaguuuaucuccucuguugguuuauuagcuguaauucuuuguuuuagugguuguuguagagcuuauuguauauaucuguaacuuaucaaagucuugcaaaugauguuauaccacuuuauuuguagucuaagaaccucaugacuguauguuucuauuuuccucucucagccuuucuguuacuuuugucaaacauuuuacuuuuaugcauaugcuauaaaccccacaauacauuauuauuguuuauucaauuuaucuuuuaaaaauuaaaaauaauuuaaaauaucuuuuaaauaacaaaaaagucuuacauauuuacuauauauaaagugcauuuuuuggugcacuuuuuuccucccugucaaccuauauuucuauuauuuucccucugccugauaacuuccuuuagcuuugcuugaaauaugggucuguugcugaugaaguguugcugcuuuuauuuugcaccccaucuccuuuuuuauaauuguuauuguucaggcaggacaguaaaucuugucccuguuaacuucauuuuggugagaaauggaagucuucguuaguuuuaaauguagguuaaguugucgguaguuaaugcugaauucuuuaauagcugaguugcaguaacauuagguauucacugugggugccucugacuuccuucagaggucaauauauagggaucaggguggauaacuauaaaauccagguuguauuccucuguacagauaguguagcuguauuagucugcuugggcugccauauuaagauaccauaguguggguggcuuaaacaacggaaauguauuucucaaagucuggaggcuggaacuuccaagaucaaggcauuggaaagauugguuugauucugagacucuucucuuggcuuauagacagccagcaucucucuguguguuugcaugaccucuucuuuggacaugaacaugugaugggggaagacacagcaagcucucugauggcucuuuuuuuaagggcacuaaugccaucaugagggccucacccuuauaaccuugucuaaccccaauuuccugcaaagggacugacuccaaauacccccucgucagggcuuaggacuucaacaugaauuuugggcggauacaaacauuugguguauaucagcagccacaaguuauaguguucugugaaccugaagcuuucuccuuauaacuuguguaguuugugguuaaggaccagagccauacaucugcucugaucucuuucuuaccccucuaggcaucucugugguaauauaaggaacacuuuacccaucaauagauuagaaccuuaccuguacuugucuggagagagaauuuuuguucccguaauucuuuuugaagugucaagaacuuauuuaguuucacuggauuaaagagagcaaaauuaucagcuugaaucaggagcaacuugaaggagagaucagggcuaugaagccuguugggagaucugcauuuauaaggagauggcuucagcaaggauaagucauaucuuaacaucuuagucuuaaaggacagauuuguugcaaagaaaauggaaaugguaggaaaaagugcuaagucuuuuuuccguggcagcauuucagaauuguguauuguagcucaauuuuugcuguugccucucccuucuguuaauauuagagucagaagccugaucagacacagugcuguuuuuucugccuaaccaaagcuguggacccgugaaaccuguaaagauauuaaagaauugagaaauuucaugugagugaggugguugaauuuuauuucuguuguuaauauuaggugauugcaaaucuacuuauuuuguuacagagauuccaggaugccaauaugcccuuaaauuuguucagaauuuuaugugggauuauacuuuuauauuuuaauuuacuuuguaacuuguuagcuauucuuucucuaaacaucugagagauauuuuucuucccggcuuuaaaauuuaauugaaaaauaaaacugugacuauguuuuguuaaguuaaacaauacucucugccaggcuucuuaaggcaaauaggauuauaaaaucuuacaugcccaguucauauuacuugcucugaacaaccgauuaaccacucccauagaauccuaggagaguuuaaaaauuacagcuuucuuaauguuucucacauuugcccaaagguuucaaagaaggugccauaagaaauauaugaaggugcccuuggagauauaggcaaagaaggugcuguggaaauuagcuuucuuuuaguggcauguuugcagugagauugggcuauuaggggcauuuuaguuuuccuguaccuaggacaaucugcuacuuacaaugauucccugaugccuuuauaaagggaaagaggcuuccguuuuuaggauucaucuaacaaaguguuauugcuuaccuaauuuuuuuuuuuuuuuuuuuuuuuuuuuuagauuuuuuuucacucugcuaggcacuggggagcuauaaggacuaagaggaccucuuccccucuagaacugcacuacuaaauuggguagccauuagucaccuugacuauuucaauuuaaaguuaauuaaaaauucaguuccuuaguaguacaagacacauuacaagugcucaauagcuauuuguggcuaguggcuaucauguuggacagcauagauauaggacauuccugacacugcagaaacuucuguuggacaguacuguacuaggaguuauuauucagauuuauuuacccacaaaauaugguuguuguaguaguguuuuuagucucagagucauguuaacccaaagauggauaggaaaacaaaaauaugcuacaaggaaaauuauuaugggcuauucagguguucuuguuacuguaugugccccuaauauuaggauuuucuucacagaacauuaucauucaaaaaagaagucauuacauauauucagguucuuacaaaggcucucauguuacugacuaaucuuucaauuacaguacuuuauuuugaacaucaaaauggcuuucaugaauguuugcuuaugaugcuugaagaaguuacugguaaaaucagauuuauaaagaagaaagauuuaacacaaauuuaguaauuuggucaugaccucacaacgacaaguguugggcauuauuguaaacaacccuuuuuaagaacagauaaagcaacaccacaagugucauugcuauggagaucacaaccccugcaggaucuaugacaaacuguccugcuauuuagcaaauugguacuugugguaaccgugccacaccugaauuuuaaaaacggcuaucccccaaacaaucuggaagggaagaccauuuccuccggaaaguaaaaaaaaaaaaaaaaaaaaaaaaaaaaagacucuagugauaauaaagacauuuuugugccuggggaguuuuuaaugaaaugugagaggaaagaaaacaaggagcuuuucuaaauuaaauauguucuauaauaugccaugugauuuugaaugugccuacaacuaaaugaaggaaauacuauaccuagacauuuaaccauuucaaucucagucuuaaaaguuaauguaaacaaguuguuaaaaaaacuuauuuuuugaggaaaucaucucauauggaaaaugagagaucaucuuauauucaggauucacuuaaauuugaauuuggauauauaaaguaucuacuucuggagauaaccuuacuguuuuuuuuucuaagaaauucuaagcauuuccagagaauugauuaaaauuuauuaaacuacagaaagugaaaucagaagacuacugaauaauuucuuaaaaucauguuaaaauauauaaaauuuauaugcauauaaguaugcuaaaaguauacagaaaagaaaaacguggaagaaaugcaacaaaaugcuaacagugguugacugggcagugggauucguguucucguuacuccuuuauuauuuucuguuucauuuucuauaauaugcauuauuuuaauaauuagaauaaaaagaaaauguaaaugaacacuuaaaaagcacauguuaaagagaacacuugauuugauguauagguucauccuuuguagguuaagcaaauggaaagaaacuucuuuguacaaaaacuaauuccaugugggcauuggauaccuuucucagagaaaauagguugucuagccagcacaccuuguuuguuuuuuaaucucuaacaacguucaggauaucauacaaaagagaagucuuggaaauucuuacauauaugaugauuauuuuuagagauggggccuugcuaugaggcccagacugaagugcgguggcuauucacaggcgcaaucauagcucacugcagccucgaacuccggggcucaugcuauccuccugccucagccucuggaguagcggaaccacuggcacauggccauugugccuggcuuuacauaaguuauuaagacuuuuguuuuguucagcauaucuggguaacauugcauggccuaucccaaagucugaaauauuuuaaauuccaacugacaagauguuaggacacucaaaggaagcauugaccacacauaaaauuguuuaaauaugcucagcacuuuucagacuauuucacauuaauuccuagugaaauaauguagaaagaugacuuuaaggguaaagguaauuuaggccuuuuuuguuucuuuuuuuuugguguugacuuacucugacuuugaguaacucaagucauauauuuccaguuuccucuguguuacuccucauuugacaucuuaagaaaguuuuugguuuuguuuuuguaaauugccuuauuuggaggaaaugcauguucuaagaaauuugaacacaaguguauccuugggaugcuauuucucuuccuuucucuagugccauuuuuuacaucacacagauuuggaaacaaaaugacguauuucuuugcauguugugugaugaguggaagaaaggaaaaaauuagcaacucucugcauauacaaagagacauuucaggaucuccgaggggauaugaacucccagguacuaguagacuaagccucuuuacaaccuuacaaaauccuguacagaugaccuguguguaaaaugcacugccuguugcuuuggacaucacuugacacuaaaaagcuaugcauuuuguauuuuugcaugucagaaucuuagccagaggaauuaaaaauaaauauuuaaguagguuccugacuuuuccuaucaaggaggcacugagacaggcaauuugcuuagcaagucuuuuuguucaccuguuuuugugcugcggagaaaugugauguuugcuucugaugauuccaaaugugcgugcauuauauggucagagcagaguauagaaaaugccagugcuaucugugcaaggcuggaugauaacaugugacccgagugacagaaauaaauguguccuggcaaaaaggagucuuaaucugaaugaaaauauuaccacacagugggcagauuaaucuuggcaguuuauggcaauggcccucauacauaaaaccuauucuguguucccacaaaugcccaaucaaucaguagacagcugccccaguguuaauugugaccgugugggacacuuggguaaaaucuucccauguuaaugauccugaauuucuaaauggucuuauccuaaaaauugauucuuaguuuaagcaagauuagcaaugugggccuuucagcuuuuuuguuugauuuuuugaaaauguuuauauauuugggguuuaaacaaagaauuuuuuuuuuauuuuuugccgcgcucagaacaucuuagcuaauauaugagguaauuaaaaaguuacuguagaagucuuccugucugguuugauugaugcuaguaguugguuaaucaaaaaaagucauaacaaauuauaaauacauaccuucuacuuuucauguuaauauuaaaucuguauauauauauuuuuguuuuuuuauuugccaauauuugauauuaggucaaggccuaguugaaauucccugacaucuuucuuguauaaacaauacccacaaugcuaaucuuuaugauuuucaaucucugucucucuaaauuggcaugguaauuuaaagauauugggaaccaaucuaaaugcagaauccuccuagauuuuuacuaaauuuccccaaaacuucuuaguuaucuaaccuacaucagcuuuaguauuuuuuaaugacucauuuugaugaaggccauucaaacauucugcuuaauuuugauagaaacaaugaaucacuuucuguuuaccucguauuucauggauuuauauggaauaaucuguucacauacuauuuaauucauacaguuggaguaaagaggcuugggaccaaacccaguacacuugugaaugugugacucagcugguggggcuagccaugccuggguacauuagagaaguccaccaggaugacucugcagaaugcccuucacaucagggcauguucuacagagggaauggacaucaucaucgcuucauuaagccugucacguuuuuccauaaacaucuacaaauagcuacaggugaaaauggauaaagaauauaauauuuaauauuguuuucucuuuaucaaaugaaaagccagauauagcuaaguaaauacuaacaaaacuguuauuaaaugagguacacgccaacauuaauaaguucugaauuguucguuuuacuacuuuguacauauauuauguaugugguauauuaauugauugcuuugugaagcuguuuaaaauuuuucaacaguagagagugauaaugugccaaaugugaaauaaaauugcagaggugaaacugucaacgacuuaaguguuacuacugacugacagugacaggauucaagaaguaucauagauaccaauaugcuaugucacaaguauaauaugaccagaguggauguggucccugcuaaacaaguuaaacaaaaaggcuuuuuuuuuucuuccuagugcuuuauauuuucccccacuauagaaaaugcaugaagacuuuuuaaauggugacauuuauggccaugauagaugugugcuucuacaagaccaaguccagguguuuccauugggaauacauggaaggaauugauuuaagcaagugauuacuuaaaaaggaaaauuaaaagaguggaaaauggauaggagagaauguuaauugggaggguuucaaguauaaaggagacuuaaggaugggcauaaauguaaauguuaggaacacauuugaaauaacuuggccuuagaaaagagguuuauagaagcauauaauuuaagaacuguagguuuugaaacugagacacacucauugccagacagaauaagaaugaacauaucugaaauuucacugagaaagaucacagauauacagucauguguugcuucacgauggagguauguucugagaaaugcguuguuaggcaaugucaucauaaugcaaaaauguagauuuuuuuuuuuuguggaucauagaguggauuuaaucaaaccuaaaugguguagccuaugacacgccuaggcuauaugcuacagcuuauugcuccuaggcuacagaccuguacagcauguuacuguaaugaauauaguaagcaauuguaacacagugguauuugugaucuaaacauaucuaaacagaaaauguccagcaaaaauaugguauuauaaucuuacgggaucacuguuguauaagcuguacauuguugaccgaaaguuguuauguggugcaugacuguauuuaaaauuauaagaacacacaaucccaaggucauuugauucaggccccaauaaagcacuaaaauaguccaagaaucuuaccuuuucccauuagugaaugaaggcauucuucagacuuccuaguugaacugaugcaaugaucaguggaccuugaaucaaaggaaacaaauuucuguuuaucuuaagccuucucaauugugcuuuuguaugcauucaucuuauucuuucuauuauucuuaacuuagucauccagauugcugcuuaaaauggaaaauuagccuaaaauggagugggcaaacaaacaaaucgaucacuguccagaguuucugaauccuuaacccauuucuuacaagaagagagggaacuauuuucuuuaauauugaaaagacguuaccuggagcaccccuaaucaaccuugguccacaaguugaaugaugcaguagaauuuagaggauucugacauucagagaacagcagccaacugucagaaaaacgguaggagaugguaauaaugaccucgauuuaaggucacuggugcuugaaugcuugcgguauuuuggcacuagcuaugccacguccugcugaucauggaacaggugccagguucacucaguggggccaaaggaacuuugaguauagugacaagaggcuaaagagccucagccgcuuggcuuauaagauugauucuuaauggaagauugaucuggauugggugaaucugugauuuuuuuuguugguagggacuugaaauuggugaaugagauaaacaugaaguucagucuccuuagcagauaacaacagcuuugcucuauauuucugucaccuagcaccuaguaggagcuugacuauugaaugaagaaucaacugaacacauuuucuagguagacuuauaauagaauuaauaucuacauuggauuuguaaaaguaaugaugguaccaguauacauuuaauuagugaggaguacuuccuuugggguuauaaguauaaaaauacucaauaaccucauugcuuuauugauguuuguuugugaagaaggauuaaauaguaucuugccuuuuuuuuccuuugcuuuuaaucauccauuguuaaauagaggcuuaggccaucugucucugccaagaucugccucgauauggaagacuguauaauagagauacuaaaaaaaaccucucuaauaaucuguuuauacuauuauucuccaggcuuuucccuaaaacaguuuuaaguaaauuucuuaccaacuaaacugcaaacuuaucuguuaauuaaaacuauuuuuguugacuaggucgcagugcucuugaggccuguagaaauuguacuuagcugccuuuucucuugaagauaagacagaaaacaggaugccuuguuggguuuaaaaaguaaaauacaaacugucaguuuucugauaucaagguacauuuuuuugagaaucaacauuccaaauggccaaucugguuaacucucagugguauaagauagggcaaaggaaauugacuauguuuugguacuugguuuuauuuuauuuuauacuaagugcuucuuaggcaauucugccucaucaauauucuguagauguaggcaucauuaaccucagugaaaaguuuauuacaagccacuguuaggacuuguuucugaauaauauuucuccaguauuuaaaugaaacaaacuaccuuuacccaaacucagucaacagaguuuaagauuauucagaauauggaaaaauaagguuuagggccugggugcuguggcucucgccuguaaucccagcacuuugagaggccgaggugggggcaucacuugagcccagaaguuugagaucagcaugggcaacagagagagacuucaacucuaccaaaacaaaacaaaacaaaacaaaacaaaaacucgggugugguggugcacacccaugucccagcuacuugggcaggugaguuaggaggauuacuugugcccaggaggucgaggcugcaauaaggcaugauugugccacugcacuccagccuaggguacagaguaagacccugucucaaaaaaaaaaauaauaauaauaagguuugggugugugauuuggggcaguguuuuuggcaugcacggguguauugugggugugcauaugccuagacagacauaugcacaaucugaagacauaauaggcauuuuccucgaaauaaauuuggcucuuagaauugcuuucuucucagucacaugcaaaauauggugaagaaucauaagcagucauaaauacuggcuuguauacaccauucagggucaccuucaacaaaauacaagucacucaauuuuauccagcagucacagugcuggaucuacugugggacucuuaaaauguuucaagugagagcuggauagucauagguagaaucugaguuauacauucugauuuccuuuaugggcuauagauuaacugcaacucugauacuacuucauuauaauccuacugacuucuuucugguaagagaauugccagguacccagcucugaauguccugaauccugucaguagcucuaguuuauaaaggaugauuugcuaaugagauuucacagacaagcacuagauauugacggugauucaauguuguauguugucugagugguuguuuugcuucaggguacuuuuuuauuuuccauuucuuuagcaaccucuuuccccacccugcucuugcagaauuugagaucaagaaguagggcauuauuaauuacauauagacauuauagaauguuuuggggguucuuaaucaaaauguaaaugauaguuuaaaacauaguuugaauacucugaaugccuaguaccuauguagucaguaaauagugauugccgugaggacuacaacuguaucaagacaguuuuauccuaguguucaguuaaaaucuuaaaaaacauaaaauaaaauucuugcuguauuuuaugaguagguuuuaggaaccuaguaagauuuuuaaggcagaggaaccuuuagaaggggcucaaggucacaguuggcacuccugugaaaacgugugaauugccuuccagacacuuuuauuuugccuuaagacugcaacuauguucugucuagggguucugcugacagcacgaccacacaaguacaguuuccuuucugugcaucagcacaaucagagauugcaaugcugcuuguggccauuaggauuuagucauggaauguaaggaaauuucaacaggaaauguaucuggcuuugauauauuuucaucugccguagucgcuuaaccugcaugccuuuuuggugucagcauuuaauucuaggauuucaucuggaauauguguguauauaguuuucuccaucacugucucaaguaacccauuugaugcuguucauguacaggcccuguuaucauuaauaaucauguaagcaguguuagcagguuuuggcaaaugcaccguuucaucuaugccgaggaacauaaaacucuuaucagcaauauaauuuaauuucacuguacguuuuugguuaggaugcagccaacaaagucagcaaaagugcaaguuguuuuuagauggcucaguuguauuauaguuauacuuacuguaccucacugcucuuaagugucuucaauaacaaauacaguaucagugucagcuuuuggauuugugacuuauacaaaugucaaaguagcagguauauuauuuuauuuccaaagagaggcuucuuuauccucuccucuacaugauuaaugcucuuggccagaauuuaagcuggcagggccuggcacauaguaggugaacaaugaauggauauaaccauuguugugguuuuuauucaaggcucucaacaugugauugaaugaaggauaccuagaaauugaaauaucaaggcaauugugaggauaacugaggaacacugggugaagcuuguguaaugucaugauuuagcacaugccuuauuauuuucguaggucucaaacuuaacccuacuaggagagaaacuguauuuggaacaguacaaagcaaauaugucaguguuugcaugugccauucucuuacauuuaaacuaaauaaauuuaaaacauucaacaaagauugagucaggagcguuuuaucugauucauccuuaaaaaaaagcuuucuuuggugccaggcauauaguagacacucaguaaauauuuguuggcacacuagcuuggugcugaauauaagacauauucaauuuuguugaaugaccaauuaaaaauguaggagucacuguaaucacggugggacccauuucucuaaggaaguuucuaauaugacugugucaugucuuugccuugggcuggucuucuaucaagguuguuacugacauggcuaugcuuuauugggguaucuacuauauaccaacuauuauacuugguucucgagcaauaucaucucaucuuaauacauuguacuagugagaauuacaagaaauuucauauuaaaaugaaagagaaauuuuaauuuaauuuuuauauccccaaauuacuuaauaaucugcuaaagggaauaguuguccuuucccucuacguggauucuccaucagaagcucaugccuuugagugauauacuuggccacucagcuggaaaacugucagucuucauaacaacauuuuagauccuagaaccuguauggaacaguuucucaaaaauuucuaccaucuuaugaaaagccacacagaugugccuucauuuuguaguauauuaacaagaugguaaugcauguauguauacaaaucuauccugagagucuucuuugaggguugauugaaaacucacuccucaucuugguuuuguuugcuugauaugggaagcacaaaacauuuaucuuuauguucugacaauagaaauaguaguugguaugaaauacucggugggcgaagcagugaaugauaagggaaauaguauuuugcauguugcauuugcaaaggaaacucuuagaaaaguggcuaacuuuagauuuacuuauacuccuuagaguucacagggaugaauuuagguggagagaugauauuugaaggaaaagguacaggucuacguacaguagacuagauuaggugaucuuguugugcaauauguuuugaaauuacugaugugacauacauuaaucucaaaauaauuaugcugugugaaauaagccggauaaaaagaguguaauaauugauaugguucggcuguguccacacccaaaucucaucuugaaucguagcucccguaauucccacauguugugggagggaccugguuuggugggagguaauugaaucaugggggcaggucuauccugugcuguucucgugauagugaauaagucucacaagaucugaugguuuuaauaaagaggaguuucccugcacaaguucuguucuucucucuugucuguugccauguaaaacaugccuuucaccuuccgccaugauuguaaggccuccucagccacgugaggccuuuuucuuuauaauuacccagucuccaguaugucuuuaucagcagcgugaaaaugggcuaauacaauacuuuaugaaucuuuuucuauacaauuauuuuaaagauucaaaauaaaugacaaugagugagagaaggaggaucaaugacugcuugagaggugguggauggugcugcuauaggaaggaugacagauggguaccaggaauuuuuagaagugaugaguauguuucuucucuugauuguggugauguuuugcagcugcguacagcugugccagaacucauuaaacuguacacuucauauauguggacuuuauuaugcauuuauuagaccucaaucaagcuauuaggaauaaaaugcaauuuuauggcaauuaccacauuauaaucaaguaauuaucuagugucugucuguuguacuggacuguaagcucccaaaagacagacuuuuuucuguuuuaucuguguucucaaugucuaaccugugagagguuccuauuaaguacucauuaaauuaaaacauaguuugaauauaguuuaauacuauauuaaacauaguuuaauacuuuugaguaaguaaauagacguguuauuuagcuaaagcacagacagcuauuauugacugagcacuugccauaugcugggugcugugcucaaaauacauuauguuaugaaucgucacaaacaguauuuuugggaaaggcaauuuuguuauccccauuuuacagaaaagaaaacagagcuuagaacaguuaaguaacaugcccuagaccacuagcuaauaaguggacaacaccgaaaucaaggcugacugauugaaagucuguggugguaaccucugcgcuuggacccuuuggcaucuccuuauggccuguauagauuuuuaaagcugugacagggaaauuuucaaggauauaagacucacuuccuagccccacacuuucaacacaaugggaacuucaguaaacauuuaaaacugaaugaaugaacccagugcugaaagucugggaaaaucuuuuuccuucuguuuacuuucccgguauuaauagagcagcguuguuuuccuacacguggcucuguuuauacuggcagaaaccugaaugggaagcaggcugggguacagcaggagcgaaugccuuugggggagccugggcuucugccagcacaucuagcugggguuccugaaaggcccgagggacauugcuucuccauugucauauuggagauuuuguuccaggagggggaugaagagagcauauauuucaauuuucuucacaguuguauuauuuguuagauuccucuaaaagacaguugauuuuuguaagccaguauuaaaauuccaaaaagggauuacaaaaauguuugcauuguaauguuauaacacaguuggaauacacuuuagucuucccuuuugguuauaaugcuaucuuauaagaauuguagaauacaaagaaugguuacaugucugaaaauaauauauauauuucuucaggcaauugguguuuuuguguucuuaaaaaagccauuacagcaucaguuugucucguguguauauuuuauaguaguacauuaaacacaaacacugacaaaaguuuuuuaguuuagcuuaaaagcaguaguuauuucucauauacuauuagguagaggucacauugggauuuacauggacugcuguuuucccuguugaaagggcuacuuuaaacaaauacuugaaauguuguauagccacauuuaaaaaaaaucccuuauaaggauauggaauauaccacugauuucauuagaccugucauucacugacauuccccuauuuauuuauuuacucauucaaaaaauauuuaucaaggacacuuuaugugccauggucugugucaggugcuggagggccagugaaaaauguucguaagugacaucugcuuuacugcaggguacuugucguuuccuccuguaguuuugcuuuuggagacauuagauguaucaaaauuguuaauauuuuuauauuugcuuguaauuucuuccaaauucgcagguuauuuaggucaacuuauuugaccuuacuguccucauuauauuauauaauauguauuauauaauauauauaauauaaaaucauauaauuauaugggaaauacuuagaaaauauagaauauuaauuucauaaaaugggcuaguaacuucuuauccuaugugaguuauauuauaguguaccucagccgggcgcgguagcuuacgccuguaaucccagcacuuugggaggccaagguggguggaucacaaggucaggaguuugagaccagccuggccaauauggugaaacucugucucuacuaaaaauacaaaaauuagcugggcgugguggcacaugccuauaaucccagcuacucaggaagcugaggcaggagaaucacuugaacccaggaggcggagguugcagugagccaagaucacgccacuuguacuccagccugggcuacagggcgagacuccgucucaaaaaacaaaaaacaaaaauaaacaaaaccuaccucaggaaaagaguaauacgaugcauaaaguauaagagaacuguucaguaaaaucagccugcuuucugaauuugugccuguguguguguguguguguguguguguguguuaguaauuuaaacuugagcuaaaucuguuuaguuuuugauuuguagguaguuugccuauaacuugaucucucucucuuuuuuauaccuuuuuuuuagggucagagguacauaugcacguuuguaauaugguuaaacuuacgccacagugauuuguuguaaauauuauugcaucacccagguacuaagccucguacccaauaguuauuuuuuccgauccucagccuccucccagccucuacccucaaguaggccccagugucuguuguucuccuuuuugcguugcauccauguguucucaucacuuugcuccuacugaugagugagaacaauuaguauuugguuuuucuguuccuguguuaguuugcuaaggauaauggccuccagcuccauucauguuccugccaaggauaugauccauucuuuuuuauagcugcauaguauucuacaguguauauauaccacauuuucuuuauccaaucagccauuaauggguauuuagguugauuccaugucuuugcuauuauugugaauaacgcugcagugaacauaugcgugcaugagaacuugauuucucuugagaugacuuuugaaugauuuccuuaucuuuguguucuggauugaaaaugcugaaggcuuuuagagugauaauuucuauuaaucucauucuagcaaauuaagcuucuacaagauguagaggaguguuuuuguucaagaagaagggaaaugauuacaggcaggauuucuuuuaacuggcaugaguggacacauuagagauguuuagggaaauucuuucuauaauguauugggaugaaugaaaugaaugcauaaaaucuuauaauuaaguuaauuauuacuaauuuguugagaguccuuuuuuaaugauauggagaaacacucuggagacaguuaucuugaaucacucugaaggugguuaucuugaauuucaguguuauuugaaaaccucuaguuauuauaguccuauaguuuucagagauauaugugauauacauaaacuuggcucuuucccaugaccucccuauugcuguuuagggcuuaggucacuuuauauuguaauuauugggccaccuguaaaucccuucaaagaaaggacuguguccuauugaaguuugugucuccaaugcucccaucagggcuuuaagcaguuguuggcuguccuaguagaaggguccgucaucaaggcucaguaaccuccuaccauuucuugacccuccuuccuugcccugccuuguccaguuuauuuccaggucuuaagaauaucaggguuauguggguggaaagaaguugcuucguccucuguugcagacggaucuaggcuugcauauucacuugaucucuuaucaacugugugaccuucggaacauuacauauucuuugugccuuaguuacucaauuugaaaacaugaauaaucaugcuuaauuuauagagucgugagaacuaauuaaaauaaugacuagcaugauugucacauaguagguccuuaguaaaugauaguuuccccauaucuuuuaaucaguucaccuucuucaguaauuuuuugaaauucuuucacugcauuagauucuuguuaacuguuuucccuauuguuuagucucuucugcuuccagaucagcagagauauugcugccagauuaaauguuuauuaauuuuguacugugugcuggacacuagauuuuuucuuuccugugcaugauuuuaaacaaacaaaaacagcccaucacugcuucgguucacagucuggccguagccuaguuuuuuagccuuaucuugugccaugccuuucacauaccuaacaauccuuacaaauugaauacuccuaguuccugauuguuaggaauugggaugagacgauauccagggacucaggaaggcucaaaucccauccuaccaaucacgucuacccacuuaccacccuccuuucccaaugcaaggaggagcagaaugagaaucugaauaccacucccugaaccuccaggucagagcucugauaaaagcuggauuggauuauggauugaggcaugaacucaagucacccuucaacuucucugcguauucuaucucagucugggaaucuuacuaguuucuggccaacugcacuaaagauugaaguugacaugagagaaggagcuugcuaagaguugauuucaaagaguggcauauauaacagucuugcauuccauuaacugaaccaaaagaaagcuuuaacaaaauguuauggaauuaauuaaacuuaaguuuaaauagcaacaugccgcuauuuagauuuaauuaaguaaaauuaaaacuucacuuccacaguugcacuugcuacauugcaauucucaaucgcugcauguggcuagugaugucuguauuggacaaugcagauguaaaguauucccaacacaggaaguucuguuggacagugcuguuauaaacacaguaacaugggucauucaucaccaguacauuacagagaagauuucccuaaacaucucuaauguguccacucaugccaguuaaaagaaauccugucuguacccauuuccguuuuucuugaacaaaaacacuucucuacaucuuguagaagcuuaauuugcuagaauuacauaaauagaaauuaucaaacucaaaaagccuuuagcauuuucaguccagaacacaaagauaaggaaauaauucaaaaguuaucucaagagaaaucaaguucgcaugcacgcauauguucacugcagcacuauucacaauagcaaagacauggaaucagccuaaaugcccaucaguggcagauuggaugaagaaaaugugguacauauacaccguggaauacuauggagcuguacugccuggccuggaaaucuggcugugacaggcacuagcugagugaaacuuaccucugucuuaccucgacugcaagauggggauaauaauaauaauaucuauuucauauggcaguggugaggauuaagccaauuaguguaaaauacacaaaaauacuaaaaacagugcccaucacuguacaaugcuguguuuuuucuaccuucuccugcuccuccucuucuucuuccuaagucuucucuguuguuuuacuaagaaacacauauucuuugaauauggaagagaaaggaauuuacuuugcucauccuguaauauuuuuccuggagaugagcucuuagcuggcuucugggaaaagaaaauauuuccucuauuuuauccagcacucugcauagccugugacaguuauauaaaaauaucaguuuagauguguuagagauuguuuuagaagacuauuccauguaagccaugcauugguucauucauucauucuugcacaagugcgugaggauugcuucuuaaaugcagggcacuauaucugcaucagauggggacuuagaaucaucauuccgugcugacaagcccucugccaaagggaucaguacuccacuuuuguauagaacugggacagacuuuccgucacaauuuuguuaugaaacugucaggugagauguugcacugaauucccuuuaguagauuuauacaguuucagagauuuuguuaugguaacuugggggcuuuuaauuugauuuuauuggauucuuuuuuuagacucuuaaggcagugguguuuucaucacuacaucugcacaauuuguuauuggcauuauugggaauugcggauguaaagcagucuaugacuuuugggaauauuaauaaacuccuaaaguacuuguucaauuagcuucucugaccugcuguccagagguugagcugucauuaacugaggaagcuuccuaugguuuaagugguggugaggaaaaccauugucuuucuuccuccucaucuuugucuugccuacuucauucacuacuuucuugggagcagugcaggaagaggccguccaauuccagagcugcagaggggcuccuaugcccuagagaaugagaaagagcaugcugguuagguuuuauauuacuacugugccuauuuuugauuaagagaauguuuucuguguguccagagguuuaaaagauuaauaauuuauuuuacauaucuggagaauugcuucucucugccucaagcauuagggccagaguucuguauuuuguuugcauacaauuugaaguguuuucucuaggucuuauaggggagaaucugaagacuucauugcucgcugauuucagucuuacugauguugggcucuuagaucagcuugcuagaauacaaaaauuauucuuuuaucgugacaccaaauucuguacccugggacuccaaguggccauugaaagacuuggguuuaauguuagugccucaugcuaucaacugccuaucuguugugaaauucuuuuguugucagauuugucguuuccuuuucagauaguagaucaucugauuuagagcaugaagguacgucuuccuaaguuucuaugacagaaagauauugaagaagaaggagaaaagccaaauaccagagaccagacaagguggcaggaaauugcaaacaugguggaauuuccagucuuuuucauuuuuugaagucacagauaauuuaaaaacuacucgcuuuuacuuuuuuuuguuuguuuccuugcuuuugcaaccaugucuaucugccaaccuuucuaaaaugucaugauguaauuauuuuaacaggcacuguaugcuccuuuauuugggggauauuaaccuuucuaaacaaaaggaauguuaauauacacuggaaacacaacuaaugggauuucauuuuucuuguuaggcaagaagcuugacuuuuuuuuuuuuuuuuuaacuucucguaaaagaaugcggcaagugaaauaauugccuuaagcuaauccaugauagcgauuuuaaacgugacuuuccagaucacuuuuauauggcuuagaaagaauaaugugauuuucuuguuuuuguuugcuuuagcuaaacaguguugaaggaugauauaaauucaaugaauucaaaacaaagaaaaugcuaauugcuaaugcgcuaaguucuuuuaaggcaugaaauacaguguuuaauucauaagcauuguuucguuuuauauagauuuaauuuuuuuuuuuaguuaguaugggacaaacucagaauaaauuagccagcuagccauuuucuuaauuauuguguauuccuauuugauguuuaaauauauaugaccuaaauauguugugguuuuuauuaaaaaaaaaaaaaagaaaaaaagaauggucauaggcucucagauagugaggcaaagcacuuuuaggauuucuacagggcaccuccucucucccuggcuuuccaccucuccccuucccugccuucuucccuccuucccuuuaauauccacugaaccauuuucacauacuuccugaaucacccuuuugaccaauagcaugcauuugccauggcauggcuaggcuauacaucuuuaauguuaaagaugguaaggcuggucaggcgcgguggcucacgccuguaaucccagaacuuugggaggcugaggcgggugcaucaccugaaguugggaguucgagaccagccugaccaacguggagaaaccccaucucuacuaaaaauacaaaguuagccagucaugguggcacaugccucuaaucccagcuacucgggaggcugaagcaggagaaucgcuuaaacccaagaggcggagguugcagugagccaagaucaugccacugcacuccagccugggccacaagagcgaaacuccaucucaaaaaaacaaaaaacaaaacaaacaaagaaaaagaugguaaggcuaugaaacaaaugaagacuaauuggcccaugugguguaaagccaugacuuuggccuuuuuauugugaacuaccuccccgacaguuccauagacauguauacucugaacaaaauaugagucauuaaucccucuaauggagggaccuagaacagugaaauagggaggacaggaaggagaaugaugcugaauugaacugggaucuucuugucugucaagcccuugaacagcuuucccuuuaagcaacaaagaugacaaguuuuugcuauuuuggauuagugagaguguacgaaaugguuucccuuuccuuccaggcaaaaauaccaacagaaucuggcuucggaaugaaagugcuaauuucauuuggugacuuucagauuugaaauacgggcuugaacaggcauugugcauuagucagcugaggcaguggagguuauuuuuacgaugcuaauuauuauuuccugacagugauuuacuuuauguugucuacuguuuacgcccccaaacuagccauuguuuuaggaacagaauugguuggguugucaugcucuuuucaaagacaaaucuuacuauuuuaugcauagaaauacuuuccuguaauaaagaagaaagcuuuauugaagagaaucuugcauaugaaauguaaucuggauaaauauucaaaacuaauagguuuauauuuuagucuugauuuuuaaaguauauuuuucugacauccuaaccaccuugcuuuaugugcauuaaaguuaaaucuguuuuacugggaugcggcugaauuuuuguuacucacauugaacuuagaaaggagcgacacauauaguuaacaaauaaauacaaaaugaaaucgaauauaaccccuugaugcguaaaggaagauaaguggaagacagaguugauugcaugucuggaaguauaucugccugauuuaugcucuaauuuuaguacugaguuuccuuuguaauaguaaaaugucacauuagcaugucccuuuuaauaaucuaauaugcuaccagugacaauaaauacaugcacugagucuagcucacgguuucucaaacuucagaggcccaugacccuucccgauguaguuaaauugcccagaugacccuccugucauauauuuuuaauuguaaagcacuugaaauuaaucauguuuuauuucuuuuuaaauaagcaccucaagagcaguggugagcaguuuugcucacggcacuuauccacucuuaaagaaaauuaaagauuggaaagggccuugcgucucaguggcagcaaagccaucuacaugggggaaaacauagcagacaagagcugcguuugauacuccucuacacagucucuugccugugcacuuagugaaaauuggcaccggugaauauaacaaaguaaaagcauuuugaauuauuaccgcaagccuucaaguggucauaacccaagauuucaaguaccucagugaaggguaagguuuucuacaauuugugugguaacugagugccuuuaauuuaaacuacacggagcuaaucuuuaggagaauuggaaucugccucugaacuaauuaugauuuacagaaauugauaauuugucuucugcaugugucugcaggaagaaauuacuauuaaauuugauuaacaaaugacagauuucagccuaguaauuuaccaucuuuauuagcaaacuuagaaaacuucuuauaguaaucuuuucaaucaugucaacucuauucugguaguuaagguuuauguagaaguaacccauguguguggcuuuaguaagaaccuaccuuaccuuuaacaaagaaaucuuggugugguuucucuuuucaauaggcaagcacuacucaaacgcucacacugauuucccaugguacuuagaacuuaauaauagguaauuaacuuccaaaaaugaauaaucuguucuuuugaauacauuccugcacucccucaaaauauaugaaauuguguaaaaggaaguagagcauuauaucauauguucgccuuauuuuucgugcaccacuuugucaaauguuuuucuuucucuucaaacagauuguaauuguguaauggaggauacuauuggcuaaagcagugccauauauaugauugacauugugaaugauucugaauccuacuuuggauguacauaacugagauguaaaacuauuguagcauggcaguauagugagggcauuaaacuuuuccuuacaugagugacaugguguaguuuucaaaaguauguuaauguacauguuuuuauauaguugaaaaaauauuccauugcacuaagcagccuagcagaauuguuacagugguuaaaaaugcccuuuuauauuuucaugucaggaaaaucuuaucuucuugcaugucaaaaagggaauuugaacuauuagccuuuaaagacccagagguaaaguuuaauuuuauaaugacauaaaauaaauguucuauuaucuaaguaauaguucaccagaaaagucugaaauggccuccuuucucaaggaugcagcuuguaugugaugcuaauauuaaaauggaccugccaaauugagugaugggaggugcuaauaacuccaaguggggagaugaaaacaacauauugcacacaccugcucucagcuuuaugucagucucauuaaguuauugaaugggugaguauaauggggaaggaggggagucagacguaugccaagaagcaguugggggggcuaguaccccacaacaugaugaguaaacggauugucuuuggcgcaggaagccugcuugucacugugguucauccaugaccuuugaccugaggaugcaaaagaaguuuagauucuuuauagcagucuauccuggagcguuguguuggcaaugaagauuguuuuauucacuuguacccgcaucuuaguuuacugguguugcauugagaguauauguuuauaugcuuauuuaguuuagguacucuaaauuucguucugucucuuucaccuuuaggaugaaucaauaggguuuuuuuuuguuuuuuccuucugacaauguuugguauuauuauucuuuguuaaauacggcuauacauagucugaucugggucaaagaaagucauucaggcaguuugcuaacaguuguugcuaguaauggucacucuucuaaacuggaacaauugaacaccaacaaaacaaaaacuuaggaacugaauuguggggcaagcccauauaaggugugauggauucugggggacuccagagguuagccggugacccuuuggcuugauccgggccucucucugacagcuuucauucauuuuaaagaaaccugggaaaaguugauauucagaaagugcugguuagcugucuguuacucaccccaacaaaaaagaaguuucaugaaaugucuuucaacaauggaaaaaaauaagaaaaaacaaaacaauaagcaggccaggugugugugguggcucaagccuguauucccagcacuuugagaggcugagguggggaggauagcuuaaggccaggaauucaagaucagcccggggaacauagcaagaccccaucucuauagaaacaacaaacaaaaaccaaaaacccacaauggcuuccugaaguuauuuagaguugauuuuguaauguuuuaugaaauuuuaccccaguagguuaauccaauucuguuuugcuuauucugacuuugacauucacuugcaguccuuaagcacguaucuuuugaauacaagccaagccaugcaguggguggcaagguaagucaauuugggauuaaaaggcugucagggauaaugcugaaccacauguggauauuugagagguggcugcaccccacuuugcucucuguccagcuugcaaaccgaagucucuggaaaaaggaacuucuuaagguaauaugauucacgugagcagaagagcccaucagaggcugucugguuucaguagagaugaucaacagauaauguacugaauugguaggcauaaugaggauacaaagaaaagacauccuggaaaccuaaugaagacuucacuuuauuaucuuuucagauaauugcuuagaugcauguacauuuuccuuuuaaauuuagaguuaaaaaaaaucaaguugaaacacaaacauaauuuugagugaagaaaugcuugagcaucugggagguagagcaagaggguccuuggaaggguauggagcagcacagugaggcugugacaaaugucccccuagccacuggccucuaucaacccaaagugcuucucagaaaacaaauaauaaaacaaacaggauguaaacaucagcaacuuaaguacuugccagcucaguuguugggaguggguaaagcuaaagauuaaagacagcuugacaaaauccuacacacuauccagcugaguuuuacacauuaugagaugugguaggacagaaugaggguguuuaaaaaaauuauugcuauuaugcagcuggagggcaaugggcugaguugggaauaugccaggagaacuugugcugcuuguguagauaaacuuacaggacuucagcuuucaaccccauccaauucuuucugucagauucucuuaaccuuguccugucccuugcugagcacugacauuuucagagcagaggaaaaucauguuaaauuuauguaugaggagggguacaucuguguguauugcuguacucugguuuuaaauguuugggcucuuuugauuaguucugcccuugguuuauuuuguagucucagaagugcuuauaaaccagugcugguuaagagucuaauuuagcuucuccucauguucuuuggucagcgugguggcagucuuuuguggucgugcagaagagccucagccccugcugugggacaaaggggaccaaauuguuugcugucccuagacagccuaggccuguugcagcccagauggugcuuuuugucaguuuaguuuauugggauucugccgaauacuuuguuugaugagagaguuuuaacacugaagaaugcaugaaaaccugggaugcuggagaauugugagagaugggcuuggaaaggaagauucaagccaaauuguagaguaccuugaaaccugacaaaggggaauauauuuuuauuuuaucuguagacacguaauggggaaacauugaggaugacugagcaggagagagaccaugugaaggauggacugaauggagacuuguaucaaagagucugaguaucaaagacuuguauuagagaggguuguuguaguaaucuagucaggguaugagaaaugguuuguauuagagugucaggaguagucguggcaaaaauauauagaucaggaugagggaugggccucaucucacacccugacuccagucaauggcaguggcucccuggaguacacuacuauaggaaggauuuuguaaaguuuugucuggccucaguggagggugagguaggggaggaguucuaugaacaguuaguggugucugccaugguugaaacaauggagaagggggacaccuuuucugugcagauguugcuucugguagauauaauccacaauguaaugggagaaguacuaagaaucaguaaauuauggaggguguaaaagacuacugauauuuaagccuggcggaccggacuuagagaaaugauaguuaaaggagaaauauccagcaaacaaagauaugacauugaaguuugggacugcgauuaguaccagagauuggauuggaggugauuuguauagaauggauaggugauuuuacucuugcaauuuggauugagggugggaaaccagagagggcggggguaaauuaguagaggucaacuugaauucuguguccauaucaaugcugaacugauugugaacauuuuuacaucuugagucacauuguaaggagaccagaagugaauugagcauaguaagcauuuggaaguaggugaguguuugggguucucugucuacaacuuuuaaauuuuaacaaagcuccacgauacucuauuuaaacucuuaaauauuaccuuguuuauuaauuaccaaauuuuaguacugacuugagcaagaggucucuugucugcuauuuugagauuauauagaauauugacacuaagaagaaacucaaucguaacuccuauuagagaagaaaaauaacucagaagcguuaaaguuuugcccaauaucacagagauaauagguagcaugguugggccugagacucaggucuugugauuuucauucuaagugcuuuuucuguauucgaugcuauuuuuuuuuuuuuuuuuacaaucuguaugauacagauuugaacauuauuuauagaaauaaaggauaaaugauguguauaaucugauagaauaauuuugagaaaugcagauauugauaguccccagcuuuuucccuuuuuauugugcugauucauuuauauauucauaaauguauuuaaaccagucucugaauauuuaggucagugcuagucauuugcucuuauaaaugggaagagacuguauaaguuaaccagacugucuagguuuaaaucugagcucuuccauuucuuaccuaugagaucuuugauaaacuucuuaccuuuguguuccaguucucuuauuuguaaaaugaggaugauaauggugcuuaccccauuggguuacugugaagguuaaaugaggguggauauguaaaguacuuagaacagucuuuggcacauggcaagcucuauauauguaagaucauagccuugagaguugaccuuuuggauucaaauucuaacuccaucuuuuacuaguuguuugaccuuggacaauuaacuuaauuuuucuaagcuuagauaacagucuguaccuuauagggcugcuacgagaacucagugagauaaugcagauaaaguacauucucaaugcuugacuucaaauaaggacacaauacaagauaaucauuuucauuauuaccaucauaaucuucauaaugaagaauaauaugauaaugaacauccaugcacauaaccccuuguaucucuucaugaauguuuccuuaggguaaguucuuagaagugaaauugcuaucuuccucuugacuuucuacaaggucuuuaaucuuuacaaaguuuuguauauugaaaaagacaagcucuuauugaacacauaguaggugcaauuuaccagcauaggcagaggagguuauauaagguugaacauuucuuugucuauauugacuuuguaaucuagugugagaguuaagaaaugaaacuaacugugguaaaauaugcaaugugagauauaucuuugaaaagggacaaaguacuauggaaacacaucauuugaagagagaaauuucagcagagggaaaucaggaaagacuucaugcaagagaugaaaaaauuagauaucuaugaugcauaguguuuugauagaugaagauagugaagcauauccuuggcauagcaagguuugucauauggccauuucugucacuggggccuuaggguuuaagugcauauacuagcccuugacuuuggagacuuagagaccgguaaggagcuuaucuucucuccacucacucuguuccuccauguagaaucucuuuaucuuccuuccaucuccuucaggacacaggcaauguuuggauuuccuaguuucucucagaaacaugauacuacaucguguauuacuuaagacagauucaggccagaguacacauacaacucuugaguuggucaaauuggaauucaguuucuagguucuccaugauuacuuuaaucugauuuaucugaagaaaaguuaaucuguugguaugaucugauggcaaggcuuuacaaguauauguguuuuaauguagucgcaauuuuuaagguaaguuaaagccuuuccaguuguuacuuauuuuucagugacaggacaaauggcuggcauaauuuauuuuuguuuguagauggauauaacuggagaucuuauauauuggguaugcauuuuuuaugaauuuauagaauuuuagccuaagacguuggauuagauguuaaagcauuuauguugauaagcaagaaguaaauuguauucugauccaguuuguauaauaaugugcaaccaacccaauucacuaaguuuguauugguaauuuugcauugcuaugggacuuaaguuacauauauaagaguugacaguuauuucagcauguguuagacuugaacuccagaagguuaaggggaaguucugcuauuuauuuucuguucaaaaacagaugaaaaaaggaucuuuauauuauucucugucacacaccgguaaauacauggucuucccaaauccaccacgaaccaaugcugugagcugcuuaguuugcuuguuucccuaaagcuuucaugugacaaauuuauaauuuuguauguuauuucuaggucaacaguuagauuaauguuuuaucuccugagcaaaaacacagugcuucuuuguaaacuuuguuaucuuacugaaacugaaaauugcaaaacaaagaauuuucuaguucucacauuccuugauggagaacaguguuuauauagagguuaucuugugguuuauuuuauauucuacuuaacuuuaacauuucugcagguagaauaaauauccuauuuaaagcuuucaaaucuuauuaauuaaagguaguugucauuacuaauuguuuacugaguuuuauuuauuuuugcuucauuguagcucaugaggaggccaccuaaauugaucagaauauaagcuuauccuagucacugaaauaauacuuagugccggcaacagaaauauacucaagaaauauuuguuaagugaauaaacugauaaugaccuaggaggaugcaagucuuaaaaaguaguucagaauaugcagauuuuaccaucagucugagaguugguaacuuagaacauuuucuauuugagcuaguaugaauuuaauuuuuuagaaugcgacgaugucaucaguucuuaaguaggccugggaacucauucuuuuugaaauauauuacauuuuagagacuuuauaacaacauuuucuuccauuugcauguauugacaguuuuuuauguucuggcuggucacagugggcucaugccuguaaucccagcacuuugggaggcugggaucaccugaggucaggaguuugagaccagccuggccaacauugagaaacccccgucucuacuaaaaauacaaaaauuagcugggggugauggcacaugcuuguaaucccaguuacuggggagguugaggcaccagaaugucuugaacccgggaggcagagguugcagugagccaaaguugcgccacuacacugcagccugggcgacagagugagacucugucucaaaaaaaaaaaaaaaaaaaauauauauauauauauauauauauauauauauaauauuuauuauguugugugacuccacucugagaccaggggaaauuugauuuuaaauaaaucccccuuauauggcguauauuaugaccuggcuuuuuuuuuuuuuuuucuuuccacaaccccaccccaaaacacuuaauacauuucagcaacugaguaagcuucaucauuaaaaacucuuagcauugccaauucuaguuauuuuucagaguguuccuagaaagacacauccuaaaagagauugucaugaaagauuuuguauuuccuuaaaggaacaauagagcuugcauuugugaucaaagauggaacagagauaaucauagaagugacccaaaugccauaaaagcaaaaauacagccauaaaccuacacauuauuuuaucuuuauuucuauuuaauaaacauuuuggguauguacagauaugaaucuuagguagucauuaugcucagguuuuucagucauugagggaacacaugauugcaguggacuccagaugucgucagccagaguucaggauucacacgggaacgcgagcuuuauggcagcuggguaauuuggaaucucaucuuuauaacuuggaugccuggucuggcaugguagaguggaccugaugaguaggcugauuugaaaucugaucugagguacuuuagugaucuuauuggaaacaaaagaauaacuuagaauacguggagggaugaauacuuuuuuuuuucuaccucuuuuauacuaaaauacuaugaaucucaguugggcaugagagguagugaauugaagaggguuuguguccgagcucucuggucaaagcuuggauuuacuuauucugugcuauaaauuaaaaggaaauacacucucuuaauugguggugaagagacuugcugaaaguugcccaauuuguaauuaaacuuuggaucuaauauucuuuuuuucauuuucuauacuuugauauuagauagcugcuuguaugacuauacaugaugaaauaauuggauacauguuaaaaaugaaaacuaaacucugcauaaguaaaauuagugaagaggcagaagguagggguggccucuaugaagcagguaugagaaaagcuccaugaaguuaugauuacauuuguuugauuuuuuuaauuacaccauguuuagaugguuauuuaaaagaagguggacaugaacucaucauuuuuuauggcugcauaguauuccaugguguauaugugccacauuuucuuaauccagucuaucauuguuggacauuuggguugguuucaagucuuugcuauugugaauagugcugcaauaaacauacgugugcaugugucuuuauagcagcaugauuuauaguccuuuggguauauacccaguaaugggauggcugggucaaaugguauuucuaguucuagaucccugaggaaucgccacacugacuugggacauggaugaaauuggaaaccaucauucucaguaaacuaucgcaagaacaaaaaaccaaacaccgcauauucucacucauaggugggaauugaacaaugagaucacuuggacacaggaaggggaauaucacacucuggggacugugguggggucgggggaggggggagggauagcauugggagauauaccuaaugcuagaugacacguuagugggugcagcgcaccggcauggcacauguauacauauguaacuaaccugcacaaugugcacauguacccuaaaacuuagaguauaauaaaaaaaaaaaaaaauuaaaaaaaaaaaaauaaaaaaaauaaaagaagguggaacagaccucuuuaaaauagaaaguacaggaucuuacaaagcauauagcacuugcagucuccuccccucuucuuaucacuuuuaugccaggaaggauuaagaaauuugaauauuuggagacaaagcagugugagauguaauugcccaauacugaaggagaguugagccauagcacacaccacaguagggaugcuauaaccaguuaugcaggcggagacacagugugcuuccuacgugugagcaucugccguuggucagugggggccuuccaaaggcugaagugauuaugauacuugaaaacauguuggguucaaggauuuauaaucuauuuuuaaaagacaguaaauucaagguaaaauagaguacacugguguguaccuuagauauuaguucuuuaagucuuucuccaaaugguaguuucucuaaaauuugagacaugaacacuagguaauuuaguauuaggcaaauauuuaaacaguuuaaaugaguuuauugcauccuggcucuauuacuuacuagcuguguaaguaaccuuaggcaaauuauuugaauuuuuugcgacuuaauuuucuugucuauaaaagauauuuaacaaugguuucuaccucuuaggguuuuugugaauauuaaaugaguuaacauaugcgaaguacuuagaaucguuucuagcauauaguaacaccguacauguguuagcuguuaugauggugguaaugauguucuccuccuccuccucuuucuccuuuuccuccugcuaacauuuguagaagugugaacuuucucucaauucaucuacucgcuucaucugagaagagccagucuuccugaccaguauuuuacaacccgagauacccacuuagggccaaccaguaugcuaccagcuuugagcuuagguuauuuccaaccaaucucuuaaaagccggagucaaaauucaaccucaguucaguaaugguaauuguuuuucucuggucaucccuaaggugauuuauuacuagacguaucaguaugacccucucauaacauuuuuaucuauuaaaaguuuccugagaaauggauuuuuaauaaaccauuaucacaacagcauuauuaucacuacuccaugguguauuaauuuaaccacaucuguggcccucuaguuuauuuauaguauugugauagaagucauggggaauacaaagagggcaaaaaagaaaaaaauauauguauaacuuaguugggaagacauaacaaaugcauaucaaacguuaaacagcauuaagaaaaaacauuaguaaagagccaagggagguuagaguaaggaaacagaaugccugcccuaagucuuggggcagaaauagaaauauagaaggcaggaucucaauacacagaaaggaggggugcaggucgaaugguggaggaagaaugucuguggugcauuaagagaaaccaugagcaaguugguuucucuggaaaagagaggugcuguugagaacuaauaggauagcaaguugguaaguuuggaagacagacaauuauguggaaagaaagaaauucuguuaccugcaacaccuaaugucuacaaccuaucaaauuagcacauguauuaagcacugauaaugccagcuaaaucucagucagaagcuaaggaacuggagaacaucaaggaccuaguugcagaagcauaucagagcugcuggcccugaaaaacccugaaagagccgggaauuaagaauuucaucuuuggacucagccaagcuuagacagacuugguuuuaaacucaguuuagcuacuuacuaguuguauuaguggaaacauuaauuaauuaauucucuguaccucaauuuccucaucuguaaaauggugauaagguuaauuugaagauggcaucuuugaaauguguaaggauugaaugaaauggguaauuuauguaaaguucuuacaaauucaaauauauagucaguacuuacuuaacgguuacuaauaauaacagcaacagaguauguuucaaccagacagaauaaguucaauuuaauuuuuuuucaucuugagaugccauguaaaauguuaacuaauguuccacuucuuuaagaaaaaguuggaaaaacacucauacuuauuuuuaaccuuacuacugugaaaugacagugcuucuaauucuggcugugaaaucuaguaauccuuuuaaaaggauuaaauugugaacaaacacaucaggaaagaacuuaaaucuaguguuuccugacuuauuuugguucugauuaauuaaauuuuuuucagaaaggguagaaaccaagaguagguauaauugaagaguuaaucagaaaauuaaauaaggguacucauuaaccaaguguuuuaguaauagagguuuuacuguauuaggaguucccacuuguucuuuuucugcaaauguggcagucgguuuuauuuuuaaaugcugacauaaauugaaagucuuuuauaaccucugaagcauguuucgcaaagugcaguccauggauccuuggaggcucccaaauuccuuuugagggaucgaugagaugaaaacuguucucauaauacuaagacguaauugccuuuuuuggguguguugacauuugcucugauggugcaaaagcaaugguggggaaaguugugggagccuuagccugaaucgaguuaguggcacuaaacuguccuagaagucauuguauucuucaccuccacauacaguaaaaaagaauaucccugaugaagcaguaaaaauuauuaauuuuaugaaagcuugaccuugaguuacauguuuuuaaaaauaguuugugugaaggagaauuacaaauaaagcauuuuugcuacauacuugucucaaggaagaagacuggggagauugaguuaaacuauaguuauucagacgcguauuuggcagacauuuucuggaaagcagugagccugucauuuuaagagaaacaauggacauuguugucagugauaaaauuaaagauuucaaguggaaaugugaauuuuuuaaaacuugcaucuuccucugugaacuugacagcuuccuaaugaaccauugacuuuucuuaugauauugguggugauacuaaugaaugugacuuuuuugauacugaauaaugaaaugugucaccauuuggaagagugcugcauaacucagugaacuaauauuuuccaaaugaccagugcaugauuuuaaaacaucaugaguggcuaaaagauccauucaaagugcaggauugacuaaugaauuuuaaugugacagaguaugagaaguucuuugaugugguuucagauuccacaauccaauuuaaccaugaagaagccaccacuuguugaguuuugguauaguaucaaaggagaauaaaaccauaauuaucugaaaagacuauuaaaauacuuuuccuuuuacaacuauauauauacaugaggcuauuuuauuucccauauacuucaacauaaacaauggaucacaacagauugaaugaagaagcaaaugugaaaagccaauuguucucuauuaagccaaacuuuagauuugcaaaauucuuuucuaauuuuuuugcuguggaaaauguaguuauuuucacaaaaacauguccuuuguguuaacacgcgauggguuuauuaaguggauucauaagauucuuuaaaaaauauuaucaguuuuauuuuuaagaguuuaaagugauccugacauuaugaacuuugagaaccacaccccugacgugguaaaauuaaauuuuccuaugaauuuuuaugguuuaccagugcaugagauugccaucuugugacaaaauagggaaaugcaaguauuuuugaaaagcucaucuuuaaggacuuggagugauuucuaaugacuacuuguuggaaauuuaucaagagaaagauauaaguucagauuuccaagggcuaugucuuaaaauauaugugccaaaaauauuaauuuucagaagguaagcaaaaaacaguuaauuaaaugcauauuucuaaagggcugacauugguuuggggccagucuucuguuaagaacacauuuaguuuuuauguucaguguguauauuuccuauuacacugagccccuuuguaugugauguuauagacuacucgaauguguauuuacuguucaaaacacugauaaauguuuguggugauauucugguggcauauaguugucccccuuuauucucaggggauguauuccaagauccccaguggaugucugauucugaggauaguauugaacccuauacagacuauuuucccuauacauacauaccuaugauaaagcuuaacuuauaaauuaggcacaauaagagauuaacaacaacaauaaaacaauuauaucaauaugcuguaauaaaaguuaugugaauguggucucuccaucaccugaugggguacucaucaauugaugaguacuguacucaucaauuuuuagacccccauuggcccaggguaacugaaaccauagaaaguaaaacuacagauaagggggggacuacuguaucaucacuugugauugacuuaagguuuagucauugguugauaccagaaacuuggcugauaauauucuucuuucuaaagggaaaugugaucaauucuuuaugauguggaguuuagguccacacucuggugaagaguuugaauuugcugcccuuaaauacuacaucacuguaguucugugugauguguccuguacaaacaugcagaguaaacauuguuccuugccuucugcuuucuugagcacuaaaauacacaguguaaauaugcacaaacauguagaaggacauauagacaaauacagccuuagccaagucaugagagaugcagcugcaagaaacaggcucaugcauaaugaacauuuaugcuauggcauagcuuguguuuuugcauccaugagcuguaugaaaaggaaggaaccucacuucguuuucauucaguuagaaugaaggcccacuggucaguuuuuugacucaauucagcugauuguuuucaaaauaaccuguucuuuucuaacaguuguguguagggacagcugcacucugaugaaaugacugugagccuauacgcuaacuacuguacuaauuuucugccuauauuuacuaugugcccagugacucugcugaugaauauuuuagacaucuucaugaauaauguuacugcccacaguagagcugcuugcuuguuuguaaggcuggaaaugcuaucaagaugauaccgacucccauucuauauaccaacgugaaaauaauaaaauaccuaaguaagguuguuggucaagauugucuuugaggaaucauggaugcucugaaauuggaugccaaauuuuacauguagguggauguguguuuuugagaaaacuccagagcuuuuaucagacucuccaaagggauugugaucucauaaagacuaagaaccacuagauaagcuuuauaguuuugaaagugcuucuccauacauuuuuauuugauccucccaaugauuuucagggaggcauguugggcauucucucucuuucucucucgaucucucaacagaagagcaugacucagagcuuaagugguuuugugcuucauccuguaggcacugggagccuuugaggguuuuaagugaggaagugaucugaucagaucguccuuuagagagauugcccuggugguaguguagaggauguuuuaggggaguaggaggcuaauuaggacaccauugggaaaaucagguaagaaaagaugguuggccuugaguuuguugcagucagauuggaaaagaggggaggaauuugcuaaacagcuuugauuuugaagaacugaugggacaucagggagaaaagaccaguaagcaauuggacguucuagucugggacuggugaggugaggaggaccucgcacaggguguauagagugagaagugaagaguuccuggggagaaaaugucagcuaguguuuggcuggagugauggucuuagggaagcgcagggagauccaggaacaucgcuuuuuuccccccauucucuguauuccuggguugacaaguagggauuaaauauauuuuuuaacccucuucauuuacuaucagauuauuuauauuuuuauuucucaaggacuuuaaauuuaugaaguuuacaaaaaucagucauaccacucuaaucuaccuucugcucaguggaggcgucaagcaaaggauggguuaaggguacuccccuauaaucaauaugaucuucuccauucuuagauguggaaauugacacguuaucgagcauauguaagugccauaccauuccaacuuuacauacuucucaccaccccugcugcaccucaccucccuaauaacacuucugggaccgugguugcuuuaagaucagcugacuuuucccucagugauucaaugcagaauccucaguaaguagagcauuccuuuugauggcuuuacuaauacccagaucucguaguucuuuaaaucccucaacuaaaaugaccuucaucuucauuucacuuuggcugugcacacacaugccacaccuaauagaucugcuccacuuugaauauuucaaacucuauuagucuccucuuugaaauagccuucuaacuucuaccugccccauccauguuucuccucaaccugucuucucuuccauuccuuguuccauuccuuguucuguccuuguuuuccaguaugggaagauaggggagggaagaggcuggcaacucucuucgaaucccugcuuccguacucagcccacaacuauucagaugguucaauaaugauugugcuuacccugcagacuuccucacauaguauucuuugagaauuuccaacucagguucuuuuccuguuuuuuuccccgacuguuacgcucaggcaccugggcauuguuaguaaauuucauaaaaacugggacaauuggaucaauaaauguauguagaauaaagaaaucuaucagauccuuccccacgcaggggaggggaagcuuagggcuguguugaacucaaaaaaacaaaaaaaaaggucuauauuucauuuuaguuacaucucaacuagcucugccuaugugaauauuuguaugugugucaccugauaguggucagaaauuuggguccuucauaccuuuauuucuauuagaaaaucagccuuuguacccauuuuuuuuccuuacagguauagacuugguaaaaucuugauaaaaauuuucugcacauauuuacucuauuugaguuaggaacuggacugugugaaugcuuuuucuucuaagccaugagugauauuuauuuauuuuauuuuugucaguuguuuccaugguucaugaauucuuuauuauauauaguaggagucaucaacuggauggagaaucauugaaauuguaaguuuaggacauuaguuggaauaaccugaacaaugugcuuaccuuuugggcccuuaauuuaauuuaaaauuaaaugagucuuaugauggcaagcuucacagaucugccugcagggcuuucagaauggaaaugugugucucugugugugggaggcucuuuuguuuaguuggaaaggcuaggaaaucuuugccuaaaaacacucauuguuuagagagcauaaauaacugaacauaauguuagugagaaguuuaauuugagauugaaccacugacuuccaagaauauagcagagugaguggaagugcuaugaacaaugucuuccuuauuuccuuuaaaaugcccaugaaauugucucaaaaaaaccaaauccccagaaguaacuacaaugaguggcaggcacugagcccauucuaguuucuggaaggaauuuuuacauucuuuccuguaguugaaaucagauggaguugccguuucuucaccaggccccccaaccugcaaccugauuccuccucuucacuucccuguuucagccacuagucauggaauccugcucaacauguacccuguacccuuuuguucauguccagugcugcugaguguuaguugauucuguaacagcugcuaacaugcuccuucuuggguggaggugguucucauugaacugacuccuggcucccacccagguucugggcuggucugugaauuuaggugcuugaaagucaagaaccaggauuugcaccugcuuccaaucauccuuuggcuccacuuugaacacaagggcaucugcaaagacgucuacaugcggucacuaguguaggauuuucuugucuccuccauuagacugagcuccaugaggguggggaaggaagagaugagggugggaguauauuccuucucacugaauccccaacacucagaauaguacuuagcacauguuggguacugaagacacgcaucaaacucauuaauguaacucaaucguugggaaggacuuaaaagcaguccugaagcaugguaagcacuaaaggccaaggucaaaccaagcccaaggauguaaaaaagaaaugaaaucacacauuauagaugaauaauuaaaacaaaauucugcagcuccaaagcaaagaaauuguagagaucugcagcaauaucuuucugaaacaauuuuccuuuaugagacaguuauaaaagcugugcuuuguaaacucaguaagauaccugaagaguuuacaucuaguaaaugagaacuuuaaaaagaauaaaacgaagugaaaauuauaguagauaaaauaaaucuccauuguaaauaaaaagcugacuguacuuagaaaauucauccaguugauauggacaggaggcagggaaauacuggguaaaagagggugguucccuggcaaaggccccacucucaagcccagaaacccauggcucuaaaugagaacaggacuuccuguuuucacacccaaauguucucuuuuggccugcugcaccccucuauccuguacccauauaaaccccagacccuaggcuccacaagcagaagagcagaggagcagaagagcagcagugacgugguagagaaggagagaagagaaggaacaucugaacaccgagaggaguucagcuggggauagcuggagaggagaugguccauggaauggucaaacuccagaggaagaucaucuucccgcuccaucuccuuuccggcucccuauccauccugcugagagccaucuccauccagcaauaaaauccuccgcauuuaccauccuucaguuugucugugugaccugauucuucuuggacacuggacaaaaucccagguaccaagagggcacugagcugguuaacacuuaagcugucuguggacagcagagcuaaaagagcacuguagcacacccacuggggcuuugggagucacgggcacccagcccuagacgcuacuaugggaucagcucccaaaagugcucuccccggcuccugcaccugcccuucugugugcucccccucccauaagguguuagagcaugcagcagcccaacagacgagccacaccccuguugcaugucuugugaggggggucagggaacucucccguuucauagugauagaggauagacuucaaaaaaaugcccagacugcaacaaaaaagccuagaaagacacagauccaaccuaaaacugauggagauuauuguggaagacacagcaaaacaauccacugugauaacuauuggagggacauuuuucaguucuaaaagaccugaucuuggguacugauauaccacacuacauuccagguacacuuucuaauuauuaaucaacauugaaaaauauucagauuuuuuuuucuaacuagaaaacuugcagguagaguaaggaaguauaaaagugcuaaauuauuuguccuucauuuaagagagacuaaaaugaucuuuugggauuauguugagaguaguuaaguggugguugaaaguuuaauaaaauuuauuuaaauuuaauaguucauuaaaauuuauugaagguuuauuaaaguuauaaaaauaacuaauagaaguaaaaaacaggaugcccauaaaaguuaauauagaaaacagaaucaaauaaaaugccauaaucucauccggcuacagagaaacagaacuguucuucuuucuuuccuugucucucauguacaucuucuuaccacaucccauaagauauacugacaacuuucuuagggacuuuuuuagcccacuaaaaguucuuuuguccccccaaaagagauuggauucuauauauauauauauguauauacauauauauacacauauauauauacauauauauacacauauauauacacauauauauauagugugcguguguauauauauauuuauauuuagauaguauauaauuaauuugacucauaaaaauuacaacauuccuuucaaacaacucugugauguaggcagacaagggaauuuagcacauaagguauugccuugucuuuuugcaaaaaguaugugauucaccugucauggugcaugguaggcacuaaagaaauacuuguugaaggaaugaagacauguauaacuuaacuagcuauacacuuggaaaauguaauuucaucuacaaacaauaacuuuauaaauaauugcacuguuucucgcccauuaaauuuacugugaaaucuggacaaaacaucugucauuauguaagccauggaagaaauguugagauuagcaugcaguaaugaacaugguaguaaaugcuggggaaggcagaaaucagaagagacguaaauaaguccuaaguuuuaggcccucaaaagguuaauuuggauuuucguucugggugucuucauaucagagagacuuggccaaucugauauaaaaaaaaaaucggaggucaacagaagugauuaagcagcuaggaaaauuaacucagaaagaagaucuuaguauauaauuuggaaaaaggauuugaaucucucaaaacccagagaaacagaaggauaauuuagaaugcuuuguagagcgguagagcugauggcauaaaaugaagcagaaaaaaauacugaguguaagacaguucuuaauagacagacaaagaaccauauagcauuccaaagaagguaguaaaguuguuuugauagaaucugacaccccaaagacagacaagcgcuaacauuuauugaguacuuacaauguaucugguacucuguaugcauaauuucauuuaaucuugcaguaaucugugaaguagguacuaauacaaucuucacuuuacaaaugaggacacugaggcuuggucacaugaggcugguaggagauagugccguauuuugaacucuuguucuagaguucaguccacaucacuauacucuccugccuucuagucaugaaguugggucucaguagguguguuguguagagguuugacagaauaacccagcugguuuuccaaaugcugaauaggugauucuaacaagccauuuuaauuaaguuaaaaaaaaaacucuuauguauuccaaucaaaaguguacuuuuuguucagucuucuggaugaaugaauccuugcagaaacaagauuuguauaugaaaaagcauucuuaaugcagauuuaaaauaaacagguauuaggcuccuggacccgauagagugagcagcaucccgcaagugccagccuugcaggagguuuuaucugcuggaaaauuggcugcaugguaguguauaggggauuggagagagaggcuugggucgaaauuccugaucugccuuucauuugcuuauuaccucaaguaagucaccuaaccccucuggaaguaacaacacugcuuaugucauggaguagagaaucugacaugauagcguauauguaaagguagccugcacauaugcaaauuagauaguaugcauguaaagauggcaaguagauaagauaacauguauauaaaaauaguauguauguuuuuauauguaaaauguuuagcucagugccugacacauaaugaauauuugauuaauaguagcuggcauuauuauuauuuauuauccagauacaaucuucaaguaaguacuuuagaaaguauagcccggugguaaguuuuaaaaaagauucuaauuuuauacaguccucucagauaacauauuugauaguaaaauuucacccucuguguacccuuuucacaauuugggaguuuaccgaaugcuuugguguuuuaaaggcagucguuuguucacugaaaaugcagcuuaugacaaauucaaugguugccaagcucuaauauguuagcaggcagaagcaugcuuuuaauauucaucaucuuuaagugcuaccaacugacauuuaguacuaaaugugcagauaugggugcugagcaaaacagagcuaggaagaggacuugcuaauuuguauucuagauggaaaucuuaaauuaguuucugagauuuuuaaauggauuuuuaaaugcugggcacauaggaaauugaguucauauuaauauuuauaagguuugagaagauauuuagugaaauauuuguauaauuuaauuuuggucauaaucaaguaguaaaccauaacaagaaggacauuguacuuuagucugguggcuguuuugugacuuaggaauauccuucuggaaaagcccugaaugacacacauacacauacauacaugcuucaaaaguucuucuuuauuagaacccagaaaccagagguuauuuauauauaaauaccuuggguuggauuguuuuguguuaauuuuaaguuaauuaauuuagaaaucaguguugauaaugauuucuuuaaaagcauuuauugacaguucugcagaacucuauaaucuagcugcuuuuauauucuuuauuauacagaacagcuccguugguucauagaauaccugcuuccuguaguuuugcuuagggcuaauugaguuuaauguaguuuugugugcagaagguauugacuugugcauaguauuuaauuuguguaaauauguguguauguaauguuuugccccucugaguuuuauuuuaaauguaacccuugaaacugggauaauagaaauucuuagccuaggccugcuagcaauugcaggugccaacgguuuaaacugcuguagaaauacaauuaugagcagccaagagcaaaucuuguuuuaagguccauguguaaugaaugccuguuaguaucauagaauacaauuaaaaagagguuuaccucuccuaagcugugauugguucuuucugauggaaguguagagucccaugaguggacuguguauucagcucuuggugauuuagacuccagugagccuggcauucugcaggcuuggauaaauucagggcaguuauagucaggcagagaugagaaaagacugaaagauuaaugagggagcuuaaaacaaagcuucaaaaaugagagcaacacacugcuuggucuuauguaauugugccgaguagaagucagucuuggcugcuguuguuuaaaaauuuuaagagguuggcagaaaauauuuguuauaaaaauuguaucuugagaauaauagugaaaaccuaggacauaagaucuaauucuugguugcuuguguaugcccuccaagacacacccuucucuucauccugcuuuuauugcaguuugaccaagcacccugcuuuccugcugccccccaccacuucuuuuuggcaaggacccuuauugaugacugauguccaagcccuggcugccuccaggagaugcacgucugggacgugcuccuagaguucacguugaugcucucucacuacaaggccugaaagaucgggagcauauagaggugugagagcccucuggggagauaaucuaagggauuguuggugaccuauggccauuucugguugaugguuuuaaauagcaguugguuaacauuucuucuauagaacuuaagggaugcuaauggcuuuaaaaugcuauuuugccuuugaaaauccucuuaauagaugcucuaacgaaccuuccauuuacgugauaggcacgguugagcucugcagugaagcuguucauacuguuaaugugaagcugggcacuuaaaggggaaaaagcagcucauaaauaacguggcgcaggugaaucacuucugaaaucuagagcuugccaauaccagugaagaagagcugccuuggaggagaaauugccaacucucaagcaaauucuucagcgcuucaaucuagacacacaccagccuuuuaacuuugcuuucuguuuccucuucaaggaguuugucgccaccuacaggaaacaggaagcacaauaacccacucagucucugagugacaccugguuucuuccauuggucauuccucaucgcaguuuuuauacauuuuaucacuuguucaucauauaguauuuaucaagcuuuuuucuuggcuauggaaugaggcuaaggucuauggaagaaaagguucuaucugcacuagcuguuuggcaggagauuccucacccuuaauugcuuuuuaaggucucugucuguuucugcugucauguucuuuuccacgaacacaccaacaagagagaacagacuuaccgauuggggcucuguaguauauagcauguaaaaguacuagugcugacuuacucacaauuuugccuucuuuuguuuguuggagagagcauggcaccaaaaucaucauuuuuauuguugauguuguugauuuuguuuucuuuugccuuauuuagagaaaaauguuagguaguuaaaaaccuacauagcaaagaaaguucaagaugcaugaugcaguucagagaagucuaaaggaagacaugugauuacuuuuacggguacauuaaggguguugaagagauaauuagaaucaauuauuuucauucauuagcaucucauaacuauaucacugaguuaaguuguuccccauuguuugaaacaagagugaguuggcuugaaaggaguuaagaagaaugcaggguuuuucuccuucauauaugaaugccuguggcucuuucuuuuucccacagcaucuuuaacccagauccucuccugaacuccuucuggguucuuuguauggcuaucugcuucuccuggaacagcaacuuaacauauccuagaccaaguccauuguggcccaaauuagauugaucccacuuuuuuuuuuuuccuuuuucguaucucuccucuuaaaagagcagcagaaaccacugccacauaaugaauccuccuucagaauauuuacguuuuguuuuguucuccuuuuccuccucccucuuccuuugggcaagcgauacuauaaucauccacuguccuaggaaauaauucuuaguuaucuuucucaguucaacaccucucuacuacuaaguccaaauaaguugcuuuaccuuuguaacguuucgugaacuuccuucaucugaaacugaaucugugcuuuauucuucuuaccaucauuucaucaucuugaauuuucuguaacucaaccucuuccgcaucauuuagcuccagaaauucuuacuaguugacuuuuaguagauuugggaaaugggcuguuggcuagaaagagcuaucuaaucaagugaaauuucacccaucuacuuucccugcaccccacuuccauguuuaugcuguggaauuucaagacugguuuuagauauuaucuuagaguuuuuauuuaaacaucaaaaguaacuuaggguaagaaaauacaucaguggcuuguugggaaaugucacacagugcuggaagauuauagauacaauauuuuauauauuucuaccgaauaguugacuaaaaguugcucaaaauuauaauacauuuaucuaaagaagauaaacacaucaucaauaagcaugaaaagauguucaaugccauuagucacuagagaaaugcaaaucaaaaccacagugaaguaccacuucagacccaguaggauagcuagaauuuaacaagaagacaauaacagguguugacaaggauauggagaaacuggagcucuuauauguugcuagugguaauguaaaauggugcagccaauuuggaaacagcuugacaguuccucaaagugucaagcauagaguuaccaauaugacacaacaguuacacuccuaguuauauacccaggagaauuaaaacgugucugugcaaaacauguacaugaauauuauauuauuauuuauaauguaaugcauuauauuauuaagcagggaugauucauaaucaaaaaaauggaaacaauauccaauauccauuuauugaugaacaaacaauaugugguauagccaaauaacagaauauuacgcaaccauuaaacagaaugaaguacugauacauucuaugacauggaugagccuugaaaacauuaugcuaaguggaagaagcccaaaggccacauauuuuaugauuucauuuaugugaaaucuccagaaaagucaaaagcuauagagacaaaaaguagauuagugguugccacggguugggauaagaggcgaaccagaagugacuaucaguggauauaaaguuucuuuuugggaugaagagaauguucugaaauuagauaguagugauaguugcacaacucuaugaauauauucaaagucauugaacuguacacuauaaacaggugaguucugugauauaugaauuauaucuccauaaaaguguuauauauacuugacauaagacuauaucuaaugaagucauuggcagcuguauaugcuuaacagccugcgucagauucauuuuugugucuuccaaaaugcuaaacacaaugccuugcauauguaagccuuugauaaaugguugaagaaugaaugaguggaugauugaacaaacaaauucacgaguggucuuguuacaguguguggaaggauuguuuuuggcaagugcuacaggagagagguaaagaacaauggccacgaauugaagcuucuguccuccuguucacuuaggcugacaguucagcuguccugucauugaucugaugucagucugauagaaucauucugugcuuugacgccagcuagaugguauauuucuuuuuucuuuugagugauagguuggcaaaauguacuuuagcgacuguauguuauguggaugaugcaugaugccagugcucuguugugaccuuuauuuuuaugagcugugagaauuaagaaccuaccaguuuuaguuuaauuaagcaguaagacacagcagauggugcauuugugggugaugauugcauuccacugguuuccucaagcagcacucuaacccuauggaaugcuuugccuggaguaucacgccacuguugcaaaauuaccaggaagacaaacacauuguaauaauguagucagaaaaucuuggaggacaguuuagaaaaggaccugaacuccacaggaguuuuaguaguuagcagcuacuggaacuaggauauuaaggagaggaauccaugacauaacggcuguagccauuuacuacccaucuuuacuuuccaauauuugcaaauaaaguauaugaagauuuuuauuacccuaguauucuuucguguaaucugggucaaacauuaaaaaugcauuggaauaugauuugcauguauuaaagugcucagagaaguuucaguaaauggagaaauacugaauugaugucagguuguuuuauuauguuugcuuuuagucacuacagagggccuagaguguccuacaaaaugcauuuuuccccaaguacugugcacuuaccacuagcauauuuacuccauaggauguugaaaacauaccuaagcagagauaauauagaguuaauccaguacuucuuaccaaucuugcaacucuuuaggaagaaaaccaaauugguaaguagaauuacuuucauuguuaagggauagacugccuaggucagauucuuuucccuuuacuaucuuugaaaaacugaauuacuugaaggcuggcauaaaacuuacaauugcacaauauuuuagaaccuaagauaauaugccucaauuuuucucauuaaugcaauauaugaaaucaucaaaaugaaauacauucacuuacuggcuguaauguuguuaaaaguaugaacuauguggauuuuacaaaauauagcaaugguugcuuuagauagaauaauuauuuaucucaugucuuugcuacaaaggaagacuagauuuggaauucuaguaaaauaaugaaauucaaaaauaauauuuuaacaggagaauauaaauucucuuuggaaaaacccacauuuuauauugauuuuuccccuauauuacauaaggaaucucuuuccuucuauuuuuagggguauuuucaucacaaaaacaugugacuacaucauccuucugcuuggagaccugacuuauauuuaauuaaaugaaacuuuuuuuuuuucuggauucccaccaacuucaggauacucaagcauugaagauaaaacuguaggucuaaacacuaauucugcaauucuucuuguaggaauaaaacauuauuaaccuuuuaguuaauacugguuuauaauacaguauagggaaauacuauaaacaccuaucugcauaggaaauucaaaauaauaacugauuuuauccuauaaauuauucaagauucugacacaagaaauugcaaauuuuauuuauauggaaacaugcuuuacugcaaaaucauugguauuucauuucuuuauagaacuagauuuucaucuaauuaaaauuuagaaaagugcucaucaugguagcucacaucuguaaucccagcacuuugggaugccaagacgggaggauugcuugagcccaggaguuccagaccagccuggacaacauagagagaccucgucucuauaaaaaauaauuuuaaggaaauuagucagccaugguggcauguacucccagcugcucgggagccugaggugagaggaucgccugaggccaggauuuuaggcugcagugagcuaugaucgcacuacugcacuccggccugggugacagagcgagauacugucucuaaaaaauacaugaaugaaugaauaaauaaauaaaguuuagaaaagauggaacuagauuguuucccguuuacucagcauauagguaacuugccgauuuuuuuguagcucuguuuaauaaaaauacacuacagaaucuccaaauaaggccccaacaggaagauaaaauuauguuugauaauuuuaggguuguuaggauuauuuauuuuaguucucuaaaauugguaagauguuaauucuucaucaucuacaugguuuaucuaauggcaauaccuuuuuugaaugaugcauuuuugcauuauuuuuguauuagaggaaguaacaacaucugucaggauguacauaaaccaauaauugacaaucuguaccuauagccucaauugcucccuugagcagucuggcccuuuuuguuaagaucauagaauuuagaaucaaagaacugccuucaguuucugacuacgugacuuauuagccgugugacuguuuauuuuaggaguacuuuuuggcucccaaagaauuggcaggguaccuauauaaugaguaaaugggaauauaauucuaccugcaaaaucaccaaaauagugauuuaaauaauguuuuuuaaaacauuauuuaaaguagaaagaaguggagagaugggcaauccagggcacguauggugcuuccacaaaaaucuugaauucagccuucuuuuuucugcuucaccauccucaguuggugacuuuuuuacugauggucaucucaugguccaagauggaguuuuugccagugcugcugccuguuaggcagcaggaaagacaaagaagagcugcuuuuggcacaaccaguuucuuuuccaacccacgcaacacuuccucuuaaagcucaugaccuagaugugagggagguaggaaauguuaucuuuaccaggcacagcuuaaaaagagggguucuguuaccaaggacagaaagaagaauggauguuugugaggcaacuagcauucucugccauagugaccuuggauccuuucaucucauugagccucagcauucuugucuauaaaaaaugguuguaaaaacaggaucuaauucaagauccuauuguuuugaguaucaagugaguuaaugcauauaaugcauuaagcacagugucuggcauauaaguaagcaauaaauguuaauuauuauucuugcuacuuccuuaauaucucuagguuaauguccuauagauacuuaaaaugcuuauguguauuacagauccuuacugcauuaccuagcucaccaccuaccuauuccaacaggcuggaaaccucagagcaaucuuugaguaugucuuuauugcugucuguaccuaaaagucaucaaguauaauucugccugcaaaauucuucauggauuucucaaacuugucccuccauuuccauucccguaucugaauucaagccgucaucuuuccuugccuucuacccgucuucacuaucuacaagaucacauccaaacuccuuagaauaguauucaugucuucauguagucugauugaaguauuaaaagcuuaaucuugauuccgccacaucucccuagucuccagaucacacacuucuuguacucuaacuucacugaaaauucacuauuccccaaauaggacauuaugacucuaguuucaucuucaggguaaauuuuuacgaauuuucaaguugaaacuugaggaaacuaagcauagauguguuucagccuauaauuuugaacauuaggaugugauuucuggaaacuccuuugugauuuuauuuaugaggccaacagauggacagguauuccaguauuucuuaucauagcugaguaucuaaauguaugaauaugaaagaacgaagggcuuuuaaguaaaaggaauggauggaagggaauugaugcauuucuaauggauggguuaguuuguucagcaguucugaaaguauagguuuagauauagagacucauuauuuuuacuuugcuagacaguagcauuaguuuagguacuuaaugugaauguuauguacgcauuuugcuuucaaauuaaaaaaaauaaguagggaagguuagcuuuacuuuuauuguguguguguguguguguguguguguguguguaguguguaauaggauguauaauguaauuucaaagcccucugaugcaauauuuugaaacuaaguugguaguacaauuaaaacauaucuuuggucauagauuacuuggccuuaugccauuuucauaggcaauguccuacuuauauagccuggauuggcugagaaaaauaauugcugcuaugaaauaauuuugcaauuaccacuguaauuaagggcaguuuguuaaugaaagugcuuggugaauaaugacugcagggcacuccaucuugcagcuucagccagaugauugguucaugugguggagguaguuagggaauuagugacacagcugucaugguuacaggauggauguaaauauccuuugcaguugaugaugaagaacagucauuagccuccugccccuugggaacuggucagaggaacaaaaauaaacuuaacacgugaugguaaaagccauuccuuaugucuccuuuucuucaguaugaacaauuaacguucuaauagaagcugcagagagcauguggaugaacccucuccacuuuacaggcguguuagugugauaaauguuccuucguguagggcauugguuguucacaguuuauaaccacucuuauuagcuuauaggccaguuaaaaacugcucuuuagagacccacaggcccuauuuaaauuuuucguguucaucuccagguguuguguauucaguuugacccuuuaaagacuguccacgguuggauuuuugcaugcugucugcaaggcugcaggggcaauugaagaucaauuuucuguaucugggcuuacuugcuuguguaaaauauauauuguuaugaagaagaccuagaugcuuaucugauccuccuuuauaguuuuuaaaagucauugaagguugaggagccguuuuuuccgccuucuuaaaauaaauguccuagguguuuaagugugcuucguauuuauauucauuccacuuccuugguguuuugauguuguuuuucauuguaaauuugcuuaagcaaucuuuuguggaguaauuucauaacaugcacacacugugguuuuacauugaguugcucgugaucugcaauucauuaacuuuugcugacuaggaagucaguauagcacguugcauuuucucucacuuuaucuugcuauauagucaguuuuauuccuuguaaaagauguuaguagaacacuuccuuaagauggcuucucuugcugucucauaugcuaaaucuuuuccucugguccaagucuucucagggccuuaaggagagauuuuuggcauuuguaucauugcauuagaggugaccagauagcgucacuaaaggaacauaacaguuuucuggguuuuagcucaaaaugacuauucacgguaacacuauacauuuuaaggaugaauuuauugcugcuugugucuggauaagauucuuugcauuugcugcuacuuuugugcccaugucuccucuuggcuuuagcaagaggaggugccaaauggaaggaucggaauuccgccucggaacuaucacacacuguagcccaaaccucugccucuuccuuuucuauucuuuggccauuguggaaagaaugaaaacuaucaacaagcugaacaaggugaacagagccuuguucagauguuuaaaugccuccuuugcaacugaguuacucacucucccaagaugaacuuuucucauuagacauagcuaacucacuguggagauguuucuagcugacuugauugugaucagacauuauaggaugcaagguaauugcugacccuaaauaguaggggugagucccccaaagccaaauaacuugaaaaaccuuacauacugagcauuuuaaaaaauguguguaucuuaguccaguaaaugacaaaauccuuuggaaaaugggcauuauucucaggcauguucauggcuggccaaauuauuuggguuuuggugggauaugacucucuggagacucuucgcaggaugccugucuacaggaggagcuggaaugcuccauauuaaaccaacaccgggaagcaagaggagagaagcaugcagaaaacacccucccaguugaaugaaaauugcacuguauuaugacuuauucccuuuuuagcaaaaguaugggcuuugugguaggucaagauaacuaaaaugggaaagaaagaaacaauuguguuuuuaauucguguugcuccagguagugggacugagaaacuuuuccucuuuuucaggagaguugugacacgcuauaguauuuagauacucaguuuguguucccauuuuuguuuuguuuggugguguuuugauuauuccauuuuuuuuuuuuuuggcuaaacauaugugauguguguuuaauugaauuuccaaggcaacgauacaggcaccugucaaaaaguauauuuaaagauacacugcagguuuucuggagagguggccaugugaauuuaacaaucugcaaugagaggggaaaaaaaaguuucugaguuuguauaaguaguugagauucccaaguaaaacagaaucuguucucaugcaguuuucugggcuaguuuggacaggagcuggaaucucauuuuuauacauuaacaacucuuguuggauuucucucauuucuucaggacaagucaaaaacuuuguaguucuccacaaugaaaaugugucgugucccauccuguccuuuugccaucuuuucuaucaaagaaacacuaauuauaaaaauugaacauaaauuuguacuguuuaauagguuuggguuuaauuuugccucagugggaagacguuuccauuaaaagaguccuuuuuuuucucuuccucccuccuuuuucuuuugguagaacaguuaguaaaggcguaggaaauugauuuuagugucacaaaggacauuucugacagggauguacuuugaaaugauucaaagcaucuguuucucuugcauaugccuagcacugcugagagcuguaccuagauuaaacuguuuaacgugucaacuccaaauccgaucacaauuuacaucccaguugcuugguuggaauuuuuaacauuucaugaacuuucuccccuaauuuaugaaacaagcuucugcugaaagugaccauuuguucuagaugccaauaugucacagucaaaauugacuuagcuugagaaguuauuuguuuuuguauggucauuuugccuaugaaacaaaaucaucuuugcaguuuuuauuccugcuggcaggguuugugaaugaacgcuugguggguguuuuuguuaccauuugccuuccacuggugcuaugucugucauacaagcuggcucagagaauuccaguuuuaagagugucugagcacagaaauuaugggcacucuguuuacuaccauauccaugacauccagcauaguaccuuggaaagccaccuaaaauaaaucuuucauauacaaacgaggaaugagcacuuucuacauagucauacugcauagucuuagucauagacucuugauucugagggcucacuuaucuacucugcuuauguuucucagaaauuaguaaggcucacuuguauuacuuauagugaagcauguccuuugaaguugaagggcaggggcaauuauuuuaugcgugugaacuuuuuauauucauagaagaaauaauuuacuggggaugagaagaaaaggcaaccauguugaugcauaauagggacccgagcucauuaacuuaauuguuuaguggcuccugacuguucuucucucccccaguguccccccaugugcccuuucacaguauuuccccaugagcuuugagugaagaauccugagaagggcuucuacucuugccuuucccucugcuaauacgagcauagugguggcguuuguacagguuuuccugggguacuaguuccccaguggacucacuuguugaccuugaagaugcauggucacucaugacuagucaguugagaacauuauccauaauauuguuaucaauaucuugcaucucuaucagcaguucucugggauuguguuagugaggauagagagcuucacauuuacaauagcuugaauguuuggaaauuuucuuaccuucacucacuagucuagggugggugguccagaucuauggauggguuggcuucaucuaguuguucagugaccuaaguuaauggcagcucugccaccuuuugcaugucacucuggaggcacucugguguuacuguuucagcuucccagaaggaggaaggagaaaguacaggaggagcaaccucaggcacuaggcuggaaauggcacacaucaauucugcccacauggaaaagaacuuagucgccuggcugaccccgcuucagggaagaccaggaaaugcagaggagcaggccagccuugugccaggcugcauggaagaagaggaaaauggauuuaguggacaguuagcagucucuuggaccuuagguuuuucccagucaguuagcuguccagcagcuuuauauuguaaagcuaguugaucuuagacuuuaaauaauaucuaguacuaucuaugauaauuuccccccuuuagguuucuuuggguccaagcuauuuauaaauuguacuaacuggcagagcauucagcuuaccuucuucugguuaaugucaaggacucaguaguuugcacagacauauuuuuacccuuugaagugauaaauuaacauuugaaugguugcuucauuuccuuccacuuuuuuaugucugggacacaugguagaauagggacauuuuuguagauuugugauuucuucuucauuugggaagauauuguauguacuacugguaugcuagucauucacuguauaggaaaacccagaaggcauaaucacuguugucugcaaauauuauuauauaguauaugcugauggucacugccuaauguaaaauuagguuucccuucaggaucuuuguuuagaagcaauucuugaggugacaugagaaauuguugccaauauuauugcuugcugcuuuucuaguuuuuuuuuucuccaaggaucuaaaaaaucauuuacagcauacuuuccucugcuuugauuagauuuuagaaacauugucugauuuucugcucacauuguuuagagaaauuauacucccagccaucucuuggcugcuuuagggugaaauauaucaaaaucuuuggacauuuuaaccugugguuagacuggcuuuagucucuucugcuacguucccacaaacaaaggguugucagaguucuugcuaugcaauauauucuauuuuuaagguaggauuuagauuauuagucaucugauguuuuagguguuagcacaacuagacacuuaauuuugguuuugugccaauacaaaucaccuggaguuuuauuuuugguaagguggggacaagaaaucaaucaaguguguucuaagcucuuuguuuuauguagaauguaauuuuauuuuaaauauacucuuccuugauauaucuuguugcucuaauauugauacggcaugaaguagaaguagguguuuuuccugaguaugauuuacuauaaguccugugauuucagcuauauugaggcuacuacuaauggauuaguacauuccagcaguguauuuauuuagcauccuacccuccgguaaucaaaacaugagaugcuucaguguagaauugcuugcuagaggugauggagagaaaacacaccucucuaguggugauauuagucuguuuuaacugucuugugaaugugcuuaaugucuagggcauguuaaauugaguuauccaaaaauagagucccugaaauuuaaauaaagcggcauuggagcaagaaacuaaucauucuuuuucugguaguuaaccaauugccaccuuucccggcucacuuauuauagcagcuccuauggcugucacuacacugucacauuguucuguaauacucuguuuacauuucucucuucuguaccagacugugagcuucuuguaggacgggaauguguuguauucauguucauggaacuccuagucacuaaauaguugaugaacaaauuaaaagaugaagaaacauauuaaauacauugaguaggaaaaucuuauccuugugccgauaggugaaaacuaaucugaugacauuccuuuaaaguuuggacaaauaaguugguauuggugauuucuggauauagggaaucuuuuuguugcccaucacugcucaucugauuaaucuuaguuuucuuaaaaaucaagaaaacauacagauaccauguauauuggucuaaaaugauaaaaaugauaacaugaaaaagagaguuuuccucacugaggugucucugacuuucugcaagcuccaugcccacucucagccuguuuucccaucugucaaacugggggcauaaugggacuuagcuuuuugggacuguugggaggccugaaugagauauauuugacccuugaacaacauguguuugaacugcguggguccauuuauaccuggauuuuuuucaaucaaacaugaauggcaaauauaguauuuacgggauaugaaacccacggucuacacuaggggcagauuuuccuauccucacauucugcaggaccaauggcaggacuugaauaugcauggauuuugguauaugcagagguccuggaacugaaccccugaugauccccgagggaugauuauauuuuguggagugcuuagcccagugccucacaccauaguaagcucccaacaaauguuagucaugacaaucaugaggaucguuguagauuuuuucauuuccugagacgucuuccaugauuauuaaaucuuuuaaaaauuuuuauuaccuauuuguuguuguuuuacuugauuuuacuguuaaauaguucauuucgacagaaaucgucaaauagugucuuucauuaccaugacuagaacucagggaaaguuaggauagcuaucuacagucauggaaaacaggagauaauaagauaaucuuucucucucuuuguagggauaucauaucacgaaguaguugaacuauguaaaguaguacuuguuuguuuauccagcauguaaugccuguaacaacaaauagaaucuccugguaucagaugguucugaaagcuugcacaaaacacugaaaugauaagaugccacagacuuuuauguuacccacaaauauuacucuucuuuuuucuucauuuuaaaguguguauuucugggucagacacugaaauguauuuaagcauuucucugcuaaccuuuuauugaagcagguauuuguuuucuauucuuucuaagaucuagugaugaggugcagugccaccucacuuaucuggaggccauguaucagauaaccucagcuaccuggaacacagcugcggcuuaggaguaaaccagaaaggccuccagcugccauaggugucacacagucuuugcauuaaggccuaugcacacuacucaaagaaaagccccgggguuucaccgacagcaaaucugucuuaauuuuacaauccuguagaacuuguucaaaaucuuaucugucuuuguuaucuuuucuccacccccccauacauacaugggaacuagaaaauuugagguuugagagguacagaguuggggggugcugcuagauacaaguaggcucaaguagcaugaagaauuccuugauaacacuuagcaggaugcaaguguugacuugagucagcaauaaugguaaaauuauuauuuuuuucacucuguuuaagaaggcagguacucuauuaacuucuggaauauuuucaucaauauaauuuaauuaaaaacugucaugaugauuccagauaaauuggacauuuccauuuucucuguuauuucuggcuauuuaugaaguuuuauaggcauaaccuugaccuuuuacuuaugaauauguuuccuuuacuugccuuuccccaucgugcauauaugauucuuucuuaccuuuauuuuuuucccaucgaaggaauaaaaauaaacauuuagguaauagagaaacuuaacaagucuugaauaguacauuugccaaaguugguauuuuuaguuuguaccaugccauucugcauuaacuaccccaucucaaauacuaaagaacaacaguaaacccagcugugucagcaucugcuuucccuccaugacuggauuucuaagcaugaggcuagggauuauucucgaguaucaguagaauuuagcaccaugcuaugcacauagaaagugcucaguaauucucacagcaacaguuauuugagauagauauuguuguuauccccauuuauaggugaggauguggagguucacagagauugagugacuugccuuaagucacacggccgggggauagaaccggaacuaacaucucacggcuggcccuuuaguccaugugucugacuguccuagaugcaaaccucacugcuuagcuucaagaaaagcucggcauuucuggauuucccauuucaguucuacauaacauaaaaacagauacguguuuccuaacugacaaaaaguaaaagaaaaacaaaggacugauugaaauccguuauuaaacuucuuugaaugauugaauuggcauaaauaccuagcucaaagaaaaugaaccguuuuaaaagcaguaauauuucacgauacuuuuuuccccaauucaccuauucuuuucauuuuuacuuugacagcauucuuggcuuguauauuaaaaagcccauggguuaaagcuaaucuuauauguuuaaaauuaugcauugacaaucuuucuuuugguuuuccuuuucuaaacuuuuuuggagcguugacaacuuuaaaagaaauggcauguuucuuuaaccuuaagaacauuuuauuuaaauuuagucacugguuuggagaaagaauaaacagaacuuuucauuuaaauguucucauaucuuggaagaaugaauggguagugauaugauuuauagcuuguauaagaauaaagaauauaaaagaaaauugaaaccccaaauuauugguuucagcagagcauuucugacuuaauucuaaauugugaauaccauuuacaucuugcuuaaauguuucuugccaguuuguagaagcaaaucucuaccuuuuguguaacacauaguuuaacugaauacucauugucuauauagauaauuuaaaauuaagagagguaaaucaucauucauaucuagcauagugcuucaauaaauauuuguugauugaauaaaugaauaaaauaaggaaggaaagggagggauggaaggaagggagggagggagggaggaaggaugaagggagggagggaaggagggaaagagggaaaggaaaggaaaggaaaaagggagggagggaaggaaggaaaaaaguaaaagauugcuguguuacuauuauacuguguguaacaggaauagcacucacacucuacagaaaaguuguugguaccauagauaucuauaccuuucuacgagaaaacuaaaaugugaaaaauagguuacuuugugaaaaaaaucacucuaacacuacuguuuugcagacgugccauaucacagaucagcuuugcaugaaauggaaauuaucuugcauugucuucauuuaaaguuuuucuaguauauuuauugaguaaaaagacagauaaagaauuaacagugguuacaauuucuguauauaugaagcaucuaccacugccuuugacuuaacccuuuuuaugucugagcuucaaucaugagguuuucaaaaauuauuucuagaaagcaaguuggguuucuucaauagacaguggaguguuuugcuccagaguacugaaauauucuguugugauguuggaaacuuucaccaauuaaggacaaaaaccuucucauagguguguauauauauauauauauacacaccuaugagugauauacacacacacacacacacacacacacacacacacagagagagaguuugugucuuuuacaggaaucauuuuaggaguucauguagacuuauuuuauugaggcuguugagcaaaaauuuuuuuucuacuucuccuugugaauuuuauuuggguauuauuugaauagucucagaaguagcagaucuuuauuuuuuaggauaauuuauuuggaaucagcccaaaguuauuuggaaucaugcuguuaagguggacacugaaguuguggauuuuaaaaaagaaagcccaguuguagcuaucaaacacuaggguauaggugugacacauugauugucauagaaggaaaggauauaaggaguaguugaaaauaugcaggaccaaugacaguaauguuggaauaaacauaugacccuucaaggcaacuauugugaaagguaauccucucuuaaaauuuuaaaucuauaaauuccagugauuuuucuucaaaguuuuaaagucucaccuuacauagacucaaagacugaugugcaacagcaggacaagaagaaccugaauacuuaggaucuaguuaauccuaaagaccugaagcaacauaaagaucacugucaaccuuggcauuagccuauuuuaguaauugggucucagcauauauauauauauauauuuuuuuuuuccuggcuuaaauaguugaaaauucauuuaaaaauguucuucugauuuuuaaauuuuguauuuauauuuuuugucuucuugucucauaggaaacaggguaacugcauuuuugguguucuugcugagagaggauaggucccuuugaggaacauguuuucugauuugcaagaucuggauaccugggacauuuaaacuuuucaaguuacuuuuugcaaaggaaaauugcuaaaaauuauuugggcucuuguaauuguaaaugcugauuaccaaguauagccaacacuuacuuuuaaauggguuaggggcauaucuauaacaacuaucucugcaauguggaaacuuaaguuugcccucaaauauggaaauccagauaaguagaaaugaaagcauuuaaauauauguuauaaauaucaugugcauuugauuggccugaaauacuguaacuauuugaaugcuauugcaugaugccagcucucucuuugacauucugacuacaucacucacucacuccaugcuacccugcauggaauauugauggacaacuuaaauccuucucaauuugaaagugaagcauggguaauuaagcaaugcauccauaaguuggauaucgaguuuuuacugaggcccaguaaugaauagaaagugcauuaaccaaauuaaaacuguugcaugucuauauguuuggacauugacaugucugugaauuucauuacuggauagugaagucaugcuuaucaaagagcuuuccagaaauuucccuuguauuaaagcuuugguuaacuucuaaguuuagucaggggagauaauucugugacacuucaucuugcuuacuaauuuuaagaguaguccuacacaauccuacuuguuaaugacccggaagucuaagacauagaaaacaaggccuuucucuuauaccacguucaguacuagauaaauguuaucccagauucuguucuguaccaaugacuaugaaaaauuuuagaagaauucuguuauaucuaugucuuuaauauagaacugcuagaagugaguagaugaccauuaaucuuaguaggugauguagucaugcauugcuuaacaacagggauacauucuaagaaauguguuguuaggcaauuuugucauugugugaacaucacugagucuauuuacauaaacauagaugguguagucuacuacacuccuaggcuuuauaguauggccuauugcuccuacgcuacaaaccuguacgcauguuacugcacugaauacuguaaucaauuguaacacaaugguguuuguguaucuaaacauaucuaaacauagaaaagguacacuaaaaauacaguauuauaaucuuaugggaccacuauccuguaugcaguccaucauugaccaaaacauuguuauauggcacaugacgguaugugugugugugugugugugugugugugugugguauauauccucugcaaauaucccuuaauuaaaauuuugaaguuuaguaaugcuuauugcugaaagugguuugauauauaggaaaauguguaggaauucuauauaaucaaaauuauauauuauagugccugaaaguuuacauggcauauucuuuuuuuuuuuuuuuuuuuuugagauggagucucgcucuguagcccaggcuggcauauucuuuuuacacuguagcagaauuugaucagaacuaaauauccugaaacgaaugacuggcuggucuguuucuagcucuaacaugagucacuaauaaaguauuuuggugcuucaccuuuuugaaugccuuagaauucuaaggcuguugcccauccuaaaaaaaucucaagucaagauacuaguucccuauuagcugcagaaaacacagaggggaggagggagcuagugcugguagaagaaacuggauuuuaacagaacuuuaaagaaugccucuuucauuguggccagccaaugcucuauuuaucccuuaucucauugugcuguggcucuccaagcuagagaggagagaaaagauugagaaucaaggugcagagaauaagcaguagagaccaaaaggacaaaaaagcaaaaacugacuagaggaagcagaggacugaaaacacagaaaaggagaggaauuucaaagacagaauuggauagauacauauuaaaaccagugagagaggaaagugcuuucugauaaugcgaacuggguugaggucuguguauauaaucagauacuugucugagcuggaaggcgcccguaggcaggaguccagauaaucuuguggccuucuggguguugcauggcaggugaggcuagaaucuaauuuuuuucuaucucaacaucaucucauauuaagcacuugucaagcuuugauuugagggcuccgggugauuuggauuucgguguuaucucucagaaguugguuuccccacuuaguugagugaguucucauuucaccaucugugagcuucuaugucuccugucuaggugucuauuucgugcaugguugagacagucugugcagucuugaauuguacuugugacuaagaggaguagucauaauuuaccauucauuucugucagagauggacaguugauagguuuuugccauuguuuacauaaugauuccauacagccauaagcaaaaaggcagugaccucauauuaccugguaauuuaacuacuccaaaaucaaggacaaaaacugucugacaauaggcacuuaauaaaagugaagcuugucauuuguuuccuuuuuuuaauuugaguugugaauuuaacauuuguuauguuauuaauauuuauaagcguauguaacaggguuuuaucuuacacaauuuuaauucuuuguauaccuguuugugguaugauauccaaucagauuauugcuuugauaauucuaagaugaaaugcauagggaguaaaugugucauuuuuagcacaauaucucuauuuaaguuuucuuugaagccaggaaguuuggacauaagcuguuuauuaugccauaguuauaucucuuccuaaagaaaaccaccauugaauuaacuuuugcaugguguuuuucuaucaaagcauuugauccuuguuucugcaagauaauccuaagaacuuuuuauuuugagaauagaagaccaugauggauuuaauucauaacggggagcugcugcaaggaauguaaauguaagcgcuugauaagguaggauuuccuaguugcuauggcaaccuuugggucaugagccugagaaaauauaaaguaaguccugaagcugugaagaugauuauaaaauuuaacugucauucuucauuuagaguugauggcaaacauuauuuacuuaaguuuaucucaaggcaggcaaagauccauuuuuuaaaaucugagacucagaucacaaaugaauccauguugcacaugucuaacauuauaaagcacaugcagcauuuauuauucuaaccagacuauuuguacauaauaucccuguagauuuggucacuuuccuauagaagccaacaguuuucaucucuugaauucuuaaugaaaacuguagaaugcagcuguauacacugaauaauuuugcaaaaauguaugugcuuuccaugccaaaaagaaggccuaggggauuguauaggaaggaggccuuugugccuucuuuucagguucaaauauaaaugguaaacuauuuaggguggacaagcgccaggauaugaauacaguuguauauucucaaaauauaucacaaccuggagauuaaagagguagguuagaaucucuuucacuaaugcuucccaucucccgguagggcacaggguuguggggagggggaguaaaaucugcuucuucuccgaggaaagaguagauuuggggugucaaguuccuaaauugagaugugacguuuaccuguacacuaugacaaagugccaguuuuucuugcuuuaucuuuuacagaaugcuguuaguuugcacuaaugaccuaugagacccaugcaaauuacacaaucuugcaaauuagugaguaugugaacaaacacuauaaaacuaucagauacagaaucaaauaaauguaguuuauugcaggaagaaaaauagacuugcauauggagaaggaaugcauuuucacaaccagauaagugcuuuccuguugucugcuugcccaccggggagcgucaacacauuauaugaucuguggcagccaaugacuuacuggcucuugggcaaaaacaucauuuuuucaaaugcaggcauagaaaaucucagugauuacaugcauacuggaaucugguauugaauuguuucccuuauacuuugccuccuuaaaaguauuccccuuuccagcuucauaugcugaacguuuacacuagaaaggaggacaggauuuaagguuauuaagaagagaauguauacuuggcuggcuuuuuuguaccacacccaucugaaccugggagauuauuuguugccccccuuuugggggaugagguagaauccagcccacacacccagcagcauacacucugcucaucaaagcacuuuucucaguugguuuguuuucaugucuagcagcagaaauagcugcucuuuuucuuuccuuuuuucuucuggcaucuuguaauugcaacugguaaugugucuucuuccuaaccuggaagcagcacagagauggcaacauugcuccacucauacacagccuuacuccuggcuauaauccaaugcugccaccguugggucaccaauggugacccagugcaucacccuuugucuaucacuccaucucccuucauugagaaccuuuccugggccaaccaguugccuccuuuauuuuugucacccugguuaccuauauucuaucagguuugcuaaugacaauaaccccaguagcaaaaacuauaucaauaaugaacauuuucuuuuuuucuuuuuuuagguaagaaaaugagcauuuauuuagaaugagaaaauaaauaacaacaaaguacaaacuuuacaaagcuaacacauacuauaaacuucacaaaaucuagaaaauauaaugguuugaauugccugauaugacuccauaauaccuuucccacuguauuuucguaggaaaaaucuggaaaacucccaucaaguuucuuugauauaucaguuuaaaaaaugcacuugcuauuuguagguuuauuauagguuugggguuacaaacaugggaaucugagaaauucuauuucacauaaugacuauaagaaacauuucuguuuuucugaacuuuaaauucaggaauacaugugcagguuuguuacauaggaagacuuguguaaaggggguuuguuguacaaauuauuucaucaccccaguauuaagccuaauacucauuagucauuuuuccugauacgcucccuccuuccacccuucccccuccaauaggccccggugugugugguuccccucuauguguccguguguaguaaugaacauuuucaaauuagguacuaggcaccgugguaauguguuuguaugugugugugugucugcguuuacugaaugcuuuaccugauaucauuuuuacauguacauauauauuuucauuucauuuucaaaauuauacaguaacauuuuauuuuguguauguauaguucugaaguuuuaagaaauauauauguucucaagacacagaacaauucugucacaacaaaaaacuuccucaugaucugugauaagcauuuugagugcauugcuauuuaauucuuauaauguuaugggguguguacuguuaucucuuuuuuacuguuuuauuuuuaauuucuguugaggaaggugagacuuagagaaauugaauaagccaaagucacacaccaaaugaacagcgaagucuggauuggaacuuggagcuaaguucugucuaagccuagaauuccagcuuuuaugcacuguaucauauuacugcucacagaacauggcuugggggcuauaugaucaguaaaguacaaaggucuacaugucaguuuuauaugauauaaaugugauguugcaccuuguagaugaucacaagauauuuuuaugugaugcacucucaaaagacucugaaagacuaggguuauuuuuuauuuguuuguuuuguuuuguuuugacuucaaguaagacuaguaagaggacugaauugaacaucucaacuggaaaccauuagugcucugcucuucaaacuaaacuucccaacacccaagucucauuacugucaugccuauuucccucccgggcugugucauacacauagaaagugaagcugggcuuuuucauuugccauggccaacucacacuauccuaucccucuuuugaaaaaaaauagaacccuuuucaguagcugugggcucuucugugagggugagucagcuuuaggaauaauaaccacaaucuuucauccaugccuucagucuaaugugcugaugcugaaaucauccuaaauaucaauacagaauuuugcuuuagacuagggauucuccugcccucacucaguguaaauccccugaaguacaagagaaacugugagcaauaaaggaggugcuaaaguucuauuugaguggugggggggcgguggaggcaaaaugcuuugcucagggaaaggcuagugcuucauagaugguuagagaaacucccuucuccucggaacuuuugcaauuuggagcccaaccuuaaauugagcuuuacuaggacaaauguaguuuuaugaccagagccuacaugcauaucucacaguuuuaaauaauguauucaccucuuccggaugaucauaaucagugaugaucauggugaaacuaugaggaagcagcccuccaugugcucguuuucuuguugucuuuccauuucauaguuuugcuucuuaauuauaaugaugcuagacauaggcuguuaagguacauuguaaauagggauacgagcauucccuuuguauagguugagaaauauuacuccagcaaauuuuguuucaagaguucuucaggacagaauuucgauaguaugugcuuucugugauauauaugcuuaagaaguaagauucacuguauauugguauaaaauaaaggaagccagauauuaacauaaaauuguauuuuggauucuuugaugccuuaauuuuaucuuucucaaggcagcaucuuagaccuucacuccugugaguaaacacacuccugucuaaagacagaugaugggaucuguuuuuaaagugaggauguauuuaaagccuaaaagccaagaaaagaguuucuaucuucuauuuguaguuaccauucaugauuaagaggguaggaauuauuaccauaauuuagacgcaggagccccuugaaaauucucaucuucaggaggucucuaggaauguuauucacaucaucaccgaguagcuaacaguacugagaguuguauguaucuauguuuguguuuguuuuaauguuuuacuucccuuuuuguagccuaauuuaggcuggaucaaccaaaaaaagucuguugcauuugcuuuuuauaauacauuuagaguagcuaaucugaaaucacaguuuucaaucagaaaggaauuuuggaugcuuuuauggaaagauuacuacaaacuaaguuuucuuuccuuuuuuucugauuuagauuccuugaaugcacuuuguuaaugucugaacauugaaucaaauaguguauuucucccauuuuuaaacauugcaaauucaaggcaggguccucugcuucugucuucaaaugaaugagaauaccauuuuaagagaaaauggcggcuaaagugucagugcucuguaucaccucuaucaaagagacugauuacaauguugauggugauuuucaaggccaucuccgucuugcuucugcuucuuaagaauguauaauggaguccaaccuuaagacaaauaggucagacugcaaaacucugcaggaauauaagaauggauuucaaaauaauaaagcagugcaacuuugagauucuauauacuauauaaauaucuccuaauuuacaggacauaccuuuuaaacaucuuuccaccaugaugcguauuggugucuggucuugccauucucaugcauuuucagcuguuauuucuagaauuuauugaguuacugauguuuaaucuuuaaugaugguugaaggggagaaaaaguacauacaccauguucaccaauucucacugcugguaaacaaaaaaauuuguucucccuguggggcagggagaaaauauuuuugagaauaucccaucugcagauaaagucaguggccauuugugguucugucaaagauaaaaauaaaugccauguucagcuguauuaaauacuguacuugagcauaagggagagugugcauuugucuuauuucauuugucuucccagucuaugcccauuuagcacugcaauagcagugaacuucacgggcagucaggcccagucuuucauguuuccuuccaguucuaaauugaaaauauuuuuuugaaaagaacuaugacaaaagcaauuugaguuagugauaucuugaaagagaacccaauuuaagauuaccuuuaugguuggucauuguuaccuacaguaggcagaugucauggugaucuucuugauauuaguauuccgagagagucugaccuggcaguguucagguaacaucagagagugggcuauaauauugagauuucaagugguggugcaaagggcugcucacggaaagcuagugcagagagaaccacuguaaccgagaaggagggcagccagccauucuccucauccuucuauauuuaguaaauaccacgugacagugaguggcuaauuaaaguguguugggagugagcuuuguaacuguaaacuguagagaaggaaauaggaaaacaauggugucuucgcugauuuuccaaccuguaacuuaaaauguugcaucuuuccaacucuuucucaaaaacucaccacgcugguaaaaugucaucauaucuuucagauuugugucauuacaauuguaacaggaucaaugauucaugaacauacggagcuaaagucucuuacaagaugaaguggugacuaggaggagaaguuauuguuaaagaggaccaucugucuuugaaagugugauuuacugaggcauucaccucugccccaagccaugaaaauaggaucuagugacugggucucaucgucuuucucuuccugccuccuucccuuucuucuucuccucauucuauccuuagagccagaaucagucaagagauucaguaagaaaugaugcuacugugaaucacauagcuucuuagagcaucuuauuuacguuccuaaaaucccuaccagacaaauaacaaguguuaaaauuguuucuguguuucagaugaggaagccaagacaaggagauaaauuggcaugcccaauacagaagggugucaguagcauugcugagacuugugucuaagucucuacuuuguggauuauucacggcaacaauuauucccaugagaaucccuaauuaccaccuacaucccugucaguugguggugaaucuguaacaauucacaaacugcauauucugccucugugugaugagagaauccacucuuauuuuaaacuaugcagaaaugagaggccaauguuacuucuaagggaccaugcagugcaguccagagguaaauaugaaugacauuuagcucugccguuuuggcuguuccacauuagugcagcucuccauucuucuacauaaccaagaguuaguuauucuuaaaccccaguguucugucuacucaugcacaauuuaccugcauuucucaaauucaccauccuuuaguguguuuggcuuuuaaauccauuuuggugcuuacaguuugugucauguucuuggcccuuagggaugcauuggaucacauaggauaaucuauugaacauauauuaguuucuugaucucaguagaguaauggaugcugaaauauuucagaaagauguauucuguaacgauucaggaauugcauacucugccugugucagaagcacaacauguaugauuuuaucuguggcuuaaucaacaggaaaaaaugccaagcggcuuugacuagcuggcaguggaucuguuuguguuugccuuauuuucucuauaagacaccugcuggagaugagagccggcacaaacaccgaguagguauccagggcuucauuacagcaguaucucuaaugaucaaagaagccuuuuuuauacaaucuuguuccugaucaugcagcugaacaucugucuaccugucuguccaccuuuuaauugcaucauccaggucucucugauccuagacggucugucagugcagcucugcuuuccaccauuucugaucauaguuaacacaaaauuucccacaaagcaaaacaguaaaacugagagcuuucuaauaaacuugaacugaaccauuuuaugagaagcuaauuuucuauugcauauccagugaaacccuugugcuaauuuauucuucaaagccaaauacuguauagcaaggaggggaauguacuauaggaauacuugaagcauuauauuuacuggauacaaaagaagcuuguucuacauagaugcugcaaucugcuaaacacugauuuguuuuaaaaaauuggcaguagaaagucaggaauuuaauucacugauuuauuuauguauucccuugucaaauacuuauuaagacaaacccauuauguauaggacugugugugauucaagagugagauacuguccacacucuaaagaugagauucauguagauuaauuauaagagaaacauuauacauugauuucuauaagaaaauacucaaaaagcggcaugguacuugucucauucuguuuugucuugcuaaaacagaguacccaaagugagauaauuuauaaagaaaagggauuuauguaguucaugguucugcaggcuaggaaguuuaagggcaugucccugacuucuggugagggcuuucaugcugugucauaacaugguagagaagaucaaaggagaugcagacacgugcaaagaggaggaaaccugaagaguguccuggcuuuauaacaacccacucucuagggaacuaauccauuuccacaagagcuaauccagucucaccagagugagaacucacuacugcaaaagcagcaagaaccagcaccaagauguucaugagggaucugcccucauagcccagacaccucccacuaggccuuaucucccaaacccaccacacuggggaccagauuucaacaugaguuuuggugcgggcaaacuuaaggcauagcacuacuccaguggagggagaacucacuuccaguggggcuaauagaaaaugucuuuaugggccaggcacagucguucaugccuauaaucccagcauuuugggagucugagaugggaggauugcuugagcccaggaguuuaagaccagccugggcaacguaguaagacccugucuuacuaaggccaaaaaauauuagcugggcaugggugcacucaccuguagucccagcuacucgggaggcugaggcaggaggaucacuuguaccuaggaguuccagguuauagugaacuaugguugcaccacugcacuccagcuugggugacagagugagacccuguuucuuaaaaaauauauaagaaaagaaagaaaaugccuuuaugaaaggcggagcccuuaaguuaagcauugacaaaugaggaagauuuguagcauuuaagaauauaguauuaauaguugaagguauucuaaauagaaggaccagcauuagauaaagcauagaaacaggaaaccccaagucauggugagagaacaguauguuguaggcuaguuugaucaaaaaccuggagagaguaauucuaugagaaaucaugcugaaaaagcagauuguaguagauccuuuagagauuugaauauuauguuaggaacuucggauuuucuucaguagaaagcaggaaguagaaguaauugaagccuuuuaagaagggaaauugcagaauuuauauauguguguauauuauauaugugcauauacauauauauuauauauauauauauauauauauauauauauauauauauauauaaaauaucuugaucaaagcauauaguauggauugcagacggcagagaguggagccugggagauccuaauaguccaacaaggaguacugaguacuuuaaccagggcagaagcagugggagagagacaugaagacugaccucaaggauguggaauguacaaaggcagggcaagugaucacaaaugagggagugaaaguaacuuagagagaggccagaaggaagagcagguggacguacugaugugauggauuuugccgugaacuuguugaaugcucacugaugcaagugaaagugcccaggacucuauugucaacauggaguugggaguggaugaaaugcgucagaguguagaaacaauucaugguugaauugauagcaucugauaaaacaucucuaagcaaacuagauuaacuaauaagcauugcugugucauugagcugauauaauucuuuuuguuguuguuguuguugagacugaguuucacucuuguugcccaggcuggagugcaguggcgugaucucggcucacugcaaccuccaccucccagguucaagcaauucuccugccucagccuccuggaguagcugggauuacaggugcaugccaccaugcccggcuaauuuuuguauuuuuuuuaguagagacggaguuucaccauguuggccaggcuggucuugaacuccuaacaucagaugauccacccaccuccuccucccaaggugcugggauuacaggcgugagcacugcgcccagcugagcugacauaauucuguguaugagugaggaggcuuaucacaaguaaaauuuuuauuuaggcuuuuugagaucuuuuugaaaauuuuauaaucaccugaggcuucccucucuauuuuauuaccuuauaagaacccucagaagaauagccacauuuaaugggcaggaagcaaaggaggaauuggaggugggugugguacaaaaaaaugaaaaaagccagaggaagaggaaggcccuucccaaaguuaaagggagagugcugaggugggagugggucagcacaguauuaaauacuagaagagauggcgguagaugagaacgggcuauugaguguaauguuuaagaagaaauuguuucaagagaguaguuucaguaguucaguugcauuaaaaugguaagagcugaaggaaggaggguuuggugaggaaguggaggcuguagguguacacacaccaccacuggagaacaggcuguguuucucaguggugcuagcagaggccuccucuggcaaaugcaugacuugagaaggcagcccagguuccuugugaagagucuagaggggugugguaggggucaccagaggcuacgucuggagaggcaggcucauccugaucauguuuccuggccaguagccaucugagcauuguccugguuauuaccugcacugcugagauacuucaccccaccuaauacuccaaacugaacagugguggguaucaggaagccaucaugaaucucaauaucugauucuugcuugugaaauaacuuaagauauguuguuuuaauuuccuuauuuaccucucuaaaucacagaaucugaacccugugaguucagaccguagaguaccuucagauucuaaaucauagagucugaagaucauuuauauagaauaacuggccuuaugccugagaaauaaaaaguuugcuucuuauucuguuucugugcuugaauuugggacuuaaacuacaguuguugauuacuaacugaagucugcuaaauccuuggcuuaggcagcauaauaacacaacuaaucauagccaauaauaauaaauauuauuaagcaauaaugagacaaaaacuacugugguugucucauucaauaauacuggcuccagggcauuuacaguauaacauuuuguauguuugcuucaaauuuaugauuuuggguuagaugagacuguaggauagaaacuuuaauuacaaguuggguuuuuuguucaugugcuguggaauaagggauggaaaccucagagaucuucagaagaguuucuggggucucuggagggcagaauaguuauacuggaucuuuuuuuuuucuuuuugagacggagucucgcucugucgcccaggcuggggugcaguggcgccaucuccgcucacugcaagcuccgccugccggguucacgccauucuccugccucagccucccgaguagcugggacuacaggcgcccgccaccacgcccagcuaauuguuuguguuuuuuaguagagacgggguuucaccauguuagccaggauggucuugaucuccugaccccgggauccacccaccuuggccucccaaaaugcugggauuacaggcgugagucaccgucacccggcccuggaucuuuuagcuauaaaaaaagucauuggaaacuuugauuuucugccucuucuccucuuuuaaugucguuucuucacaguaguuuaaaugauggcuaauugugcugcagcauuugguaaaugucauauaucuacuuuucuaaaagcagugaaguaguguaaacauguggcaucuuuuuucaaaagaucuauccaguaauuauccugaaggcuauuacaguaugcaaauagcaaggggcguccuugucuccuaaauuagaauaucaauauugauucaacauguucaaaaagaaaacaauauuucuaacaaauguuaauccugcuucaggauaguggaaaagacacugguugccaagcuuugauaggauuugaguucugggucccccauugacugaucugccugucauuugaacuaccgccccugguuucauuuuucucaucuacaaaaugggcaugcugaugucuguucugccugauacacauaucccuuggaggauugaaugugauaaugacuugguauaucauaacaugccauacaaguguagauuauuauuauuucaggagaaacuuugucaucucugaauuuuuaauuauuacuaauuugaaauguucugagcacccgauuuguucuggcuuccacauagaauuuaaauuggccucagauaaggaugugccgugcuuccccucuuucauauuagggaaguugaggcauguagaugugaaauugacugcuuuuuguuuuccauugaaaucauuucuccuugcauacuauuaaugagcuuacuauacuugguaucaauuaaauucacauugccugaaauuacugcaugaagcuacaaaaaauaauuucuucugacaaugaaaugauacagucuuacagguacuuuuaguuuuaauguaaacaugacugccucugauccauuuaauacucccaucuuggugugcuuguauguauuuggaaucccuugacuuuagacuugaacaagguugucagcgacugugcggaaguaaguguuuuugccaucacaccagguggaugaccccuccagcuguuguuucagugggugguaagaaacagaagacaagccccuagucuucauuauucuuaggugugaaaaauucucccaauuguguuuuccauagguucccaauauaccaauuacuuccuaaugucaugcagacaccuauauucucagaaaugccaaagaaaggcugcucugcaaucucucagaauuauuuucccagcugaauuugucaguccaaauuuaaaagagcaacaggcaauuaaauauucauuuuuaauuuuuuugucacucacugcugcaggucacagguuuuauaagauuucucugacuguguaguacuguauacuaaacccuguuuugauaguauuaauuaauauucucuugcaggcccaagugagggugagagagagauuuggcugggcauuuugguacagcaaugcuaauuuauaggccugggcaguggaauauuauggaaguguguaaugauaauaucaaaacugcauuuaauucuugaagaggaaggaaggcuagcacaugagagacagaaucugcuguucucuuuguaagugaaaggucaugcuacugagcgcugcgggguggauuggugagaaaugagcucccguuugcuaggaauuagaaugagucuaucugauuuuccuucacuugugaccuuuaaagaugcagcuuuuagauugauaagcagguggaugcuuuuaguaacccaaugcagaauuuguuucauauaaaaagacuaucuuucagacacugaagauauugcuuccacaaaggguuuuuuucuacaaagccucuggagaaagaaauucagugauuauaucuuaucugucacacaaagagaaaauucagaauuacuguauguucaauuagaacauuuuuuuuucccucaaagcauuaaucauuuccuggaacacacauccuccaguuaagaaucucuaggaaggcuugacagugggcacuccucguugcucucgccucuggauuuccugcgccacuccacagagccuccuccaugcccauaaaagagcuuccuauguugcuauaguaauccuuucauguugggcacuacgcuaucuugaaggcaaucagaugggaacaaggaguggggagcaguauagaguuaaugucaggcagcugaaggugaucugcgcuauucuauuuggagauguuuugguaugcugaagacgggaugccagucaaugcaagcccuuagcccacugugggcccaauuugauguuuagauauuuaaauauagaguuuuuuaugacacuugugaacucuaaacaagccuuuggauuuaaacaaguugaaauagcuuacuuuccauagccaacaagcucaaauuucucuuccucuccacuuguuuucuguucguaauuacaucauccaucuuauuuguucuaauuuccuccuuuuauuuuccuuaucuccccagccaucaacagcucaagcccaucaguguguguuuuauuuugucaaaugcugguguuuuauuggggcuucugugcuguuucuguuucucauuugauauuccuaccugauaauaaauucuucauaaagcaccccugaucaaauacaucagggcuucauucuuuuccuguguacagguuuuaauuuccuacucaaaaucacaaaugagguuuaaaaaaaugcauuucucccgcacaguaugccugacuuuuuaaauguuuagggaaagcagaggagugagcugagugacuuccauccagcagacuuccugccacugucuauggcaagagucaucagcucuguuuuccucucuaauuuaaaaauacccugcuuuuaaaaaaaacuaacccaguagcguguuguauagaccacguagaugaacauuccccucagaagugucucaacacugcagagccacuguguauagaaaaugccagcuuaucugcaggcagaaccaccaggccucugcagacacugcucucaccuuucugcccuucccuccaucuguuuacaugugcaugcauaauuccacauucacugaaguccucccaggcacuguucuaggaucugagcacgacgcuguggcgcucguggaaucuacauucaaaucaauuuugaccuaucugaaagagaggauaccuuuguaggaggcucuagacccacacugugugucacagaaagcacuuagcccuuauggcuauugaauuuaacuuaagcaaaauucaauacaauuaaaaauucagggccgggcgcggugguucacgccuguaaucccagcacuuugggaggccgaggcgggcggaucacgaggucaggagaucaagaccauccuggcuaaugcagugaaaaccccucucuacuaaaaauacaaaaaauuagcugggcgugauggugggugccuauagucccagcuacucgggaagcugaggcaggagaauggcgugaacccuggagacagagcuugcagugagcggagaucgcgccacugcacuccagccugggcgacagagcgagacucugucucaaaaaaaaaaaaaaaaaaaagaaaaaaaaagaaaauucaguuccuuagucgcuguagccacacuucaagugcucccauauguugagugacuaccauauuggacagugcagauacagaacauuuucauuguaccagaaagguauacuaaacagugucaguguagaucguccaccauucuuaaagguagacaauuauuacagaggaaaaucuguaaauaaauaacuugauuuauuuauuuuuuuauuuuuugagauggaaucucacucugucgcccaggcuggagugcaguggugcaaucucugcucacugcaaccuccacccugcggguucaaacaauucuccugccucagccucccuaguagcugggauuacaggcgcccaccaccacacccggcuaauuuuuguauuuuuaguagagacagguuuucaccauguuggccaggcugguuucaaacuccugaccuuaagugaucugcccgccucggccucucagagugcugggauuauaggcgugagccaccgagccuggcaauaacucuuauuuuucaucuccagaaacguuuaagcuuuucuggcuucuucaguucuuccugagaacagucagcuaagcaaaaucaacauguuccuuauccuaaccuggggguagugugagguuuacaggaacaggagggaggagggcagcugaaauugaggcucccucugagcuaccugagucaucugccuccaguggagaaggucaagaugggaagguuaaagaggaaggucaaggugggaaagcugaguaccaauccacuuuuucauucauuguuuccagaaacuuuuuuuaggcauugagaggcaauugcagugaaguaaauacaauauuuuuaucuguaguggaaggaaacaagggucaaacagugacagggcagcaugauaagugccaugauauaggaaugccugagagacugugggaacuuggaagacauuguaccugacugcccugugaaguggggacaagggagagaaauaggaagagguacaucagagaaggaccacaaguugugugggcaguguaguuuuaguuugcuugucuuugauguaacccucuuuagcauaaacugauuugaaagccaaguuauauagaaacagggguuggugauuuuuuuuuuucuuaaucauaaaugugaugcuguauuuuuuuaaaucccgaaggugauuguugauuucauaaaauaagcacucauaaaauucugcaaguaacaaaacccugucguuccuuugaaauguuugcuguaaaauguaauuuuuucuccuggacuucuggaagaaaaguauuucauuuggagcuaugugugagguccugcuagaauucuagaugacccauucucuccccaacaucaucucuuacuccugaucaugcuggcuuccuugcuguuucuggaacacaccaaggccauucucccuguagggcccuuguuuuauugcuccauuugccuagaaugaaacacacuuccucacagauauucacuuggcugucuccuucacaugcuccagauucugauggaauuucuucacacagaaugucauuucaucacaaggccuugcugaccacccuauaugaaauaucagccuccccacacacugccccaacucuccuaaaguuuucaaagcacugaucaucaccugacauaaugauguuauugucuauuuauggccugacucccaucuuuaggauauaugcucccugaagacaaggacuuggauguauauaccgucauaugcccaacaccuagaagagucccuggcauguaguacgucucaguaaauagauacugagcgaaucauuucuaucuugauuuauguuauggaucccaaaaaaaugguuagguuaaccuuucugaugauccauuucacuauuccuuuuguaaagauaauugagacuugguguuuuguggcaauucguaacucaguaauucucaguaaccuaaucucagaggccacucucaucuucaccacaccaaagaacuguuaagcaaaacugaugcucuguugcuguuugucagcugccugguugucuccagugugguaguguucaaauacaauucacuguguuugaacgcuucuucuggcagaugacuagagugcgcuggagaagcagcagagugugccugugaggccaggagcguggagcucucaaaggaccaucuuguuuuucugguuuuaaaccagguaaucugggcuugccuuuuuuccugccuccguccccucacccucugucccuuucuucguuucuuucuuccguccaucauaccuuucaauagaauaacagcaacuaauaaugaaaucauccccauggaggcagguguuagaguuccauccccaucaaccugguuuucagugcuguagaauaucaguguauaaacuucagaagaaaaacuucagugcaagauauacaagcuccuuuucuugcauagcaugucauucuuaauugagagaaugcaauguguuccugcuuuucuuuggaugcuuggcccuaaaucuaaacagaaaagaaaggaaaggcaguguuucaaacaggcaauaguugggagaaggggucgggagaaacuacuucucuuuuauugauuuugugaaauuguuugaagaaugauucagcauuuugggauauaaaaauaacagcuucgaguagcuuuucaauuaggcgaauguacuuuugcugaaagguucuguuguucuugaaaugcacuuuccuucuguucuuuuggagccucuuuaaucaguagugaugugacaggaggugcggcaaccuccccaacaccccugcuucuuccuuucccucucucuuuugugaggcugaguugccaggaaaacugauuggcaaaauuguuccuuaacuggggggagagguaguucuguaaagacaggcccuaugcagaacauaacaaauugaacuaccagaauguauguuuuaccccaguuggguucuguuucaacuagaaauccuaagcagccauggacugcguuugaagcaggcacuuauuguaaauuaaaauauuacugagguuuccauuuuuaaaaauaguauuacuuugagcagggucaugagaauuuuuguuucauuauuguguccacugucaggucacugcauuuaaacuccuuugaaaaugcauauaguaaucaguuuuguauauaagcugaaugcccugagccuuaacagaauggcuaauagguguuuccuggccuaaacaaaaugaaauuuccuuugguucucuuuguguauuuguucuggagugugagugugggugugagugugugaguguugaugugggggagaaaagauuauacuguaguauuauauuagcccuuguugaauaaauuuaugauaaugggugcuacagauuugcugcgguugcaaaguaaacuucagugugcauauaacgaguagcaauuucguuugcuaauuuaaaaagauuauauaaaaacauuuuuaaaauuuaauuuuauuuacacauaucuaaacuaccaccucuuuuagaagaacugaagaacuaagagcugauuaugucucuuguuacuuaugcuuuuacgauugacaggugucuguggccuuugaguauaucauggugcuuucugcuaaauuauuucauuuuccccucaaaacaaccaugucuaugauaauuuuauggaugaaaaauauugaggcucagaaaaguaaaguaacaucacucuguaaaagcugauauugagugccaagguuucaggcucuuggcggggcaccggggauucaugcuaagauucaagcucugccccacaggacccacaugaugagagagcuacaguggcucagagggagggguucaccgagagcucagaagcuccagguguaaccccagcugccugugugcucuuagacacauuaauuucucuucuaccucaucuaucaaacuuaggcuacugaauacccucuuuguauuuguuuucagauuaaaugaaauauaugaaaacacauagcagucacucagugaguguuaaauuuuucuuuauauuucuagcccaugucuuuucuucuuuccuuauaccaacuugcaucauagacaccacacuuguaaaacucuuucaacgauuccagacuucacuccuuacuagccaggugaccuugaacaaguuauucaacucucugugccucagcuuccucacuuaaaauggggauaagacuacuacuucauugggauuuuauugaggguaaaugaacuaauguaucuaaaguacuuagaacaauuuguagcacagaguagguacacaacgaaguuuacauauuaugagcuauauuaguuuuucuccuuuagauuauaaauuguguucacaauuguuuucagugugaaugugucuauuaaaacguuuuaguaaguucuaaguguucgaucugauuuuaagccugaaagguaaagucauacucuccugaguccuucgacuguauaaaucaggggguuggcaauuugguuucugauuccuuggcauugacugaucaacauuugguucauuggugagcauuuaagaaccaccagugagagcauaagaaauuagcaauccuucauacugucaggcagcauugagauugagcugucagaggcugagggugaaugcuucguuggauugacucacugaaccagcuguauuucuuugucuuccauggcauucuuggauagaguccauuuaacuaggaaguaaagacuuuggucaguucauuuaauaagaacgaacuuagaaaauccugcauuaaccacuuagacguauugaaaauaggagaacauuaguuauuuaacuaaacuccuuuaaaaaucaaaaauauuagggcaugaaauaauacauaauaccuuugacuuuaaugcacacccuacauuguaacuuuaaagcauuagaaaauguuuguauucuuucuuuuuuaaaaaaaauuaaucagagugacuggggugguuguaguggugaagaaaaaauagaaaaggaggaacuagacauuuggaauugugcuugguuacaguauguaaacuuucaugaaugugcuuuauuccuuuuugaaaacuaucuuccucuuacguuuuuccuuucuguuuuuuuuuuuuagacaaaccuugucugacugacuauaaccuuuaaauaauugguaaaguagagcagugaaacugacaugaaaaucuauugaaaagaaauggaagccgggagcauuauucuaguaaaggacuggcuagccuauuguucccuucucuugugcugugugugggaauuauuucugcuggcaacagacaacaucgacaguaguaguauuaaaauaauucacaucuauuuuuguuaguaauaauguaauacuggaucaucucuaggccacaaaauaauugacccauuucuaggagcagaaagucuucaaacuacaagugcuucucuugucugcccacgucugcuuucucugccuccucaccauacacacacacacacacacacacacacacacacacacacacagagagagagagagagagagagagagagugucugggcuuguagaucuucacccugguucucacaggccccccugccuggaacgccacuuucagccucaauaauuuuaccauuuuucaggagcaagucuaggacccgaucccuuaaagcuuuucuucacuuguccauugcauucaguccuauucaagagacauuugagcacuggagauaccacgcugaacaaggugggcaagccucuguacugagaccucacaguguaguggggacuuguaagcaaggccaggccuuuacagcagcaugguagacacuacgacagguggcacagggcccugugggagccuugcccagaccuugccuagucuucugcaccgaucccacuuugcccugaaugucuggcguggcuuuaguagcuuccagggaaguuggcauuuaauuuuuugcugccuugcauuguuuucuuucugucuguuaucucccuggcuggaugguaacuacuuugaggauaauggacuucauuuuauuuuuaugcugccuuuuuaaacccuauagggucuuaaacagcacucaguggaugguaaauacucaguaaacacucacugauuugcuuagacccucuucccuucccuccaccucuguggcuuuacacagggaugacuuccccucacugcguuccuuccaauaccuucuauaauuugaaaauggcuggccucugaaccuuguuugcuuaggggcagugaacuccagcugauuauagucauugucuucuggcccuggguucuugggcagcaacaugacuuccuucuaccaaccuauccuuucuuccucagcucccaucgauuuaauuauacuucaggcucuccaggcacagaucuaccaucaccucuuuuugcguagccucuaaaaugcuuuccucuuucagggacuguuuuccuaaugagggcagaauauaauuuagaggcuuaauuuuagaaaacuauaugaagcagcagacccauaaaauguuaugauucacaaccacuuguuuuguucucauaaugcaaccuaaacuaaaaagccauucaucaaagcuauaaaagcuguucauggcugucuuuaguauaucguguggagcauaauucagcccacagagaggcuaaagauggauucauggggccauuugccuugguguacguuaaaggccaguaauuucuaugcucuguagaauacuguauuuuacuauaaacccuggauuuuuucuuaaccccacuuagcuuucguuuccauuuuaauauaagcauguccccauuuauaaccucuuccauccccuguaaauaauugccaagauccugacuguucccuaauucauaguccuucuugucucagcuacuuugaccauuuaaggcgauugguguaugaagauguguugaccagaaacccaaaaugcagccuccauggagagcugccuuggucaucugucuccucuaacaacacccuaggagaaccauugguccucccaucacagcuccccagagagcaaauugccaacacuuuccuagaaaugaaugagggaacaaagcugugggcauucugggcuauguuuuuauaguguugugauaagaaugcacuggugauugugaacccaaguugcuaacuauagugucgucagaacuuaagaugccucuuauauuguguucauauuuaaauaaugaggucugaccuuuacauuuacucauaaucauguaucuaggucaucacgucacauuuucaaaaguacaagauaauauccuggaagcuaaagguuccagccauaggguagaugcagcuggguuugaauccuggcuuggguaccaguuuggcugugcuuccuuaagcauguuacauaaccacucauuuucuucaucugcaaaauaagauuacucacugaaccuaucccauaggauuacugugacgauagcaaaaagauaauccauauaagacaucaccauaguacuugguucaugguaaucagcauuacuuauucaguaauucuucuuuuuauuaagagucuaccaaaaaaaauaauaaagcaaggaacuggaaggaucuuauuaaaucuagacaaacauuuucaauaaaacucuaagauggauggcuugugugucuuugauacauguuuuacuuuguagagcuaguuuaaauuguguuguaaacagaaggacaccuaacaaaaaaugaaccaguuauuuauuuaaccucaugauuaaaugucagugacaugguguucuuuuuuuuuucaguuagccauuaaauauaguauuaugauuuuaaacuuaccuuuugcacaucaguuguuuagcugaaaaguacauucuuuuuauuuauuaggaacuaagcuuuuuuucauugaaaacugcuguaguuauagacagcucauguauuuccacuuaagguguaccuuguacugcauauuugcccuggaucugaagauccaucuuuuuuuuagcagacucauuuuaaacucucauagaacuaaaugauuuccuugaagaacaaguuucauuauuuggcagaugaaacuggagguggccauucagaaucuuaagcuggaucacacgauuuuuaaaagcucaacaacuuugaaauaaauucaugcaaaauuuauaauagaaaaaugguuaaaaaaauugagaauuguuuugaaaguggcuuugcccccguuuuaaaaaucuauuuuucugcaagauguaaaaauagcauuuaucuuaguguucucuuuaagcucaagucuugagggggacaguucccuaaaauuaaacucuuuuggcugaauuaauacucccaugauuuauuauuuuuauugggaguuccugggcauucccugugcuacaaaagagccugccuccuacgcucuggauaaguuuguuaggucuguucagaauagcuugacacaacuauggucaggcaucuuccaggacccauagcuuuaggaaugcucaggcaaaaagauacagugugguucuuucuguagcccuuuuccauaaugaaagaaacagauucugucuuguaguuggguggauuuucccaaucuaccgggaguucaauccauuuauagcuaacauuaggucaaggccagaggggccauagcccucgcaguugucauuagugagcucuuauuucuauuccauugagaagcugaaauugacaaacugucuagggagaugugcaguuucuagcugccuguuuuugagcagaacgcauuaaggauaggucacuucucaugguagaauuccucgucauuaaucacugaaagaccaaauuccuagguaaauaaguaaacucguugauaaagccacaucuugauagaaaauguaucuucuugacauccuccugucugccagccuggucagcaauguugcugcccacucggaacagacugccuuguuuaauucuguugauggagauacaccacggaucugugaagaucugagucguagcuguugcaggaggccugcuuugauuuguauacaaugugaauaacucucuguguauucagagugcuguaauuuuuucuucuucuaugccuacagggacuggauugccuuaucaggguaaaguucauucgguaggacuaacaauuaauccccuguucuuucuguuuccugcuuucuuaucugguggcuacauuauauacaaauuccagcauuuuucaucacuaugccacauaaagcaguuuggagaugcaagccauaaaaagcuuauuuuuauaaccccucuagaaagaaagcugcucagauuccauuugagugaaaaaggcauuccauuuuguggccauguuuacaucuacuaccuaaaccaaguucugggagaaugagaugaccggcugugacugaugagucucuauuguccaauagagucaaagaaaagaugguauauuuguuaaagcuauucccacuauccaugagcuuccuguacacaccacacugucuguuuuguuucucuugcuuuauaacuuuugaaacacagaaauaagauagucuguagagguuaucaacucaagauucacauccuuaacuggauagcaaaugucuuacuaauugaggcauguauuuaacuggauuaaauccaguggcuugauguuagcaugcauugcggccaagucugcuguccuuugaugagaaggggcuuagcuuucuacagcugugcaguaugcgagucacgcacucauccuaggguacuggcuugccguaauuucauuuggggacaggggaacauugcagcgugaugagcuggguaggagcuaaauauuucacauguaagaaggaauauuguucuaauuaaacugaaugcggugcccauggcaagaucugcgcuuaauauauuuggguaugugugaaaaauuacauauauuuuuuauaaauuuguccccaccccauccuugacaaaaagcuuuuguuuuggauaucauuuaccauagaggaauuaugucauuaaagguauuucauagcacaauaaaaucugaagaguuguaacaguuuccccagcccuuaaauguuuuucuuuagaaaagggaagaguucaguuuucaccuauaacuuguaaaaugaaagaacaaaaucucuuugcauuaucuaauacagaaucuauuguacaaaucccugggguuuuaacuguuuuucauuuagaaaagaaaagcaauuauagcauaaaguagaucuuggauauucaggagaaaauugggacuguguacaggauaauuccccuuucuuagccugaaacuuugcucuuacauggucuuugugaaauauuugguuggggaggagguggguaaaaauguuaaguaucugauuucacuugacaacccauugguaggcauugacuauacccccaaauccauuuuugcaaccuugaaacgucuacuuaauauauuacaauuagaaauaagugcuaaugagucuaguuuucugacuuauggguuguuaaagggucuguccacaaagggcuaguggaaugugggauuggagaggaugacauucuuagggacaggaucgucuuaccaguggucucugaaggucugacucaacugucaucuugauuugggugauucccaaaucugcagcuucacccuugagcucacuuggaaaauguaguccuacacaccauccagcuaguggaacacauuaucuacuuuucccugcccacguccuccaggcuucccaucuucggcaguaaguccuaguccuccagacucaaucuuggcauuuuccuuuauucccuccauccucucucaccaccauuuugugaucaaccacauuguauaaacuccuuccuuguaauucuaggaucugaucuuuccuguggagacugcugcuccucccucccugguucaggccagcauugacuugccuggcaaugcuccaguaaccucuucgcuagucuuuuuacuuucaugguccgcauuucccacccuuaucacacaacauucaguccuucuuacaaacuucuguagaauuguucuucguggaauacacuguggaaugugguaccucuuuacccuguucccucuauacucaucgacuucuaacuaccuucagucauuuuucaacaucuauaggauaaagucucuauuucuggcucuggcauucagaacccuccauaguaaugacaaaauaaggcccuucuuccucucucuuaacuccuaccaguccuuucugaaauauucauaugaucuuuauuaugcccugcuccuuauccuaguuauaugaagaccuuucuuaucuauccuacuaaauccugaguugcuagagguuaaguucuauuucuuuuacuugcuuauauccaccacauacaauucuaacaaacugugacuaguaauaaugauagcuuacauuuacugaacauuuucuaugugcuaguuacuguucgaaguguuuacauauuuuuuucucaucuuaguucacagggcggguauuauuauucuuucccuuuauuacagugcacauggaauuuaaagaggcagaaaugaucacuucuaugcaacauaaucaggcaagguuucauggcaauccacaggauauaguggugagggaauuuauuguagagauaagcuucucugcaggggaugaaaaugugauuggggaggggugggaauuacaggauagguagagaggggcauggucaucggaaguuugauaccagggauggaagaaacugaggaugaggaugaaucuuguauuaaguacauuggcaagcaguagagaaaggaguucugcagagauuugugccuagaccacuugcucaguauuuagcacaaauggcuucauauucuucuuuuugucuauucugucuguacagcuagauccuaagguccuugaugaaagggaaugcaguuuauucuuuuugguaguuucagcauuuagucuauacuaaaugccuagucagugucauuugaugacgaguaugagaggaaaaaauaaaaauauuacaaaaggcagucucuccuccauuaacagaagccuucuucaugugaaccaagcaugaggauggcguauaaaaccuauuuggagcaggaacuuuaugaagaauagaagagcuucuuuccucucaucuuucacaauuacucgacccuaguaauuguauuguuuuaaucucugaauucgaugaagggauuuauaacuagcauuucuacuaguuaagaucugcuuuaauuuugacauuuaguggaauaguccccauaauuucacuggacuguagauuauuguuguuauuauuauuaaugauaguguucugcacauucuguuguuguuaaagaagaaagcauacccuacucuuuagcaugcauuucagggagcugugagcccuguguauuuugucaagccauggcuuucaucgagucuccguaacaacauuagagcuuggugguugaugugagcuuucaggguaucaaugcugcauaauaauacuaauaggcaaaacaaaacagaaacuuguaggagcaaaagauguugcuauggcuuacuuugugguggggcauuguguugcuggucagcaauauguucccgucuacucaagcuggcuuuuggcuaccaacugugagauguuucguugcugacaagccuuccccauucuguauuuugcccucgggcucgcaauuuacuggaugcaaucuuguugagaaaauguggucuuuauuaguguucggcacagaucgacuuuucuuuuuccgcuucugcagagcuagugggaugcuuggugcagggaagaaacaggggacagaugacaguaugagggcaggaaaauaaggguuuucgggugcugagaaccagaaugcuggcuuaguguagagaugauuggagcagcaucuaggguagaaacagcuuauuuguacccacggggcuuuuggcagcauucuaaucaacaacuaauugucagagaaagauauuugucaauaaaaauacuuguaaguuaguuuuuagguacaugacaaauaaggaaacuuaauuguauaagacaguucuugcccuccagaguuuuaugauguaaugagaacacaaaaauaacauugaugcuccccaaaucaccaugaauauguauggcuuuacauacaauauuuuauuuuucacugugaggaucugugcguguauucuuguguauauuuuucuaucugucuccacgccgcuuugucuguugacuuggcucuguuucauucaucuaauguauucuacaaagagauuugugaguggcaugcugcagcuaccucuuuuccuucucccauaugcugucucuuuaacaaaugcccacacaugugacuuucccccuccuaauccugauggugccuauuguuuuaagcaguuccucgauuuauagguguuacuggguagcuuuuuaagcacaaauacaaaugcauugcaaguggaaauuaaaugccagagcaucugugaaaaauguaaaucauagucauuuaaaauagucauucuaugaagaauuguagagaugcgaaauuaauaaauacuaguauaagcauuaaauauucacugccugcuacuucugaaaugguacaacagcaucauuuuuuaaugauggguaaugauaaaacacaucaauuuuaaauaaccuguuuucuccuuuucuccuucugaagcuaugaguuggcaagcuugaaauuaaauacaaguaaugguaauaacuaagcuucuguuaaccuuagucauggaauagacacauuuuuguguuuccuggauguucuguggcuauuugaaaagacuaguaaauugaaaauugcagcuaaugggaccagcuugaauuuaaagaaaaaaauaugucuccguuaguggaaaacaggaaacguggaaccuuaaguagcaagcgcaccauuauccucuaacgcauucuuauuuuucuccuuauuaaggcuuacuggguccucuuagagaaguuaaaaugaaccuuuaacuaagauacauuucuauucccuccccuccaaccccucuaaaaucucuuaaaaacaccuuuauuuuuaguuaugcuucacuaguucuuuaauaaguuacuugcaaaauacaagaguagaauuaaagagccaacaauuauaucuugaauucaugugucccuaugcuaccaaagaacuguguacaccuuuuaucuucaaucuuauaugccauacaaauggaauugacagaaauuuuucucucuauuucauagaugggaaacaguaaagcaucuaucuccuaaggucacguuguaaagcauguuacgaguuuauguguccuaagauggggaagggcaggauguugugagucgcgagccugucuagggagguuggagugagguaaggccuccugaaggaaaucgcaccugcacugagaucugaaaaaugaguuggaauugauugggcagccaaggggugagaaagacgugggcgagaggaggacaugggugagaggacgugagcgagaggagguaggcauagagaaaugacuguauguggcucccacggggaggggccaugccaugcuguuagugggccugauucugggcaguggcgcaauguggggaaggauuuuugugaaauugaaaggaguggguuuucccaaguuuuuccaugcucauuuuuucucuugagcugguuaagaaaauggcaugaccauuuagaguggcugaaauguaauccugauugcagaccucaguuaccucaacugaaaauaccauggcagcaaacggccuugagacaaauucgugggaagggacuuuguagaggacccagggcaggagucaagauggggccaaaaggagagcgcuuauggugaaagcaggacagaucugggggaagacacaagaucugaacuucugaugucauugcgggguccugggcugccaccccacccaagaaauaccgguauuuauagauaucuaaagcauccagccuguaaagaaagauauaaugaaguuauuaauccuaugaggacuauauaaaaucaaaaucucguccugugguucuaccuucuuuacuacacguucaagagcuagugauuauuucucccaguuuucguuguugcuguugucuugucucccccaguuuuuaagcaccgugcugcaaaggccaggaguggcucugacagaaacauugccaauggcauuauuacccuggaccauugucaagauuuuguauuaacaaguuguaugaaacugaaaugcggacaagggaagaaguagacuuuuuuaagcccagccauuuuguuuuucaagggacaaaucucccugggcgauaacuaccagauugauggggauagugaaauggcacucagaaaggagaacuguuaacacagugugcgggcagagccuggugcucgugcuuaagcaccugugccauuccgugauucagagcaagaaauaggaaacaaaccccuguugucuaaagggaaccuagcaggaauagucucuguguuuccauuugaacagaacuccauuaagagauuacuaacuaagaagcacuaagauuugugguugaauaagcaauugaaaucaaacccuaaagcuuaucuagaugaauucacaugcuccuuuaccugcagaaguuggcuggaauuaugcacaccuuaugucaauguugaaaagcaucggguaggaagugugauuuucagggaggaaaauagaucuugaaacccaccaaaauguacugugguugggggacuuuucuggagagaacacaacuucuauuuaauggguaugaagaccaacacucuaguauguaaugucaguguguguuuacugugacacuccuuugucauguaucuucaaagauggcauugaauuuaucaugagcuauagccaucucauucuuucuccaggcgauguuuugauaaauguugaugaguuuauaacuguaaaaccaaaugacauuuauagugugauacacacuuuacccauugcauaauuauaucuaauggcuucgcauguagaaaggcauuuaccauuugcuuuuguauaaaaugacaaucuaaaccccagggcuaaauuuuuuuuuuuaaacacgaugauaaagacuuaauuaagaaccaaauacaauuuauuuuuguaacuggcauuuaagguaccuaguucuuugguuaaauaugugauaaaaaucaugauacuucuaguaacaaagaucaguggguuucauuuauuucccucugucugaaauauuggugaacucacuuaauuaucgaacugauaucugguaugacuucuuguuucucauuucuagcuaaaagagcuauuuugaaagguagcacagaaucgaauaauguguucaguuaaugaggaacauuuaagagauguuucugaauuuaauaugauggaaaaaaaauaaaccaccacuguaguauagacauucuuuaucuagacagugaugaugucuuaggccucuugguuguggucaagcaagguuuuauuuuuagccauuuagacauuuuggaauguuuaucaucauacaguaggucacuuaauagaucaaaacaguuuuauucuuagucuucaugucagaaauagcucuuaguaucuuguuaggauaucuacuguguucaugugugacgacuaaguagcuuucuuggaaacaagucugcuguuguaguagguuuaucuuucugacccgguauugacccuaccugcccugacauugacggccucugaucagccuaccaaugagcagaaguuaaaguuguucucucugucugccuuuccaugguaaaaacuucacgucguugcuuuuuuuuuaaauuuuuuuauuauacuuuaaguuuuaggguacaugugcacauugugcagguuaguuacauacguauacaugugccaugcuggugugcugcacccacuaacucgucaucuagcauuagguguaucucccaaugcuaucccuccccccuccccccaccccacaacaguccccagagugugauguuccccuuucuuuacaggaaauaaaacuagaucgaaauaggucucuucucaaguguuucaucguagaaauaaucuuauuuugagucucaauauuucugaaaaauacggaauuauuugugaauaacaugaaguuuguccucuucaaauugcuaauguuagauccuauuaaaaaucuaagccucauggaaugcuggagaguuaaaaguuuguuuuuguuuguuuguuugagguuaaacucauaauaaucuagcuguauacuaguuaggucuaacugauuaaacuaauguuuuuuuucuuuuaaaauaugaaaacaguuuuuauauacaccugaauaaauguggaacucauuacuauuagauaauaagcaaaaaaaaaaucuguucaucuuagcucaaaaaucaagaguagaguguucacugauuucugaacuugaaugcacaauuuggagaaauguugcaacugaguauaauccuuuggcuaagaggcuuaauagaaaugagaaaugcauugaccacaauuaaaacacagaacugagauucuugcuugugucugaggucgggauuuuaauaaugcaucugugaacugcuuucuuuugccuuuaacaaaauuauagagcaauggucuuugcaaguuccuaaaaaaaaaaaaaucuauaaugaaccagaaaaagugauauuaaacuaacauuuaagaccuuccagagagauugcagaauuuauuggaagaaggaacagaguaauuuucuguguaagagugauuaggaagaaccauuuucaugcuuuuagucugggacaggugguauagauuaauguugaauacauacaaaaucuauugagacuaauuaaagaugcauauccacauggaauaccacaucucaguggaucuuuggcugccuauccaacaagcacauguaguguuuauaccaagcauuuuucaaauuuagccaagaauaguaccagugaaacuucugaaaacugcccugaaaauccuuagucucuuuguauuauaaagucucucuugagaauuucuaccuccaauaaaugcuucuuggaauagaaaagauuguaaccuguguucaucuauaaugggcacaaauauuauauagcaauauagaguauuaguugacuguacugaucaaaauccuaggcugggcgcgguggcucacgccuguaaucccagcacuuugggaggccgaggcggguggaucacaaggucgggagaucgagaccauccuggcuaacacggugaaaccgugucucuacuaaaaauacaaaaaauuagcugggcgugguuguaggcgccuguagucccagcuacucgggaggcugaggcaggagaguggcaugaacccgggaggcagagcuugcagugagccgagauggcaccacugcccucuagccugggcgacagagugacacucugucucaaaaacaacaacaacaacaacaaaacaacaacaacaacauaaacuauauacagagcuucaauuuaaguauuuggcaguggcuauaagaaugaacuugacccuuuacuuccugagagggcauccauuucuaaccugaugcuuagccugauaaagaugaagcuguacuaaggaccuaucucggauguuuaauccaggagagugaauuaacacaucagucccuaagccucugucccucauccagguuggcuuaauacccuuuggugacuugauugcuucuuacaaaugcuaaugaacaguucacuuugacacuguacacaaacacaaucuggugguuguguugagauguuuuucauacugcuaaugaauaaacucccagugguucacaguuagcugaaauaagcagugacuugagguagaucccaaaagugauuuauuaaccauguuguaaaccaaguggacuggauuuuagagaaagugggaauguucucuugaauucaagggccaaaguaagaaggauauuuuaaauaaacgagcuuaauaaccuuagauauuauuccauaccaacguuuuuauugggagugggggugagaguugggaauauguacagggagauaagaaugcccauuuaucauuuaacagaagagguaucaacauuugucuguaaagcuuucuuuuuaauaaacauugaauuggagcuuugcugggccaucagcuauccagucagugaugggcuucaaagaggccacucuuuccuuccuuuuaagguuuucaccaauaaagcaaauccuguaguugcaacaagaauaagaaggaaauguucuggaagaaaaggggagggggugcccagaaguuauggggaauagauugauauuuauagacaucagcaauggucuguuaccaacauuuauaacuccaacaguagcagauugagggcugaaucaacauuuuucccccucuguaaaauaauaaauaugguaaaguagcucucagaacugccuuuaucauagggauaaaucaggacaguuuguguugcaggagagacuuaaaacuuauaaauauguugcccuuuaggcuacuauucaucaaagugucugauaugaaaucuagacuaaaggcuuuuguuauugugugucugcguauucucuuuuagaagucuaaauuggaaagagcgcugucauuuuggucauacuggccugcugugcuacuuaaaugcaugucccuuuugggauguauuugaagagaaggaaauagugggaguugacgccugcacacuuuuacacaaauccucuucgucgccuaaaccuuccuugcagagggcauaauuuccagcaggaaaaauucaguaaauaaccgcuugacaaaugaccuauuuuggugcagucaacuuucuuccuaagacaccggaguagagagguuguucuuaaaagccucaucaaauccagagggacguagcuuuccuucuuggugcuccaauucaaauguauacaaauaggcauggcuaaagauucuuucaguuugcagagggaaagcauaucaggcuagugacagaugcuuuaagucacaugacuugauggguauuaugguauaugaaaucucauauaacuuugcaauucugaucugaauuuccuggcuucugugguuuggagucagaguugaagcuccaacccuguccucuacuccccuuggugccuuuaaauguugaaucacguaugguguauggaaucaccugcuguuuggaggcccccacagaguauguacugagcaguuuuccuuuuuuaauguguaguacagcuccuaguuuucaagaauaacuaauugggagcauaaaccucauuuuguccuugaaugguuugcaauucaggaguccugaauaacggaaauggagggccuacaaagagggcaucgaagcgugcugcaguuugauaauuugcccacuuggcuuggguaagcugcugguguggaauugcucugggaagaaacagcagacucucucaggucgguagcuugucucugauguugauuugggggaauuuagagaguuggggaacucugaugaccccuuggggccucuauccugccauguguguuuucacaagagcaagugugggccacuggguuagucuggauuugcuugaaugacagcauguggauuguacacuuagauuggagcgcugaaguugcaccaggccacacucauuuauagaaaccauuguuccugggaguccagucuagaagcuauggccgaggagagaaauacuucgaacuaugggauccaaaaagcccacuggucccuaugugacacccaagcauguuuaccuccugcugggccacguagccaaccagaagagcgcaauauggugaugucaaguuccaccugugugucgaacugaaaagacggcagcucugcagccccacucauucuguugaggugguggcaguuugacuugccaagucaaauuccuuguacucuguacaagucagaaugcccaaccuuaucacugguaacugacucuaaagaggggcucaggaacgggagagcacagguuuucucuuuaucagaugccuuuaaagccgcuucgcagcacaucccugugauugcuaacaccauuaugaagauugacaguuucaucaagaaagcaaagaagaaaaucugcaggcaauaaauggaggcagugcugggcccugcucugguuacccucaauagugcuuccagagcacugagcugggguaggguccuuucccugcuucaaggaccuguggcuuuuuuuauugagcacagagccugagaacuucuguggcccuuuuccuaguacaaauagguagcuuuaagacuuaaugaggagaaaucugaagagugcagauagagauuugguugugguggugaggauugguuuuuuccuugccugaaaaggaugaccugaaaacaagccucuagcauuguccagcaaccuuuccaccucacaggcugaaaugcauaucccaaagucugcaaauacuuuaguacaguggccaaacugaagaagcucaaguguaaaaaaucaagaauguucuucuaaggacacagaauaucucugaauuguuaguaguuaucuauagcuaauaauucugggcacucucuuaccccaagccagcugcgucacaaauaugugggcuguuggcuacaaggccaguggugugaaugauucaaugcaaacccaucaacacuacuggaaaaacaauucuucguaaagacuuacuggagaugauucagugccaucaucagcagaagcgagcagcugugugaaaccacugcuucucugagccugggauguguuaacgauauauucucagaaguaaauaauccuuuugcuaacaagacgaacccuauuuacucacuuucauucccuugagguuugaauucagcccggugaccgugucauaaauaucauucugaccuccaagggggcuguuccugaaucugaguucuuuugcacguguccuucucggagguuaaacuguccacccagccauguugccuuauauucgucauauuuuuuaaaggaaccaaagggguuaauugguuucuucaguaaagagacuuuugccgaagaaagcaauuuuagaaaaaaaaaaaaaaaaaaaagaaagcaauuuuagguuaguuuguguaguagccagggaaauguacugaaagggguggaccauguuucuguugugcagauaaccuacauacugcuuuagaaaugugugauuuccagcgugugcuaaaauaagaagugguuguuugauuuaucucccacaaugguauggcauucucuuccuaaguggcauuucauucgcaagccaggcacuguaaauuugaacugaauauguaaguaaauaucccucaaggagauagcacacuggcuggccucgucugagaauacggcugcuaaaaaugaagcucuuggcuuguggaaaaggcucagcaccugaaauacauuagcauccaaaagagugcauggugugcuagccagccaaacaaaucgaaaguuugucugagcuauaauuguggagcguugccuacaaagaaaguaauauuuggguuguaccuccuacauuugcccucaagcacucaaacugacauuuaacccgcuggaauuuugcuuugaacuuucuuguuuggguacaucaccucagugcauggcagcuugguacaucauagcuuuuacuauagcaucuuugcauggcagggacaaagacaguaacaguguuuuaucaagcccuaacaagauugcugcagugcauaauuguuaaagggcugucgaucuacucaugugcaacaggcaagaagcuuaaagaauggagaaaacccauaaucgcagaguaacuuguauucugauuuauuauuuaucacaucacgguuaaaacaauuuccuaguuuuguguauuuuuaauauugacauugaauuuucaccuaaugcaaaggcagguuucagaaacuuuuuaaacauuuauauaugcagguaguuaagggggaaaaucccuuuuuuauuaagauacagaaugcauguuuaucaaaauucaucucagauuccauuuagaaauauagauaucuuggguuugaaagagcuuacugagcugcacggaaugacagauauuacugacagaacaaaguuaugaaugauaaaagaacccaggaaaugcuuauacucauguggcuauaaauuaaguaguagaagaaagauugcuauuuguuggcuggcauagaacaagcauuaaguugguaaauguggaagacaacacucaguguacaucuugcuucauggagagguacugaaccuccucuguggcccaguccugcguggcugauggccugugaacccagcacucccacggggcucucacugucauaaugcagacauggcacuccagcaggccccaggcaguagcacaggagugcugcacagagauccuagcugaaaaaguuauaguauucuagaacaauugagcauuguaaaugcugguuuaugcuucaaaauguuacauuucacugcuaugaguaacaucugucaaagccaccuaauguuaagacauggcugaguaauauuaccuuuguuuugagcacaauaagcagcucccuggaauaacuggugcaguccagccccucuggaaauccuacuggcugaugcccacagcacacugaaugcuggcggguaaggcugccuuugcacaccuucguaacucaucucuuaccacggugguucucaaacuucaggaggccucagaaucaucuggaaggcuuauuaagacauuguugggccccacuucuacgguuucugacgcauucaacccgaaaggacacccaagaguuugcauuucuaacaagcuuccucaugaugugaggcugugguccaggaaugaccacuggggacuacuguccuccuaauugagcuacaugguuaccaauuauccauuucauugauuaacaaaccaccucaaagaaaagaccugagaggggagggguggugagaaaagaccuggacuuuacaccaaaagauuaaaugaauguacagccauauauuuuaagucaaaauguuuauggcauguguguaucucuuuuuaugauuucccaccauaagucauucuuuuggauuaacccagugaacuacuggucccaaauacagauuagacaaccuguauuguagaaguaguguuuguguuuacaacacagguagguguauucaaugguggagacagggaaacuuuuccaugauuuuaugagggaugaacacuggagcacguaaaaauaugagaaauacauaccaaaagcguuuucuguguggauagaggcagggcuaaauagcugaguaaugaaaagcuagaauauaaaggaaauacaacagcaagaaugcacugcccaagguucccagauuuggcauagccuguaucuuauagaccagaagccagaggcccaggaagacuaagggccagauacuggucuaggcacuggagaaaccaccaugaacacaacacccagguuccuucucucuuagagguuaaagucacuucuuuccuuuccucaugagaaaaggggaaauuucaguauugguauugaauuccuaaaaauagggagauguuaugauuccuugguuuuaaaaacaggcaggcagaaaacuguuuuccugauguaaguguguauauucaagaaggggaggggcaugugguaggugggaggcaguccaguaaacaauauuucgagagcaaacauagccuagugaaugccuuauauuuuucuuaaugcuaacagacuuuucauuccuaauauaaugguuugagugugugcgugugucccaccaaagagauggagaaauacugugguguuguucacuuaccuucauggcacccuuguuuaguaaauggggucaggcaguagacucuccuuccccauucccacccgauuccagcuuguucucuuguguagguguggaaagaaggauaguaagagaaaucaucaugauugucauaugauagcugcuguuuauugaauccuuauaaugucaaacagcacguucauugucucguuucauccucgcaucaguuacaaugguucuuaauauuuccauuuuuauagaugacaaaauggaggcuuagguuaaauaacuuacucaaggucacaaagcuuauacaaguugaaacaggauuugagucuagcuccaucugguuccaccaccagagcucucaucaucagcacaaauauccuuguacaggagcuuuuguuguguucauggaaaaacuaggucucugaaaccuucauuuuugcagagaauguuuuucuguggucuugagauaggguacaccuguccuugguugcuacaauagaugacagagauggaagugacuauuuuagaacugaaugugccauccauuagcccacagaaaggaaacauuuuugaauguuuguuuuuucuaauuguguguguuaaguaaagugauuggacaaacaguucucuccugcuugguaaucuguuauaaaucaaccuucagauguuaauaaaacaagucaagacugacaaaggaaguuccguuuguauuuuaaacucccaauucaucagggucuccuccuuuagaucuucugugagaguguccuuggucuuaauguagcuggaagauaaaaugcagauaaaagagccauugucucagaagagcauuaauaaaaaaugaauguugauccuaauugaguaguauuuaaacauacgggguggaggcagcagucugcagggagcaucugagucuguuagaauuugacucucgaucucaucuuccuccucuuauuacagggaccucaccacccagcugccuucugugaauguaaacugucacacuggaaucagaaaagauauauauagacauaguacuauagcagauucucagcucuuuugcuaucguuguucuuauuuugaaacaacguacuacuauuccucuaucuuuuccuaaaaaucuugucauaaaauguucaauuaacucauuuucuguucuucccuuuucauuguuugccuguuucuguuuacagugguucuugauaacuuaguuuuaaguucuccuuaauucuuaauucuguuaugcuggauauaacagaaagaacucgcaauggucaaaggugaaagaauuugaacaaaaauauuaguaauaauaguauuggauuauaaaccaaagaacaaaauaaauauccaugaguccauacugauauaauuaaauuacugaauaaauaaaugggaggaaagacaaaugucuuccuuacagaagaauuucaauuuaaggagugaaagaaauaaaaauguuaccacuugaacacugaaguaauuucugcagacaagauccacuaguggaugcuaaaauuaacaagugaaaguuuaaggagaaacaugauaguuucacagccuccaaguauuuucccccaaauauuuauuaauuccucuggugguuuuaacauacacauauaucuacaaauucuuuaauacugcucccucuuaggagaugaggauaaauuccccucauugugaggaugagcuggaugucagugacuccaauuccaaugaacagacucuggaaagguaaaagucauaauuuuucaguggagaaaccuggcauacaucaccuugaccgauggaucaagguuaaugucaccaauaguaagacuuugacgucauguaccucaugauaugaugcaaugaaggggcgcgucgccuccguggcauucuuccccaaauucauaaccucgguguuaucaugagaaagcaugaaacaaacccagauugagggacagucuacaaaauagcugaccgguacucuucaaacugucacaaucaugcaguguuguaccaacauucaucucuuaguuuuuguaacuguaccacagcuaaauaagauguuaacauuaggagaagguggaugaagaaggcuuuaugauaacuuuuugcauuauuuuugcaacuuuucuguaagucuuuagguauuucaaaauaaaauguuuaaagaaaaaaaaaaagacccaucaagggcauagaaaagcuuaggugaagaaacccuaaaaugaauccucauuuaucaacucauucauuuauugauucauuuguucauucauuuguucacucaagaaguauuuguugccagacacaguaccaacaaagaaaauaagcauccacuacggcuuugcagagcuugguacgcaaugccugguucagaggagauauuuguucaucgcuugcuuuuaacuguaucacagccuaggguggcaugcagagguuugaauaagugcugaaacaggacaagugaggugcuuauggaaacacacaggagaggcacuuaaccuagucgugggagaccacaaaaggcucccugaucagccuuuguaauauaaguaagccuauuguuuaaucuuucauuuaaaguguguucaguguuuucuaugggacgaacauacuuaugacuuacauuuugaaguugauuucauccuuuuagauucuaaaugccuugaaagugagugcuuuaaaaguaagaauagcauaaguuguuuauauguauccauaaaauccuaguugguaacacagaguuuuuauaaggaguaaaggggucucaaaucccuuuggguuggaaucauuuguuacuuugaguuuuccuuagcaggaaaaaaaaaaaaaagacaaaaaaagugugacacaaaauauauacaugcugcugugauuuaaaaaaacugaaucguaaaaauaucuucgguggcucacgccuguaaucccagcacuuugggaggccgaggugggcagaugacgaggucaggagaucgagaccauccuggcuaacauggugaaaccccgucucuacuaaaaauacaaaaaauuagucaggugugguggcacgugccuguaaucccagcuacucaggaggcugaggcaggagaauugcuugaacccaggagguggagguugcagugagccgagauugaaccacugcacuccagccugggcaacagagugagacucugucaaaaaaaaaaaaaaaucuuauuggagugcaugaaauuuuugauguuaaaaagauguuuucuaaauaggcugaaacaagaacaaauauuuuuacaaaagucuuuucaauguaacauuuucagaaaaagaaacuuagaaacaauguaaauauaaaacaaaaaggagacagugaaaugacuucucguauuccuauaugacggacacauaagauaguaauuaaaauuacagaauuuauguagaugugcacauugcacacauacaccccuucaacauaugaaaaugaaaaaggaauacacuaaaauauuaauccuuaucucagaguuaugggauugugggauuuguuuauacuacuuuguuuuacuuuuucuaccaugacuauauaauuuuuauaauuagaaugaaauugcccuguguuaauuuuugagagaggcauuaauucuaagaaguagugguacagagguccugggacucuuaauguauggguucaguaacagaugcucuaauugaaaugagaaucagagcucaggaaagcuagucuaggucucccuguguagcuaaauaauaauuucauguuagcauuauuuuuguauaccauuucucaauauguuuuuaaauaacaucuuugaugguuuuauauaggaagaaacauugugcccauaauagguguacccucaugacauuuagccuaccucaugguaggcucucuuacagcuuguaagucucaggcauugagaagcacuuggccuauguaacaaguggguagacucuacauugcaaauucccaaaaagguaccuaccaaaggucugauuaagagcaccuggagguaggaugggcaugguggcucauaccuguaaucccagcacuuugggaggcugaggcgggcggaucaugaggucagaagaucaagaccauccuggcuaacacggugaaaccccgucuccacuaaaaaaauacaaaaaauuagccgggggugguggcaggcgccuguagucccagcuacucgggaggcugaggcaggagaauggagugaaccugggaggcggagcuugcagugagccaagaucgugccacugcacuccagccugggcaacagagcgagaccccgucugaaaaaaauaaauaaaauaaauaaauaaaaauuuaaaaaaagcacuuaggaaucuuuuucuuaaaauugauuaugacucaguaaacaagcacagccccucaucaaucagugucggucauucucauguagccauuugaccuaaugucuuguuagcaauuauaccuccucauuauucugaaaacuggccaggccucggccauucaggccaccaggcacaaagauagagaggcccacuggccacauauuaccugauacaguaugauacaaccauugagaguucuguuacauccagcguacaaccaauauguaugaugugacauauuaccugauacaaaccacggaagggaaccauuucuuagaguguugagcucuaccugucuuacucucugcacauuggaucauuagagacuguccugggacuaauccagagaggucaaucuaagcacauuaaaacaaaaggguggccgggcaugguggcucaugccuguaaucccaacacuuugggaagccaagcuaggaggauuucuugaguccaggaguuugagaccagccugggcaacauagacagaccccgucucuaaacaaaauuaaaaguaaaaaaauuaggcaugguggcaugugccuauagucccagcuacucaggaggcugaggcaggaggauugcuugagcccagagaguucaaggcuccagugagcuaugauagcaccucugcacuucagcuggggugacccagugagacgcugucaaaaaaacaaaaaacaaaaacagagaggguuaagagccauuaucucagagauggagacaggacugagcaaaggagaaggcuagagcuaaagugaaaugaggugggaagggcauggagccaggaguuacagagggagaaaacgaugcugaagaguucaggaugagaucuuuagauggcaggauuucugcuuggacaguguuuggaggaaagcuccuucuuuagcuccucuugggcuauaccgaacguuaaggaaguagacuccuaacagagagguagagaccguagcucugcuuucaucuguagauuaagcaccucuuuccuuuaaaaaaaacaaaaaguuggcuggacaugguggcucccaccuguaauccuggcauuucaggaggccgaggcggguggaucaccugagcucaggaguuugagaccagccuggccaacauggcgaaaacccaucucuacuaaaucuauaaaaauuagcugggggugguggcgugugccuguaaucccagccacuuggggggcugaggcaagaggaucacuuaaaccugggaggcagagguugcggugagccgagauggcaccacugugcuccagccugggcaaccaagcaagacucugucucaaaaaaaaaaaaaaaaaaaaaaaaaaaaaaaaaguuaagacugggugcgguggcgcacgccuguaauuccagcacuuugggagccugaggugggcagaucacuugaggccaggaguucgagaccagccuggccaacauugugaaacucugucuccacuaaaacuacaaaaauuagcugggcgugguggcacgcuucuauagucccagcuacuugggaggcugagguaggagaaucgcuugaaccuggggagcagagguuguaguaagccaagaucauaccacuguacuccagccauggugacagagcaagacuccaucuaaaaaaaaaaaguuggaaaguuaacauuuuucucuuuuucauguucuuuaaaaaaauuaaaagcuuucuagggcaccuaugacuaccauuuguuuuucuuuaugcuuugagcuacaaucaucuaaaaauaaaaaugauugugcuucuuaucuucauuuuccccuaaaguaggacucuuccuauuugaaagaugguuggaggaaaggaaaaguauaugugaacugcuacaucuccuuagauuugagagacggagggagaaaaggaaaccuuagauuucuuuaguacuugcuccaaagaacucagauaucuuauugaucuugguaacacguuauaauaaaaguagaguuuuagcuucuugguuuuggcugccaguguccaugacaagguucaccaaagaugguuuuggacucugggccuggcucuaagcuauagggcccaaaucuuagacaguugagauccaacaaagcuggguucuggaguaggucgggaaacagagcugguggcagagugcaucucggaguucccucuuugaccuguucacaggccuuucauugagccuuguuugccaugcuuuucuugugguuugugacagauaagaacuguauugauuccuagcaucugcuggcaguaaccuuugaaagggcaggcgaugcaucaccacagaauuuuaucuaucaauaucggaguaauagaaagacagggaugacaucuaaucacaacacagcuggcagaucauaaaucugagcugauacgguacuaguaaugggcagcagaaaaaaagggacauggauuaacauucggauaaagucagggggucguuuacauggaaaggacacgaucuggccaugagaaaaguccucauggaaaugaucacccucagaggccugagaaguuaaguaaccuucccaaguuuauccgguuagucuguggaagagcccugcuguaagccucaguuuccucaucuauaaaauaggcaaauacuuugaugguugguaaaggauucaauuagauuacguaugccaauucucagagcauagacccuggaucagcagugucagcaucaccugugagcuuacuaggcaugcaaacgccugggccccaccucgcaccugcugaaucugaaacccugggaagggcccagcagacaggcccuccaggugaugcugaugcaugugacaacguuugagaaugcagauguaugcaaaacaaccaacaaacacccuuaaaaggguggccuggcauagagcuaagguucaaagcagcagcauuuaacugcugcuuuuauuacuauuaauauuacuugguccugucauuuauacuaauaauuuacucuguguacaagcccuacauucuucauacuuuuuucauucacuggugaauuagugauaaaaauaaacauuuucugacagauaaacauuuuugacauuuaaaagaugucauagaacuggauacacuaacuccuaugcuccucugguuacagugcuagagaauaccagcauucuaaagguuaagguucuaaugugugcuuuggacauauuuagugcuuuugacaugucaggaagcuuccagucuggacagugaauagugcuacaauuuaauaacauaaauggagucugucugauucugcaaagaaauggccuuccuuggggcccagaauauauaguuccuucugcaguuacacucacaguauuuuuaaucauuucaugauuuuauuauaucccaaguauaaggugcuacaaagagucccuggugcuggcagucacucaaaaauuggcaaaucuaaaaagugaauagaacagcaaguagcccauuagauuauuuuuuucuuuauuaaaaaaaaacuuuuuuaaaaagaaaaacuaccguauaaaguuggaaguguugauuuuggcaucuuauacaugaaaaguagucguaauaaagugccucaauuguuggugcuuguucugcagaaauuauggcugugcacaauugugagggcuuaacuggguuuccaggaaguacguaauucacacucuaaaugugacaagcaugacugcccauaaaccuaacgacuuuuuuaagagaccaaaauucagaauguuauucucucugaaacugcacuuaguaacccagcagaaaacuguucagagaucugcucccauugcaaugaaggcaucuggacauaccagugguaagaacagcuaacagcuuucauauaagaacaaacuuuuuagaggaaggaguaagugugaaccuauugcaauugccauauguuaaggaacacaaacaauaggaacuagaacauggcaauggccauuuuguugcuggcucucucucccugcccaccuccaaccagaaaaaaaguuuacuggaaaacugaaacaaauugaaguccuagguauauaaauuuucagagugauaggaaagaaccucccccacacugagccuuucacucugaggugaauucucugguuucaagguaaguguuacuucccccugugagcagcugcuaacgaugcuguuagccuauauccggauggcacaaggcacgcugacuccagugacugagaacagggccagcaguccaggcugauccauggauauucauuaagaggcugugugaaaugaaacugguguuuacuuuuucuucuccuggacauucuaugaggcucauuccaagccugauucuuucugccucaagcuuaagacucuuguuauuucucuuaaacuuugguuuaugcuguuaccuauauuuuuacagcaauuuuuaucugcuagccagagugaaaaggccuguuguaauggguaagauagcuuuuauuuuuuuccugccuucaaaucauauagcugaauuucaucacuucuauaacaaaccucugcagccucuuuucaguuuucauuuuggaacacuugcuuuauuucucuauuugcuguuuuugucuucacuggccuaaugcucacaaacacaaaacacacaguaacaauaaaaccaaguaagcaaaaauucagcuagggugcuaccgcuugugaacugacagaccccacuaagggugagagcgcuggcuagaaguagucauuuuugcaauuaagugcagaauaaucuauuugcauugguuacagucagcuagcugcuuugggagaggauuuuucauuugugcauugguuguuguuauuuuucaucugugcauugcucguuguuugcaacuuaaggaagaaugauacauucaguuuccuauugauuuuauccaugagccacaucaauuuaucuuccugcaaccuugaauuuuuaaaaauuuguuuuuaaacauguuuauuccuggaaacuggccuaauuugguggcuaggauucaugaucuucuuuaucccauuacaccaagauucaccaguuuccucaaaacaaguuaucuaggaauauuucucuuucuaggaucuccuuugguuuagcuguuagucuuguguuuaugacugugauauaaaagaaugauuggaauuaauauacuccaggccagcgcuccucaaauuaauaugcguaggaauuaucugagucucuuguuaaaaugcacuuucugacuuaguaggucucgugugaguuugagauucugcauuuuuaguaaucucccagggauugucaagacugcuggucaacaacacugcauagcaaagcucugaggggacugguggacagguguccuaauuauauuuuugguacaauugggugcuacggaaaacccucuugagucauauugcagaauguauguguccuuugcccuuuaacuucugaaauuagcucuuugcuggucuuuccuuagaaggcagcuagaccuuaacugacguuuauagaggcaaguaacgcucauuucuuccuuuaaaaggggaacacugaugccaaagcccgugcgccugaccucugaaguauucucgacuccugcucacucucuuuuccuucuccugaguucugcuuccucuucucuauacucuuuucccugacucuuaucagcuccugagcacucuguggcagucucuuaacugauccuccugacuccagcccuuuuccuccucagccucccaucccucucuacauagaagguaucuuucaaaauacagguguaaucauucccuggauuaaaaucacuuaauggcccccuauugauuacaagauacagugcaaauucccuagccuggcaugcaaugucauucaauaucuggaccuaaugaccuuuccagaaaacguuccuucuugucucuauucagagcacacuguauuuuucauauuguuccaaauaugccacgauccuccuuucagauuuccucuccuucuucccccucucuagaagcugcacccuuaucccaacugagcuggucauccuuuucuaugguacccauagcauauuaguaacuugugacuuacaaguaugcguuuguugucucuguguguguguguguguguguguguguguguguguguguguguguuugucucccuugcgcauuaggaacuucuuaaaguagggcuguuuucucuauuagcacucuagguccaauacuaaggccuguuuccuuccaagagucuugugaaaauccccgagauaucgaaaaguauuggcuucaaaauaaaauauacaauuggaaauaauuuugaaagcaaaaacccuuugaaaauuuuaauucaaaauuauauuuagugugagauauggaugauacuuaauaagucuugauguuauauggaccaguuacuucaaaaagugagagcgccuagcacccaugaagucuuaaaacagcuuaucauuuaguaauuuuauucaauaaacauuuauuaacauucgcccucuuagccaauacuguauuaugcuuucgagauacaaagaugauuaagauagugugacugcucucaaggagcucaagauaauuaaaauaacaauauauauuuuuggcacacagguuuugugucaagacucaagcuguacaaauauguggauuaucucauuugcaccucaagauaaccuagcaagggagguauuucauacccauuauuaugugugagaauccugaggcuuaagagaguuuaacuuucccaaggucugccuaauaacuggcagagcuaggauugaacccagaucaaaaucaaaugaaggaaauaacccuauaaacaaauaaucacagagcuauccauguaaugaguacugagacugagacacauaacgauuugugugaguuagacaucaagaaaccugggcagucaucagagcucucuucauggagaaagcugauggcuuugagcucaauccuacaggacaaguaggaauuccuccauggucaguuuuccgcugugaugaguagauuaguaauagguggguuugauuaagcaauaaauuaagaaauuaugucaguaacuacugucagucaucaauuacauauugauuugcuuccuacauucaaggguauauuuuuaccuaagaauaucuauuagugucauuguauaguuaucaaacuaaacaaaauauuauuauucaauuaaauuuugucugugcaacuuuucuuuguuugaugucaaaugaaaggggaaaauuaugucccgugaugccauaggagcacaccacuuagugaagguuagguuuccagacaccccaaacaucuuagacauacccaggaacucauuagaaagcaggaaaggucucaauaccugauagcuuucucaaagcucaugcacuuaguccuaaaggcaggaauuaucugugagaugugacagccagcauucgagggaaacagcagaggacacgugcaagccgaacaggcuaagacuguuuagggccagcuuguccaaccugcagcccacagaccauauacagcccaggacagcuuugaauguagccuaacacaaauuuguaaacuuucuuaaaacguuaugagauguguguguguguuguuuguuuguuuguuuaaccuuaucaggggucaucaguguuaguguauuuuaugugugacccaagacaauucuuuuuccagugaggcccagggaagccaaaagauuggacacccccggcuuagaggaaggccaaguauucgugcauauuucaguaacucauggauguccucccuguauagaagcauagaacagagaaaauuggaagacagcaagcuuuugugcaauuugucauuuauuucauuuugucuuagucucaguguuuaaagagagguuuaguuauauggaaagcugacuuuugugaaacaccguauucccucaagauguuuggcaucugaaauauugauuuuuuuuuuuagguuuuacagggagaagggugcauugcauuaucagccuaacacuaggcacccuucacacccuuugaauauggugauugcucucugaacuacuuaugggcuuauacagaaagggaggaaacccagacgauaagucauguuuuuaaugcuguagauugcaauuccaaaugucugguccucugcccucaucugcuauuuaccuuauauguuucauacuugugguuuuuaauuugcaauucaauauaaauguuugauaaagauauuuuaauuugcucucugcuuuuuaguuagccuuagaauuaaaacaauuauagcuaaaccucugaaauaaaaaaaaauucagcagauuauggaagaucauaagaagguccuaauaaaauagacagagagugcauagaugguggugaugcugaugaagaauauggaagagaaggucauaguucucuauuuagcauuuuuggagcuuaaauacuuucauaggcauuacuucacucaauucucauaauaauccuuuuggagagauaacauuuauccauuuuaaaauauagaaacauucagaauuucagagguuuuccuguuuucaccaccaguaagcucagaacuacaacaaaaauuccuguuuuccaagugcgauggucucauuucuucuuagcugcccccuauuagugaaaaauaagucauagguaauguucuucucacuuaucucuaauuucagugaugauuaaucagcagcccacacuuagaugauacuaaucaaguuauuguuauaauggcaccaguuuguguaguuacugugcauaauugucugacauaggcuuugcacuggggagucagcaggcauaagaguagaaucuggaaucucuuugguccacugacuucucuccacaugcaauuccuucaucaaacuguggcuuaaaagagcuuucuaccucuauuauacgucuucccagguugagcugggaccagcaacugaggaaaccaguuuuaaaaacuaauaaacaaacaaaaaaccacuagcacuugcuuuaugauugacagaugauagagugaauaacucagcaauaagggccuuagucauggaccccaguuuuccagcuaagaaauugucauuucauauaauaguucaaagcugcuuggcuuccugguaggagauguggauaagcugaauguugcagcauuauucagcaugaugauuaucauggauuuacagcuguuucuugaacaaaccauauuacacacacucacagaauacacucuagaauaagaauauaaaacaccucuccccucccacuucccaauuuucuguuucuguaguaaugucaguugaaacugacauucacucugaguccauaucugauguguuccaacugauauccuuacuugcuuguccugucggcucuaagcuuuaaauuuggaagguuuucaaugacucuuguuggcaggaaaaaugaaugaggagguguagagagagacugcuauuacagccacauuucagccacguagacugucaauacuaaugaaugcccuugaggcagguacuguaaaugccguuaaguuggaguugagcugccuuucgaguuuggguccuuuggcagaacagacaucuccucucuaaauacuaaagacccuguuguagagcuaauuuuaucaguaucacauauuggaacaugcugguugcugauagauuggcuguuuggcuucagauuccuugauaugcugagaauguuacuuuaguuuuguuccugaguuauaaaaaugagauacuauaaauucauucauuaguucuccuucauucuuuuagcaucguaaagcuuauuguccuuucagcuaccuuauuaauauaguauaauuguuaauagcacccaaucuagaguuaaacagaccuggauucagauauugguuccaaccacuuauucaguauauguaaaucuuagcuuccuugucuguguaauggagaugauaaugggauauugaaccacauaagauuguugugagguuuaaauuagauaaugugaagaaagggaaaaaaaagaagcauagcgccuugcauagaaaacauuuuaaaaauacauuagcuauuguuaucaugcagaugauuaaaagaauauccuccuccagauagcagugagaguuuucuuaauauuagaaaaauuaauaauaagugcuuuggaaaauaaauaauuuguuuuucuugccucuauacauguggagaauagcagccacuuuccuuuucuucucuuuauguaguaauuauuguuacccguuacagucuuaugauuuuaaauaucuuacacuaguuguuaaucuuuuaacacccuggagacaaauguaaagggggaaaaacccagcuuuuagugagcugaagugaaaagugacccaaguuuaaucacaguaccucuuaacaaagagaaaaucauauuaaauuggguacuuaaaauuaggauauauaaaauaagggaaauacauauguuaucuccauugagacuugaggaugagguuguaaagaaauucaauuuaaauaauuuuauaaagaauaacugguaagggugggcacaguggcucaugcuuguaaucccagcacuuugcgaggcugaggcaggcagaucacgaggucaggagaucgagaccauccuggcuaacacagugaaaccucaucucuacuaaaaauacaaaaaauuagccagggugguggcgggcgccuguagucccagcuacuugggaggcugaggcaggagaauggugugaacccgggaggcggagcuugcagugagccgagaucgcacuacugcacugcagccugggcaacagagggagacucugucucaaagaauaacuaguaauggcaaguauugugaacagccuacaucucugauauacuuacgacucagggggauugagaaguauccauuaaaguagaagagaccacaguagggucacccauccccauagcuuugaaauccuaaauuuuuccuuaauuugguuagggaaagccaauguuauauuuuuuacagaguaagagcucaccagaggcugcugcaguauauauaauaaguaguuuggcuacuaagaucucuucugggguaaaagagaaaucuaaguucccuuagauuuuguaggaacaguagaaccuaauauuuguaucuuccuuugugguuuucaaauauguguuuugaguuuuaauccaguaaaccuuuuguuuuaguugugaauagcuuguguuuugggaaauguagauaguucuauauugaauuaaaucagucgcuuccuauuaucccagacuucaacuaacuuuggggccugugaccaacaacaccggaugaagugaggguuugugcuuuaucagcuaucagcugcuauuuacacaguucaucccuuuuaaaagaaugugaguuuccuucucaauaguccaugcuugucaacaguggaauuuuguguaaccgguuuucacucuagaaagcagucacuuaauguuuccuagaguauaauaucauauuauaaguucauuagcaaagugguugauacagaagaucaacaauuggccuucagcacaacuccauuuugucuaaaagaaacuucauauguuuugaaaugcuggaauaccacccagcuuugaauugcuacuaaagcagcucaaucuaaaacuauucuuuuauucuuuuuuugccauaaacgagcaucacagaaucaaauccauugagaagaaacugcuugcuuugccaacacaauuaguuucauaagaagccucugccuucagauuguucuucuccaaaguccacguuuguuggauggcugcaguuauuguuuaauuaauauuuuuuaagagccccccuucucccaagggccucuaagcagauuuagcaggcuuaaaaugacucuuccacaaggugauuucaaugccaucucacaaacaaaugaaauaguggcuuuucuacuuugggggcucgauuuuuuucucucucuuuuaguucucauaaaaccuguccacuagagagaguuuuucuucaggguuauccuaucuucucucuaaaaaagaugcuaucuugcuuaugaacgaaaagcccaugcaaccuauccagcuaugaaaagaagugagagaaaaaagucucagguuuucaccuaccagugugcaaagcaaaaggauucaaugauuauuauuaucuuuuaugguuuauuuuuauauuccuguuucuuuuuuugccauuagcuucuuugauaagugaauuuuaauggaaaagcuaauucagaucuucaaguuuaguggaugggugucacuccgcauaaacauucuauagagagaauugcaccucuuccuuuuaugggaucagauagcucagaccuucagcgucguaauuguuuggcacuuuuagugaugugggcccugauuaaaaagucauauugagcucagucuuuuaaagggaaggcagcuaaugugaugguugaaauuguaauaguacaggcagggaugcuauaacuauuuucuuuugucacagucuuccuugaaaagaguuuucacccaucuaaucaguguuuucuuucacaagagauacccauccuguauguaaauagaaguuggacugugcuugaccuccguucuucagccuuaaugucaaaaaccaauacacacaaagguagaaaugguuugaugcauauuagucuuugaagucaagacucuggucaccuuugguuuggcaugguguaggagaucauucucuugggagagaaaagcagaaauaacucuucuugcagcugauguuaaagaauuucauggggacaaaagaaacuuuacauaauucuuuccaauaacuuuuuuccuaauuuacauaauucuuuccaguaaguguuuuaaaaccugacuacuuuccaguguguaaguugagggcggaauugucaaaaaucuauucacuagguaaguuuuguuggccuuauagcuguggaaaacccagucuggggacucugaaggagaaaccuugcugugcuauuucagagcugccucuccccaaaggaauuucagaauauaagggacacuagaagacaugagguuugagaaaaugggucuucauguuauuugcugugguugcuguugaguuagacccugaguggaaugcauuguggugagccaccacccuaagcaucaguauucuuggcuauucucccuucaugugcauuuuggacuuaaaggugaaauuccaucuuuaacccccuugugguugucugaacaaugauuaaugaacuagaugugauucccugcagaccuuucaaaggguggaugaaggauggaauuucagccuuuuuuuuaaaccaggccuuuugcuuaauacugcuuuuaaaauuaauguccuccuuugaaugccaagaaaacaaaaggaauuucucaaaaguguaugcagcuugacacaauagaccuuaauuggugucaaggagauguuaggaugaaugggaaaaugcccaauaagacugaaaaguggaaccuuguuaugagcugucauuucaacguguauuuaaacuauagcaaaacugaaacauauuugccauauagaucauaaugacuccaaaggagccauuauacucuauuauguaauuacauaaucaaaccaugcauaguaaucagcuuuuggaauucaaugcuaaucaaacauaccuauaguauguguuuaagcgaaaauagagaacguuaauuugccauuagucagcuaaacaagaacguguauacagaauauucaugaauagcuuaauguugugucagaugauauuuuuuguuguguauucaggggaaaucaacaauuuuaauugaagaaaaauccagcacagaggaggauuacucuuaaacuugccauucaaaaauuugccucaccuguuacugauuauaaaauguuaaauuaaauaaaauauuuuuccuuuuauaagcucaagugacacaacaguaauuauauagcagaagauucuuuugagauccugaccaucuccaugccauaggauacaguguuauaaaugcuacauaaaauaaaacugucaaaacaacaacaacaaaagccuuugagcacauauugcuuuuguaauuagcaaugaaucaaagguguuaucuagaaagagccaagaauagaaauaucuugaugacuuggucagggggucuggcaucuacucguggcugggccucaugcuugucauaugauuucaggccuaucugcucccugggccuaaagugagagaguugaucuccaaauuucuuucuacucaguucuauugauucuggauuccauaggguucuauaaaaaacaaggugauacagaugaaguguuugggucaaugucacauauucuuguucacuccauuauuuguugaguugguuuaguuuauuuuaucucuaagccugugaacuguaugguuggcauucauaauuauuuucaccauuaaguagacagucuuuggagcagacaaucaacauauuugacuuaacuguuugguguaacaagacauggagaggaucaaaaagguuaagaggggcuuuguaaacagcagacagauugauugcuuuugauuuuagauaaauacuaaaguauucaugcagguugauauuugccugucucagaaauaaagaauugcauuugucuugaagaggucacacccuuaaccuuaaaucuacaguugaugggccccucucuuuggacccugguucucacugucucuugucugcacauuggaugccuaaaaauguuacuguaauauuuaaauagaacuaaauucuuucaucaaacgcuuucguggcuugaacuucgaauaauuuauuuucaaauuacuuuuacuguaauucuuauuaauucaaauagguuucugauuugauauaaaacucuguaaaugcagggaacaguuuaaugaauugaaagauaggauugagucuuuuaaaggaaauguacaaaauaugcugacaauaauugcuuagauagaaaucaaaucuuaauggcuuuguuaaugauuuguagugaacacuguguuuacguugacuugggggaacauacguaguuagaaagauuuuucccucuggguuucagcagaaucuuaauuuuuuucauucuuuuccugaacguacucaacucuguacuagcucucagaaacguuagcaggaauugcagugccucuacuagugaugguuuuauuucggguagggauuagagguucuucuuccaaguugggcccacccugaacaggguuguaaaaauaguauccaacagaaaugagcauaauugacaagucauuugaagcuucaagucagcgaaggcucacacaucuaaagaaaauaaguuuuccaaaacaugcuucuuugaaaauuuccaaccuaggaggguaggaaugaauaacccugagccuuucauuuguguaaaauuucaagaacuauaguagaguuuuuaaaguaguaacuuacuauauugauuagcagaauguuuuuuuuuuaacaaucaauaguuuugguuugacuccuauuuagacaauaugugcugauuuaauguuagguucagucuuccauagagcagaagguuuuccuaauaugauuaguuuuccuaauaugauuuugcuacaagggacuguauuugcccuuucucugggcaaacugucuucccugugaagagucgcuggugcuccuucucuaugucaguaacaguuuacguaguugccauaguauaaacucaauucuguuuuaacuaugacuugcccuuuuauuauagucuugacuagagagacucccccgguguaaaugaagugcuuuauugaugaacagccaggcagcgggggcgagagcuuguggugcuggcaaaaggccgccaugcacugguaauaaaggcuuucucuaggggcagagugccgagcacugaaagaaggaagcaguaguaaacaaggucuuuuacauucaggacaguuucucucucaucuuaaaguguguaauuguguucuggauaaaauauggaaauaaaaaaaaucagaaguugcucauaggcaaacaacccucuuuaaaaacaaguacauuuuccaaggcagagccaguaugaaccuuggcaucaaagccugaugcuggcugguaaagagugcaagcugugugggccggagaaucugauagaaccggguucaagcaucagcuuggccacuuagcugaaugacaucaggcaguuuauuuaaaucgcucugucucagguuuuucaucucuaaagcggggauacugaaaacuccaggaguuugagagagaaaaguauguaaagcauccugcacagugcccagcccuggauaaacauuuguucccuuccucaugucucauuuaagauuugccuugucaccucccuacgguggccauauuguugacugaauagauuccaauccaggcaaguguuuuauguaaugucacugaaauggaguuuauaacaaaaugagguuuuaggaaagcauuuguaaacuauguuaauugaagauugaauuaguaggggauuuaugugcccgcugcacccccaccccaacaacucugcuaucauggucauuacuaaucauaaaaauauauuuuaucuuucuuuagacaauaagcuuucucuucauugugaugagugcccuaacaacuucuaguuuacuacaggaagcuugauuguaagcgaaugggacucuccagugccauaguuuuauuuuuaggaaucgucuggcaaaucggggaguuauagggaauauaguugcugauacaaauaaaaauccaguuggauucugucuucuaaaccucacccauauacaccgauuagucuauaaaugccagauauuguuccacccuuaaaauaaaucaccuuccuguuaacagccuuauuuaauggcuacaguauguuguaccuauuugauuucuuuugcccagaacauguccuguuucugccuugacauuauaucugcuaauugaguuuuagaaaaucagaaagguuuuaaaaauggauucuugaagaaaggcaccaaaguugccuguuuguacccuucugcuacacaucaaauuguguuuuguagcuaccuaauugucaugauaucuauuucaaggggaaauuuaucaagucacagugcacucuucuguuuggaagaaauauuugaggaugugagcagaaauuauuuuuacauaaaggcuucaggcaguuaagaguacugacauacauaccguauuuucaucacugucauucacuuccuuugccucaaauaaauaggucauuauuauuccuuugcagccaucuuauggugccuuaaaguguggagcucuguguaacauaacugccguccagcugacccauauaauuuauuggugauauuuacagaaugacauccuugggccaccaccaucagacaaggcccuuugauaucuuucagcaaaauauuucaugaucacuuauaauuuuuuagcauuaguauuauaaccauguuaacauagcuaggaauuggcauuuucugagacacuggauuuuagguuagccuuagcaauuuuagaaaauaauacagucaugaugaugauaccaccauggguuugcagagcgcauuaugugccagagcacagcaagggcaaacauuugcagauggaaaaauuuuaccugaaugauucacucaguagugacacauuaaaauagucuggccuuauaguacucaauuauaagugauuaagaauguuucuagaaaacaaacaaaaccucacucuguuuuauuguugucauugcuuaaaagacaaaaucauggacaacaugccucuuuucccauccccuauauacauguucuguagccuuaauaugaguggaguauucuacucucagaauaugcuagccuuaggauuucaauaaagagcuaaaauuaaagcauacaguuauuuccacaggaacuauucuguuaaagcauaauugaauugcaacuggcuuuaagucccaguggcugcaagauaguagucaggauuuguaaggccuugguuuauguugaaaggauuaaugcccgucaccaggccuuuccacauguaccuuuuguaaacugaagauuauuuauguugcuaauauacuuccuuugauagaagaaaucccucccauaacccaguaagaccguguuugguauucuugucuacucaaagcaaguccuaugccuuaagacaguuauagcccuugaaucacacaauuaaauuuuuucuuaauuuucuuaguagaucgcgcauuaccugaggcugugagagugguagcuuuucuguacacacuuuugccagggccagcaaaaccaccuugaaaaccucacuugauugguagaaauuuucuucuccuuuuucuuuucuccaaucugggaauaaacuuucuccagcuggguucugaauucuguguuugucacaguaaugcacuaaggaaaaaauaagcaucuguucauuuuuuuuuuuuuuuuuuucugaucaccuuuucucuuuguuguuauucuguaacacuguucggcauacuaagccuccacugcuggaucaagcuuucgggaauuuacccucucacugcaagcccggugggccugcauucucacaccuggguuaauucccuggauccuagagcucgagguuggguuucauuuuggucugcuccucaagcaucagaaauuuuugucuaucuguggcucuaauaauuuuuuuuccuuauccuuuuaguuuccucuuuucuaauccucugccaggggcuggucuauuucuagguggauuuggcuuagagccaucuuagccaccccucucacacuuucccaguguguccuagcaaaggaaaaaaaaaaaaaaaggauccuucaacagaaauaugauagcagguagaaaccuuccauuuauucuaauugcaucucuauuuauacugucucaaauuuucuuuagaugaguauuuaucuuugaccuuuguuucuuuaugugggaacauuuuuuuaaggagcaaauaaucugccccgaguugguguaaaacagcugcauagggagguccuugagagcaggagccuuauucuuggauccacacuacucccaaugcauaauggcuuaauaaaucuuuguauuugaugucuagagaaaugaugacgaugaugaugauagcagcagcugccauuuauucacuuuuaugagaaacuagacacagugcuaaaugcuuuauauuuauuauccuuuuucauccccccaucagcccugugagauagcuuuuaauuacuauccccauucuucagaugggaaacuggcucagggacuuuaauuaauuuuccagagaucacacagcuaaaaagcagucucucucucuccccuucccaauugaccauuacaucuacugccuauaccacacuuuuuguucuguaaguagggauaagguaucgguuuucacccacguggcagcuucuuaaaggcuaggacaacauauacuucuguauccccuacuaugccaggugugacauugaacacuggagaauuacuucauccuuugguucugaguugaacucacuucuccuccuaccuguacgguggaucauuuaggacauuuaugagguggcccaggcugccgucacuaaucuuagaagcaacaaacuagggcagaucugaagauaauccuuauauaucagugaaucugaaagccucgacuuuuugacauguucugagggagauuuucuaaauggcuggcaggggguggggggugauuugcagauaggggugucaguucagagaugccuggggcuuugggugaaucaugaaggugugaguuucggagagcagaguaacaaacuccgaacccuaagccuucccaggauuucaucgagaucccaaagagucacucacucacacacgaugaacugccuauacauugggacugucaacaucaacuaacaagacgagauuauuuauugaacccuccuaccuacuucuauuaaguggcuccuugaguuucugugaggcugaccaaauagcuuagcucaagggcagguaagcuaaaguuggcugugucuaucuucccuacuccauuugugagagauucagcauucacaaaagcugguacucugaccuuuccaauaccuccucaauauacuacucaacuaguacaaaguacuagaggcugaaaccuuuuguaccacagcuuuugagaguaugaugauuccaggcuuaguuguauuuugucccuugaucugucuucgauuaacagacucguuuuguagacuacaaagaaagguauuagagccaugcuaaauguugcuacuuguguucauuuucuaauaugccuaguucccacuuuaauagaucccacugaucacauuuuaauugauggaaauuuuccucugaccuuuucuucccuuuuuuuaaggugaugggcagaaucuguuuacgaaagacgugacagugaucgagggagagguugcgaccaucaguugccaagucaauaagagugacgacucugugauucagcuacugaaucccaacaggcagaccauuuauuucagggacuucaggcguaaguuuccaucucuauaguuguagauggcaacuuuuuuaccuacauguugucuugauaaagagauugcuaaggccaccuuuuuuaaauuuaauguuagaugcuuaaaguuuagucaguucuuuagagggaagaagagacaggcaaucauaaucuuucuacuuaauagaaaccuugaauggccccuuuuaaaaguaaggcagucuuacuuugcaauagaaauugauuguaguaauucaaggugaauugcaaucgagucccaaauacuuagcugacacaaacaacucaacaggguaaggcaaggaaaauacagcauucugaaagguaaucccuuugguuugaagauugaaguuuccaaggcaauaaaugccuauaagcauaaaaccaagucuucucucaucauagccuuuggcauauagaaguguccacaugcugaaaucuuuccaaauguaauaucacaaaaaacaaaauugcaauggacuuguauagaauagaaaugguucauaucagugucagggcuuaguaagagcaagaaucaaaucuuuugaaaaaaaaaaaaaccaaaaacuguuauuggagagcaucggugccuaaccaaagcgaagcaugucucuucccagcugcuuguccccuuccuccccaauaccucagggucauucaugaccuguggaaaacguugauaaaccuaaggaacauuuaaaagguugaggaaagauaaaaggaaauaagccagcuucuuuucuuaaaguuaauuuuugucauauacuaaguuagucuuugccaaaauuaagaaaggauuuugaaagagaacauuugaacuaaauaagaggcccacauguaucaguuuugcagugauuuugauuuccugcuuaaugcuuaaucaguuucauacugugaagccaaauguacuuaggaaaccacaggaccaguuuaaggccuccguaggcucgaggucauccacuuuuggcagcuccaccucaaaucacgucaaauauguuaaggugcauccaaguugauuagguuuauuuugcuauuagauuauaaguuuuuaaaauaauuuuucauguugcuuuuguaauuaauaugaaggcuuuuuuaguucuguuucauaauuugaaacccuuguuuuuugaaggccuuacuuacaauuuuugaggcauuuuaaaaggcuguaggcccuagucccugaacuuccagugcccaaaggcuagggggcccuggcacucccugcuucaggggacucaugaccugcuuuuucccuuuguuuucuuuuugucuaucucuaguauaaaaccugaaaacauguaugaguaagugcugaaaacugacagcauuuggaauugugccaaguuagaagggugcguagcugggugugugugcauauauauauaugugugcauauauauauauaugcacacgcacacauacacacacacucacacauacacugauauguguaaguuuccuuuggacaagguuauuugucuacaugaaguuacugcaaacacccaaaauaguaagucaagaaguaucagauacagcaagauguaauaaauaauuaaggaaaauagacuguccguccaccuucucacaaucacuaacucucuguuuuguuucacagcuuugaaggacagcagguuucaguugcugaauuuuucuagcagugaacucaaaguaucauugacaaacgucucaauuucugaugaaggaagauacuuuugccagcucuauaccgaucccccacaggaaaguuacaccaccaucacaguccuggguaagaaacgcauguggggcuuacccggggaaauggaauagagauggcccuuuuacagcagcaaggaaaagguuaauggugaauucuccuguucaaacuuguuucaggaagaaucaccgcccaucuugcugaauuuuaaaaauagccuauuuuaccaaaugcuguaaggaauggcaaucagcagucuuuauagauuccaccugcucuuggguuucaacccucaagcuucagaagcaaagaucaagagaauuuagagcccucaaaugaaucacucaccacaugaaauguuauuacuucuaacuaccgggauuuuuuucuuccuugugugcaggagaaggggagaugggcuaccaaaucuauaccccauggcagagcucaguuaugaaauccacguaaugauuuuuccuucugaguuacauccucguuuuaauauuguugaucuccuuuucauuggcuugacuuacggccuuguuuauugcuuauacucuagauuaugcuguaaaaaaaucauacuccaugaacauauacuuugccacaaauugcagucauuggacauaaaagaguuaagagcacuuuaacugguaauaagcaaagaacuguugacgggcugcuagguacaccuccagugagcugagugucuucauuuaugaucaccagauugugaguuucagcaaaauccuaguagccagguuuccauguucaauuuuaauauagucagcagauauuucuauguugaagguggucugaauuagucaccuuuagacaagcuuacucuacugcauaacaccagcugauuuggauucuugaaacugaauuuucaaggacauacacuauagcaugaggcaagaucucugauuuacaccuucgggaagaugaugaaucaaagucuauuugaggcggcagacugcagcuuuucaguguaaugauaggaagauuaaagaggaaagauaaauaugaaggacauuuuugcuugguaugugugcacauauauguauuuauggauguacauauugagcugcugccucauuacuuuacuucaacacagcuguagaagggaaauuuuuuuuauucauuaagcuaaaacauaacccuaaugcucacauauauguuuuugacaagaggaguaucaauuuuagaaagauguguuuaaaaccaguccauacaauuucuaaucuggucuguguuuaaugauagauggcuuucacguauucauauuugucacuauugugguuuuacuccagauuagaccuguagaaauaguaagcaugggagguuuuagugggaugacuauuuugguauuuugcagauguaccaaauucgcaagcauaaauuugaaguuuucugucugucugcuuguaucagaguauuugaaaaugcucuuugcuuauuggaguaagucauuagcagcauagacuucaaauugacuauccacucauccacccuuugacucaucaucguuuauggcauuuccacaaaagugacagucauaaaauaaaaucuauuuauggcauuuugaauuuucagaguauuuuacuacauauaccuuuacguauuuauauguuguuuucacagaaguaaaaugauaauaacagauguuagacaucuugcccagguuacaaagcacucaguaagaaccaaaaaucuuagaauucagaauaaaucuuacaauucugucuuaaaauuacaaccuuugugucuuccagucuagguuguuuucaguuaaauaccgaaugcuuuuguuuuaaauuuuuuuuuuuccuaaaggcacacaucuuuuguuuucaggaguaugucuagccauuggcaagcaguuacuacugccugucauuuucuggugccugauacauuuauucucaaaacaacugcuuuggaucaguuuggcuccgaauacaccaugugcuugggagccagugugccagcacuagaauuuugagaggcauuaugccuguaauccuuuuggaggucugauuauucuagaaguaauagguuccuacuuguauuuuauagaaguauuaacuuaaauauacuugaaaguagcacuuucaaguauaaaaaguaguagauauucuuucuguagauauuauucauucacuuaauauucuuuccauuuaauuuacucuaggauuccuugacagaguaaaauuguugucaucaguguuugaguccuucauuuuccaaaaucugacaauuuccacugauacucguauauuccaacguuucucguaagguuuagaguuuucagauauuacaaugaaugaagaaugacaguagcaucuucguugcuaucuucaguucucugaaaaggacuccaugcguacuuacacagcugucaaacuucuugauagguugaagaugcucauuuuagugcaugugucuauuaguuauuugauacauucaguaaaaacuucagcauaauuauaagauauggaggcggguacuuguuaauguugucuaugcuauucuauaguuacuauuaugcucaugaucuuauccauguaaaaucugaagacucuccuaugauauuuuguaugcauuuguugccuuuaaggauauucauucauuccuuccacuugugacgauuuuguuucuuucuccagaacauaccguaggacucucuuuauacuacuauucauaagaggagaugaaugagacagagaauacacuucuuuaagauuaauauaguuacugguaauaguagcuaauauuaucacaguccuguccuucuaagauuaguguucguucuuaagauuccaggaacaggagaaccuaauuauuuuaaagggucuuagagugagauuucacauacuggaucagcuuuaagacuccucuuuuguuguaauuaaugugacucaucuugauauugcugauuuuuguuaaauguuguaggcguaauguuuauaauuagcacucuuauagauuugagguuagcugagaagaaccuugacauuucauuacuguuuucuaguauuucccucuaugugauuuucauucagguuuucaucuauaugcaccuccuuagaaauaucuuugguuauuuucauuaauggcugcaggcaguuuuuacuaaaugugccuguuuaguggaccaugcauaaguauauucucugguuagcagcaguuuuaauucauuuuucuuauaaauggauuuuuauacuuuacuaaccuuuuguauuagaguagacauugugaagcuaaaggaaaaacaggauagaauuaauagaccaaauaaguuuuaagauuuucuuguccaacccuuuuuuuuucagaaaagcagauuuaaaucaccucauuuauauuuuugaaagcuuucuugcucuuaaaaaaaaaaaacugagcaaagucagcuuuguaacauaucaauaaacuauuaugauucacaauaucagauuuuauuuuauaaaccaaacaacucccaguauacaugccuguuucuucuucuaaccuuagcuaagaucagaaauacuggucacaaucuugagaaaacuauuuaugggcuuggaaaaaaaaaucauucagugauuucacaggauggugaucucaacaaugaauaagcccuucauuuuucuacacugggcaaauuuuuuuuuuuuuuuuuuuuuuuuuuuuggagacggagucucccugugucgcccaggcuggagugcaauggcgugaucuugacucacuucaaccuccgccuccugaguucaagugauuuuccucccucagccugcugaguagcuggaacuacaagugcccgccaccucaccuggcuaauuuuuguauuuuugguagagacaggguuucaccauguuggccaggcuggucucaaacuccugaccccaggugauccacccaccucagccucccaaagugcuggcauuacaggcgugagccacuucaaaccugggcacauuuucuaaugcuucugaaguuuuccacauuuuuaccuuagccuuaaauuugaagaugaugucagcucuuugggcauauaauccuaggaacuagcacugguucaggacucacucugaagaguuacagaguagaauuuaucuguugcaguuguuuggauaaugccaaacaacaaauaauccagauggggaccuagcugccugucaggaucucagcccccaaacgaaaucuggaggagacauuggugaauuuuccucgauccuuaucuguaccugucccuuuucauuuccuuacuuuggaccagcagacguuauugauaauguggaaggaacacacccucaucuuuaugaaccaaauggaggcaauaaagacuuuccacugagaaauaucauugaagaugaacgagguagugaagguuaggagaagcuugggguaaacagagacaagggguuuccaggcucagccugaaaacucagagaauaaaggaaagguauccaggaacacaggaaacaaccaucugaguauguuugaggguaaauuccacuaagacucaacagagauacauagaggagucuuuuaacaacugcuggacugucgcaucaagaagauucccguguuuccacagagggagcaucaaaguguuucucccaaaguuauacagauaaagugggaucugaucugguccauucccuagggauuucccggguugccaguggcuuuagccauuugcccucuuugucacauacuaagagagccaccuuccuaaguuccuaucccaucaguuacauugcuccauuacaguucucauuaggaaccacugcauauuucaacaugaaaaauuauuuucaucacuccuauuuuuuccuggaccuugaaagguauuuuuuuuuuuuacuuucauuccuuccuuaguugagaagacacuccuauauuuguuacaccuuaguuguuuucauuuuuucuuauaccacucuuuaaggucuuauuuucuuuaggcuuuuccucugacauuugaucuaacaauagcauguaaaaaauauuccuauaauacugcacucagaaugcaguaguauuuauuaguccuaaacaucuagucucucuguguauccccuaucaaccaucuagguauguaugaugaaaaucuauaaccuacgugacugucaucuagcauggaugaacuaugugaaagauacagcuaguugaagucauuccauuucuuuuguuaaagccuuucugugucucauaaaaugcuagcagaugugaaacucuaaauuagauguuaaauuaucuuuuuguuuauuuuuucuuaaaauguagacuaggguaguucuuugccauguuuaacuacucauuugggccauaucauauuagcaacacauccauuugagcaauguuguuuuccuuguacacgggaaacaaagaagagggauccuuuggcucugcucauuacaccccccgccaccaccaccaccaaacacuaucuugcuaaggaaguaugugcaacaaaucauuuuacuuuuacuuuucuaucauucucuauaggaauuuucaacugcuccaauucaguguaaaagucuuccuuugggcagaauuuucacauuguggacuagaacaguuggaaaucccaaauacuugguuuaauaccauaauuuauugaagcaguaucagagauuuauuauucaacuugaucaucaggauggcauguuuauacauauuuaauuucuuguuucucuucugaguugagaaacuuauuaaucauaagucucggaacugucuuugcuuauucaugguggucaggacauauauucuuagauucacuguacuaaauucaguauucuuacugauuuuuauuucaacaggcucaguccugagguaagguugcauaugaaauuuuacugucaacucaguuucauaaaagauaacauauuuuaucaucaucaucauugucaccaucacuaucacuaucacacuacauacucuugauuugauagucaguacuuuaacuucccaauccguuauuuugaccauuuuaucacauauauguuuaauaugcuuacagaagggugguuguaauucugauauguaaaucuacuuauaagcacuuaagagucucuuucgucuuugguuuccaaaauuggagcacuggaauucagaauauggaaaauugcugcaaacuaauuggcauuucuuauauuacugcaucuucauauccaaaggacuuuauuacuacauuauccaucagagguuaugauuacauucuggaucucugugaauuauuugauuacauggaacugguuugagacaauuuuucugugcauuuuauggugagugauucuuuuaagggacucaaagauuuuuaucuuugcuccguugacuuuggaaucuuucauuugaagauugaaauucaagaguugaguucaaggagaaauacugcuuucugggguuuccugguaaggaugaucauuucaauagcauguacuccccuuuuauaucuacuuucugguuaauuuuugaaugacuggugacuaauaucuauauugauauaaugugcucagugauaagagugagacauugguuguuguuguuguuguuguuauuauuauuauuauuauuauuauuauugagacggaguuucgcucuuguugcccaggcuggcaugcaauggcacgaucucggcucacuguaaccuccgccucccagguucaagcgauucuccugccucagccucccaaguagcugggauuacaggcaugugccgccgugcccggauaauuuuguauuuuuaauagagaugggguuucuccauguuggucaggcugauaucaaacuccugaccucagguaaucugcccgccucggccucccaaaguucugggauuacaaaugugagccaucaugcccagccacacugguuauuuuauaacauaaauuuaggauagaaauucuaaauuaacugauuuugcauaacucacuuuauuugaugauuacuuuguauuucuuuuucgccucuugugaugauuuaaauucccaucaggaaugucuacuguuuuucuccuuuuugauagcaacaaugcaaaaaugcauucuguguuuauaaagcacauauguuuaauuuguagucccaccacguaaucugaugaucgauauccagaaagacacugcgguggaaggugaggagauugaagucaacugcacugcuauggccagcaagccagccacgacuaucaggugguucaaagggaacacagagcuaaaagguaagcugcagauugccacacacugaaguaguuagcugauucuagcagauaugccuuugugaaaaucauggagaaauacaaaacaugcccaugaaacaaaaguauucauuuagauaugguuuauaaucaguuacuaaauaugucugaggccaaagcauaaaagcauuuuauucuucuaauccauguccucauucugcuguuugaggguucauggugauagcugucgcucuacucagaugcccagaaagaacuaaaacuguaaacuagaacucuuuaggcuaggaaaaauuuucaugagggcugucuccugagcucaggcugucucugucuguaccuucaauucuaauugcuuuuacccugucuuuugcagagaccuagaggggaccagaagcccacauuuucaggguauacauuuaaaaaaauguuuaacagucuuucauaugguaaauuccaagucauucugacgucuauugcacuaucaccuguguugacuauaugcuuuccugcaagagugguugcacuaaguggacuaacaguuucaucuaaauugugaauuuacagggaccaccuuucuugugaaauuugugauucaguugcccaauucaccagucuguucuuaugcaggcugugauuuugugaugacaguacaaggcagcuccuucagccccauucugaucaucuuuaccucuguacugggccaucccggguucggguccuggauccucaaauaccuggcaccucagguguugcaucagauaaaggagacagccuauacccuauuugaccauuuuuugccaguuaucuuaaauuccgcauguauuucugcauugagauuccuuccuuuucaaaguuacccugcagguaguacccugcacaaaggucuuaggggcugaacuccucuaauuguuugacagaaaugcuaguggcaugcuucaguuuccucuaaaauaggguuaaucguauuacauacuuuauggaauuuuuaugaagaugaaaagagggaauaguuguaaaguauuuagcuaauacuugggccaaaguaagugcuguauaugugcuuguuaaauaaauaaagagcgugagaaaugaaagaaucagcccuuuuagaaagaggauauagaaaucuauaucuggaagcagauaaaucuauauauaacagcuuaaguuucaagaagcuuguucuguuuuaaucuccuacuuccuagguaugguuuuggaaggaaggaguuucucauuuccucucugcuuuucugucuaagugaauucagccauuaaauguguaccgauaaguacaaaacauuaaaagaaaguuaauggugugccauguuccugggagugcugaguucaggaagggacugccuuggccuauucauuccauccggaagccuccucccuccuuuucuggguguucuuggaugugucucccaucuggccccaagcccuguaucuuacuuugcucuagcccacugccacugcauuuuugaggucuuccaaaagucucagaguuuaaacauuucaauuacaauuucaauuauguaaauccauuuaguuacuuucucucuuaauuguugaugaugggaguaggcaaaggggguuguuuguaacucuacugcuuguugaauuacuuaggggauuuggauaauauccuagaauuucuaaauggcaugacagccuagucaauauuucaaguucagaugguuguaggggugaaaaacauuuuucuuuuucuccuccugaauaccuugagcagccagaugucagaauguuucaacuuucagcugucuuuuucugggagguuuuaagauagaaaaaccauacauaauauauuucaguaaaaauaguguaugguauuuggacuugaaauauaucuuaaauacuaugcugccugguugaaaagucauaaauuaaggaaauaaaaacuuuaucagguaacuauccacagguuacucucaucccaaguaacugccaucauauuuguuaaaauagcaauguugggguuagaggacagaggggaggacauaaaaacaaacugauggaaauucacccaacucuggugucuugguacauuuucuguuccccaggcaaaucggagguggaagaguggucagacauguacacugugaccagucagcugaugcugaaggugcacaaggaggacgauggggucccagugaucugccagguggagcacccugcggucacuggaaaccugcagacccagcgguaucuagaaguacagugugaguacccugguaucuuauucugagggcguagaguugcaguuacauagaaacucuucagaagccauuuauucaaugcauucauuuuauauaguauacauagaauucuuauuuuugcuagaaaaauaaaggauuauuuuauugaaauauuguacugccauauuacagagugccaaugaggauuugaaaaugcuacauugaacccaaagguaaaacugaaauaauaucaaucugcucuaacacgugacuuaauuaauuucuuugcauauagacugucaucauuucuaugccaacugcaaaaucuaggguaauuuucccccuuuuuuuaucccaucauaaguacugaaguuuuuauagaagggauuuuuuucccauuuacgucggcauuuuguuuuaaaugacauuccuccucuauuuuagcuuaaauuagagcaaugaguugaaaagucgacucuuugggaucauugccacaaucuugauggcuucaucaauaaaagcuagauuguagugagugagguuuucuccuuaccaugcccuguagacugaauauguuuuccucaucuucuccucuggacccuucugcuuaaaaggaaaaagucuuuuucugcacaaagccauucuuaugccaagguuguggcuaaguagccagcuucucacuuuguauuuggcuucugaaaaaucaaggugaucuuugaguaugcauacugaaauguuaccagaguuugguugggaugguagugauuggaugucugauaaaggaaaagcuuuacccuuugugaaucauuggauuaauuuccuagggcugccauaacaaauugucacaaacuugguagcuuaaaauagcagaaacuucuuuccuuacaacgcuuuaggccagaaguccaaaaucaagguuuuggcaggaccacacccccucccaccacaaagacuguagggauggaucguucauugauuuuuccagcucuaggagucccaggagcgccuuaacuuguggcuucaccacuccacucucugccuucaucgucacaugaccuuccccucuccucugugggucucucgucuguguguuuuucugaggacacuugucauuggauguagggcucacccagauaauccagaauggccucaucuugagauccuuaagcugauuucaucuguaaagacuuuuuuuccaaauucagcuacagucacagauuccaaggguuagaacauggacuuaucuuugggagccaccauucaacuccauacaagcccuauuauuugucuaaaugaucugagcaaaaugggaaggcaggaaaaguuauaaaaaguugcuucuaagaaaccaucccauuccaaccuuuucuuaacuccgugagcuuggcucaauuuaacauuacauaaugcaggguuuccucguuaauucauuuaaucugcuucaauaugggcaucaugcuuauaauuuucauaucacuaaaacuauugugguauaaugucccuauaaugggaaaacggaaaugaucagauauuaucuaaauuagcagauaguagauuucuugugacuuuguuaauauguaauucauuuaagcaaacuuaauauccauuaacuuuccuuguaggggcccauuagcuuuaauaauacauuagcuccuuuguacguccugaguagauauucacccaguuuccaccccuaaacucuuucaguauuuucccagaauaucuuuuaaauagaauauagucccacccaccuaccaaauuacccucacucccaaaugcaaaauauuucaagcgcuacaccuccuacuccuuggaaaacuugauaaugauccuuauaagccuugguuuccauaaucuguagauucuaagacaaggaauaaggcuccacaucugaauccauuugacuucaaucuaacaaaguacugcgagccuuuaauugcaggaaagugacucuaaugcccuccaaaaacaaggaugcaccaauugauacuuuaaacucuaauauggcaccuuuuugugggagacucuguuuuuuauccaagaaaaucauacaaauauuuuagccuuuauuccacuuuucagaauauacauaaggaaaaauauuuuuguauaaaggaaagcuaagauaauuacaaugcauuauauuaaccugaauggaacuucgcaucugguuugauaucuuaaguaaggcucucugugcucaagaaaguucacuacccuccacuccuagagcacuauugagaacuuugcagagucagccaggaauuccuuuuguagcuucuucaaacacaguuggaauucucuacaucauuuccuaccagcuuuacucuccuugaacacuagcagcuaugcaguaacaaaaaguuucauuccucaaaugccugaagcacucagucacugggcccugaagucugaucagucauugcccagugcuguugauggcucaacuccagugccccccacagccguccucucucugcagacaaguagcaccauauuuugaugaccaugaggaaagaagagacacucgaauacaugagauuccuagaauaauuuauucaguagccacucugcauggagguugaauuauuuuggaugccugugaggaguaacauugcaccuguauuuuaauguugacucaugccguugaagucagcaguucuuaaccuuuuggggaucauuggccccuuuaaaaacccuuugauagcuauagaccuggaaaagaugaauacaaucacauauucaccauauucuacuuacaaucuaaggaguccauuuaccccucaggguuuuccuaaauucaguuauuugaggaccacuuucacaaauuugccauguucaugcaucaucuguauuuuuaccugauuuagaauuuuucuuuaagucacuuuauugcuuuauccuaaccagggccuauguaaaaauaucuauuaaauuacacauuucauuuguuauauauagugucuaauaagcuuuaaaauaaauguacaacuaauauuuuucaauguccuuuccuuugucaccuaaaaagauuucuuauguucucggugagaaacaauagguuaucacuaggaaauacugaucccauucauggaccucagagucuacuccgaguaaauaaggcuaccuugggggcaaaucuaaucugauacuauugguauuaaauaugcucacuuguuuaagccuggcugauuuuacaccaugaagguuuauggaaaccucucuuuauccccaucuaagaugaauggauguuaaccaggacaugaauaggguuaaaugacagaucauggauuugaauucuacaucaaguaauuuuuaaaaaauacuauuaaaaaggaaaugaaauaaugaaaaccugcguuauaugucauuaaauaucuuacuuuaaguaagacagggaaaaaagagaggaaggauaaaaagaaaggaaguguugcaccucuguccuuaaaauggagugcuaccauauggcauagaagacaaggcuugagcugcaacuuggaauugcuuuugucuuguggauuuaaguccuaauuaauugaaccaggauuuugcaguguuuguuuguuaggacccuuauuugugauaccaggagaaauuguugugcccaauuaugugaaaaaucagccagauguguaugcugucauacuuuuaauaauccuuaaguuuuuggugaguacagauauuaauuguguaguaugcauugaagugauuaacaucaauguaauuuaucaucuggagauuucugaacauaaauaaaugaguuguuuuguucagcaagguguugaccccuucagaaucagugaauuaaagucccccccccuuuuuuauuauaaauaugaaaggcaccacaaucagccaaguguucaguuauuugauuuucuggggcauuagccgcucuuguuugugacauuucccuguugggugcucguuugcaagcucauuaauaagguuuucucauaggaacguugccgggaaugaagaacauacaguaggucucuuaguuuucuagcuuucauucugagacucagcaaggguacagcagcagcacacaguuaaauguuuaaaacagaaaauaauuaugcucccaagcuggaagagcucaaagcucucuuuccuuagauguuaugcagagaacaguuuugcuuuuuaauguuccgagcuguaugacccuaaaaucuuucagugcauuuuuuucuugcgaaugucuguacaggugguggugcccaaauuuacaacaugguugauuauagcagagugugauacaauuguagcacgguuaguagagcuucagaucugagggaauguacucuugucaaauaaaagccuguuuaaaugggaacaguucacugucugagcguuaagagaaaacugucuaaauagcaucaagguggcaacacauagcgacauaagcugggaauucaaagaaaagcugugacccucaguauggaauucagauugcuuugcacaagggaggaaagccuuccucuggacuggggugaauaugaagcucuugaauuacugcuguguggcuucugcuuucacccaucauagccuugcucuuuaaaauguuuggcaaaaauccucauuuuuugaggguuuuguguuugugcauauuuuaaaaaaagaaagaaaacucagagaugaguuuugaaaagaagaaugaaaacaaagacucuagaaaugggugcuugaaugccaugccugcucugauuaucaucugacaguuaauuguauacgugggcaucauuuucaaaaugaguuuuauugacugaauguagcuagguauuuuauaaauccauagcccuguucauccaagguccagagaaggguagauuuuuuuuuuucuuucauucccucaacuggaggaaaauugggcauugaggagaugaucaaaaccuguucuuuaucugugccaaaauaaauguuucucugguaucgauagugcccugcauugaaggagagaggaaaaccuggaaaucagaaaaucuuuccuauuuggaguggaggauaacacuuaguucccaagagcagcuucuaugucaaauccucucccucaucaauucuguuuccagguuguauucuucagagcauaauagcuggcguuuucagauuuggccuguuucucucugaucuccagucucucucucucucucucucucuuuuuuuuuuuuuuuuaaacggaauacgcucuuccucccacucucccuuuuauuuuuuuuuuaaagcagugaauugaguuucagggagguuauuuuaguauuuaugauuccuuaugagaaauaaucaaggaaugaagaaccccgauugaagcuaauuuuuuaaccuauuauuucuuuguguuaacacagaguaguguugguuccaaguuccugauauuauaaggacuauagauuguuagugauacaaucugcaguaccaaaagugucaagaggcugaguaaccaguauucaaaauacaaagagugaguguugggcaaauacaucgugagcaagacuggaauaacccuuaagggaaaagccuuugccuuuauaccugccuucugaaugcauacccugcagaaagaggccuguuuuacuaagaaccaccuccucucaucucacugaccuuaauguauuuguaaaagaugugucuguguggcuguggacauugaauacuuacauagugaaaccagucuucuaaugcacauacuucacuuaaugguuuuuaacucaagguuaaauuuugauuguguggaagguuaaauaguugugaagcuggcaucuaaaaaucuaaaaggaauggucaaacaacauccuuucugauuuccuguaagacaccacuuagagacacaucggaagugcuaaauaaauguauggugaaguggaaauauguaaagcagaacaccugggcugaaccucugauuugggcggcuggauugaccuuccaaaagaaaaacaaaauuauauucugugaugaggacuaacgggaacucgugaucugauuuuauuuauuuuuuaaucaguaguaaagguggaaggagaaguccaugccccaauguuucuucacuuucucauucacuuauuccuucauucauucauccagcaacuaugucuugaaugcuuacugugugccagucccuggcaccguucuaguuaccaagacuucaagaaacagaacaaaacaaaacaaaaaaaccccucucuuguuacagagggaagauucuuguacagaaaaucuugcuauagggauuuucuugcccaguguuugcuuacaaaugaugagaauugcuuccaagacauggaagaauauucugugaguauguacccccauuuaaaaagcagugggaacaaagcuuucugccaccacaccaugggaucaaauuugauucuuuuuuguaaacaguaauucuaauacccacaaaccuaccugaaaguugcagcaagagaagacugcauucuacugugguauuggucuuacgucagucccaccagauuugacucaucccacucacaaucguucagcccucuucaggaagcccaguuucaguacuaugagucauaacaacagauguaacagcaggagguucuucaccuugcaaacaaacaaaauaaacggcagugaaaauuauucaugaauguauuaugacaauagaaagcaaauauuuugcaagauguucucuuuaacuccucugagagcucugugugacuccguucauucaccaaucccagucaccuggcauugcuagacauugcccuccuuuaguugcaaagcuguccucccccaacaauuuagacagccauauuguagggguugauucuugcuuugagcucaaacagcuucuaacacucaccaaaucucagguuaaucuuugcauugucguucuacuccaaacuccaauaauccuccaugauugacaaagacucuucagucaaugcuuccucacuugaaugcacaggggcugacccagacccgcuacccagacauucugauaucaucugugcucaugcugcccuugaguucucccugguaggacuugaaacaauuagcacuugauccacaagcaucaaauccccauacuccuugguguuucagaauauugggugaaaucuaaguaagaaacaugaagaagagccugugucccaaaugcaguugcagaaacagauuugcacucaagccccuggaccuaguugcauugagcacaucaaagaaaauaugacaccugcauuuccugauuuagaaauucuuaggaagagagggaagguuguggggacuccagggauaauaggucucccgcuggcaugucuccugccaggguaugaggaugccuuuuccacugacucagcucugcuccucucugcuacccuggaagggugacaucccagucaugaagaaacugcaaaguaccuuuuucuaaauaaaggaaugcaaagaccugauacguuaguguuuggaccuacagaggagacugugucuuuucauuuacauaggaaacugaaauacagguucagaaucuugaguuucaucuucugaaaagaucacagaauguggugcaaggucagacuggcaugaaaucaauuguaaucugccagcaacccauuccaaccucuuuaagaguuuccuuuuauauauuuuuucccuuuauagagagagcaaaguacauuuaaagaaagucucaucaaaucagaaugucuuucuaauauuauuuuuuuaauugguugcuacuguagugugaccuaaagccuccugguguuuaacccucugugcaacuuugacuaaugaacaaauuugucugcuauagcagucuugcuaaaugucuuuuacaggguuuaaaaaaauucacaguguauuaugaaaaccucagaucccucgaccuaauugauuggcuguugaugaugccaugucuauaacuguaauguucuuuaaguguacagaccuaacuauuuuucuuauuuuuauauagcaguuccauuuuauaaugacauuaagccauucugagugauacauuucugggcaguuauugcacuuggguagaaaguaucgucuggcuuuuggccucaugccuuacaacaccaaccgaggcguaaaaugaucccccagaaaauguacuaggcuuuaccucauuacuuaaaaauaaaucuuggaggcugguucuguuucagaaaagguuugguggguuauaacauuugauuuaugaacauaauuaaaauauaaaugaugagcucugggcuauucaaucagccaucuggauuguuugguauuuugacauauucauaucguaguuaggcucuucaauggaaaauuuaaugucccuuaguucuagaggugccaguggaaucccaggguuucuauuccaccuguugaaaacgcuuaaguuucucuuucaggacaaaggaaggggaacagaauuuauuuuuaaguuuccaucacccagggauagaucucggcacauagaccuucuauaauauuugauuccuaggcugggcgagaggauagcucaucugcccguggucagauaauaugccuauaaauacugcaugugucaacagaggggaacauuuuucuguauaaugcaggcaagacuaacgcuuaccuuuucagccagcuauuacgguaacuguggcagcuguagccauaaguagauaguagauguuucuccagaacuuaaagaguaaauugggaaaaucaguuaucaaaacugaagguguauuuuuugugauuuaguaaaugguuuuuaaaauaaauuuuggguauaacaaauccuuagcuuguucuucccaauuuaugugaauaauuggcaacugauaaacagcucauuaggaacauaaaaaagcauuuaacuaaaacucagugguacugaagaagcaggguggauuaaguuuuucaacacugucuuuauuauugauggaaguugagcauguaaaauccuuagugcacuaugcugaaaaauaugcccucucuguuugcuuguaaauuacauuaaggaaaaaagaagaaaaacaaaauccuuccacauaggccagcaagcauucugcuucuucuuaauuaauggccaaagucagcagugcaugaaaaacguagccuuucuguagaucagagauuaaccuauaagcagauguuacauuucagcccaaauuuugggcuuuaaauuuagccucacccagaagguucauggguaagaaugauagagguccccuaacuaggaacucuaguaagugcugcuguuucuggguaugaacugugagguagcaggucuucuguuuucuguguguccagugucauaaccuucuucuuucauuuuuuuuguaucuuuuuuaaaaacuaaacuucacuaacuaguguguguguguuacacgacuacaaacaauaaacccacaccugaugcccagcaguuguaguuagccuaauauguggccucugucucugaaagggggugcccaggagcucuugagccacccagugcugguucaaggucauccuguuuauccuuuacaagcauuucugcuuuucuuuaaugacuaccuucccgacccaguuaucaguaucuggaaaccucaacaccauuuugcucuuaaacaguuucuuugccaacguguccaagaauagaacuguguaacuugcaagggucagcuggagcuucugggcuuguuaacuuuacguucucuggcaagagacuuagcuucucagaaagcacuaccaauucucaguaugcagugcacacuggugggugaacaagggggcucucuuaaaagguuuugaaugccauguaauuuuuagagacaugagagaaagauuugugauaggaaagagacuauaagaaugcaucuagaaagcagcuaucucuagugaggacuuccuugugcagcuuauauagcuguguacaagaugagauugguugagccuugccguaauauuucuaucuucucccuuauuccauaggaugaauguuaaugagcuaaccacagcuuguaaaaggccaaggggcuguuguuuaggugguaugauugucugagaaaguaaaacuaugguaauuauuuugaccuuucagccaaccgaugucuugcccucucacauuuauuacucuuggguacauuuccaaaaauaugcauuuacagagccacagaauuaaaugagaaaaccgauuuagggauuaauagcuuguuaguucagcacugaaaaaaacgaucuccuaauuacauucagauuuuauuuguuaauguauuuguauguguaucuauguuaauuccaacuucuguagcuucccucccuauucccugaaccucccauuauucagcucucauagccauauccccacacugacaaauacaguuuuaaguagcugguggaaaugagaauacuuauaucuccuuccuaaguaccucacugcauuaggaagcuauaccuggcuuuaauuauggauugccauuggaaaugcacuuauggaucagaaaucuaucccaacauacacuuauggggcugucucucucucugugaucuuggaugagcuacuucaaucuguggguaccagaguucccaucccuaaaacuaggcuuauucuacccccaaugaugguuccuaggggaguagaugcugaguaaaugucaguauuuuuucuuuuuaauguuuacacugagaugucagaguuuucacugggagggcuuccaaaauaucccaguuguuuuuucuuaaagucauucagucugccuuucucauuugaaaacaagaacauagaagaggcaaauuuauuaacaugcagugucacaacauauugucacauaguaauauaugauauaugauaaaauguaucaauucugagcaccacagauaucuauggcuucaccucagcaugaaggcaaaugaguuuccuuuagcuugagugaguuuggagauaaacuucaguguaacaaaauguauuucacaggaaauguuugauguggcgcaguuggcuuaugaaucucuuaucuauuugcgguucacuccuuagaguuauuagucaauuuaauuugagcaaaugccaggauuaccaacuaauuagaaggguguuacugaaggcaucggaugggagagaguaagugcugguacugugguuuugaggcagugugugagucugauuuugccugaugauaucauuugcuaaacauuauacuuuguguuuuugucacacagauaagccucaagugcacauucagaugacuuauccucuacaaggcuuaacccgggaaggggacgcgcuugaguuaacaugugaagccaucgggaagccccaguaaguucugaaggccaaaguuggcagagggucaugcgcaguaaaugucacaacacagacaugugcauucaccaguccuuggccugucaccugucuccugcugcaaaggauggaugguuuuucaggaacuaaagaauauucagugagaguggaaauaaauauccauaguucuuaauggucaggacugggagaaaaauuaaaugcccgcuaagauugaaaucucagcuaauucuauuuuauuauuaucaacaugauugucaggacuauuuucucucacacacaaaaaaauaauccuaauaaauuauuggugucccuacaaucuaaugauauaucugccaccuuuuguguuaaugucuaagcugcuagaaagaugguuuuaagacuuacauuaagcugcuauguuuagggccagcuguaggcaaaugaauuugcccuaccuuuaauuuugcaucuucuucccucaaagaaaagugucauucauacuugacucccagaaauauuuuuguuaguaaggaaaagcucaggaacuuuucuuaaggaggauauauaugccacuucauaagagaaaaagaagaaacaacuaagacucuuauuuuauugaaaguauaaaggagccacuugaguugcccugugaaaugauccaaagugaauuugaggaacuacauauaucaucacuaauacaagaaaaaaagccacacagugguaccauuuuaacuauuauucaguuuacuuacugggcaggggacacuucuuuaguguuucuaguaaagauuguuuuuaacuguuccuuagugggggaaagaaaaaaacaaguugaggauucaugaaauggaauaauaggucaauguugggauuaaggacgcucaaacuuuagugguacccaacaaaaaacagcauugagcucccuuugcuguccccguaguaugauuuuguuuuuucccucaaagaguuuugcuagccagcgucaucacaguuuucauauaaagaauucagagcaucuuaacaaagcuuccccagaaaucucuggaaagaagccucccuacuuuaacuaaggaaugaucuaugacaagagaccagaaagccaaagggggcucugccugcuguugguucucucuucucauuucaacccucccuaucuuugcacuuaccucuccaugugcuggaauuuccuucccucugugcuaaccauguggaguuuuaaaugaccuuuaggagcuggaaaguggucuugguucuguuucacuuucccucugguguuuccaaguuauuugguuuugaaugcuucgagcuucagcagagugaucuuuuucucguuugagcacugccaaagauucagaucuuucuuuuuguaaacaguuugaauuauucccuaauuagcagcuuucuuccagaauaauccaauggaguaagaaaaaaaaauucucagaggccucuugccgcuugcaauacccgugcucggccacauuaaccacaguuacagucuauggcuugcuaaccuauacuuuguuuuuguauuuuuccccugaagaagguacuucguucaauugaaugugccacggggacaguaaauuacauguuuccuucaggacauuuaugccagagaagggauuuguuuguuccuuucaaauaggaaccaguauaugguugugugagcaagcucacauuacucuacugcuaccccuucuagcauguuacuuauuuauuuucucaagaaauugcauacaauaaaaaugguaauuuaacuugccauuaaauguugugaagauucucagcaguuaccccuacugauuguuucagcugucaagcagcaggacauuacgucugauugccaggcaggcccauuugccauugccuacaaggaggacauaugcaguacuaauuuuuaaauaauuuacuggguugugaugacaaacccauguguaauuaaagaaaaauuguaacuucacaucccauuugaaaauuggaaugcuacuugacagggcuaacuugaggauccguucaucauuaagcaugggucucuugucgugucgcugcuccuagaggcagcuguaggaacuggaaggaagucacuugugugcuggaucucuguuguccuuccuucaaaaugaaaguuuucaggcacaauucuaaauguggccucaacuucauaggagguugagggaagugccuugaagaauggaaguuuucaaaagauacuugguguguaugcauuuuuagcuuuggcgaaucuuaugaaauuugcuuuuuccugauggauacaaauguggcacuuuaaaucacuaaaacaaacuugucucugaugagcaaaugcccugggcccuaagggauccauguggaaugcaugccauggugauuagccugagagcccuacccacgagcuuggggagcugcaggugcacacacagggaaaguucucacaauaugcaggccuuggagagccaguaaagaaggcaauuugccaaggaacagauagacaugguggacuagggcaucagagacagggguggcauucuggguagggggaugcagguuauggggagggguuaaagggaagaggaaaugauuacaucuuuccagaaucaaaggugguuuuucaaacagaggcccaagaaaagcacuauucagauauaaaaguccauuccuuuuggugaaacucaaaauccaucuaaauaucacaagaggcuucuaaacaagucuugguguguuaguaaccaucagaugaaugcauguaucacuagccaagaacuugauuucuuuccuaauuaaugagauguuaacaaugggugaggucuguccugccugaguuggugugaaaccacacagcggggcauaaaaauaggcacacuguuuuauuuguugauuugucgaacaugaauuggaaauaaugagacuccugcuuguggucuguucaaaguuuuucaacaccugaucguguuuaaaagaaaaaaauuguauaccaaacagauuuuuggagacuucacaguuguaauucugugaacuuaaaauaucuccaguagguccucauuaauugugucacccugcaugugggugagcaguuugaugcaauggggaaugauaaugugacuugucuuccuccccuucccccugcaggccugugaugguaacuugggugagagucgaugaugaaaugccucaacacgccguacugucugggcccaaccuguucaucaauaaccuaaacaaaacagauaaugguacauaccgcugugaagcuucaaacauaguggggaaagcucacucggauuauaugcuguauguauacgguacgugagaagauaaaaugcucuucuacuagagucagucacauggagcugcuacuugugauuuacucucaaagcuuuuggucaaguugaaaaucaaaaaccaguugguuuccuucuagaacuuaaagaagccuggccugagguggacccuagugucuccaccugggauagugacuuuucuucucucccucuaaugguggguguuucuacuagaucacagucuuuggucaugcugagaaggaaagcuguguccucaggcacaagccauggagauuacguuagaaguaaugacugaaacauucagccuuaccaauuagcagcuuuucagcucagaaaguuuauucccagugguauuuuacuaugauaccugggcuagcuuucuccugcuuugaugagcagaacuauucuauuuucagcaugaagcuauuaauuccaaaagauguuguaagccaguaaauacucagaacaaauacaaggucccuuguagcuacaugaaccaccuguagcuacugcuucagaacaaaagcuuuuuuaaaaaaugugucuguuuuuuuaauaucauuuuacaggauuauuaaaacaucaugaauuuuauucucuagucaacagauauuuauugagcaucuacuacauuucaggcaucuuaaacuuacuuccuguuuauaacuuacuguugauuuugcacauggugaauauuuucuauuuaguugagaugugcaccuccucucuaguuuuauaauaucaaauuaagucucuucuguucaauugaagccucauaugccaaaaaauagccaugaacugacaugacaaagaaugaguaaccagaggcaucggcauuucaauguguuauaaauauuugaaugugugugugugaaggggguauuuuuuucuugauguuaccaguguaaauaauccaaauauaaguauauaugaauaaauguuuagauacacauaaauuauaccuuugaaauauccacaccacagugucuuagaaccaggguacuuugcuuaugaagaaaauaggaguggcagucuuuuuaaucaaauagaagcaugcuuuacaccauaucugcauggauauuaaaauauaauccuuagccuauaccugagguuuuuuuccuagcauaaugcaaaauuaaaagaucacaucuaaucaccuuauuuguagacuucugaaguauguuuuaucuuuacgcacuaccaauguuguccgugguuguauuaugucuguucacacauaauaacauuaauucucccaguaguuaaggaaauccaugugaagcaaacagcuuuucuacauaggugagaggggacacagcauggcccguuuucagcuggcgauaugcagagccaccucuuuccacagacugcucggcgggggugaaaaguacauuccucccuuuuucugcaugugcucucuucacacaagggccugcgccucaugggaguccccgacauugcuguugcccggguuuacuggcuuucaguccagcucuuuacaaacugcagguuauaaaaagcagugacaaauuuccauuagucuguuaugugcauccuugauucagaacacuaaguuaucuggauaaacaguuuugauuuauuguacuuacugccccuacauuucaagagaagaaacauuuuguggguuugauggacagauauauuugaauaauuuuggauaguaguuuauagcuagcauuuauuuagugcucacuuuauuccaugcccuaugguaacgauuuuccaagcauggucuccuuuaaucuccacaauaacaccaggaggcaggcauuaucacgaucccauuuuacagaugauaaacugaaguucagaaagguuguacaguuuuccccaacuucaccagguuucuaaauguguuuuagaaccaaaauacuuuggcucuaaaguccacaacaaaguaugucuuucuuuguauauucucuuauucucacugcuuuccaguagaacaauccccuucaauaugagaugauccuuuuagaauuaacugucugggccagagugcauuaucugaaaaccaagaaauauagggauccaccuguuaaaggcagacacagcuacauacacaugucucccuaauccaagaugguacaccuauccuugucuagggauuugcuagaucuguaauauacuaccuaucuccccuaaucaguccuaguaacaauacuugggaugacagauuagaauauuagccuaagguauuacuagucuacuaacaaaauacucuagcaguuugggaagguguugaguagauuuucuuuccaaagcugauuuguuguauuacuaccauaauuuuggaaguauuuuaugaacuaaaaguuagcaagcccccauaaaguuuaacucucuagaagcaacuucuacacaugaagaaucuagcugguuagugccugagccccaacugauuuuauucuuuuagccucuacaugucaagcacagcucauuaacuccaacucuguacuuucuuaagugguggccucacauugcucuuauugcuagaaaugaucuaagcacugaaguuauuuuaccuguuaaaggaaucuaauucuuucaggucacuuuagccagaugugaaggacaacaguugccccagucgugauaaagauaauugaaagugugugauuugcacaaaaugggagggacugaugaccuuucucugaagucugugucuucauuagucugguccaccccuugguucauaaucauauuuucaaaucaccuucagaucuacucuuauuguauuguggacaucacacacuuuaugucaacacuuuuagaauaggugcagaaauaggauuauaggcugggcgugguggcucacgccuguaaucucagcacuuugggaggccgagguggguggaucacaaggucaggaguuugagaccagccuggccaauauggugaaaccccgucucuacuaaaaaaaaaaaaaaaauacaaaaauuagcugggugugguggcgcaugccuguagucccagcuacucgggaggcugaggcagaagaauugcuugaacccgggaagcggagauugcagugagcugagaucaugccacugcacuccagccugggcgacaaagcaagacuccgucuaaaaaaaaaaaaaaaaaaaaaaagaaauaggauuauaguauaucaggggaaaucucccaggaacaaauguuccuuuucaguaguagauauaguaauugaagcaaaacagaaaaaucacauuaacugacccugugcugggcagcaggcaccucucuggauauaguuuaguuguguaguggagggagcgggacgucuuuagugcugggcucaggggucagugcacuugguucauuuauaucuaugcugacaccugcagcagguguguaggugcauccaaaugaguuuccaggucacaaaaugcuucccuaccuguggccuccauaaaaagugugaaggagcaagacugaacacauggccugaaucaccguauuucucauucugccuuucuuuuaaaaagguaguuuaaaaucacuaacuuaaccauuuuuaccucuuggaggagaaugagauuuuuuuuaaacgacauccuuuuuuggacucacgugaggcugcuuuaaaugaaaguguaaacugcuuguauccccaucuuaaaggaacggagccucccauugaacagaacaguugauucuucucuguuaauuucauccaaguguguuugugugagagaagcaauuugugaggaaaauuaaaagcucagauuguugaucgaugguagauaucauuuuaaguagacuuugcaaccaagcaccaaaauaauauuucuauaaacuuuugggaaguugcaccaaacccaauaaaggugcaguauauaauuaaaguuuugauguauuaauuagacaaucugagagcucacuugaagauaaaaggacaccagaugugucagggagaaaaaguugacaugcuuuagauaaaauuuaaaaucaaaagcuuucaaaucgucuuaugcucuauuauagcagaaugauugcuuaguucaaagucuugcugacaauuuaacacauucaguuugaucauuugggcuuagaauuuuuuuuucucuuucauauuugccccucccuugucuccaaauaauuuuugagaugauagaagaauauacaguauaucaaauaucugacagaggguucccuaucagguuccuggcuuugaaggucgagucucauuuauauuuaguucucuuguuuacaagauggaaaacguucuuucaguuuuaucacuguagucuacuuaggucaagcuuuuaauaugagcaaaggcaacuuauuaauauuuauaaguuguaaaauuuauugacuuuuaaagaauaaaaucucaguaaaaucucacaugccuggaacuugauauuuaguggugacauucucucuucuuuguauuuauuaugaguagagaaguaguuuuacuuccugcuggguuguauugauggagaauaaugaaguuaacagucacagagagcaagugugcaggggcacgcucauccuuggcugauaugagcccccuaauagagcagcaccaccuccuccuccuccuuccugccaucuguaaaagcugaaacgaaaugacaaccauuguacccucuugguacugaguugauuuaaccucaccuuugaaaucugguagggaagaggggugucguauguuuugauuuuuccuccccucucuucacaucuccucaucccuaauucacuucauuaaugaaaauucucuuuucuucuuuucucagcucuuccaacuaaggcuuugggauauaauuacaagacauaaaucuugcagggaaagaacuuuugguuuuaaagggggaagccaucaaacaaacaucucaauguccucaugccuuuguuuugucauuacuggucauuguuguguucagcauuguggguuugauuuuccuuuuuuuuucuauccagauccccccacaacuaucccuccucccacaacaaccaccaccaccaccaccaccaccaccaccaccauccuuaccaucaucacagguaugguaucuucauuaccauugaaaauguccugaauguauauugucuuucugguauguauaaaaagaagccgaaaaguucccuuuaaauccuuggaauuuaaucguuccuuuauuuuggaacuccaacgacauuagauacuauguucuuaaguugaaucuuaaggaccucagaaacaucccagcauuuaacaguacgucagauauuuugcagcuuaugcauaaaagaauucuuuuuuaagcaucacuauugaaagcaaaaugcuagggaaaauggcagcuggcuacuagagaacacgccuauagcuucugcuuagacauguuugaugaaaugguaaguacuguggcuuucaaucuugucucugucuuaguuucaucucaguccauguaagggaaaauauacacaccuaacuucaaugugccuauuugggccaugcuacuaaaugcauagucauccuuccugcuccagagaguacccgcugacaagugauacuaccuguuuguguugccuagguagucacaagagaucagagggagucacugucuuuuccaugcugagcacucaugugccccucccugcccucggucacauauuggaagaguggaagaggcagccacugugguucuaacucugcggcuuuaucuuuuuggacugucugaaacucuuauucagcaugaguuuuacugucucuuguuucugucacugagggagguggcaugccauccagcccuuccuggcauccaguggcucucucauacugcuugauguggcuugucugggagccaugggguuucuucugccuaccuaaguaggaaagcuucuggccacacuauguccacuugacaugaaggauuucccuagauaaggccuucccaaccuguguuuacagggacuuaacacaaaaacaugugaaaguaauuauucugugagaaaaaaauaucucuugaaagaguaacuuuuccgcugcauuuuguuagcuggugagacugcaagguaucugaaccgugugcccugguacccaccccugucucuggacuucuuuaugaacacugaguauuugacuccccacccuucauggucagcuccuuuuaacacccuagauaucauugcuguccuuuucauugacaugcuagagacauuuccaauuuucaugggagucaguaagauagagaugaugaaaauucagaguguucaaagaaagaggaggccucaucaguugauagaauauacaacagauugucuaaucucaguuuucuucacuuuucuacccauuacaguggaaaaaagaacccuuaaggaagccagugcuucucaacauugguuacaaaaccaucagugccagcacuuaauuuaaaaucuucugaaaauccaucaguugguuuucaugucucacucuaaacucagcuccaaccaggcugcuuccuagauucuugucuguguguguuucuguuuuggcucuuuguuacuuccuucuguaaacuuaaguaaacucaguuuguugaccuagugaauugauucuuuccauuuucuauacuauucaccagcauaucaaagaugcuucuuccuaacucugauuuccagaguaacugugcuaucagcuuuucauacuaagaacuagguuuuuaccuuuucacauuucuugccugcuacccaguucguaagccaaauuagacucguacucuugugaagugcccuuuagauacuaguguaaaauauacugcguaauucuccauugcccuacauauauuaacccuuuaagaaaauauaucaccagucuauuuuaucuucgcagaacuugcccagguaugagccagcauuuauuaccacucauucuagaaggugccaguuagguagcuauccagguuuacauuuuaaggcagucgagaccuuauucacgugguauauaaacaaccacauuucucuuuuauauggaacaacacuuuucauuugcggcuggccuucucacuagcuuaugcuuuuuuuuuuuaagaccuuucuuagcacucgcugaacuccucccccucacaaucaaucucagcaacucagcagagucgcuucaguucacagcucuuaauccuucacuccagacuaaagcuaaucuuauguccucaaacagcuacaacucacuguuaucacaguuccgacugcagagacuccauuuaagaggaaauuuaaaaaauaaacaaugcucuauuucuguccacaucaaagguaccucuaacagaaacuugucuuugcuucugucucucugcuacuggacucucagcucaagguaauguaagaugaucucauagaugcacuuuagccucuugauguuagcaguugaguccucccugcgcacaaaauacauuugugguaaugaaugcccagaaucucacuggcacacccaagaguaguuaaacuaaaauugcuacuaacacaacauuguagaauucguugccuuaauggaugugaucuucuaggcuuacugugucuuaacaagcagucuuauauauauuuaucuugcccagaaaguacacuuguagaauuuaacauuugcuccuuucuccaaacagauuaaagguuaugcagcugaaugauucugugucccauuuuaaagguccaggcuauccccuagauuuagauuaguuccuaaaaaaucuuccagucugaauccugacaaauggauagcuaaauuaauuuccacuccucuucucucuugcacuguuugguacauuacagccaccauuagccuuaaaagcugcagcagccaaauucggugacaguaacauaaagccugagcuuaaaaaaaaaaaaaaaaaaaaaaaaaaaaaaagaaguccacagucaucuauuucuuuucugccagucaaaugcaauaacugaaacccauucccuaggucaggguuucauuacaagaaaaauguacacaugcaauagaaaaauauuuuuaaacucgagaagucauaguugauuucugauuucucugaaaggaaguguuccaguguuaucuuuuaucuuccguaaccaggauaaucaaauuguuccccuuguuaggaaggcagacugacauucuguucugagucgccugacuuccuugaaacauguuaaagcuucaucguggagacccuucagagagaaaaauuauaagccaaaucggacucugcuuugcccacccagaaucauaccccucaugggugggagcacagggcguuuucugccuccugcuuacccuacacggagcaggucuggagaguuacacgugaaggcacacaucuaaauguggccuuaucuagggagaaauuuuuguagucucuaaaguacugaaaggaauacaaacagucccugauuuaugaugguucaucuuacaauuuuuugacuuuaggaugguccaaaagcaauacguauucaacagaaaccguacccauacagccuuucacuuucaguacaguauucaauaaauuccauaagaucuucaacaccuuauaaaauaggcuuuguguuagaugguuuuacccaacuauaggcuaauguaaguguccugugcauguuuaagggaggcuaugcuaagcugugauguuugguagguuaggugucucagauggauuuccagcuuacaauguuuucaacuuagggugcguugauugggacauagccccaucgaaagucaaggagcaucuguauuugaugucaacuugccguaucaacuuguuguggcuuuaaaaccauuaagccauuauaguaccauuaaauuuuuuuuccaacuauaaaacaguuuuagauugggagccauucagagccucacuaugauuugccacgagguuccuuggagucuguuuucuuuccuguguauugauagucugaccauauauuucuguuucaacuauugcuauuggcaagccccuguuccuuuuuuuuauugugucaaauuguccgugugguuucauucaugaagacauaugcugucauguggaagcauaaauugcauaauuuaaauugucccuggaauccuuugugaaaaaguggagacagccagccauuaccccggguaagaguccuucacacagauuccugucaaaaacuagaauagaagaaaacccugaugccaugcugggguggcgggaggaggugggggagugugagugaguagggaguguuuguucugucuuguuuuuaacuuucuuuguaauuaguugacuuuguguguuagguguacauaaacuuacccauuucugugauaguauuagccccugucuuccaguuggaucaaacuuuuuccuguaaucaucucaggaaagcauguuguguuucccuuccuaguuagcguggcuguuguuuuguuuguaccugguugcaucuugaguuagaugcuugaugaggaauaucauagaaaggacuccacacucaguuuuaaauacccuuagcaacuuacagagaaaauucaggcugggaggaguucaaccuggaggucacacuagacaugugacugucauaaauuaaaaaauuaaaaccaccuuagaauaagaaaugaauagcuauagggccaaauugugaaacacauuaaaaaauccuuucauaagaaugaaguaggucauuucuaaaugaguuuuccaccuuuuaaaaguacguacccaauuaaauauuuuguguuccuaggaaaagaaaauagccaggcuuuucuuauugguaucuaaguacucaaaaaccaauauagcuuguagcaaaugauuccuacccccaggcccacauuauuauuuuuggcuuucauagucugaaaucauaagcuuuuguuuuguguaauguggauuggaucacauaaagaagguggguauagccuuuauccuucagugauauguauagaauaugcccaaguggggaaacuugacaccagaacacauguuuuuaguuccuuagguacaaagcaaagaagcacaccuguccuuaagacugaaucuaugucaugaccaucuaaaugaugauagagagcuuuccuccaaauacagcuggcuauuccccagggucuuagccuaaugauuccuacucuuugcuauugauauuugcaugguucaagagcuggucugcuuuuaguuaugcacucaacaaauauugagugcccauaauauguacagcacgaugcuagugcuuauggagacaaaauacucccuaaaccccuuaucaugugguugcgagaacagguuacacacauuggaacccaauaagagauacuguacaauuggggugauucgguggcacaggcagaaggugccgcagaugcugaggagagugucacaguggacuuuggucugugccaucaaagaagggacaaaauguggauaagaaaggauggcauuuuggaaguuacacaugaagguccaauguuacuucaagcaucuaucuucaauguguguuuauuuugcauguauuuauguuucaggcauagauuaggccacucuugcuaggagauacacaucuucauccuagaauguuuacuaaauugccuuuuucucuagaguugacaucuacuucauuaagauuauuuuucauucagcauuuauggaauauucaucaaguguuauugauaugccaguauaccuagugacaagaauauuuugggggcacuaguaaauacucaugagccaccuuuuacauaauaagccaccuuuucaaguuuuuacuccaaaaaguauguguccauuuuucuucauacugucuuaagugucuacauuuuuuuuuccugauaauuguaaaccuguuacaaauaacaacauagcuaaccagcuuuugaccuauauugauuuaggagggaaugagaaaagacuugaauacuacagugauggaggccaccugaccccauauuuuuuaaaaaaugaaugagaaaugugaugcuaguggaaaaguuuuuaaugccucuaucauaauuucaauaacuuuaugcucuuuauuuuaaaaauaaucuuggagauaaagauaugacauguuuucauacuaaagaccuaaucaacaaugcaaacaaauaauacugugaauacagguuucccagaauuaaaaagugauguuuacagcuaucuugguagugaaaaauaaaagacuugacuggaaggacccagcccucccauaucuaacacaaaauuugccaagacuuaaaaaugugcuacaacuuacagagagccucuuuccugucuccaucacuacccucguggcaacauccucuucuuuuccuucccuccccucugccuuccucuuuucuguacccccuuccacugagcauucacacacaacaugauauaggaauuguuuuucuuguuaaaugaaaccacuauacagauuccuauuauuuugcagaacaucugguuugcaaaugaaaagaucucaggggcacaacagcacuagugaacaauucugaagaagcuuuuaacaaaacuugaaauugcuuauccaaaaaaaaaaaucaucccccguugcugcuguucuguagcacacaaucucuucacucacaggggaggugacuuuaacaaggaagagagcuuuauccugucucuccuauuuuggccuuuuaguuuucauucuguuccuauccacuucucccaucccuaagacaggggaguuugauuaaaacauaacauagauggaaagaaaauuagccaggaaaccaggagaaaauaaauuccagaguuuaauuuuccagcaguuauuuuuguuuucgaucgaguucaaauaacaugaaagagaagaaaaaaaaaaaacccaccauauauuuaauauauauuggccagcacagcacaacuaugaaaauaaaauugucaggggaauuccuugccugcccuagugucuagauuuaaagcaccuccauaacacaaacugaaggggaauucaauuaagaaaacccauuggcuucuuauugacuuuaguuaagaaaauaaacugggagaaaguguauuaaaauaugucuaacugcuuaguaugcuuucauuuaggcuuaugacaaucaaaaaugagagaauuuaaauuuuuuacaauuaagcucugguuuugaguagauuguggguuaucacaccgugcauuuuuuuaauguacaccuuacucaaacacacccuaaaaugcaggcuugcagucugcgcauuguaaagcaggagcaccgcagaucaauugggggaaaaaauauuuaagguuguaaauuuaauuuuguucuaggauuuucauuuucauuuauggcacccguuguguuugagaacauggaccaauuuauggauuaguuuuaaacccccagucugucacacucaaugaacaauucuaaguuggagagaauccauaugaaaggauuagaaugugccacaguggagcuuacacaugacuguuucaacuaaauauugcccagcugccucuccugcaguauuauuuuuuuuuuuugcuacuuaguuaaauugcuagugucucuaauuucacacauugucagagcuuuuuuuauuuuguaaauauacugccacaauaaauguaugugauguuucauuuauucaagauggggucugauaaacuguaggacuaggagacuaagaagagaagucaauuuugaguagaaugugcaucuuucaaauaauauugcugggcccuucuuuggauaccuuguuugacuguacucauaaaauagccagagagugacuguuaagaccguacacacuuaauggguuuucaagaagaugggauuguuuuuucuuggccauauaauauaaauguauaauaaauuugcucucuuuguaauuaaaauuaagagacaguagcucagcuaggccuuuuaaaugucuauauaacccaacaccaccauaaguccagcucaauuuuuugugaccuguuuuucucaugggcuagcucaaagauuuuuuuuuuuuaaggcagcagcaagaugagguuuuaaaaaggcuuuguuagggcaauuagacauuuucauuuuucaagcugauuauagcauuuaucacuuacauugaaauuuaguauuugcauuuugccucuacgcuuagaauguuacccaacaauauggucaccacacaaguugauucacaggguguguuugcacauuucuccaguuuucugauuaagauacccuaauaaauccugccucacagaguugcacucacuucagagccagggugucugugguuucugcaugaagucauaacgcaauuaugaaggagaauuagauucugucaucguggucuccugcagggagcacaaaguuacuucuaaagaauguuuucuuaauucuuuacuugaaaauaaccucuguucaaguagcauaccagaugcucuuagagaaauggagucagugacuccccagacacaccaucaaucuugcucugaacuuuguagccagccuguguuucuccugcagucuccuaccccguugcugcuccggguuuugccauuuccagcugcaguaaucgugugugugacuugaacauguguuugcuguuaaccauuuuagaauguguuuuuucuucucaacaucccccuuuccuccccuuuugggugcaguugauggauuucccauccccagaacggggaagcaagaugcacuguggauuuuccuucauuuauuuucuaguacucaccuaggagcagacgccuagcuucacuugguuuaauuucaucuuaaagcugacaugauguugugauguaggaagacaguaaauuggggucacugguuaaugcugauauuauuuuugaugacucuaacccuuaggucuuacuccaccccccgcccuucuaucauuuguacuuaaguauuuaccuggugaaaauaaagcuuaugccgggcacggugccucacgccuguaaucccagcacuuugggaggccaaggcaguggaucaccugaggucuggaguuugagaccagccugaccaacauggggaagccccgucuccacuaaaaauacaaaauuagccaggcgugguggcacaugccaguaaucccagcuacucgggaggcugaggcaggagaaucgcuugaaugcaggaaccagagguugcggugagccaagaucacgccguugcucuccagccugggcaacaagagcgaaacuccaucucaaaaaaaaaagaaaagaaaagaaagcacauuagaagagcuacuacaaaaauaaugagccagaguguugauugcuuuuuuguaauuuuggaaaggagccgaugccuaucuauaaaauguauuaacaugcauauaaauguuucuguacaaaugggcauuugauccugccccucaaauuuaaaguaccuaaugcugcacuuggauguuucaacuaaggaaaugugucaucugugucaggagaaucugugacagaguguguuucaacuguacaguuuauuguuuuuuacugcuauuuuaugcacacagacuugacuuguaaguauuuuguucuuaugcgguauauuguauguuucucuuuccuucaucuauucaucagaaacuaagcuaucaguaauauuaagcugcauuggccuuucagacuucugguuaauucuggcuccuuagaagggaucuaauuuuugaugguauaggauccucuggaaagcaugccaacugaaggggaaugccggugugaauucaugugucacauuuauacaucagaagcaccaggcucauuugccccccaaaaaagcuucauaugaaguuccagugcauuuaaacauugccuguguugaaucagaaagucuuuuggcgucuccacagcucaugaaagcaauugccagcuaaauagcugcauucuacaaaaggacagugaacugcuugcuugcaguuuaacccagaaucuuacuucaaccaccaccauuugacuagagauaacuaacuccugucucaguuucaccauuucuuuuugccagcaaugagucguagaaggaaugugccugggaaguuuagaacucaaaaugaaaguauggccagauggguugacauuggaaugagguugacuagaagaguggugauaaaaugacucuggaaaaagaaugucacccugcauuuuguuagauauuuauuccacuuccccuguagccaaaaauaaagagaaaauuccuugagcuccuuggaggaauuucuugugaacaggagcaaguacagcaagcuuggcuuagaagccugguagaagaaggagaaaacuugaacagcaucagaaauagaagaagaaaaagacaaaauacauuuccuuccacagcaaguucaucuagcaauggaaaaagaaaaaaacaaaaacaaaaaacugcacucucuccuacuccagccaugaaagcaggacucccagccccucagaauggugaacgugguucugaauugugagcgaaaggauggcuggauacuuaaauuuuuggaaugucauaugauuagaagcagcguuuggcagauugugugaacuuggguguuuucauuaaaggcuucugcucuuggauuuuaacaugaagagcuuuagagugaagaauggauguguguguuuguguguguguguguauagaaacuaaucugugaaaaccuugaacauguucauugccauggccucccaguuaauugaacuuucuggcuaaacuaugcugaaauaauacacuggauggaaaacuuaaaccugucuauucaucuacaggcaucugagcauaagcaguaaaaggauccuaaaagugugauugagucagugaugccuaauuggcagucaagaagcccaagugcccggguggguuggguuaaaacaaaggcaauguuugaauguuaugaauccauuguuuaaccagccuuucgacugagcuuuucugucgcaguccugagccuugaugcuuuaagagccaucuaccagccacugaguuugcacugguguuucucaucacuuugcauguccaccugacuauugacuagcaaauauauguguccuggcaagacccccagaaccaaagaauuuacuguuuuccucacuggcucgcagcuuugagcucaaggcaugucuuaaaacagugcaacucacuucaaaugcuuuuugcuuuucauuuauuauugcuugucacgcgauguucuuugaaagcuugcucauauauuaucuguuccauuuuuuuuccauuuucccuuuuuuugcaugccguuccuccuguuucuucccuuccuccaauccucuguucccgucuguagacacaacggcgacgacagaaccagcaguucacgguugguaucacauuacuguuuaucuacuuucucagcacugcugagaggcaaggcaagccugggaaaaagagaaauguagucuucaagggaaaucauguuucaaguagacugaccucauaaauauacuauaauuuuuuaagguuugaaaagaugucgagucuugucauuucuguugugaguucaguacccaauggaugcaagcugagaugagaccuucuccccacuggguggcuggaauuguaggaguuucaguggcacagaguccuccuuacaaaacuccaccaaaccuugaaauacauggggcuucaaacaaacgaguauucgcaggaaaauuguaacaucugaauuaaaggcccaguugcuuuguuuauauauaggccauagucccagguaaaucuugaagaggagucauuugugucacuuaguaaaguugagauggaaggguagaccagggaagaagauuccuguuuaaaaucgugagcuucugaugaggaaggucauuguucuucuuuagaaaggucaugacuuuaauuauguugcuaaucauauguaccccaccaccccucacugguucacuccuaaucucuauguguucauauaacuuuaugcucacauuuggcagaaaacuccuccaaaccaagaaugauaccaugugucaauuuuaucagcauuaacugggacuuuaaauaaguuacugguguguguguggcuugcagguaaaauaguaauacguuuuuaaccacaaagugauaaaaacugggugagucaaagcucaggaggggcaucaggaaauaugaucucuuuuuccccaucucaccaaugacuuacuggauuggaauaagucuauuaacuuuucuaugucucuccaaucagaaaaugagaaucauguuucaucuguauauuacuuuauuacuuagcucaaaucuagcccugacaagacugcuuagaaaagauauguuuaaaacugggcugaauuuuaauaauugaauccaagggaauuauuugguaaagggccuacuuuaaucgcuuugccuguuguuguacaggguggaaaucuaucauuuaaaugacaagaggugaucagccaacccugccauguuaauucaacuuuuagagaaacauuuccuggcacagacugacucacuuagagaccuacauuugauaacucaccaguuggaaaaucucugagcucuguaggagcuguccuugaaggucaggccuugaugcuuggcaggucaccccaucuuuugacuuuccuaugacgaauucugagaaagcaaaacgaacuuggguacugagcaauauauccuuccccaccccauuccuauuucuuucugcccuuucuggucauuggugcaaagggaaaaguucauaaaauaacuuaaaggggcuaggugugcugacagucaugagaaaucaauuagguauaaaacuuccacuuucuaagguaaugccccauagugcuugcuacaucucaggcauugcaguccauuaagcucaguuauuuguagauuucaucauuaauugagcaccuccugacuuuuaucuauuauucucaaaggguuauuuuaauguaguuagagagauuuuauucuauucuuuuuaagauacuuaaguuucuuuuuaagauacuuuaaguuuugagcuuacuguaauuaacuacaagguaaaaugcaagcucauccaacccauagccuaugggcuaccugcggcccaggacggcuuugaaugcggcccaacacaaauucauaaacuuucuuaaaacagugugagauuguuuugugauuuuuuuuuuuuuuuuuuuuuuuuuaguucaucagcuaucauuguuaguguauuuaauguguggcccaagacaauucuucuuccaaugugguccagggaagcuaaaagauuggacaccccugauauaauguaaccauacaauuccuaaauucugugagauccuugaagaaauauugaccauuugucuccuaaagcuccagaauucuauuuucuaggucccuucaauaaaauucauguucuuagugugacucuaguggauguaggucucagaguuggauaggcuauucgaaguaggaaauuuguccccuaaucugaaaaauaagaaguuaacuuacaggcugauccugauuuuagaguacuaguuuuaaucgggucuuucccuggagagagagaaagagaaggugaucucuuuuugugguauaaggaagagacacuuggaaugggacuuuauagcauuucuguggcagguaauagagguguuuguguacugugagaagcaacugccuuccuauuaguuuggagacgauguucaaguuggugaaaccucaguaggauguuauugacuagcagugcaugaagaauacaccuagagccaagggauuuauuguauuuuguauauauauacuuggaauuugacuucuuaauggcagagggauagaaaagugauagauaaucuaggcugaucccuguauaauacacuuauaaauacauucuuuaccuuguccaaaauccucguagcaucuucacaaagggcuccagccacuguuuuaaagagcauacucuuuaacccacagcaaagaagcuguaaugaaagccagauaauaucuaaaauuuugcuugaugucggggaaaaacuuccaggucaguugucaggauagaaaagguaauagaacgugguggaaauuacaaagcaacaucugagauuuccaaagagaugaugauacagaacugauuuuauucuaaugaauuguagcugaaaacccaacuucuucauuacagcaaccauuugacuuagauucauuugagaauaaucucgagauguuuguuguggugaucugggccuagaaauguugaaagguuugauaacuuagcaacuuaaaugacaagacauuaagucaaucagcuaugggcaucuuauuuggucuuaaaaguuuucauacuggauuuccuucuauauuucuguguuuuuauaaaaaggaaaagaaaaaauaaaaauuuuuaaagcuuucccuuugaagacucauuaaaauauuuuauucaagcuuguuuugcuagaguauguaugaaguuuauaccaguuguuuauguauguugaccauuuguucuuaccaauaucugauuggaauaagcauguauuggaagguuagaagugcaugggcaugauucaaaaucaaguggauuuucuccaaaaagaaagccaaacaacaaucagccacaaugugcuuuuaaggauuuaacugauaguaaagauaaaugugaguguuaagaaugggauuuuuagacuaggcugacacaagggaucuucuuugaauaaggaucuugagcauuuguguuuuuggagcucauccuuaaggccuggacaggaagaauccuguguuaugugugcauguugagcaaugcaaaaaacacucugccaaauccugauaccacauggucugagaaaugcaugagugauuuaacgcacggaugguguagucauuauguucuugaugugugggugcgugugaugguuuucguuuguucauaugugggcgcuucugugucuugugccuuguuccuucugcccuguguguccccucuccccuuccccacccuccuccccaaugugaggggucgggugacagcaugcccauggucuggaauagugcuugugcuuuugcugcacugcagucagcuggcuuccucuggguuugaggucucucugucuccgucucucucucuuucucucugugccccuucucuccccucuccauuuuauuauuuucaagucuaccuguccucuugcuuuuucaccucuuaauacaguagaggcugaugaucucaugaauuuucauauccccaaugaguuuuuaaauuguucuuaauucaguaugcaauugugguaagacgcaaacuggaaaccccucugaagaauaauuucucauuuucaguuuugguuucagaauguuuggccugugcuagcuacaugcucguacccuacgagcacagcccuuagaaaacugccccuguagcucuuccuuuuccugacucguuuauaaauaaugcaaaccauggucaaauucuaaaagcacguacaauuuucuuauuauacuuuauauucaguuguggggaaauucuuaagcccauuuuaaagaaacauagccagcagugcgcauuacuacaaccgcuauguccaccaucuguguaugugccucuauguacaucucucuguaugagcacauaacaauggcauucaaaggcugucauucagucacgggacucugcagacauuguacguucuacacaagagcaaagcucaagagguuuacgaauggcugcaggaccugaagauuguguuucagccuugauaugcaguuuggaaacaaugugcuacugucuaacggcgugaaccaaauuucugcuaaugggaagaagggaaaacucuccacaaaagcugacaaagcaggaagaacaggaugacugaguuuuuagauuaaaacucccgggggcgucugaacucauggcuggugguggaaguaagaguuuccauaauauggccaagugaucagauguaugcugcuuagguaagagagagaccaucgccuacuuuguuuuucauaaugggaaugguacuagggccggugggcuaaguuuuuguuuucuggagguuuuauucgaucauucuauuucaaaauuuucuggaaaaaaaaaaugauacccugaaaaacugagcccauaagcauuuaaaucguauuugaccuugaauugauuuaauaucucuagaauuucuuacuguuucuaauuuuuugagguuuuucuuacccugguuuuaaauggccacauuguaucacuuuuagaagccagcaauuacuguugaaaaggaagaaucacaacggcaaaagcauuaccugagcgggcuuaggguauguuauagcacauuguagcaccaugaaaaaguuaaauacucaucucugcagaagagauggcuaucaugcauauauuaaauuaccauguuugcaucuuuaggacuuuauuaauugcucaaaaauaaucccauauggacaaaaaguaaacuuucauuuguuuaacaaaguuuaaagacauauguugaauacauuuuaauuagcagugacuagaaagaggccuuaauggaugauaugaaaguuucaagagaauacacaagaaguaauuucccacuuauuguuagagugaagucuccuuuugaagaauguucucugcuucauaaaauacgucuuugucuuuuucuuugagaaaaugaaaaguguauaauuuuuaacaugaaagaaaaauaccuaagccaaaucaguuuuaggagauaaauuuugcucguccccacuugcacacccagugcuucaguaaauucuuuugaauuauauuuauucagaaauuguccaacuauggcagaguauuguagguucacacaauauaauagugcuacaaaaacaaauuuaaugccaguagccuaaauggcuuccugcuuuagaacguaauccgagcaguagauuccagauaacuugauauauuuuaaaguuuaugccauuaaaaaugacaguuuccacuuuaaugagguguauaucaacugucuguugcuuuuaauggaaaccuuugcauaucaaugauauuucauaaacauauuugucuuuuuggguuuuuuaauuagcuuucuaaugcccuccccgaggaaauaagccuucagcaguaaagcuaccuacuugaaacauccuuguuuaaugugguucagugggcaccaagcacauauguaggacgcuuugauauuuguugggccagguagaagugagagauuagccuucugagaacugcaaauuuauaauuaacuacaaaggaguacuuuauguugccuauuuauaacaguuauuuaaauaauuguauucaucagucuuuauacaauguauaagccaauuagaaauaggaauauugucaaccaaucagauuucagaacaaauggauaucaucucuacucaguugccucuauaauugauugcauugcucacugcuuucccuuuaguugccuaaaucuauaguuugggaauaccugugggcucaaaaucuucccauuuuuaaucagcaccugcuguuaacuauuagcacccaagggucaugauggaaguucuucuuccucaaggguugauggugugacagccgucuuucacagaauugaccuggcuaucaauguucguuugguuucucuauaaagcaacuuacaaaaugcaggcuucagugaucauuugcacaugacuguugugguucauuugggccuuuaaaaauagugaucaguuugacauuacuuguuucaaaagcauuuguuuugguugcuuuuaugcucugauugggcauuauucccaaauuauuaauucaacaaauacucacugagaauacacuuuguggguuggcuguagcagaagggaaagaugcaaaaauaaacacaacuugcuucuccaaagaccuugcaguuuauuaggucuacagacaucuucaaaagggacaaaucugacuagagaaguaugagcaaacugcugugcaacuuaaaagaccuaagcaguuagucacacuggacuuugagcagaacagcaaagaacaaguaaagccacauugaaugucuaacauuuuguguuauuaaauaaacuucauuaaaggaucagcucacaaauaaagcaaaaggaaauggaaaccaucuccuaucugagccucccauuguuuaucuacuucccucuucaccccuuuuaauucaaaucagagcuagcugagaagcaucucagcuggccagcauuggaauugacucggauauaggcauuucaagccccgauuugauuaccuccugaccuaacugcuuuuucagcuuugaggguuuuauuuuucaggaauaccauugauuuaugaaauucucuuuuuuaaaaaaaucauuuugcgaaucagauuuucugaugaaggcauaaccugcaaucugcaguuagcagaugcuguaccauuuugaaauaugugauccaagaucaucauaaauugauaaugaacuguguuugucaguauuggcagcggauuucaauuuacaguaaaaugcgaaauaaaauguacauacaucaguauguaacaucuaaauacauuuuuauuuaagagauaucagagcaucgacagcuaacaaucaggcuuuauugauuuucuuuuugcaugcuguuacgaaugagugauuuuaagcauucaccuucauguuucauguccuuugaacaguggagacugaggaaucuuucugccucgauugcguauuaagaacaaaauuacauaauugaagaaauguacuuauggauuaauacauucaugcuaucaaaaacauagauagcaagagauuuggcucauguuuuuaaagaaauucauccucaguucuuaaguguuuuguuuaugucccucgaggaaugaaaagaaaaacgauuuguuuuuacuuguaaggccuuacucaguugcccaauuccgcagaagaacuggacagugaggaccucucagguaagggcuagucauuagguaaggcacugcaguguccaaccugugggugcucuauccacuucuacaaaauggccauuugguuugcugagcaaucaguguggauuuugagacuaacaaaaaacaaauuuguaucaauacugucuuccuccccggucacccacucaccuguuuucucugugguagcgauauuuauauuucggaauggggacaauuuaauuaacgcaggagaggacaaguuaccuuugggauuguacuaaagccccucuguucaguggcuucaaauaauguuuauguccuagauauauaaugugucgggagaaauuuuguuguauuacaaagcaauuuaaggauguuggauuaugugacaagaucuuuuuuaaaaaaaaaaacaagcaacucauugacugccuacuucuguggaggggacuagaauagccauguuguaguuaucuuagaagucagggguggggaagggcagggaggagggggaagcaauuguuuugucacacaccaugauguaaacuaauuauccaccucagaccucuuucacagcacacugagcucuugcaaaaguagguuucaugcuugauuccaggauuuagguguuacuaauccagaauaagaagcauauccuacaaaggagggagggaggagauuuaaaguggucagagcuaaacaauuauaugagcuuccaugauguugugggacuuaacugccaaccagcuauggcuuaaaccuuuccauccaucacuuaauaagucaguaagcaaggcccuucuuguuauugcaguggagaaauuaagucauaggacuguagacacuuacucaagccuauuggaaagaaagauuccagaggcgcuuuuacugaagcuccuuuuaauaguuggcuauugaggugcaguccuuaacuauaagucugacccggugagagaauaagauaguacuacucgauuuuucaaagugcaauugauuuauugccaacuacgugcuucugacgaaccucagggauaucuucacuuugcuguuauguagccuguaguuugaguuuagcugucggauuuauuuuucuacagacuggaagcuccaggaggccaugcugguuuuguucacuguuguacaccugucauguacuaaguacccaguugacacuuauuggaugaaugaaugaauuuccaaaucccaaugcauagauaaauaaauagauuagaaagauagacagccaaucaagagaguguuucauuuuuugccacuucuuugugguguaguuggagaaguugcaaaaacauuuaccuaguuuuauuuuaaaauaaggguggauaaguccucccuacguaaaaugugaugcuggaaguaagcaauuucugcuugcauuucugguaauagacagucucaguucugguugaccguaaagaaaacaacucucuuugauacaguagcccuggcaauuggaucuucucaaagauccuaagaaagcugguggguguguuggcccugaucccucuuggcacaauagccagacaaggaucacucagauaugcaaaagucauuuuucuccucuuuaggaaaaugugacugaaucagccauccaccccuuccaccagcaucaucaauuaggaauacucugggccucagcacugcgccaugucagaugggucccugcugcaguucuaucaaucacccaagucagaagcaauaaaccaacaacuguuuguguucauaauaauucaguuaaauuaauaauuauguugucccccucccccacucccugcaggaacacugcagucauauauugcucaggagccguaagucauguagaacacugaugaacuaucaggcugggccgggcugccuuugcaucugguuugaugaacuaaucaaaaacugauuagcaccuuuguucgaaggggaugcugauuaaucaauuacuauugauugugagcuuggcuucacucagcagcaaagagacaucugaagggaaaaaaaaaacaaccaauaaaaauugagcagcugucauaguguuuaaauuuauuaaaacaaaauacauuauuuuuaugaagcugucuugaaaugggucacugaaggggagcauauugauugagaaaggaugaacuucucaaauuucuguagccuagagacugaauucaauuauaauacaagacaaaccgguuaacacccgucuuaaacaguccaucaauaaauuagaguagguguugcacauuuaaugcuaaacugugguaaugaauaauaucauccauucccugcugcaucaggguagaaauuuccuccuuuccauauuauggauaaauguuacguacucaauuuccuuccaaauaaugauggucuauuuuccuuuuguccccuuugccccgaccucccccacgcaccagugcuaccuucauuaaugacaguuucauaagcaacauauggugcuccauucucacccagcaaagcaaguugcccagcugauccuccucuuuaaucugcauaaagaaauuaugcucguauguaguucagugauuuaauuauuggcaggccuggggagcuuacccaguucuacuuugaacccuuucauuuacuuuuuggguguuaacuuuauugaugauggauccauaagaguuuugaauuguuuugucaauuacaucugcucuuuccuggugacagcuggugguuauugccacucauguggaauagaauagcuuuaagcauauuuauccuucuauuuuauuuuaaaacuuuuucaaaaugucuccaacugccucucucccuucagcaguggaggggccuuggggaacuguuuaguggagugaggugguaaauauacagugugccagaaaauggcccuccagcacaguucaagaaauccaucagucuucugauuuggaagcaaaggcaccaaaaagaaauuccagagcugucaugauuccucaaaacauguuaucagcucuuguccuacagacaagaaagugaucuggaaaacuccuacaacaugucccucacgauccaaaaaagaaagcaugggccucggagggcaauucuaaauggcuuugcuaacccucaucuagguguuaggaagaaucuaggugaaccaacugcaguccccuaaauggauuauacaagaaacacggcuucaaaauauagccuauauuuagcugggcgcgauggcucacaccuguaaucccagcacuuugggacgcugagacggguggaucacuugaggucaggaauucgagaccagccuggccaacauggcaaaaccccaucucuacuaaaaacacaaaaauuagccaggcgugguggcaugcaccuauagucccagcuacuugggggcgggggagcagggguugacugaggagaauugcuugaacgaggagguggagguugcaguaagccgagaugacgccgcuguacuccagccugggcaacagaaagagacuccaucucaaaaaauaaauaaaauaacaaaccuacauuuagcuaauaggagcacuuaaagcucuuuugaucuagauuaucagucccggagguggggauauauggccuuccgguuacugggagugucuuaaguccuggcuaaacuuacuugaaaugugugugagaaacugucaguagcuguaccauuuagggggaacucuuuccuaacccccacauaaagaguggcccagauuuggcaaacaggcuauuuuauucccuugguagaguaauaacaacaauaaugauaauaaaacauuaaaaaccagaugagcuguauagauauauuuaaguuauagcccauaaaucuaaaguguggcaugauauggcuuguaucuguaucauacuuuguaacuuagaaagcucuuucacacauauuacuucguuugaucuuuauucauucaacaaaauuauuugagauccuugugcugggcucugggcugggcaccagggaugcugcagugaacaagaccaacaggagcuggagcugccauggcguccaggagccagggccccugcucuccuaccgcgacacccuacugagggagacagacccaaaacacgaguuaaucuuggacagugacaaaugcugugaaacaauaaaaccggauaaaguggaagugagggcuggggcuggaagaagguggaggucaguuuagaaaaguuuaccagggaaggccauugggacaggaagacccagauagaugagaaugagccagauaauagaagauuuucaugaaaaucuccugagauuguuaaggaagggcucuuggucuccauuuauaaaugaggaaacugggacccaaacggcuaaacgguuugcuuaggagacagugagaagcgaagcaugggucuuccuggcucuagaggaaauagaggacuuugguuugcaggggccaccuuucccccuaugaaauccacagcuuccugugugcuggagccuuugguaauccucuugacccuuuucaauucacugugcgcacccggggaaugagggaaaagucaggcucucugcagcccaucaggcauagagcaaugugcugacuaaccugggaagauuuuuuuucccagcaucaaaucaagcucuuucuccucaaagaagaccuaaacucugcuucaguaguuuaguacuguugucccacugauuccccuaaauuaugggaucaguuuccccugggaggugacccuaagugccaugggaaagugauggcuggaaaagguuaaaccacaucaauucccuuuuaaaacugaguuucauacaaggcaguagacugaagaaaucacauuggguccaugccagcucacccacgacuuccccacgauguguuugaacugcauccugcugcuggucuuucucauaauccaacaugcuccuguuuccaccgugggaagggaggagaccaucaaacgggaacuuuucuuccaaaguuaaaaaguuggcaggccacggugagugugaauucuaguucuacagguuggacacugcuuuggggugacuucaccauauucauuaauccauccuccucacacccccaaaugccugagguccacugaagcaucuuucuccagagagagauucuagugggaaauguauguuuggaaauacucgacaacuguccuguuuaucaggcguauauuccuuuaagggaaacucuggugucauccucagugccuuccuguugcuuaaaauggaaaagaugaucacauuucuaaaucugugcuaucaugagaugaacagaguggacucaagcacgacuucuggugucucuggcgguguuaaaugccuugggagaaaucuugcauccuguuggaucaagucauuuccacucaugguuaaauuaacuaaaucaaggaauuugagaggggaaaaaaucaacaagaaaaaacccaaaacacuuguuuucauauuuagcuacaauaguauuuaauauccugauacucaaaugguacacccgaaucgaaaccugaaucagacggccuucaccugccaggcccacagccuugaccuucauaaaggacagcuaagccauuaguuacacaguuugucaauucuguauaaaugaaaagaacuuggugacuucaacucaguaaguguuuauugggcaucuuaccaugugugggcaaugcugaguaugcaguaccacgcuuaccccuaacgaacugguaauuauuugccuugggucggugauaagaacuggaaaagcccuccuuaggcucuaauacaggagauuugaauuuggcaaacaccaggucccuaugauacuccaagcccugagccaaauaggcacuuucauuuggcucaggaaaugaaaacaguggccucucaaagugacccugugaaguacguaauuguacucaguggcucagagugccucauugaccugccugaagucacagagaaaaguaaugaagcucaaguucugucccagaaaugacagcaaguccagugcucuuuccaauggaccaugcaggagaugagcuccuagcucguccccuguucaggccuguuucuggaaagcaauguagccagugauagucuaagagagcccugaguccugaucauuugaguagugacaagguacagccaaaaucugugugcaguacuucuaauuuaaaugaacacauacugagcucuggguggcaccaugaggaugaucacugcaguuuuccuuuaaguagcuuaacauagcuccuuugaaacguuaguauagaugcaguuacauugcuagaauugaaugcagcugacguguaguaguagaugccugggaugcuauaugggagucuucaugauuuucuugcuuuacguuuauuccuucucguccacuuucuaagaagacagaaaagaaagguuaugcugcauaaaggcuagugugcuccaauauauauuaacaucuuaaugggaaagcugugcauguacuguauacauuuacuacucucugacaagagggaauuaaaugucagaaggauuuguagcaucuauaauugaauuggugcugagaaaagcaaaucuuaaagaagaauaacauauuaggauuagcaaauaauguggcauuuugucagcgcaugccauucaguuuguuccccuucaguaauaaaguugugcuuuuuaaaaugcacacuuauuuuuguugccauggacgggagcuacaauagaugaugagaauggguagcuacauuuuucagauggugccagguuuucuuaagugucauuuuuuuuuuaggucagauuaugguuuugcuucagauuugggaaauccacuaccaggcuuuuucuuucuuccuagcaagaaguaacaaaugacaucauagucacuaagcuuucucugaaauagacuaaucccuacaacccuaggaagcuggaggcagcauuuccauuacaaacaccgauucugagaguuuguaauuaaacugacuuguccagcaagaucuccacccaggaaaggaacuaaaacugagccacgugacagaacuguugcaaaaaaguccgcaacaauucuuuuccuccagucauccacggaugggggaagcacagaacgcugagcaucugaacugucccuaaacagaaguaggaagacuaauaccguuagaaccuccccauggcuuaaacguaaaaaugagagcugagguaguuuaugaccuaugaaaagaguuaaagugugcguuuaagcgccauguugcuaaaugugccuuacagccugagccagggauguuugagaugugagggugacccagugcaauguggcugucaugccucaugcugcauacuuuauuguguaucauugugucacccuucacuccuucucagagguagaaaucuugguguccuuuuggcaaaaagacugaccuuggacucuguguagccgagggcuucagggugggcaggcagcaguugcagugaagguucugcucagugaguccuucugccaaagucccuauuugccaggagcuugucuaggauguacuagccacucuccaguuauccauggauccccacuuuggcagcagagccuucuaggcuuaucacagauccaugauuauggcauuugcauggcgguuuaugcuacacaucucaugccaggugguaaaguagccauagaaaccaggaucucuugcagagcccuguuuaauacaggcagcauggcugccagagugcugcguuuaagacgacucuggcaaggaguuugaggaaugaaaacaaguagagaaagaaaagucuccuagaaggaggggaaaggagacugaaguuccacuagcagucaccuuucuugucacgcccuggggaacuacugccuuuagaacuuccccuucuuauugcccaugaggaauggaucgggccaggucaacuggcccaagguaaagaaaucugagcaguuuggggcaucacucuugggaguuucuuugagauuucucugucccgcaauuucuaagaugcuaaagcgagcccaggguuguugaagcugugacccaagcaguaguggccaacuuaacauucugcaagcagcugguaaacucucaccuggagccaaguuguuucagcuuuuugccaaaagaaaagcuaacucacgaauacuaaacaccucaugauuuaucugucacacuuagagccauggaaguggcugcgggaugggacacgacaggcagggaggguuguaccacaacugugagcugucaggaacaccucccugcaacugcugccugcccgcccugaagcccucgacuacagaguccaaggucagucuuuuugccaaaaggacaccaagcuuucuaccucugaggaggagugaagggugacacagcgauacacaauaaccuuuacaggguucaucugcaagucagaaucauucaaggacuaggccuaauucaccugaggucacaugugaaauaauuuggaugagauucuuaacuccaguugaacuguguuaugcaaucaugcuugguucacugaggcuggaauaaccuuuaugcuggaaccauucaccaagcaaaaacauggcuuuacuuuucaggaugauggggcagggcuuagucccagaaaagaaacacucuuacacuuguuacuaguaagaggaacacuuguagccucuuagggaacaagaaaacauggcuuucuaaaccgaagugauguccauaugccugagcaucaggcauguuuaaaagugcuuuccacucccacauuuauuuuucaauugacaagcuaggggcagcuguagaaucugccucugguuucguugccugcccgauucagaaaaugagccgggaaucugaagagaauguccccaggaaagccagcacuucaugggaccugaagaaggggucugcacccugcaggaccaggaucuguggcucauggggaaacccauagcuuucccacuuagaagucauuucucauggaauugguuagaguccuugccuugggaauggaaggaaaggucaagcagcugacagacuuugucgcagccaugcuucucuuagugcucgguauuuccuuccauuucugguuuucgugcgacuccaguagcccaguuccccccugggcagcaucuugcacggcugcuucaugucaugagugaggcacagcccgcaggugcaggcagcucaccccggcccugcugccuugagccaauccauggcauuauaaacacucccccacccuccccacacguggaaauaaaagaacggacugagaugacuccagaaacagcucugcuuuucauagggaaggccaagacagaggcacucagugaacaggcacaacucuauuaacaccucccacguaaacccaggaggugggagugggggugggaagaggcggugaggcgcucguaaccggcaguguucccuguaaauuaaacaucaguuaccuucuguguccaucugcaguaauugaaggcaggagaaaugucuuggugauuaacuggugguaguaaacuuucugaucaaaguggguaucagaagauagcuggagagauuacccuuauaaauaaguaucuguaaaauauguauguccuugaggguggggaagauaacuagaacaucuaagguucuaguuuaauuugggcaaagugcagggaaaaauagcaacacugagcauauuuagcucaaaguucauggagggcaaaggucaaguaaggaguuucggcucaagaaauuaaucucacagauacauauaccucgugagaucuuuuuguuugagggagguuuuuguuuuucuuugucacagagccucucucugucucuccccuccccccuccccccucaggcuuccagaauauuccugugucuaggcauggagaggaggcggucuuuuauuaagaguggacaagauagugucuuccccuagauggguuagaacuguccuggacagcuucucgaagcuucucucuguucucagucuuccuggaaccucucuucaccucuugccucuugugccuaacuuuccccuguccucaaugucuagucucacuuguuuuccucccccaauuuuaaaacauacagaguucaucgaaagacacauaaauuuuaauaggucugaagcucauggccauuggagaugaguuaauucucauucccccaagauucccuauuuugacagcucccuaaggaaaacacaacuugcuggcuuuucuguuacuuuugucccccaugagcaauuuugcaucugugcaguuggacugaacaucuccagugugucaagcgcucuccuccagcagacaccccguguccagcagcaccccacggggaaugcuccccuucaacgagcuuugucgucucuaaaaaggaaaaaaaaaaaaaucccuugaccgaguucugccuuguugaaaugacuuucaagacaauggggguuguagcaucugcaguuggcaacacuuuuggcugaggagggagauuccucuccaccacuuuucaaguugagcuuauuagacacguugcuggaggggcucgcucagcucagagcgggcuaauuggcugcagugcacucugccuccaacccagcucccuucuccaauuaaacucccaucauccuguuguccugggcgaccugcugcugccucugauuuggcauuucuguuuggguuuugguuuugguuuuucuguaguccuuucaaagauaacuuaaugaaacacuuuaaauacuccauuuuaaaauuuaaacucuuuuaauuaaagcacuuuucauggaacccucagucacgaguuauuuccccacauccuucaguacuuaaucucggagcagaauuggaaauaucgauagaaaguguaaaucaugcccuccugcugaaagcguuguaucagguuucggcucaaaagagcaccauuaccuuuagcugucacggaucuguacacuugaucgauaaacuucaaauauuauuagagguagaggcuucagagauuugcucuguucuuuggagagagacagagauaaaucuuucuuaaaaauugacuugaauuugcacucucagucuuccuggugaaaugcauuucucuuaggcauccagcaacugcaagggggacagauuuauaggccaugugcuucuuguacugaaagauucaaaugguaaauccuucacauaugacuucacaaaucauguaaaguuaaaagauuuuuaccguuucuguugcugcugugcuuaaauuguaagguacagcuaguaaaucauuuuaauggaggugucguacuugacucaauaaaaaaaaaagacaaugguuuagcuuccacuccaaaauguuaauguauuaaucaacgggagaauaauuguuuuuuacuacauuauaaaucucaaaugccauuaggauuucagcaaggggugauguagccacauuccuaaauuaaaauuguuuacacugccauacauccauucugcaucaccauagcucauucuggguucauuuuggaguuguuccccagccaaacaugucguuccucagucagaagaagacauccugagggggugaugcuuauaaaggaaaauuaauugcauugcaagguguuaaauaaauaaaauaaaaaccguugguggcaauggacaauuauuccuugcugucucuuuugaaauagguuuuuagguuuuaaauugaggcuuacuccuucauacauccuaaauguagcaagccugucauuugucuuuagucuuauaauccuuguuuuaucucuaggcaacuguggcuuuugagcaccuuacuucuccuaugcauaucccuaaucuaccagauaauaaaagucauugggcgucuauagaaagaugcuguacccuucuguugccuaaaggugucauucagagcacccucaaauagucaggucagcccccuuaauuaggcucugcaacuggauacagacagagugaacgcuaagacuaggucagggccggauagacuauuucuuccuucccugccucccuaagcuuguuccacaugcauuaacccuccuaugcugcuuaucaugaaauugccucguggggagaacagaucgauucagcacuggacaggucagccuguuaccucaguguaacuugauccaucucgauuguucucugugacuccuccauuaaaaaagaaggugacccucugacccuggagacagugucgccggggcuucuggugccuuguaauaagcucuacaucccuauuccucuucugauuuuaacagauucccgagcaggugaagaaggcucgaucagggcaguggaucaugccgugaucgguggcgucguggcgguggugguguucgccaugcugugcuugcucaucauucuggggcgcuauuuugccagacauaaagguaagcaaagcuucagcagacagaagcagcguguccccacagcuucugccuuuggagacuuuacaagguuguccuugauaggcaauuugauguauguggccacacggccuaucugauuccugaaacuggaagagagagaagagaaaaaaaaaaaaaaaaacaaaaccagaaaucuuagcagccgcugauuaggacucugggaguugaugaguagcacuccuugauuuggauuuucucuaaauauaaagcuuuguagaguuguuauucugccauccauaauuggggauagaggaaaaaugauaaaguagaggcuggugugcaagguguggcaugaagccgcaaaggauaaacauggaaaaagcacauccacaaccuacuguuuucugggaggcagaggauuucccccuauccccuguccccagacucuguguaagcuggucacaauggcgagaagacugccuugguuugaugugcccagguuaaagaaaauuuuuugccuuaaaagccgcauaaauauguauuuuuaaaauuaucagugcaauugauuuaaauugccauuaaucaucacacuuaucaacugugcagucuggaugggcaaucaucuuuuccaaugccccuccugucugccccaugcugcucugauccucuucuucccucuugguaauuuauucuuccuuuucuuuguccgccccugucucucucaguuauuuuucucaagcacugugcaaugagcuugcgggguuuucuaggugcuugcauacugcuugacuguugaacuuggguuugggggaaggucccuugagcacagcaguggaggucuaagguacuuaggcaccuuuaggauacagagugccugucucaagcauaaaacaguuuaggacgaucagagcuguccauacuucgcccucugcccacacucaggaggcagucuguuuggccaagagcucccagccucucggugguaagcuugacagagacaggagguaaggccagagagcagggcagcauccgagcagcagcugugaaggaccaggggaggggaacaugugugucacucugcagcaagaaaaaaggauacugagaagcguuugaccucuugcuuucucagauuuguuacuuugaaaaccugaaaauauagcaaaugucucaaccuuuuuaaauagaagacucuucaggaauacaguauguaaugggaggaagauuauuugauuaugguaggcaguuuaacuucuaccuauauagcauacugaggugcagucuuuguuguucuccauguaaacuguugggauuuggugauaagaguguccccagcuguguaaugucugucuauugucauuauaaaguggcugugccaauuagcaaauccaugaauccggguccgggcuagaguuauacgaugagagagaccuacuugcucauuaagacagaucccaaaccuugaucccugcuauuauaaugucaaauucuuucucaaucuggaaccucacucugaaguggaagacaggaaaaucaaacauacuugugcaaguucaagcaccuucucaccuauggguaggcaacaaugauucauauagacacgggacggugguucaaauaaaugagcugaggugacaacagaagcaucaucagggcccuaauucauuuauuggcuaauugcucuuccuugcuuuggucuuuaacaauguacgugcacauaucuggucauuggucauugguguuuacuguuuauacguuagucagccccucuccagcuuucugcauuuuuagcucccacucacgucuucuucugcugacauccucuggucauaaucacugcucuaaugucucauuugcugaauuauaucgcagcgguucaguuggaguggugccuuuggaacccccggaucccccuuugucucacccaccccgcucucuucuuccaauuguuuuuuccccucugcugccugcacaccacuucggcugaugauggccauaaagcaaguugccaucucuguaccacuuuacacagaggccaucagacagucacggugcuuuaccccuucaucuuucagguacauacuucacucaugaagccaaaggagccgaugacgcagcagacgcagacacagcuauaaucaaugcagaaggaggacagaacaacuccgaagaaaagaaagaguacuucaucuagaucagccuuuuuguuucaaugagguguccaacuggcccuauuuagaugauaaagagacagugauauuggaacuugcgagaaauucguguguuuuuuuaugaauggguggaaaggugugagacugggaaggcuugggauuugcuguguaaaaaaaaaaaaaauguucuuuggaaaguacacucugcuguuugacaccucuuuuuucguuuguuuguuuguuuaauuuuuauuucuuccuaccaagucaaacuuggauacuuggauuuaguuucaguagauugcagaaaauucugugccuuguuuuuuguuuguuuguugcguuccuuucuuuucccccuuugugcacauuuauuuccucccucuaccccaauuucggauuuuuuccaaaaucucccauuuuggaauuugccugcugggauuccuuagacucuuuuccuucccuuuucuguucuaguuuuuuacuuuuguuuauuuuuaugguaacugcuuucuguuccaaauucaguuucauaaaaggagaaccagcacagcuuagauuucauaguucagaauuuaguguauccauaaugcauucuucucuguugucguaaagauuugggugaacaaacaaugaaaacucuuugcugcugcccauguuucaaauacuuagagcagugaagacuagaaaauuagacugugauucagaaaauguucuguuugcuguggaacuacauuacuguacaggguuaucugcaagugaggugugucacaaugagauugaauuucacugucuuuaauucuguaucuguagacggcucaguauagauacccuacgcuguccagaaagguuuggggcagaaaggacuccuccuuuuuccaugcccuaaacagaccugacaggugaggucuguuccuuuuauauaaguggacaaauuuugaguugccacaggaggggaaguagggaggggggaaauacaguucugcucugguuguuucuguuccaaaugauuccauccaccuuucccaaucggccuuacuucucacuaauuuguaggaaaaagcaaguucgucuguugugcgaaugacugaaugggacagaguugauuuuuuuuuuuuuuuccuuugugcuuaguuaggaaggcaguaggauguggccugcauguacuguauauuacagauauuugucaugcugggauuuccaacucgaaucugugugaaacuuucauuccuucagauuuggcuugacaaaggcaggagguacaaaagaagggcugguauuguucucacacuggucugcugucgcucucaguucucgauaggucagagcagagguggaaaaacagcauguacggauuuucaguuacuuaaucaaaacucaaaugugaguguuuuuaucuuuuuaccuuucauacacuagccuuggccucuuuccucagccuuaagaaccaucugccaaaaauuacugauccucgcaugauggcagccauagugcauagcuacuaaaaucagugaccuugaacauaucuuagauggggagccucgggaaaagguagaggagucacguuaccauuuacauguuuuaaagaaagaaguguggggauuuucacugaaacgucuaggaaaucuagaaguaguccugaaggacagaaacuaaacucuuaccauauguuugguaagacuccagacuccagcuaacagucccuauggaaagauggcaucaaaaaagauagaucuauauauauauauaaauauauauucuauuacauuuucagugaguaauuuuggauuuugcaaggugcauuuuuacuauuguuacauuauguggaaaacuuaugcugauuuauuuaagggggaaaaagugucaacucuuuguuauuugaaaacauguuuauuuuucuugucuuuauuuuaaccuuugauagaaccauugcaauaugggggccuuuugggaacggacugguauguaaaagaaaauccauuaucgagcagcauuuuauuuaccccuccccuaucccuaggcacuuaaccaagacaaaaagccacaaugaacaucccuuuuucaaugaauuuuauaaucugcagcucuauuccgagcccuuagcacccauuccgaccauaguauaaucauaucaaagggugagaaucauuuagcauguuguugaaagguuuuuuuucaguuguucuuuuuagaaaaaaagaaaaacaaaaacaaaaacaaaaaaaaaaaaucacaccauugcucacagaauuggcaucucauuuuugggaccucccaucuuucuguuuugaaaaguguacaguagugcaguguuccugauguaacuuuauggcuuacaauguugacaugucucagguucauguguugcgauugguguuuuccgucucagguagauugcaaaguguaggccccacacauuggaaaaaauaauaauaaaacaaagcaaaaacaggaaauuauggauuuuaguuguauauugguuuauguauuuuuucuuaaguauacagugcacuguuugaaauguauuguugaguauuacuuuguacagguugaucacuuuuuuuagagugaagaaagaacaaacuuguuuuuuguguuuuuuaaaggaauauaaaauaaugaaggauguauaauugaugccaaauaagcuuguucuuuagucacaccgacgucuuauuuuucccuuuaggccaguucuguuuuuaagguguacauggacaauguuacaguguaagaaacuccauauccauauguucccauucgcauuuuguauugguucauguauaccauuuuuacaaaaaaaaaaagaaaaaaaagaaguacuauaaaauaucugucuucuuaauaaaaaaaaauuaauguuacaaaguga

SEQ ID NO: 21456 - RNA, 41015 nt, Homo sapiens
cgggaggcggugaccagcagcaggaggagaaagaacauggcgggcgcaucagagcucgggaccggcccaggagcagcggguggagauggagaugauucgcuauacccgaucgcgguuuuaaucgacgagcuccgcaaugaagacgugcagguacuggacugaggccggggacccgaggcgagaccggcuggucgcgugguagagaagggggaaggccugcgucgcgguggggguggccgagguacugaaugagucggacucguagcagaaacuugaaggggaggcggggaaugcuccgcgaggggcuguggugacacgccccgacccucccggguaccucucuaguaaccuugcuucggacccccugaggcguccgcccggagccuugcccuucccgggcgguugucggggaacccgcuucccgccugggcgccccauccgggccgugagguggccgcgucucuugggcgagggagcaggagaagcgcggugccaggccgagacggggcuggagcggcugaggggcgcaggaugcccagaagcccuuugaagugccccuggaucccuucaucucggcuuggaacuggcucggcuuguuggguagaaagcgggggugggauggccgauuaaucuggacgaguaguguauccgcucugugggaacuuuucuuugaaaccacagguguuguauucaaccguuucaccugcuucaccacugccaaagugcucucuuuuuaaaauuaucuuacuuccuagguguuguauugucuuuccuucauuucucuuccggucccuucugaguguuucuccugggaaauccuccgccggcuagugaggccgaguuacacuucuuuuuggaaguccuuaugagcuuccuuaacaguaaaaucuaaaugaaagguuaucuucauucuuaccccugugucauaauuucaccuguuagcaccuuuugucuuuugaucuaaauucagccguuucuuuacauuguucuucuuucuacuuucuuuucugaagcuccgacucaacaguauuaagaaguuaucaacaauugcccuagcacuuggaguagaaaggacccgaagugaauuguugccauuucuuacagguaugugaaucuuuguuuaaagaaagguagggacauuccauuuuccaguagcuuucaacacugacuuuuuuagaguuuauuacccacauuaaaaugagccagguguuuuuugugcaaaagaaacagaacagaguauauuguuaguuguggcuagauauauucaaacaucaaccauuuagcuauugaaaguaauugauacgggaguaugaauuucuaauucguugugcaaagcagauacaggaagacgguugagaagaaagaaaaugcuguuaggauuuugacugggucaccuuccuggucgcauagugaaucuguuccuaguuuugugucaguguccagcugugggagagcuauccauguugaugaguccuguuguugucacuuccagauacaauuuaugaugaagaugagguacuauuagcucuugcugagcagcugggaaauuucacuggccuagugggagguccugacuuugcccacugucugcuggugaguauuuauaagcugccuacccuccuucuacaacuuuugcaguauaaaugauacauuguuuggugauagacacacugcagcauuuuuuaugcagaucuuuuuaugggcagauagucauaauguuagucauugagagaauaaguacuguaggcacuuugcacucaacuccuuuuuuuuuuuucuguaaauaagagaacuucguccuccuuuucugcgucuguagacuuauuaguuuagauguagggagaaaaaggguuugauuguuuuuaugguucccccgcgcgaugguggaaguuuuaauucucaccuagcagcauuuugucuuugucaguuuaacuuuugcuucugacuuugugaguuugaugaauuuaguucaauuuaauugacauuuauugagagucuacuuuaucagacacaucauaguuuacaauguuaauguugaagaagaccaaugugagggggcuugguggcacaagccuguaguaccagcuacucaggaggcugagacuggaggaucacuugagcccaggaguuugaauccagccugggcaacauagugagacccccaucucuuaaaaaaaaaaaaagaccaccaaaaugaaucuaaugaggucacugccuuuaugugucagcaaauaauuaccgugcagucguaaauggaaagauauaaguacccacaaaauacccacguaauagaagggagaaagggauucacuccgggugaucagggaagaccuugggagaugaugucugaacuagguuuuaaaggaugaccaggaauucaacaguuggacaagguagggguguaugugucagagcuuugaauacuggguauguaauacugauucuugugauuucugucucuaguucugacuuuuccauggaacuccugagguagauugauuaauagauaaguaugaauauauauauauagagagagagagagagagagaguuuuuuuucugucuauguauauaggccuaugcuuuuuucuacuuguaugucaaacagguauuucaaacuuaacauacccaaaacaaaacuuagcuuuaucccccaaauacaccucucauuuaguuguuccacuucaguaaaugguaucacuaucuucccacuugcacaagccaaaaccuagaauguauucuugaauccucugugccuuguuccacacaucuaauccauuaguaauuccuauagagucuacguauauuucaaauaaguccacuuucuuccaucccuccuauuaccagccuaguccagacugucaucuuuccucuagauugcuguaguagcuuccuagcaaugcuuuccacucuugccucucacccgacucuuacaguucacaucacccagcagauggcucacucucugcuauagcucuuagaaaauccaaauucuguaccuuagcuuacaaggcuuuuuaugacccgccucuguaggauuaucauaugcccagugguacugcaugagaagaggugacaguaggcagggaacagacugcaaaaggccuugauaaccucuuccauucacauuggucaucuuucuguuuuuugaacuaaccaagcucauuauucccuuaggaccuuugcccuaggucuucccucuaaugaaaagcucuuucaagcuuucuguggcuggcuccuugucauucagggaucaacuucaaugcaucuccucagggagguuuuccccaaccacucaacuuaaaauagccucacagucaucccuuacuacaucauccuacuccuuuuuucuauagaguacucaucaccaucuacuuauuuucuugauugauuguugucuuacuccauuagaauguaaaugccacuagagugaggaaccuugucugccuuguuucuucuguguccucaaugcuagaauauaccaauaauaauguauugaaaaaaugaguuucagaggcuuggaagcaugaaacaggcuggguucaaaacugccggaguguggcugggugugguggcucacaccuguaauccuugccuugggaggccaaagcagcaggaggauugcuugaggccaggaguucaagaucagccugggcaacauagugagaccccaacacuuaaaaaaaaauagcugggcaugaugucaugugucugaguccuagcuauucgggacgcugaggcagaaggacgaggagucugaggccgcacugagccaugauugugccacugcacuucagccugggcaacagagcaagacccugucucuuaaaaaaaaaaaaaaaaaagaacugcuggagugugaaguguugaggcuggguaggcagaguggucaucaagggccaggcagaguucaaaucaagagaccacucauaagcaauucucaggagcauggccucauccuguaguaaugauagcuauuauccagugguacugcacgagaggggguuacaguaggcaggggacagaucaugaaaugcauuggcaagugagaaacaguaucuuuucaaugaguuucugaaauaccuucuaggaaagcugaauacugucuaccuguguguaucaaacaauuuuuaaaauauauuauuagacacacuucuuuucuuuaacucauuaugcuucuguuucacucuugguuaguucuauauguggguuuuaugcuuuaaaaucuguagcucauggcauguguagaaucuaccuggacuacaugcaaacucaguaaggcagagguucagagagccagccuguuuacacuuuuuacuaggccaugccauauucaguuacugcucuuaauccagaccauccaccccauuuggcuucuuuuauuucuaaagcuguaagcaagguguccuaccaucucuguacuuuaccuuuuuuuuuugagacaagagccucacucugucacccaggcucaaguacaguggcacaaucucggcucacugcaaccucugccucccggguucaagugauucucaugccucagccuccugaguaagcuggguuuacaggcgugugccaccaugucuggcuaauuuuuguauuuuuuguagagacaggguuccaccauguuggccaggcuggucucgagcuccugaccucaagugaucugcccaccucggccucccgacggcugggauuacaggugugagccaccgugccuggccagucucuguaguuuucacuugauuguucugucagaaacuccuuucugcccuauggcuaauggaaaguugcugaauguguucugaaaaaagcaauuuugcauucagcauuuuauagguuggauaaaaggaugggauggagaugguggauaaggguugcuugcaccucugggaaugguggaaagauacugaaaaggcuguggacucagugaccugacaagcuguuauccuguauuuguggugccuaacauuggucauaguuuuguacuuacucuugaggaaauauacaugauccugucugaauuuggcuauguaucuuuuaaaccuagugauucaacucacaguaauauuaauauugugucaagucuuuuacacugugucauuuguagacaccaucugggaauugccaucugggacacgagaucuuggcuuuucuacagaagucgugucuuuggguuggccgcaccauauguuaucacugugugagcugaaaguaaccauuugguaugaugcagcuaacauucugguuacguguaccaccucccuucagucacuuuaaaaggugauuaucuguuucuaaccugauucaauaaguuuucuucucugguuuuccuuuuuaauccauucagccuccuuuggaaaaucuggcaacuguggaagagacuguuguucgugacaaggcuguggagucccugagacagaucucccaggagcauacuccuguugcucuggaagcuuauuuuguaccucuggugaaacgcuuagcaaguggggauugguucaccucucgcacaucugcaugugguuuguucagcguuugcuaucccagggcaucaaaugcuguuaaagcagaaaucagacaguaagccaugguauuuuuuugccuuguuaaagcagaaaucagguaguaagcuaugaguuauuugggauuacuggggacuuguagcugacaauuuacauaguaccuuguuaccaaugaguggcugauacuaggauaguaggauuuaugacaucuuucuuuuuuuuuuuuaagagauaaggucuugcucuguugucuaggcuggagugcgguggcacaaucauagcucacugcaaccuugaacucuugugcuuaagugauccuccagccucagccuccaaguagcuaggacuaccgacauacacuacugcgccuggcuaauuuuuaaaaaaaauuucuggcuggaugcaguggcucaugcuuguaaucccagcacuuugagaggcugaggugggaggauugcuugaacucaggaguucaagaccagcuugagcaacauagugagaccuugucucuacuaaaaagaaaaaaauuagcugggcauggugggacccgccuguauuucuagcuacucagaaggcugaggugggaguucacuugagcccccgacaaacaacaacaaaaauauuuuuggcauauagauagggucuugcuauguugcccagucugcuuucaauuccuggccucaagcaguccuccuaccugggccucccaaagugcuuugauuacaggugugaggcaccaugccuggccuaugaugucauuuuuuauuauccaguugaauauguuuuauuuuuguuacuucuauaaguagaagcuuagucacugauuauuguaagauaaaaccucuaaaagucugucuguguguauggggggcagguuuauucaguguuauuugaugggaaauaccuucauuguuuuauguugcaggcaauuccguuccuugugcucagaugacacaccaaugguacgacgugcugcugcuuccaaauugggugaauuugcaaaaguuuuggaauuagacagugugaaaagugaaauuguuccacuguucacuagucuagcuucagaugaacagguaaacuaacucuuaguauuuaagggacacagauaugcuccuuuccucuaaauuuucagaauuucuuuggggaguuuuaguuuucuuguuaggauucuuuuuacagaauuagugcugauucuggccugguuaaaguguaacaugcuuaucucaauguucuuauguuucuuucuuaaccagaccaugauuucucucuuacauuagcagcuguuaaaagaguggggagucagagaggaaaugggagccauaauuagaaaggaagaccaaagcugcauggaggguaacauaccuuugggaauugcuggcuguauuguaauaugagggaguaauguuuccuggaauuuuugacuuuucagauaaauaagcuuagaauguguuaggaaagcuauuugacucucugcuucuucuauaguaguguaugggauuacuucacauaaucguauucaauucugaagaucuagaucucuuugguguagaaauaacaauaaaacuagcaaacauccaaaugaaguacuuaauuuuucucugccuuuaaguaguuauguguauuaaguaauucaguccuuacaacagccccaugagauagcccauuuuacacauuagaaaacaaaggcacagaaaguuuaaguaacuugcugaaguuugcauaguuagcaguaguggagucagaauuugaaucuaggugguuuggcuccagaauuugugcccuucacagcuaggcugucccgcuucucuguaauggugcuuaauaggaucagcucccagaguuccuggacucuagaauaguccuuuugggcuuuuaauuugcauguugccugcccuaagaucgcuucauguguacaggaccacaagccccaggacacauauuaaugagucucauuuucagauccuaaaucuaaagaucuaaauccuacuuugaaaauaauuuuaaaaauuauuagaauuuuuauucuaauaauaaauguacaaaaugaauguauaacuuaaugaacuauuagaagguaauaccaacuuguuaacgaucaccuaugauaggagacaucacuuugacagccacuaucccagaaucccuccauggauucccuuucaaacacaaucucucuuuccuccuccacuugccacuccauuuccuuaagaguaacauuauccugacuuuuaugguaagcgcagccuuuguuuucuuugcacuuuuucuuuucuuuucuuuucuuuuuuuaaaaggagucucacucugucaccaggcuggagugcaguggugcaaucucggcuuucugcaaccucugccucccggguucaagcaauucuccugccucagccucccaagaagcuaggacuacaggcgcaugccaccacgccaagcuaacuuuuguauuuuuaguagagacgggguuucaccauguugaccaggauggucuccaucucuugaccuugugauccgcccaccuuggccucccaaagugcugggauuacaggcgugagccaccgugcccggccuucuuugcacuuuuauuaccuaaauguuauaguuuaaaacagugcuuuacaacagaaauauaauguaagcuaccuguugauuuuaaguuuucuacuggccauguuuuuauaagaaaaaagaaauaggugaaauuaacaauauuuguauucgaccaaaauuuuccaaaaucuuauuauuugaguguaaauaacguguaccagccacauuucaagucucagcaugagaugauguuguuaauagggugguagugaagauggaaaggauuuggaugucaguuuggaagugggaucaauagguuaguauuauuggauuggaucagugggagaggaaucaagaucuccuagauuuuuugcuugagcaacuggguggaugauggugucaucguuaagauagagaaaauucugggaagaggaacagguguaggagagaaaacgaaguucuggaagagaaguaauuuuuuuuuuuuuuuuuuugagauggaguuucacuccugucgcccaggcuggaguacaauggcaugaucccagcucacugcaaccccugccucccggguucaagugauucuccugccucagcuuccugaguagcuggaauuacaggcgccugccaccaugacuggcuaauuuuuuguauuuucaguacagaugggguuucacuguguuggguaggcuggucucgaacuccugaccuugugaucuguccgccuuggccucccaaagugcugggauuacaggugugagccacugcaccagaccagagaaguaauuuuuuaacaaauauguauuagcuuauauuucaguaguugauuagcagucccaugauuuagcaucauuuucgaaauucaaaaauaucuguguagucacuaccaagaacuuaguccugucuuuuuuagccugugcaccugcauacagaggaaugugugugucuuuggcauauagucaguuauuguugauacacaguuucuaagauuuguaauauuuuggaaguuggagucacuguuaugucucucaaguauguguauacguauauacauaacuguuauuguacacacuuaaaauuuuuuaccuauuucuccugggugcuaauguuuacauguauuaagauucuaccuuauauauguauaauacacaaaucuacagucucaauuucuaauuucucauugauguuucuuuuuuuucgguguuuuuuuuuuuuugaguuggaguuuugcucugucacccaggcuggagugcaguggcgcgaucucggcucacugcagccucugccuccuggguucaagcaauucugcugccucagccaccugaguagcugggauuacaggcacgugccaccaugccuggcuaauuuuuguauuguuaguagagaugggguuucaccauguuggccaggcugguguugaacucuugaccucaggugauccgccugccucggccucccaaagugcugggauuacaggcaugagccacugugccuggccccucacugauuugucuuguauauuuuccacuuguucaaaggacguaggugucacguugacauuggcuguuuacauuuggaaaguugaguucauuaaucccauacuuuucuaauuucuguguuuuucuagccacagcuuccucaaaguuauucuguccuugaucuucgacauuuaaauccaacugauuuuuguuuuugauuucuaacuuuuaauuguucuguguauuucuuuccaagucauuaucuuaugcugccuacacuccuguuacugcgacccugaucugaguuuuuugaaaacuaagcuuucuaagugauuuccuuuacucuuacucuuaccuuuguccuaaucuguuauaaauaacuuguacaaauauuguuuucauuuuuaucccucaacuuucuguuauaguaaggcuuugaaggcaucauuaaaauguuuuuuuuuucuuuuuuacuuaauuuuaaaauuuucauuuccuuuauagaaacucugcauucuagccaagguaauuacuuggcuguuuacucauaguacaaagucauuucuaucuuuaugacuuugacaugccauuccaggcaaagggagcagcucuuucuuuuuuuuuuuuuccuuuuuguuuuuugagacagagugucacucugucgcccagacuggagugcaguggugcagucucggcucacugcaagcuccgccugcuggguucacgccauucgccugccucagccucccgaguagcugggacuacaggcacccgccaccacgccuggcuaauuuuuuuuguauuuuuaguagagaugggguuucaccguguuagcuaggaugguuucccucuccugaccucgugauccgccugccucagccucccagagugcugguauuacagacgugagccacugggcccggccgggagcagcucuuucaagauauaaauacacggccaggcgcaguggcucgcgcuuguaaucccagcacccagcacuuugggaggccgaggcagguggaucauuugaggucaggaguuugaaaccaggcuggccaacguggugaaacucugucucuacuaaaaauacaaaaauuagcugggcgugguggcuccugccuguaaucccagcuacucgggaggcugaggcaggagaaucacuugagccugggaggcggauguuggaaugagcggagauugugccacugcacuccaaucugggugacagagugagacccugccucaaaaaaaaaaaaaaaaagaaaaagaugucaagacgugaaacuauauaagguguggcagucuuggugguguuaauuuuuuuaaacaccugcaccaccccacagcaguuccccaugggucucaguaaaugucugaauuacagaaauuuuguuccuuuaggauucagugcgccuccuugcuguggaagcuugugucaguauugcccaguuauugucucaggaugaccuugagacuuuggugaugccuacacuucgacaagcagcagaagauaaaucuuggcgcguucgcuauaugguggcugacagauuuucagagguaaagugaucauuuuuaaguacuaaggaaauaaaccugaaaacacauagauuugcuguuguacccaaaguuucugaauuaauucuuuucaaugggaagugcuguggcaaaaauauguauuuacagauugcacaauuuuguuuuguucuuguuaauucuuuuguuaguauacauuaaaacccguucaaauucuuuuauagcuccagaaagccauggguccuaaaaucacccuaaaugaccucauccccgccuuucagaaccuacuuaaagacugugaagcugaaguccgggcagcugcugcccacaaaguaaaagguuaaggaguucaauuuauguuggaacaugugucauucauuuuggugcauuuuuuuguuagucaauuuugcauguuuuuuguucuagaauauguuuuuaaaauacauagggauguuuuuaguguguggaaauguuacauugucacuuaaagauagucucuuuauauuuaaaaccaagaaaucauuuugucuuguuuuuguaaaaaaaaaaaugccuuucagguuggauuggugugauaugcaauggcauagagaguucacgaaaaaguuuauuuagaacaagagcuguuuuccuuauuugcuuaaacauauaauuuaauugaaauuauugauaaaccugguuaaauguccucauuuggcucuuuguaaauggcccugugaaagcauucuuuuuuucuauuuaucuuuuagaacuuggugagaacuugcccauugaagauagagagaccauaauuaugaaucaaauucugccuuauauaaagguaaaccugacuuuauuuuguuucacucucuuuuauaugaagguaaaccuuaaucucauuauuuuuguuuguuuguuuaccuuaaagcucuuugaguuuaaagguugacagggaaugaauggggaagauguguuaaugugcaacauuguuauucaucacuuauuagcccauuguaauuguaaacugcucuuuggugcauagguuuauguuaccuaacaaguagucugaggaaacauuaucaacuaaucaguauugaaauagugcugucuuuaaauuccuuggggucaggcauggugguacaugccuguaauccaagcacuuugggacgcugaggugggaggauuucuugagcccaggaguuugagaccagccugggcaacauagugagaccccauugcuacaaaaaauacaaaaauuaguugagccugguggcaugcaccuguaguaccagcuacuugggagucugaggugggaggauugcuugagcccaggagguugagauggcagugagcuaugaucaugccacuguacuccagccuaggugacagggugagacacugucucaaaaaaaaaaaaauuaggccaggcgugguggcucacaccuguaaucccagcgcuuugagaggccaagguaagaggauugcaugaacccaggaguucaagaccagcccuggcaauguaguaagaaccugucucugcaaaaaaugaaaaaaauuagccaggccugguggugcaugucuguagacccagcuacucuggaggcugaagugcuugagccugggagggugaggcugcagugagccaaggucaugccacugcacuccagccugggcaacagagcaagacucuguuucccagaauaaugguauggaaguuucuguugucuuguaauaaaggcuuuuaauuucgauuuuauuuuaggaauuaguauccgauaccaaucaacaugucaaaucggcucuagcuucuguaauuaugggauugucuacuauuuugggcaaagaaaauaccauugaacaucuucuaccucuuuucuuagcucaguuaaaggaugaggugggucuugcuuuauguucuguugccuuugauaguaauuugauuuuauuugauuuugguuuaggguuucauuaaaauagaacccccaaaaagaaaauggauaaaaaaaucauaacuuauuuuaaaccaaugacaccugugauuuuggguaugggguuauagguuccucagaaagugggcaaaaguacccauuagaguaaaccuagaaauaucuguuuaucaucuuuaccugauuuuugcuuuauacucccugguuucuuuaaagcuaaugugucuuuguuuaaaaaguuucauuuauuuaaguuuaaauauaguaucaaaaauuauaaugauaccuaauauuuacugaguaauuacuacauggcaagcaugagccuuagugcuuugcauguauuuuuacaugcaauucucacaacaauccugugagguaggucuuauuauuaucccuuuuuguuuguuuguuuguuuguuuuguuuuuugagacggagucuugcucugucgcccaggcuggagugcaguggcgcaaucucugcucacugcaagcuccgccuccugaguugaugccauucucuugccucagccuccugaguagcugggacuacaggcgccugccacagcacccagcuaauuuuuuguauuuuuaguagagacgggguuucacuguggucucgaucuccugaccucgugaucugcccgucucggccucccaaagugcugggauuacaggugugagccaccgcacccggccaauuaucccauuuuacagaugagaaagcugaggcauagaggguuaaaguaacuugagcaaggucuuucaacaaugacagaucugaaauuugagugcaucugauuuaguuccagagauuaugcucuuuaccaucuuacggacuuuucuuguagucuuuaguauuacggacuuuuaauugaaauuucugauuaagaucauuuauguuccuugaguuauuuauguauucacuauuauuucuucaagauuauccauuuuuuuuucaccugagucuuaccucaccuuuuaucuuacccugacaggagacuguugggcagaguacuugauuuuuaaauguggucuuuuggggcuuguguacuugcaguguccugacguucguuugaauaucaucuccaauuuggauuguguaaaugaagugauuggaauccgucagcucucucagucucuccuuccugccauaguggagcuggcagaagaugccaaauggaggguccgccuggccaucauugaguauaugccgcugcuggcaggccagcuggugaguauguguugcuccaugaacugcaggguagugucagauagugacaauuuaccauggcaaguaggaggccuaguagccuguaugcuuauguuuguuuagaugcaugaaaguauggccuuguucuuguuaccuauaggaugguuuuuauguuuguuagugcauacguuucuuuucuuuuaagauggaguuucacuguuguugcccaggcuggagugcaaugaugcaaucuuggcucacugcaaccuccaccuccuggguuuaagcgauucuccugucucagccucccaaguagcugggauuacaggaauaugccaccacacccagcuaauuuuguauuuuuaauagagaugggguuuuaccauguuggucaggcuggucuugaauuccugaccucaggugauucacccgccucagccucccaaagugcugggauuccaggcgugagccacugcaucuggccuauuagugcauacauuucuaacaaaaagguauagguugaguaucccucaucuaaauacgcuugggaccagcauguuugggaccagaaguggauuuuggaauauuugcauuauaaauauuuacugguugagcagcccaaauucaaaaaugcaaaguccagaaugcuccaaugagcauuuccuuugagcaucauaucagugcucaaaaaguuuuggauuuuggagcauuucacauuuuggauuuuuggauuugggaugcuuaaucuguauuacagaaacauauuucaccucaucaccaccgaaaaacaaagccauagaauaaucaguuucuugguauauauaauguaaauuuuauaauauuuaaugccuuugugacuuaagaaauguuuaacugagaagaaaagggauuaugguuuuaggguaagucugcugugauuuuugcucaaggaaacuucccuguuugccuuguauucuaagcaaaaugucccuagguaccacuugcccuacauucugauuaaagggaguugaggaaucaccauauagaaaagaaguauugaaaggccgggcacaguggcugacaccuguaaacccagcacuuugggagccagaggcaggcgaaucacuugaggcuaggaguuccagaccagccuggccaacauggugaaaccccaucucuacuaaaaauacaaaaauuagcugggcacggaggugcacaccuguaauaccagcuacucgggaggcugaggcaggagaaucgcuugaacccaggaggcgaaggcugcagugagccaagauugcacuacugcacugcagccugggcaacagaguaaaacuuugugucaaaaaaaaaaaaacaaaacaaaaacaaaaacugaagcuuguaauguuaguauuuuggucaaaguccacauuaucacauuaucuguuacuguuugaguuucgugaucaguguuacccuaacuaauaccauguuaguuaaaauuucaaagcuggguuuuauagccacauccuuuccuuuuuuugaguagguggccuagacaguucuaaguuugauguaccuucaucucuguugguagcacuuauuacagaguauuguaauugucuguuacagucuaguuggagagaugggugaucucuuuuagggcagggacuguauuuuauuuccagucccuaccauagugcccgucauuaauuaggcacuuaacauuuuuuauuuugggggcagggucuugcuguugcccaggcuggucuugaacucauggccucaaaugauccuccugccucggccuccugaguagcugauaauaggcaugagccacuguguauagccaacauuuguugauuguugaguauuuuuugagaaagaugugucaguuuacuauugacaucgcuacaguuuguuuccccuuccucacucccacuuccauuccuuucaggucacaacauauggaauuuauuuuuucuugucuugaaccccugaauuuguauuuuuaauuuuaguacauuuaguuuaugaacaugcaauuuguggaugucuguggcauuauauguuuuauaaaauugaaaguguccgauucuuugaaaaguauaccagagguauuagugcauggcaaaugggaucaggugaaguuauuuugucauccuuuuugucugucacucccaagugcuaugggucaucuucucuucacuggugauugucauggaucuacuuuucagaguggagaggagcagugauuaacugauuugcugaagaccaaaacuaucuggaagggagggugcauuuuaguaccauuucuuuuaaccucugcuccuucuagaccuggaaaguuucccaggguugcuagcucuauagagagcagugugaaagcaaggcagauggugucuuuggcugacuuacaccugucuggcaggggugacaugccucagucaugaacauuuugcuuuacaauuuuaacuucuuguuaguauauauauucuccuuaauuucucuucauaucuaaauauuuuuauaucagauagucauuuuauaaaauucucucaagacuuuauguaugaccuggcuuguggacgauguuaaguaaguguaaaguuaaacuacaaaaaccggaaaauaggccaggcguaguggcucacgcuuguaaucccagcacuuugggaggccuagguggguggaucaccugaggucaggaguuugagcccagccugaccaacauggugaaaccccaucucuacuauacaaaaaauuuagccgggugugguggugggugccuguuacuugggaggcuucuugggaggcugaggcaggagaauugcuugaacccaggaggcggagguuguagugagcugacauugcaccacuguacuccagccugggcgacagagagagauuccgucucgacaacaacaacaacaacaacaacaaacuggaaaauaaaaguuaauuaaaacugaaggaaaauucucaaccugaaaugaaaaagaaaucuuggcugacguaaucuaaguguaugccaaaauuuguucauuaugaucuuuuaguacaaagcaauuuugggccaggugcgguggcucaugccuguaaucccagcacuuugggaggcugaggcggacggaucaucugagucaggaguuaagagaccagccuggccaacauggugaaacccugucucuacuaaaaauacaaaauuagcugggcaugugcugcauaucuguaaucccagcuacuugagaggcugaggcaggagaaucacuugaacccgggagguggagguugcagugagcugagauugugccacuguacuccagccugggcaauagagugagacuccaucucaaaaaaaaaaagcuauuuugucuuauucaaucacuauuuucaaagcacugacacauuauauuaccucucuuuuuuuaaaauauagaaucaccagucaggaacuucuuagaguucaaagaagcaagacuguaaauguguagaccccagaagggaggcacuaggaaagugugucacagcauucuccaugugguguggaagccccgggguuagaggacuguguaaaucugcucccggagcccauccccagccugcacugaaguggccaccuguugacagucgggaggaacagggcugggagagcaagccaugccugggccauaugcccuguaguccugggccugcuuuauucucccuccagggcuuucuccuguugucucgaaaauacucucuuuaacuggggauaucucuaugucuugaggucaguugcuuuauccuuaaggauuugucauaauaguaaccaaaaagggaagacgauugagaauuaguaauauuacugacagguguuuuccuggguaauucauuuuuacagguaauccagauuugcuuggcagaccauacacagugcauucuuccugcucuuuugcaguguuguggcugacuucuggccacccuguucucuuuuaccuagcagggccuaugccagcucacguaugcuuuuuuuuuguuuaugauuuccguccaauaaauagauuuaugguuuguuuguaauuccugugguguuucuaucucuuauuuguuuauuuggaaacaaguuuuuuuagccuucagguaaccuugguguaauguaaauagaccaucuuuauuucugaauuuuggcaauguauguuaauggaaucuucuguaucuguaggguguggaauucuuugaugaaaagcugaauucuuuauguauggcuuggcucguggaccauggugaguagauaaaaacagauuauugaaagcccauauauccaugauuuucauacauuuccuuuuagaaaggaaucucagucugaccagauauuuugccuuaauauuguaggaaugaagaaaggcucuaauuaaaguuuaaucuucugaauauaaauuugacguuucuaccaauuuuuuguaucuucgauuuuauuuucuccauuaaacaauuuauuugcauuauuuucuuacucaaucuauuacauuaucuucagaccaucucuuuuauauaucuacuuacuccucccuuaucugaagauccucuuuuugaccauccuguaauuggugucuucagcagcuauacacuagguuguauggagauuggaaucagaugaaaggccugggugggagaaauggcuacuuggcuuuuugaggugacauagaagaggagaucuacagugagacaguagaggauucuuaggugugggaaacacuagcuuugccauagggagagagagggccuggauuucugguuugggugaaaggaaggcuuacugcuuguacucucacugcugcugcuacagugcuaggagagggugagcucagggcaggucagauaggacagcaggaaugagcaagugacuuccuggugaggcuucagguagagguauauguguguauccccuugugugccaggcagcagugggugacagauguaccgucucugccagaucccagguccagacuugacagcuucaguguugucuuagaccuguuucgaugagugugagugccccuauggggucaugugacauuguccuugagcuuuguuuccauguuuugguggauauaauagauaaccugagucaguuccacaguaucuuuuauauacuugauauauguauuuaguguaucucuuuguucaucuaugggugcuuaugccuggaaauuugggaggaaugaggauauuugugucugcuuauacgugugggugguuuuguuaaaggcauguuugcaucauauggaggaucauaugguuaagagugugaagaggaaggaugugaaaaaauaugugaaaauguauaagggcuuauauauguggguauuuccaguguuuucaaacuggauuguagacuucuuucucuuuuucuucucuaaaguuaucuuauuguggccuauuuauuucuuuuuaaauaaaauuaaaauuuggcaaaucauaggaaagaaauaccacuuuuaaaaaaaauguuuauguuauaucugauaaauauuugacguuacugggaauggugcauccuagcaaaucauucugugcuuuuuuaaauuuuauuuuacuuuaaguucuaggauacaugcauagaacaugcaaguuuguuauguuacauagauauacaugugccauggugguuugccgcaucuaucaaccugucgucuagguuuuaagccccacaugcauuagguauuuguucuaaugcucucccuccccucgccccucacccccugauaggccucagugugugauguucccuucccuguauucauguguucugauuguucaacucccacuuauuagugagaacauguacuguuugguuuucuguucccgcguuaauuugcugagaaugauggcuucuagcuucauccaugucccugcaaaggacaugaacucauuccuuuuuuauggccgcauaguauuccgugguguauaugugccacauuuucuuuauccagucugucauugaugggcauuuggguuggccucaagucauucuaugcuuucuuuaaaaguuggcauuuuagauuaagaugguguuuuauuuugaggaauuuuuaaaguucuaauauuccacaaagaauuaaauuccuggcacccuuucucuguaagauugucuucucuaugcaacuugauuacuccuuccucuuuucggauuuucucuuucaguuugggagcaggagaaacccuuguuuauuucacugcagcagcaugcugaaguggggacugcaagaguuccaugaaccaaugaaauaacagcucugaaauuguuuuguacuuaaucacaggagcuuuuuugcuuuugcauuucagauaaguguuauauaaugaucacuggaucaguuagaguuuuugaaacuuuuccccuaguuagguaacuacuaaaagaacauugugaaaauuccagagaaguauaaggaagaaaguaucacucaccuauauuccugugguugaguagacaguuuugaucagagggaggaauguagaagggaaauuuauuuauuuauuauaggagaaaggagaagguaucaguuauugagcauagauagacauucaaagaaaccuugcaggucagccaggccuugagaggagauggggagagagaaagagacagaaauagacaaaagaaaacaggcagaacucuggaaugguuugcauucuucugaaaacagucagaggaaccaagaacauaguaggcaucuggccaaguagaguucagugcaguuaaggucuuggucaaggcuaugcauguguguuccccagucucugguuuuucuggcaguagagaucccuuccuaugguaauggcauuaugauaaaaaucuaaagcguguuaaaaaaaauaguaauuugcugagcaugguggcucaugccuguaaucccagcacuuugggaggcugaggcggguggaugacuugaaguuaggaguucgagaccagccuggccaacauggugaaacccugucucuacuaaaaacacaaaaauuagcuggauguguuggcgggcgccuguaaucccagcuacucaggaggcugaggcaggagaguugcuugaacccaggaggcggagguugcagugagccgagaucucgccacugcacuccagccugagagacagagugaggcucugucucaaaaaaaaaaaaaaaaaaaaaauuagaggagaagacacaaauacucuagcuagcuccucuuuaguggggaggacagggaaggguuugggccaaagacaaagacuauggauaugaagggaaggaaucuguauuacaguaaaacaguugacuugaguuugcuccuuagugcaucugagucuuaccgaaagguugcuucuccuguagacugucaguuuaaguguugauaaucaguuguaugggucacuugucuaugcugucuugcuuguucucaacaucauugcccagaaggaucuaugaauagaagaaguugccuauuucuugguuggaggcuuguauaaauugccuaggacugggacuguggcuuggauagcuauuccugcccuuccuaucaucccaggaagguugggcccaccuggggagagaaguagaauaaggaauuaguaccuaccacccucgauuuguuaaucugagcccaaauuuugagucuuacuggaucuguaaagugaagugacaccaggcuuguuuuuguucagugcuguauauagcaacuaauugugagaggauuguagcugagaccuuuauuaucuagcuuuaugucuuugauaaaugaucaaaggauauagggaauuauuagauguuaaggcaggcacauugauucaaagacauuugacaucuuguuucaaccuaagcauuuucauggagaggaagcaagucagucugauguuuguauuugcuguuguauagaugaccacaguggccucuacaccauuuccuuguugucuuucucagucaacgucgcuucuccgugauguugcuggaauaaucuugcuaaaauuccacauuggucaucaggucacaaguuugcuuuaaaaacccaucacuguuuuuccuaaucaaaucuaagucuuucauaaugcucugcagucuggguccacccuaauugucuaacuuagaagucucacagguuucaguuuuuucuguuuguguccuggauacaugucuuuacccuuucuaggaauuccuccccgcuucucuccacuuacacagauccucccaaaucuucacugcccagucaaggcuucuuucugugccgaagccuuccuagaccuucccuguucacucuucucugcacugcuacaacccucacagccuuuacuacacaaugccacacuucauucuaauugcucuuacaccaugugacuucauggaguguguuagcuuucauuucucugauaagagcauauuucuugugagggaaaguaucuucuguguucuuuuuguagcacauaguaggcacuuguauuuguuaaauaauugaugaugcauauggugagcuccuugcaucccuuuucuguggauaugcacacuuggaaacugaguuggagcugagcaugcuugucauugcagcaugauuacauguggagucugauugcagagggguuuugcuuuugguccacauuugauuuucauguaaguaaacuagguuaugcuuaaaaaacaauaagcgauaugagaacauguuuuugaccucuucugcaguauacgccauccgagaagcugccaccaacaaccucaugaaacuaguucagaaguuugguacagagugggcccaaaauacuauuguucccaaaguguuaguaauggcaaaugauccuaauuacuugcauagaaugaccacuuuauucugcauuaauguaaguauaacauaacuguuauugcuaagcuuaaucauuaaagcaaaauuauucaugacuauuucugaauuaucaguauacugucuucuauuuggaauauaugucuuguauugauuaauuggaauagacaggagaugagagaaaaugucaauuuuaaaauucauguuaaaaucuacaguauuggcugggcacaguggcucaugccuguaaucccagcacuuugggaggcugaggcgggcagaucaccugaggucaggaguuugagacuagccuggucaacauggcaagaccuugucucuacuaaaaauacaaaaauuagccgggcaugguggugcaugccuguagucccagcuacuugggaggcugaggcaggagacucccuugaaccuugggcagggggcagagggugcagagguugcagugagcugagaucgcgccacuacacuccagcuugggcgacaaggcaaaacuccgccugaaaaaaaaaaaaacaaagaacaaaacuacaguauuuuaaaaguucaacuuauuugugaauucuggucuaauucucugaucauuugaaugauucuugugucccccacucagcugcucaaacuagaaauauuuuccuauuggucaauuauuuucuuauuaaauauuaauuuguuucauuagauuuuggaauuuuuuaaaguauuuuaaaugugccaucuuacuuauuuuucuaggcacugucugaggccuguggucaggaaauaacuacuaagcaaaugcugcccaucguauuaaaaauggcaggagaccaaguagcaaauguucgcuucaauguggccaaaucucuacaaaagauuggaccaauucuagauaccaaguaagauuuuaguguuuagucuuguuuuaaaaguguacuuuaaauuuuaccuuauaguggggaguaauuagcuaaaauuaaguucagggauuuucacuuuacuuaagaucuggguuugcuuaaagaaaauaauuuagcaacuauuuuugaggauguccacuaugacuuuuauauuuaagcucuguaaauguguagauccuugucugaagcugauuuugcugagaauuucuuuagacauuauuuuguguauuugucaaguuuauaaaugucuuuauuuuuuuacuuuaaauuuuaacaauuaccauuaaccauauacaccaaaaaggauuucuauggcccauuagacugucuuucacagauaauacuuuugaaugucagugcuuuacagggagaagugaagccaguacuacagaaguuaggucaagaugaagacauggaugucaaauacuuugcacaggaagcuauaagugguauguauuuccuucuuuugccuugcagcuuaugccuugguuaacugggauuuaucucuauuaugugagagguguuaaguggguaggaugauaaguauuaugggaaacagggaggguaguaaguuccuggaaugcuggugucucucugauuagaacccucuuggcccaccauuuucucauaagugagcaggcuauuuuucuuaguuacauguaggacuggguaggaaauacgauucucacugguaagaauaguuuuucguuuggaauuuaaccaguuuuuaaaguuucacuucugauuagccuggcugaguaaagacaguaaccacagugagaaguuguuaguuugauacguuuggaucauuguuauugugcuuaauauucacauagaucguucgugaacuuucuguaccacuaaccugauuuuguuuggaauuuuccaguucuugcauuggcauaaugaggagcaggagggaaaaggccuuuacuagauucuugucacaaauuucuagucaauguguucuuaacuggguggagaaagaauggaaaaccuucaagaucucauccaagcaaauggcaacaacuuagaagaaaucauuuagugacuuaauucuuucuaaagaugaaaugggauuguuuuuuacucgucuuccuuguuaaaucauuauuuaagccguucuuauugaccaauuccugacacuugauugucuccuaaugcuuuauccaucaccaccugggcuccugcauccucacuguggaaucaggcaccagccacauaauguuccagacaaagccuggaaggguguggacccagacguggaguggagugauucucuugacguuuacauauaucucugugucucuccaucauuccaaagcuaaauguacauguuuagaauaacuuauuuuauaaacucuucgggagacauguugagauuugaccguaaugaaagccacauuuuccugaauuaugauggucugcauuagucucaugugaaaggggaauguggaagcucaggguuaauguagugguuguuuugguuuuuauuugcucaauuuugucuguacucaugucauucagaaaccugaaguguggcugcaucuugcugcuaaugugugauguugacgccuaacugaauuugaacagcucaccacugugccuacauuuaaaaauacuucucucucuuuucuaaaaagcuuuaacuguagugccuccuaauaagcaguauguuuguuucauugugagauugcaguucuguauuucgaaugagucuaagaaccacagggauaauacugugcagauuuccuguucuuuaccuggcucugcuuccagcaguauugacaccuaguccuugcugcauuguacaguagcuuuucaaacugcaguuuuauugcuaaguuuuuaguaugggugauacuggagucuuaucauuugaaguguuugcuuuucuacuuuuacaguaaaaccucauuaauucugaaauuuaagauaaugaguuaagcugaagaguuuacugaagcaaauuaauagugaggaagccuauuugaacuacuuaaacaguauuaaagcccuuuuuaaaaagcaccuauuugggaucauuugaggucaagaauucgagaucagccugaccaacauggugaaaccccaucucuacuaaaaauacaaaaaaguuagcugggcgugguggcacacaccuguagucccagcuacucaggaggcugaggcaggagaauugcuugaaccugggagguagagguugcacugagccgagaucgcgccacugcacucuagccugggccauagagcgagaguccaucucaaaaaaaaacaacuauuuuucacauaaucaaacucaccuugucucaugacuuuugguuaaggggguuuucccauaguuuauuuuucucucagugcaucuugcuaugagguuugcuuguuacccuuuugguuuuugaauuguugauuuuguucacaaccucuuuuaaaucuaacaaguccuguucuguuuagugaaggcccaaagacuccucuaagacuuuguauauuuguuacauaaaaccaaguuuuacuaaauacuuuaaaauuuguccuacauucgaaaaauagaaauuguaaaucagagguuaucugucugcauuuuaaacugccaaauuaccuuauaguaaguuucuauuuuaugacuuugggccaagaauuaaguauuuuccuaagcacaaaucuuuuucuauauucucauuuuaauaucuuaugcuauuauucuguaaacauuuuaauuuuaguuucaugagucuuuauuuuuuguuaccugcaaguuauguucuucuucauugaauuucauauuugagagacauuugucuucaugaagcagauuugcacuggaaccauugcuuuacucugguuggaaaugccauuguuuuggggacagacuuuuaaaaugcccuugugucucccagugaggagcccuaagcauugacuucucuacccuaaaacuguuugagagagggagagugggcccuggcuuucucaagcaugggucggggguucagcggggccucugucuuuuguggugaccccucagggguuucauuguuuccuucugacuuaagcaauagagagagaauuuguuuugguacucuucagaggaauugugcuuuggcucauaacuuggccauguucuccaugaauuaguucuccuauuuuuuuuuuuaacuaccuuaaacuuaagggaaaaguucuccuaucuugauuucacuggaauauaggcuuuaggagcucuguaaggcugguauuuuugucuguuuuaucuucuacuguaucgccagugccuggaacagugucuggugcacauaauaggugcucaauaaaaauguguucaauggaugaauuucuaaaauauccuccaaugugugcauggaacaaauaaucaaaagaaccagacugugucuuauucucccacugacagaaagauuuuccugcuuucaggaaacaagcuuuauguggcccuuuucugguccccuggcuuagacuacaguucuguguggauuugucugauugcuucagacauguaauguuguuuuucauccuuggcagcuuacaucaguuguuuguuugauuagaaaaaugaagcagacacacacacacacacacacacacacacacacacacacacacaaacauauaaccuaugccaauaaaaaugucucagcaacaguggaauucaccuugguguuucucucuguaauuugugugggguuuaccccucacagguuuaagagaccaggucuuguuucucucucugugcuaccaagaagaugugaaccugaggaugcaucuuguuucauaagaaggaaggcaggugaauaugugguuucuaacgaggucuuguugaaauaacgggcugcccucagcucacagaaauaccacagcucagccacugugaugcagagccccaggggucuuugccagacaacuuguccugacucaacagagacggcagccugaccuuugagcuggcuuguccaggcauucagguugcuugcguagacuuccagggaagcaagccuguccuuccugacccggcgguuaaccuggugcacuuuuguuccuuuguuaacuguuguguugucacuaaacugaaaggcuggggcuugcccuuagacgucacauuggcucugucccuguggcgauggcagggcaggguggccaaacaggucaggugcuuguucuguccucuugccuuuuacuuaaauuccucugacuuuuaaaaauggugacacucuuaucguaaagcuucuuauuuuucuccacugcuuggauaugaaacuguagagggagaggcccuguugcccaguguucuccugguuuagcagcugaggugacugcagucugaugugauguaacuguuucccuuugauucuccaguauuccuguuuccauccaguuccuuacucuccucuuuccucuucccucgcaugucucccuccaguccucuguaccuagaauagucucacugucccccguuugccuccacgagccugcuguuuccaggaaauuacauaacguucaguugggauggaaaucuuccggaggacgaauagaguuuaauuacucauugcgucggaaagccaagccauuucugucuccagaguuguucucuuaaacugauaugaguucugaaaggagccaggucuuuccugugguuggggcucuggagaccaucagugaccaggauguggggaacagccagguggacaccaaaaggcccgaugggguggcgcuuuccagggccccgagggaaaggcaccucagcacgacccugggcugccccagcuuucucugcccagugccccauauacuuguaggcugcugcuggacacccaacucugcuggcacaacugagggcauccuggcugggaagcacaggugggcuugggagggaugugcccuggucagggacaguuacagcgccacugucugugucucuagugguggcacaaaggcugaggaagcuagaauuuccugugaaggacaguggagaacccagugucccucgggcugacaagaaccacuucccaagacccacagugccuggagaggacauggggaagguaagugcccggaagccuggggucaaguccugcccucagggcugcgggcagccaggguggcauggugugcagggagcugccacaggguaggcggagaagcagcaccucucacuuuguccccaggggaagaguccaauuuuaagggccgggaguagaugguuaaagccuguugcuggcuuacuucauucugggaaugcuuucugagaggugggucgccggccagagcugucacucuuguagcuugaggcccaucuccuaucaccucccaguccaacagcgaggcccauacagaggacaccagugggguuuggugaagaauugcuuguaaaaaggggcuguucccacuuuccucacauaauauagaagugacuugccauaauuccucucaguuauuuccauucaagauaaaaauaguugcaaguuucucuguaacagcucagauguucuacaagccccauuggaugccacucuguguggaaauggugugaaaagccccaguucagcagucagugggugccagccacugccccagggccauucauuaggagggcgauuuguggcuuacagauacauucagaaaaggagagcagcagggcuuggcugccucgugcggaugccagacugcguuuaguucauggggaaaaaucugacauucucacacccauucuaguagguucgcuuagugaaaauucaaugaaguaacaucaaaaaggcugccuuuuaagucacauggcuuuucauuuuaugugaaccgaaaccaugaaaacguuuuuugccuuuuguugagguccagaaucgcagucacucaucuuagaacauucuugccuuccugaggggcugcacacuuguccgugggcagcuccagccguuccugcaguggccgcacagugagaggaagggcugggugaccacuguccaguuggauuccagggguggccagcccuuggaguccaugucgucuucacagaacugggccucagggaggagagcuuggcugaaggagugggagugacaguuacacauuuuuuaggccuaaaccacagacuucuuugggaagaaagggguuacgucuuccuacaaauucagagccagcugcucaugccaugaaugcgugguaugacccgaucugaguguggaucauugaggcggcccucccauggcugaccugcucagcucugacagggcccgggcugccucugcuagccgaggaguuacugagaauaaguugccguuacucgagccuuggucacugcagcaccuugucaggcacuucaaaucucaugucauccucacccacccuaggugguaggugcuaucauuguuuuuuggucccucaugaaucuccuccaaccccuggcaugucuauuugggaaucuuuuuuccaggaaaggaggcccaguggugcuaggccucugaggcuucaguucauuuaacucagaaaaaucccccgccccaugacucagggagccuuccaugcauuuguuucacuuaaggaaaaugacccgagggugagauggaaagggaauuggcuguugccaggcagagcccugugugucaggggccagcagccaagugagugauccaggaagucauccaauugcaaccagaaauuguucuuaaccccucacugucuagggugcguaguggacuugccaaucuguccgaauggggugagcgugagcgcgcugcuguugagagcccugggaacugucaguucucagccagccucagggcccucagggagccauuggacaucccuggggcugggcccgccacuugaagagaaaagggaaagggcgagagccagucucccuuggugaagagcgccuccuuggcacccuugaagucuguggaggugccucuguguuggaugucacauguguccacccaggcaggaucugccagggagcagcgagggucaccucccacaccuugcugccgcggguccggcagcggcucacuccuggacgggacacagggugcccccgcugaagcugcugacgggccuugucaggcagggguuaacaggggauuuguuuauugaaucaccaaguagcugucacaugauuuuaaucaaaacaccauuucccugacaacagugaugucagucuuguuauugcaggaaggagcagcugugagggacauucagucuccaugccgagcccagguuuggagacuaaaaucaagugaagcauccauaaauaauggcuacagacacugccugacugcgcccacccuccuccucuuccuuuucucugcacacagucuguccuguacacacacugacccgagaccagccccugcgccacgucccagcuaagaccaucuucugccuuccaugccccuucuacucuuguuucugguuuuuuccugccugccuuauuuuccccaaacucagagagucccuugggcccugagggucucugacuugugccuuucgaugcgggucucuucucuggauuuaaucagcaccugcuggugaaccaggcuguucugggccugaggcuggagccauucugcagcucaggaaccucacuuguccuagagccagccucuagcaucuagcugcauguccuguuccucccacagaguuaggcuggcagggccuucgcgcugcccuggggggucucaagggcagcucugaggagcucugcugggagugugugaaggggaggagcuccuuaagggccaaccucuuggccagcggauuuuguucucuugaacccagaaagacuacaggagaugugaguccagucaaacugaggacugaugacaaagaccaaagcccagggauguucagucccauccccaguggcuuccagcuaaggcaauuggaccuugaaguccauggggaagucagacguaggcuggugacagggcacacgggagcagguccuuaggcugaccuccugucagugcccucuccacuguggggccuaggggccgagcuguccgcacaaaaagacucccccaggccuuccaagucuuuuccacacuggagcuugaccuaacaguuggagauaaaaaaguccuccuaccugugacauagauucucagggauguucuuauguuugugguacccaugucugaugccuagaacucauuuccgaaaauucagaaauccuggggcagaguucccaguucuuagccugaagcagaugcucagaacagcacaaccacccuuaagucagugaagacagagcucacaggcaagaagcagccauuuucuguaccuaguguuggggcaggcaagaguuaaaguaagauaggcagagugggacucugugacagcccuccaggggagugggggucuuccaggagugccaggccaggcugcauuugccccucgcaguaaacccuggggugaaaccagccagccugugcuccaaguuaccacuggagacaccagccuuuacaaugauuugccuggguuaguggcagggcugagagggcgccaggggccgaggccucugucagagguucuuugcugccucccagaaugucccugccuggaggguggccaggugguggcucccgggcugggugggagccgggccuugcucucccaggcuugcucugugccuagcccuccuugccuggcccucucaucccugguucccuuccacugccugccugcccuucagcccucacuuugcuggcacaggggcacugcuaagcauuugggcucuguagcgacuggaaggcaguucuggcggaucccagacagaagagacaggcaaggcugugcgcuccgggagcuauguguggcgugcuuggaggaaagggcuuggugggcuuuuccuccauuccauugugucccacccccaacuauguggguggcccuggggugacaaugaacagucuccucagggucugauuugucagucagccccacucggggcauuucacuuuuggggagugaggagcuggagccagaacugucccagccgaccugaggagagagugacucaguucucccuuugagaagcucaaucccuaaugccucauuuuccucugggcccacauuuucugagcuuuucugcuuauccagcuuuugggggcucggcuccaggggaaguccgcuucccaugcuguggcucccuccugucuccacccucccagacacugugcuggcucgggggcucagcccagcucaugcuuucccugggcuuggaaucucucuuugccaauuucagagcagcucugagucagucugcccuaggaaauccccccagaaacacggacaaagggaggcagcagcaggaaggcuugcuggaaagaacaguggccgaggcgccuggcaagcucucugcccugccugaccuuggguuuggccugagugauuugugggcacagcuucauaccuggggggaggcaggugugccaguggccccugugucugagggagggcccagccccuucgccucagucaggacccacaucugccuccuaagggacguuguccaggaugauuccugugcgauaauccaucgcucaagggcugcucagcuuuugaagucacugguggggcugaaaugagaagggcagagcagccauguucugugcaggugacauuuccuuuguagccacauagcacccaggauuuagugcacaaagcccagaacuuccucccauggugcccacgggcugcuggcaagcaggaggcucccugucaccuggauccacccagggagggaugagaacccaucagcagggagggucccucugagcuuuguuuguuuguuuauuuguuuuuugagaugaagucuugcugugucgcucaggcuggagugcaguggugcgaucucagcucacugcaaccucugccuaccagguucaagugauucuccugccucagucuccagaguagcuaggauuacaggcgcccgccaccacaccuggcuaauuuuuguauuuuuaguggagaugggguuucaccauguuggccaggcuggucuugaacuccugaccucagaugauccaccugccucugccucccaagguguugggauuacaggugucagccacagcaccuggccaagaacuuuugagagagcagaggcugagucagggguuccuaacuuuggucccugguggggaggggggccucgggggcccaggaaccaacuccuguccugaaauucuguguccgaaguucugggucuguguacaugcucuuugggaauaguccauagcuugcaugucaaggggaucucugaguccucgauuuaagaucuaguggggcagaaagcagcugcucgccaggaacagaaccuugggcccuguucccaccuguccugcgucuugauggagaacuugggaagugcaggcacugcugucugguuccauccacugggcagaggcccuggguuuggggugcaggccucccugcugcucuccuuccccacccugcuggagccuucgacucacaaaggcugcagaacugaagaguguccuggggagugcgggguuggggccuagcuggccacuggucuguuauuuugccugcguccuggggcauuggaguuguuuuuggcaacacagaauaagaaugauggagaaaucuggugggaaagggaaaacauuguuacugaaauuuagugcuuuccuuaaaaaagaaaugaaacucagcaauacugaaauuuuggguagccaagggguaaccaccaguuuaaggcagaacugagcuauugucagcagagucaggcagcaguggacguugguggagagggcuccgcuccuuccagccucugccagugugggcccugccgacugcaccuucccaccgcuacccagagaccagcggcucaccccgcagggagggaacugucaauguucuauagcaugggcuuaauuggaaugguuugagugaaaccaaauuucagucgagauccugcugccagcaagcuggauauaacaguggccuuucacucagggccuggcacugaaacagguccaggaugcaggagagcagcuuggcacauggugccuccagcacccugagggcguggagcugggccucaaaagggugccccgcccaugugagggaaugcacugugugagcgcacgugcagugucgaggccuuuggcagaccccagagaagaugugacaucgugacuaaguagcagugucuuuugccuggcagcucgcagcaccuccccucccauuuccagccccugcccuguagcugccuguccucggggaccccugcaucugccuccccuccuccuaccgcggcaugaggcccuugcccaggcuaccugggcugaugcgcuuugcccugggacucugagaaucaaggagcaguaauuaagcagugcccagcagggcccuguccuugugcaggcugcgguuagcagugcuuccgucagcgaucugcagcggcuaacguguacucgggcgauucagagcaagguauuauuuacccugcugacgucaaugagaacauauuauccacuguccuuuucugcagccugaaaugagcaccagaacucagagaacacagccaccuuccauacucuaaaaauuccacccaaggcccgaugaggcaaaaacccuaucgcauuaaccugacauucacaucacccgggcucuuagaaaagaaguuguuuuuauuuuaauucaagaggguuggaaacauaaaaacaguacauuuuccuugcagaaaauuaccccauuuaaauuacuauuugguacagagauuauuuauuacacugcauuuuaggcaauuuucuaacauuaagugacaaguuauacuuuugauuuuuuuuuucacauuggagcuauuaugauuugcacucauaauaccaaagcuacugaacucaccaauuuuuuucuuaguaauuaaaaaaaagcacacagaaaauauaacuacaguuagauuaacuuuaucaaaaguaacucuuucagaccaaacauccagcaaaaccacccaccucccuucagauauaagcaaauaaucuugcccuuucuacaaagugcagauaucucuguaucccuuuuauuucucaaacugcaguccccgaagugaagcaaaccuuucucuccacuucuuuccccuucagagauuuuggugaaggcagguuucucuuaccacccaugguggaaaggucucaccacuugaauuuccuugacugagcaaaucuucugcagacagacaccacagagccagcagcagcccauuaucugcacuggggaaugugacauuauuccaucuggggucauauguuuccaggauguuguuuuguacuucuauuuuuaaagcuccccucuacccacccacuuugccucugaaaagacagaguauuaagucaaagucuguuauuacuuuuuuaauccuaaaaguaauaagcacuucuaguugauggggcuugacuguaaggaaauguuacgccccucguugagacaaaggcugaguucaugaccguuccugggguggaaucugcuggccugcagugguggccugaugccgugcgaugcggccccuuggcaauugaggaaggggguguucuguaggaaacugcuguauuguaacuuggaaaaacuagacaucuuugaggugagccuaaacuucugcaguuaacuggacgcugaaaggcaggcgggucugcgggguuuuugucucccucagccugguucagugcacggccaccuggacagcugcacugucaccugaaggcggccucuuccccaaagccaggcggcuguugaguggagaauaagguugugggaacaauaucacauucacccugugcuugaccaaaaugggggcuuuguuuauacagcuguuugcuuaugaaaagagucagaugcuacugaggaaagagaagggaaagagagggcuucuuccagcacuagaagccagagaaccaaaaccagaagccagucaacccaagcgcgugucccagcuccuucuaucaccagcugugaucucagagaagucacaaacuucccaaagcuuugguuucuucagcugugaaaaauaaggacaguaucuccccagcuaauuucauagaauuguugugaggguuagaagagaaagugcuugguaaaacuaauguacaaauauaagcuauugcucccuugugggugggcgagcagaguaucugggcagaacccaucacagcucucccugggugggucugcgagcacugcugccgccugguucucuaucugugccccagugugugccugagucugcugauagguugaaaccugccuggagaagauguggacacaaggugggggugcacguaggauggcugucuucuagaaucagcuaggcuaccuuaauuaggacaaaaaugguaaaauaagaaugugagaggcuacuggaaggugagaggcuccacugcuuucguucaccugccaccaagggccagacaagggcucugacauuacaggugcuucagaccacacuguagaaccugucagaagggagaugauagaaacuuuaagaaaaucucuuuguccaguuuagaaacagaggcagaugauacugcucuugucuuuuuuuuuuuuuuugagguggagucuugcucugucgcccaggcuggagugcaguggcacgaucuuggcucacugcaagcuccaccucccggguucacgccauucuccugccucagccucccgaguagcuggaacuacaggcgcccaccaccacgcccggcuaauuuuuuguauuuuuaguagagacggcguuucacuguguuaggauggucucaaucuccugaccucgugauccgccugccuuggccucccaaaguguugggauuacaggcgugagccaccgcgcccggcugauacugcucuugucuuucauacauugcucugaagauaaguucuauaaaaaaauuccaggucgggugugguggcucacaccuguaaucccaguacuuugggaggccaaggugggugggucaccugaggucaggaguucaagaucagccuggacaacauggugaaaccccaucucuacuaaaaauauacaaacuagcuggaugcgguagcacacaccuguagucccagcuacuugggaggcugaggcaggagaauggcuugaacccaggagguggagguugcagugagcugaaaucacgccacugcauuccagccugggugacagagcgagacucugucucaaaaaaaaaaaaaauuaaauaaauuccagaagcaacaaaaugaucaaagaucccugccuguacaaugacuccaacuuacgagcuucccuguucuccaauuuucaccuuucauguuuaggcacaaagagaccgaguggcucggguggcuucccaggaggcaguuagaggcagcccaguuuaggaguuugaguguagcaggucagcccuggcaccggugucagccacuguucacagggacugagacugugaaaugacacacugcauauugucucuauaggaggucgaaugggaaaaaguuaccuggaguaugaauuuucuuuaaaccaauagggagcuuaaaugugacuguugauacagguuuuaaaauguaauacaaacauauuuacgaaccuggggcuugacuagaggcuggaggaccccaaaaaggagcgccacucacucacuguguccuugcauccucaacugcccgcaugucuccagaggcugcuuagugcccacacgccugggaccaacugugacuccaggcugcugcuugucaccuugccuuaguuucuggcugaucaccuaaucacucuggagcugagaauauccuucuccccacaucuaacccgugggcagaauucugugagcguuucccugccuuuaggacugaugacacucgguguguggguggaggugggggagucgucagucuuaugaugagucucuucugcuggagacuuugguccacgagagaggguagggggcaggggagaggccgauacuccuacaggggggguccccccuugcuccccaucaaaaugcagagcaccccauuacuccagcaccagaguugggaagggacacaagaggcaagggcuggcuucagucuugggcuccugucugucccaaccacugacuccagcauacgguuuaaacacuugggaguucuugauaucugaggaagaaagggccacugacuuuuucuuuccuaggaggcaaaaguggauggaagagagaagggguuugcucagaugggcaugaacagccccugagccccauccccacuccccuggugggcccugaugcucucccacgcagggauucucaagguggaugguguagagaaccaucagccuccuuuucccacggugacagaaggcagugcaggcagagguggcgagggggcagcuggggacggucagugucaccgggaaugugaaagugggcccccucuuccugucgggcuaacaugcuguuugccuuacagggaccaguguaucaguugcguggagauacuagagacacacuugcccagcugggaauugcagagcuagugcauuucucccaaagcacagacuaauaccccagauuuaaaaaaagaacauaaaaaauaaaguaccacacauauugcacuuuuugccgaacgaaauuuuuaccucacguucaucucaccaaagucucuucagaggagccugguuuacagggugaugaagcugaugaugauacaguaguguacacacugcuaacgugaaucagacuggaaagcaagucaguacuucagaguagccccgcagaaaaagagcgauacuaagccuucuuaguguuuuguuuguuaguagugaugaagagaaaacugcuuggaagcuuccaugggucacuaguuagggacagagcagcacaggugaucagacagggcugagcaaacaccugacugaccaacagaaccagucuccucagcagcuuacauugcagucaauacagaggguuauggaauuuauugauuucugcuugaaauaaacaagauaagcaaauaggagcuuacaacacaggucccagcaggaggggucacgcucugcaucaggccgguguccacgccgcugccgugugugacggauccugauaggccuggcugcuguagggcaccucucgauuucucucuggguccuuaaccuuccaguagccucucugcagucccucaucggcuggccuaaccguccugccauagcucccaggucuccugggcuaagcagcucauggcauuguuggggggcaggaguuuaugucgaucuguaacuacaccauuccugcaguucugaaaugaguggcccccauuuucaaucugcaggcauuuuaauaucgcaaauauuguagcacuucuguaguauauuuugggaaaacgucuuccuucagucuaaacaaaucaagccccauuuuauaacuggcuauuuuguaaagacucaaaacagauuagagaucuuaaugaaaugaucucuuaaaugaaaugauguucuuuauuucacgaaaucaucaaucuuaagcacgagcaggaauaaacaacucccagaagaagcuuaauucauucuuccuggauuuucacuguguguuauuaaaucacaaaaaugacaguccccacacugcccuuucccacugacaccaaguccaaccgugagcacagugccucugcgaagcauccuggcacccauggugagcgcuggcgaccaggcagucucuggccagcaacagggacugcucaaguuaccgacguugguaggagcugggcucgcauggccagaauggaacccccuagacuuuccacacgucaccugccugaacgcuaacuacaaagaggaaaggcaacuuaaagguguuuucuagaugcagcaucaguuagucccucucuuugugcuuuaaggaagaugcuuugugcuuaacacauucaucugcugaugggacaagccauucuaaagggcagaaaugaucaucuuuagaauuaacacugacuuuguaacaccuggauguuaacuguccaaauggcaaauuauucaucauuucuagggauacaguuagcuagcuguagcaucuaauuuuuacuuacuuugaugacugaauuguaaguguugguuaaguuuuauuaguaauauaauguuuggcagaugaucugc

SEQ ID NO: 21457 - RNA, 146065 nt, Homo sapiens
uugaaccggaagcgggaguagguagcugcguggcuaacggagaaaagaagccguggccgcgggaggaggcgagaggagucgggaucugcgcugcagccaccgccgcgguugauacuacuuugaccuuccgagugcagugguaggggcgcggaggcaacgcagcggcuucugcgcugggaaauucagucgugugcgacccagucuguccucuccccagaccgccaaucucaugcaccccuccagaguggcccuugacuccucccucuccucacuccaucuuuccuggccucucuccgggugcuuagcggacuuggccaauaaccuccuccuuuuaaacgcccugaauugaacccugccuccugcgcauccucuuuuugugucaccuuaggguucagauuuaacuacgcgacuugacuagucaucuuuugaucucucucucguauuuaguacuuuuagucagcgagcauuuauugauauuucaacuucagccucgcgguuaagagcuugggcucuggaaucauacggcuggaauuggaauucugucagucguguggccgcucucuacugucuugugaagauaagugagauaaucuugaccuguggugagcacucgugagcguuagcugcuguauuuaccagguacagauaagacaacuacaguggaugauaauguauguggugauaggggaguacucugaugguagaggagugacuuugguucucugcaaacucagccugagacuaucaauucaguuuguggugagaccucgcaguguuaccuuggcagaugguagaagccuuccagauggaaggaaaaaugcguguaaaggcacaaaguguagaaggacccugaagcuccagcgugaggccuggcauugaaugaaauauauuuuguggguuuucagcugcugaagucauaggaauggaugagaccaagaaaacaaagcuguuuuugagguaugagcggaagaagagauaucaggagacuuucgaaacagucauaacggaaguuaauaugaucauugcuaacauuugcuguguuucaggcacuguaagcauguauauggguccuuaaagggacucauagagguagguacuaguauuguuuuuccuuuuaucauugagaaacugagguuugaagagauuagugaacuugcucuagauuauacaguuuguaaguggcugaaccaggauuugaacuaauacaaucugacuacagaggccacacuccuuagcacuagaaaagaauggcaugccaagggcagaguuauuucuaggaagaugggauauaagcgucauugucaaguugugcaaaggggucaacuugguugagaucuaaaaaggaacacugaauucgucaauucagaggcucguaggaaguaggaaauccuuaucuuuucguuugaaccuugaguggaaccuagauauucuggauuaauguauaaaugaaguucaucuuuauauggugacacucauacucuaguugacuaccuaauaguuccucugccuucuuucaguuccgccaacauacuguguucuuuaacauuguagaacccuuuggcuaugcuagucuccuucccugaaguguugguccucuagcccuuuuuuugauuggcaccaguuaguucagaucuuggcuuuauuauaaacuccucugagauauauguucccugacaguuuaucuaaaaugauucucucuacaguuauuuucuauuacuguguuuuuguuuccucagaggcauacaucacaauuuggaauuaugcauugguuuaucaauuuacuuguuuauugucacccugcugcccagauaugacuucaugaggguaggauuuguaucuguuuaguucauuauuugucuagcuauaaguaguaaauauuguuugcaucuaucagugaaugagcaucuucuguuuauguagauaauacugaacuguuuuguuuucuucaaaguaaucauuaagcugaagguaagaaaaacaaguucaaggaagucacaccauggggaaaaaaaagucaaguuuagggcugccucuuccgggaagugucaaaucuuuaguauauuuaggaauaaaggugccaaaccuuaugguucuuuggauauugcuaagguauuuucauugguuagauuaccaguuucauuuuccuuauugacucaagagggcuuuaaacugagauugaagaaguaagaagauuccuagauaaaaccauaaggaauggaaaaacaaaaaugauaauacuuguccacaggaaguauauaaucaaaugaaaagaacucaaauaacaaucuguaaucuauagcagaguaaagcggaaguuguaauaguguugggggaugggggaagucagaagaaccaccagugaauauaaaaggagaagagaaucagagccaucugcuaauaaaauggguagucagcucuuuuuguuuuuuuugucuuguuuuguuuugagacagucucgcucugucgcccaugcuggagugcaauugcgugaucucagcuaacugcacuuuccgccuccuggguucaagugagucuccuaccucagucuccccaguagcuaggauugcaggcacaugcuaccacaccugguuaauuuuuguauuuuuaguagagacgggguuucacgauguuggccaggcuggcuggucucgaacuccugaccucguggaacgcccaccucggccucccagagugcugggauuacaggcaugagccaccacgccuagccccgguagucagcucuuacugagaauauucaaagacagggcauucauuuuguaagagacauuccuuccuucauaggaagauuggaccuggucuuuuaguuccucccaauuuugagauucugugagauugaaucggggcagagaaacauacuuaaucuugaaagauuaaguagaauuuagauggauggauaggagaaggacuuucccuaccuuuuuacuucuugagauauaguuauuuguagguauaauauacauaaauauauguauuuuuucucuguuuacagacauucauaguuuaauaaaaaacuucuuuguauuauauaaagguuuagaucagaacuaguaaaacagaaugcuguuucuuuuuuuuucuuuucuauuuuacuuuagguucuguggguagaugugcggguuuguuacauggguaaauugcauguugcugaggcuugguguacgaaugauccugucacucagguagugagcauaguaccugauagguagcccuucaagccauaccucccuuucuuuccaacccucaaacaguccccagucucuguucuucccaucuuuguguccauguugaaaugcuguucuuacuacauuuuuuugaaggacaucaaaagagaguuugauuauaucagaagcccccaaaagaagagagcuacucaguggaaucaaggcauaguaaaauauaguugauccuugauauuugcaaaggauaccaccauagcauagaauuugcuucauuuccuuuuaaaacagaaaugucauuuuacuccuauuguuauguguuaaauaagaaccuuaauaccaguugagauggaagugguagacaaagcuuacuagcucugauaaccuccuacuuaucagcuccaaagcauguuuuaagccuuuggcucagcaaaaugacaugucucuccauauaagcaagagugcuuuuuuuuuuuucuuugagacggagucuugcucugucaccaggcuggagugcaguggcgcgaucuccgcucacugcaaccucugccuccuggguucaagcgauucuccuaccucagccuccugaguagcugggacuacaagagcacacuaccacgccuggccaagagugcuuuuaaauaguucauugucaauguuaaauccuugagugcucauuuccuuauuuaccuggcuguuuucuauucaucuuucaugucucaauuuaaaugucauguuucuuuggucucagaguaauaaaaaguaaauauacuucccccaucucccgccccgcagagccuuccucuguugcccaggcuggaguacaguggcucgaucuuggcucacugaaagcucugccucccagauucaagcgauucuccugccucagccuccugaguagcugggauuacaggcgcgcgccaccaagcccggcuaauuuuuguauuuuuaguagagacaggguuucaccauguuggucaggcuggucgaacuccugaccuugugauccucccaccuuggccucccaaagugcugggauuacaggcgugagccacugcguccaguguaaauuauacuuuuauuuuaauccugcuacuacugcaagcaaggcaaacauuuuuguguuacagcauuacuuguauagauuuuaagaaaaucucauuuuaaauacggaaauguuaagaaaaauuauugugccuuugaccagaaugugccucuaauuguacaguuaaaucuaacuauaaauacugcaguauaaaauaauuauauacacauuuuuucacaccucuuucucucuauauaugcauauauacauauacauauauauaccuauauguauuuuuuuuacagacagugauguguguucugaaauugugaaccaugagucuaguacuuaaugaucugcuuaucugcugccgucaacuagaacaugauagagcuacagaacgaaagguaguaaauuacuuaaauucaauuuuuccuugaaauaagugugauuaguaacccauuauuauuuccuuuuuauuuucagaaagaaguugagaaauuuaagcgccugauucgagauccugaaacaauuaaacaucuagaucggcauucagauuccaaacaaggaaaauauuugaauugggaugcuguuuuuagguauucuauucaaauuuauuuuacugucuuuauuuuucucuuucauauuuauuucuguugugauauuacuuuuguguguaagucuuaacauuuaucuuugcuuccuauauaucauuaugccuugcauaugaauuuggcauuuaauauuuauccaaaacauaauuuuuaaagguuguucauauagaaacuuaaaaauuauaaauuauuucuucaauaaaauguuuuagacauaucucacucaaaauugagagagaauuucuuucauuuuaguuaguucacaagacuucagauuagaggaaaaaauuauaauaaauguuaggauauuauuuucacaccuuuaaauauuacucugauuauaaguaaaugcuguguguuaaauuguaauaaaacaaguaaaaggaagauuggaauacuuguguaugaauuugguuaaaaacaaaaaauaccucgaacaaugaaaaaacacaacugauugcuggacaggaguggcaaacaggguugaugcauuuuuacauugagacaucauuuucaaccgugaaauccauuuauaacuagaaacagauuguaaggauuaggaaagaugaauaaaguauuuuaaauacugagaguauuaaauaaacuagaaauaacauuuguagucaagaggaaguguguauuuaguuguccuucaguguuuaugacagauucuguuuuauuuuuagcuccuguuugguauuagauugacuguuacagauuugaaagcauauaaaaugaaacaugcaugcuguuuuuccucugauuuucuaguuuauuuuaaauaccacaaauauaauuacaaccugaagaugaauacuauuuuguauaagcugaucugguaggucaaauaugcacccagcauuccuggcuaguuaugaauaucuucuaggcaggcuuaauuuauuggcuggcaacauuaccaacugccuaagaaacagguagauccuguacagaauaacagaaggaguugagagaggauugagaggguccuuacuagcauuguaagcuuuuaaugacaaauuuagaaaacaggcaguaaagcaauagaaagucauagaagauuaagagcuuugcagaccagauauuaaauuggucuuguaggaguuaggccuugaaagagagauuuaauuguuuuauuuguuuuuuucagcugauguaguaaucuaagcaaggugguuuaaaaguugcucuuugugauggcaugaacagcuuuugaaauuauuauaauuuaaguauucaacgaguuucugaaauugcauuuuguuuucuugaagauuuuuacagaaauauauucagaaagaaacagaaugucugagaauagcaaaaccaaauguaucagccucaacacaagccuccaggcagaaaaagaugcaggaaaucaguaguuuggucaaauacuucaucaaaugugcaaacagaaguaagugauguuauaaauuauaaauaaauggcuuaacagauuacugucgcgugaguuuuuuuuuuuuuucagaucauuuuaaggacuuaacuguugcauaaguuuguucuaaauagaauaagauaaaaguugaguguaaguacauauaaugauuuuuauuuuuauuaaaagguuuuuuuuuagggcuagucaagugaagcagugggaguuuagaaggaacaaagaaaucuguaacugguugugaucaauucguuguaaacaccacugcacucaggccagccugauuuuuaauauuacaaguucaaauauuuggggaaauuuaugcaagcauagaaugacagaaaucugaggauugaagggauuuauuuauuuaagagauagggugucacucugucacccaggcuggagugcaauggugugaugauagcucacugcaggcugaagcuucucuguuccuaagugauccuccugucuuggcuuccuaguagcuaggacuacagaagugcaucaccaugccaggcugauuuuuuuuuuuuuuuuuaagagguguuauuucacuguucugcccaggcugaucuugaacuccuggccucaagcaguccucccccugcucagccucccuaguuauugguauuacagaugugagccaccaugcccagugaaggaauuaaaaauuacuguuuaaacuacccagucuuggaugcccucucuacgucccuagccuuuagguagaagugcagucuucaugauugaauauacuuucaaggcuuucuuuuccaucuuugaauagcauuaacaguauuaaaaacuggccaggcgcaguggcucauuccuguaaucccagcacuuugggaggccaaggcaggcagaucaccugaggucaggagaucgagaccagccugaccaacauggcaaaaccccgucucuacuaaaaauacaaaaauuaauugggcauuguggcgcacgcuuguaauuccagcuacuugggaggcugaggcacuagaauugcuugaacccaggaggcagagguuguggugagcugagauuacgccacuacacuccauccugggcgacagagcgagacugucaaaaaaagaaaaguauuaaaaaccugucuuuuguuacugcuucucccuucugagaguauaucaaaaacuccuauuuauguuuuuagugugacauccuuagagauguuugaaaguagccacaauauuuccuaaguccucaucucuaaaguucauaaucucacuuucuucagcucacgugaccuagguuuuaugcuacucuccucugaauauucuucacuuuaauugucugucuuaaagugugggccucuacuuacagggaagaggccagaaaaacaaacaaaaaagugugggacucauuuuuuuuaauacaggcucuugcucuguagcccaggcuggagugcaugcaguggugcaaucuuggcucacugcagccuccgccucccaggcucaggugauccuccugccucagccucccaaguagcugggacuauaggcaugggccaccaugucuggcuaauuuuuguauuuuuaauagagacaggguuucacuguguuggccaggcuagucucaaacuccugaccucaagugauuuucccgccuuggccuccugaaaugcugggauuacaagcgugagccacugcaccuggccaggacucaaucuuuuagguauauucugauuaguacagagugaagcaauucuugcuuaucuuucauucuguacucuuacugauuaauucuaagaucaugugagcuuccuuggcugucagaaccaacacuuaacugacauuuuacuugcuaugauuugaggaaaaaaacaacccccaaaaauauuuuuuucuccugaugagccaaauaguucccaucuuuaacuuguacaauuaauauugugaagaguugauuuuucggaaccaaaaugcaggauccuggcaagcuuuuguaaggaaaugggcuuuacacauacugaaaagcuagaggcagaaguguguguucagggacuccugggcucuucacagauaaggauguugcuuugugauaccaacucuuaauuuaagaaucaggagugugaggcgcgguugcucacaccuguaaucccagcacuuugggaagcugaggcgggcagaucaccugaggucaggaguucgagaccagccuggccaauauagcgaaaccccaucucuacuaaaaguacaaaaaauagcugggugugguggcgggugccuguaaucccagcuucucgagaagcugaggcaggagaauugcuugaaccuggaagguggagguugcagugagcugagauugugccauugcacuccagccugggcaacaagagugaaacucugucucaaaaaaaaaaaaaaaaaaaaaaagaaucaggaaagcccccaaauugguaaauauuuaguagaaguaugcagauuauuagugaauauuucagauuggugguaugagacuugaguccaaagaauaaugguuuagucaauuuucuaccuccucugagaugcgaguucguguggauagcuucaaccccuugucagagacuccagcagagacaaaggaaaacuacaccaaaauauucugcacucacuuuugcucuguguaguagcuuuguauccaguaaaauauuuuauuugcuaauaaugcugggauauaguagguacuuacugaaagagugaaugagagaaagauaacaugucaauuuuguagcccaccagaaaaguuugcaauguguacaguaguuuugccuugcagugaacaaaccuuuuaauugcaacauuaacaauggagauuacguuugaaaaugcaucagccuguugguuuauaagaaauaguuggugaaauuaucaaugcuggucauguaaguaguugaaaauuuguuuuuuuauuuacggcuuccuuuucuuucaaauuugacuuuguuacuuaaaccuuuuuaauauuggggcaaaaccagggaguuacuauucccucaccccacuucaguuguuuuuguuuguuuguuuguuuguuuuuuacgaaaagauuggaggguugauggaaauuuaacauaugucuaaacuuugccauucuugcuuagcauugguauccaagguaugaugaaagaaauagagauuaguaaaaaagaaguaaaaggcagcugagaagaaacaaguaagcaaauauuguugauuucucuccuuuuuuuuuuuuuuuuuuuuuuuuuuuuuugagacagagucuugcuuuguugccuaagcuggagugcaguggugcagucuuggcucacugcagccucuucuuccugggcgcaagcgauucucacgugucagccucuagaguagcugggacuauaggcacacgccgccaggcccgguuaauuuuuguauuuuuaguagagacgaggguuuugccauguuggccaggcuggucucaaacuccuggccucaagugaucugccugccucugccuuccaauaugcugggauuauaggugugagccaccacacucacacacccagccuacuguucauuucuuuucuuuuuuuuuuuuugagacagaguuuugcucuuguugcucaggcuagagugcaauggcgccaucuuggcucacugcaaccuccgccucccgggcucaagcgauucucccgccucagcuucccaaguaacugggauuacaggcaugccccaccaugcccagcuaauuuuguauuuuuaguagagacgggguuucaccacauuggucaggcuugucucgaacuccugaccucaagugauccaccugccuugucaucccaaacugcuggguuuauaggcgugagccacugugcccacccuguucauuucuuuauguuagcauuugucugcuuuuguacaaagcuuaaauagagucuagauagugcaaaacucagcugcgaaaaauguuaaguuccauaagauuccugaaagucucuguaaguaggcugggcacaguggcucaugccucucuaauccuaguacuuugugaggccaaggcaggcagauugcuugagcacaggauuuugagaccagccuggguaacauggugagaccucaucucuacaaaaacacaaaaauuagccaggugugguggugaccaccuguagucccagcuacuuaggaggcuuagggaggaagauugcuugagcccagggggcagugguugcagugagccacgaucaugcuauugcacuccagucugggugacagagugagauccuguguccaaaaaaaaaaaaaaaaaaaaagucucugcaggcaacuuaguuguacuuuuaagaaagauuugaucccagaaguuugagaccaaccugggcaacauagggagaccccaucuuuaaaaaaacuaaaaaaauuagcugaguguaguggugcuugccuguaguccuagcuaccugggaggcugacauggguagaucccuuaaguccaggaggucaaggcugcagugagucauaauggggccacugcacuccagcuugggugacagagcgagauauucugucucaaaaacaagcaaaacuaugaaaaaaaagucaacauuucuugaaauacuucucauauuugguagaggagggagauauauugggauaaaggacauaggaagauaggauuuuauuauaauauuaauuucuguaguuauucaacacaaauuaauuuuuauugagcauuugcuauuagggcagucacugggcuuuuacgucagaauauagagauuaauuccuuuccuuaaggaucuaaucauacaauggauguuuuagauuagaaaaauguuacaaggacuauaagagaaaugcacaggguacuagaaaaaaggaucacaugguugugcauuucauaacuggacaaugccuaaaauuaugaagugagccauaagugaagaugauuuugcaguuauaucaguguauauuuguuuaccauagccugugaauauaacuaguuucaucauaggaaaacccuaauccagaauauauucauauuuacaugaguuguguucugcucauaguuauggcaauaaauauauucaauuuuaagauugucaguauggaaaaauggcauuucugcugugacguaaauauaauuuacugaaaaugauaauuaaauuauuuuuaaauguaauuuuguuaccuucaagaauauguguguagucaugccaaguuuucagaaucucuaguaaguaaauaacaugcuguuaaaaaugacacagguacaggggucaagcacaguggcucauaccuauagucucagcacuuugggaggccaagacaggagaaucccuugagcucaggaguucaagaccagccuggggaacauugugagagauucugucucuaugaaaaauuuaaaaaauuagcugggcaugguggcacaacaucuauagucccaguugcucaggaggcuaaggugggaggaucccuugagccugagagguugaggcugcuguugggugugaucaugccacugcacaccagccugggugauagagcgagacccugucuuaaaaaaaaaaauuacaaccugagguguuuguaugccauaaaugcuauuauaggacuuagaacuaauuuugcuuuccaagguaaauauucuccuuguaaucuuauguuauucuaauaaauucauucuucauaaagagugccaaaaaacuugggaucauuuuuggucuaacaccagaaauugugaauuauuaagguuauaauuguuuaagaaugauugcuuuucgagaugagcagaucacuugaggucaggaguucaagaccagccuggucaacauggugaaacccugucucuacuaaaaguagaaaaauuagcagggugugguggugcacgccucuagucucagcuacuuggaggcugaggugggagaauuacuugaacccaggagguggaggcugcagugugcugaguuugugccacugcacuccagccugggugacagaccaagauuccaucucaaaaaaaaaaaaaaaagaaugauuguuuuugcuauauauuccuauaaaagaggcguuggcaaacuuacuguguaaagaggccagauaguaaauguucuugacuuuauaggccauguggucaccucugucuuaauuacaaaagcagccauaaacaauaaguaaaugaaugguugugacuauguuccaauaaaauguuauuugcaaagaaaaaaaaaaugaauuuugcuuggggccauaauuugccaauuucuucucuacaaaagaaguuuaguuaauaguaauuucccaaauggaauuauuuaaauaguugccauuccaagugucuuauuuuuguucaaauuuauguuuuucuuuauuuguuuauuuugaaauaggagcaccuaggcuaaaaugucaagaacucuuaaauuauaucauggauacagugaaagauucaucuaauggugcuauuuacggagcugauuguagcaacauacuacucaaagacauucuuucugugagaaaauacuggugugaaauaucucagcaacagugguuagguauguuuugaagguuguuguuugugaauuuuuccucaugaaaugaaacuucaccaaagaaagcacucugucuguaucugucuauaucccccaagugaccugacaguuuaacaguacuuuaguaaaauuauaugguuaucgaacugacccuuaauuuuuauuuauuauguagcuuuugaauaaagucaugaauaauauaucaggugccugauaucagagccggaauuacaguugaaaaauaccaucuccaucgucaaggaguugacaguggcagaagaaaacccaaguaaaccagaguucauaaugugcugugauacagacauauuuggguucaguagguauacaaaacaaugacaccuaaacucaaccaugauuuaaguagaaagggagaaaaccaagagagggaaguaccauaaaagugaaagcaggcagggugcaguggcucacgccuguaauccuagcacuuugggaggccaaggccgguggauugcuugagcucaggaguucaagaccagccugggcaacauggugaaacucugucuuuaaaaaaauagcggagguaauggcucuugcuuguagucccaguuacuugggaggcugaggcaggaggaucaccugagcccuggagguuaaggcugcagugagcugugaucacacugcacuccggccuccaugacagagugagacccuguuuccauuuaaaaaaaaaaaaaaaagugaaagcaagagaguugaaaguucaaaggggcguggccaacauuuuaaguguuguagaaaggauaagacacaaaaguauccauuggaugaggcaguuagcacgcuacuucuaagguaauggaaaucaaauauauuagaauagaaugcauuagaagacaauguacagaacccagugauucauuagauguguagagugugugcuagggaggaaucugguguuguuuccuguuuauagcugggagguacugagagaccacaaaggaaggaaguuauggucagagauugaaauacuucaguuuguugguuucaaagauggagcauuucuggguuugagaauaagugaaaguaggauuugacauuaacaagaugauuuuaagucaggugucaaagucuucuaauacacgaacucuaaaaguuuagaagcuuuuuuuuuucauggaaaguauuuaagcuaaauuuugcuagcuaaauuaaaagacauuuguccauauucuuuauugccauuuuauuauuucaaaaugagauacaugugaaccacaaaacuacuaccuaaucaguacccucacuccugcauuacacucuacuguuccccugagaauaaaugccuucucagcuaauuucuuaggagucauuuguagccuuuacguuacucugaacacaagauaggcugugucuguaacagggcccucaacaagccuagagacagccuuugggaauaggcuggugauaucuagguuaccuaaccagaucuuuccccaguauggcuggucauauuuaggucauuuuacauuaucacuuacaaccauggcugucacugaaacaaaggcagucuuuccccuagucugcuuacuauauucugucaucuaguuuguucucugaaacccccuuuuuauuuuuaaacuaacuacucuuacuucuuuuuuuuucuuuuuucuuuuuauuuaagcuaaccuuugccacuucuucccggauguuacuucuuauaauuagcuuuuuugucaaaguauuuuuuuacuuagcuuccuuuuaaaacuugcuuagaugaggacucuguggaagaagcgaagucugugcucaaaauauauauuugguacagguggugacugaagccaugacuauggaugagauuuguauauagaguuuagugugagaugagaagaauggccuaagauugagucagcauuugcauauaaauuuuggaaucagcuuacugauuucuacaaaagaucuugcugggauuuugauacuaauugcauugaaucuguugcacaauuugagaagaauagaaaucuuaacaauguggaguuuuccaauccaugaacacuguauaucucuccauuuacuuagguuuuuuuuuuuuuuuuuuuuuuuuugcuucuuuguuuguuuuuuugagacagagucucccucuguugcccaggcuggagugcaguggcacgaucucaccucacugcaaccuccaccuccuagguucaagcgauucuccugccucagccuccugaguagcugggauuacaggcaugugccaccacacccagcuaauuuuuguauuuuuaguagagacaggguuuccucauguuggccaggcuggucucgaauuccugaccucaggugauccaccugccucagccucccaaagugcuggguuuauagacuugagccaccgcgucuggccacuugucuuuuuugauuucuuucauuaguguuuuauaauugucagcauauagauuuuuuguuguaaauugacaauuuuuuuucuuuaauuuuauauauuaaaaaaaauagagacaggaucucacuguguugccuaggcuggucucaaacuccugggcucaagugauacccuucccuugaccucccaaaguguugggauuauaggcaugagccaacaugcccagcugcaaauugacauuuauuuauaauuguauaaacauaaagauuuuguauauguuuuguuagauuuauacugcaguaguuuguaauugcauuguuuuuaacauuuugauuuucaaauuguucaaugcacaaaaauuauacagaaguccaguuaauuuuuguauagugaccuuguauuuugggaccuugcuaaaaucacuuacuaaaucuaguagcuuucuuugaauguucuuuuggauuuucuuuguagacaaacaugucuucuguaagcaguaauuuuuuuuucuuucuuucugagccauguggcuuuuauuuuauuuuugugcuuuauuacauuggcuaggaccuccagugugauuuauugugguaaaauauauauaacauuuauaauuuuaacuuuuuuaaguguacaguuguguaguauuaagugcauucauauuguuguguaaucaucuccaccauccaucuccagaacuuuuuuuucuauacucaguaaacaaugauuuaccauuuuccccuccccuauccccuggcagcuaccauucuacuuucucucucuaugaauuuggcuauuugggguacuucauuuuuauggauugaauguugugucccaccaauuauguugaaaucuaacucccaaagggaugguauuuggaggugugggauuuaggagguaauuagguccuguggguccagccuucauggaugggauuaaugcccuuaugaaaagaggccagagagcuaacuugcugucuuucugccaugugaagauacaguucaaagucaguagucugcagccccaaagagggcccucaccagaaacccacaaugcuggcaccugagcugcuuucagccuccaaaauugagagaaauaaauuucugugguuucuaagccaccuaaccuauaauacuuuguuauagcagccugaaguagaggacuccuauaaguauuuguccuuuugcaaccugcuuauuacacuuaccaaaaugucuuugaggcucaucaguguuacagcuuuugucagaauuucacccuuauuaaaaacugaacacuauucuguucuguguauaugccacauuuuguuaauucauucguccauugguggacauggguuguuucuaccuucugauuauugugaauaaugcugccgugaacaugaguauacaucuccugaguuuccugcuuucagucuuuugauuauauacccagaaguagaauugcuagaucaugugguaauucuauauuuaauuuuuuaaggaaccaacauccuguuuuacacaggagcuacgccauuuuacauucucaccagcagcccacaaggguuccaguuucucuacauucucacuagcacaacuaauagaaaaugaggauuccucuucuaggccuugaaagugcugcauaauuuugcuucuuccuaccugucuaacuuaacuaaagcgcuucuaauuucugugcucaagcuacacugucaauuauucaguuucucaaaccuagugguuuccauuuuuuuaaauugacuuuuaucuuuuagaggaauuuuaaauuuacagcaaaacggaguggaaaguccacuggacacacacagcaugcccuacugucaacaucuugcaccagugguacauuuguuaccaucaguaaaccuaugcugggacacaucauuauuauccagaguccaagguucacuuuuggugguacauaugcuauggauuuugacaaguguuuugacauuuuuaaagaucuuuuucuguaucuaaugagauggucauauuuuuuuuuccucugggagagaaugguaacaauuuuucacuauuacagaaucauacagaauacuuucacugucagaaaaauccucugugcuucaccuuuucaucucuuccuucuuguaaacugugggaaccauggaucuuuuugcuaucuccaugguuuagccuuuuccagcaugucauauacaguugugcgucucuuaacaauguggauauguucugagaaauacaucauuaggcaauuucuuuguugcgugaacgucauaggguguauuuauacaaacuuagaugguauaacacuacgcaccuaagcuauaugguauuacugcuccugcacuacaaaccugugcagcauguuacuauacugaauacuguaggcagcuguaacacaauggcaaguauuugugucucuaaacauauauaaacauagaggagguacaguaaaaguauaguauaaaggauaaaacaugguacaccugucuagggcacuuaaccaugaauggagcuugcaggacuggaaguugcucuggguauguaaaugugugguaauguaaaggccugggauacuauauacuacuguagaauuuguaaacucuuauucuguaccaaauuuaaaaauuuauguuuuucuuucuucaauacuaaaguaacauuagcuacuauaacuuuuuuacuuuauaaacuuuaaaaauguuuaaacuuuuugacucuuuuguaauaacacuuagcuuaaaauacaaaugcauuguacagcuguacaaaaauauuuuuuccuuauauacuuauagauguuuuuucuuuuguucuauaagcuuuuuaaaugaaauuauuauuacucuauuuuuuccuuuaaacuuuuuuguugaaaacaaagacacaaacacacacaugagcuuaggccuacauaaggucaggaucaucaguaucacugucuucugucccugcaucuugucccccugggagaucuucagggacaugcacagagcuuucaucuccuaugauaauggugcuuuauucugaaauaccuccuaaaggaccuaccugagacuguuuuacuguuuuguuuuguuuuguuuuuuaagaagaagaaggaggaauauaguauaaaauggugauaaaaagcauaguagaguaaguacauaaaccuaacauuuuaccaguaacuuagucauuuauuaucauuaucaagguuuauguacuauacaugauuguauguauuauacuuuuauaugacuggcagugcaguggguuuuuuuuacacaaguaucaccacaaaugcuugugaguaauuucuugugcuaugacaucacuaaguauuuaaauaggaauuuuucaguucugauacaaucuuacgguaccaccuuuucauauugccauuugucauugaauagaauguuguuauguaguaugugacugugguuggaaucauaacaguauguaucauuuucagauugccuucuuucauuuaguaauaugcauuuaagguuccuccaugucuuucucuuucuuucuuucugucuuucuuucuuucuuuuuuuuuuuuuuuuuuuuuuuuugagauagggccucacucugucacccaggcuggagugugguggugagaucauggcucugcagcuucgaccuccugagcucaaaugauccucccacccccuuccaaguagcugugaccacagacacaagccaucacacccugcuaauuuuucauuuuuaguagagauaaggucuuauuauguugcuuaugccagcagcuugaacucagccucccaaaguguugggauuacaggugugaaccaccguucucagcuccucgaugucuuuuuauggcuugauaggcugaagugggaggaucacuugagcccaggaguccaaaucuagccugggcaguguagugagacuuccgucucuuaaaaaaacaaaaaacaaaaaaaagaggaccaaaguuacugauauuagaaaugaaaugagaucuaauugcagauccuauagauauucaaaggauaauaaggaaacacuaugaacaucuauuaauuuaaaugggccaguuccucaaaaccauacauuaucaaaagucauccaauauaaaauagauaauuugacuagucccauaacuauuaggagaauaaauugaauccauaauuuaaagccuuucauaagacaaauugggaacaagauaaggaugugcacucucaccacuccuuuucaacauuauguuggagguucuagccaggguaguuagacaagaaaaauaaaaggcauacagauuggaaaggaagaaauaacacuccccuuuguagaugacaugauugucuauauauaaagucccaauauacacaaguauaacauugugaauaauguuauuuggggacugggcacaguggcuuacaccugucaucucagcacuuucggaggcugaggcagguggaucaucuaaggucagaugauggcuuccucuaaaacaggacagauuuacuuguagccuauugauuauaaaaagcuugagguuucucuguuauaacucaguccacuguuuucgcagugucaagugucccauuucaccuugccuuugguacuggggaacugaugcaaaaaugaagguagucuggcuaccaucauuacugggagaaauaaacuguccuuuuucucuuaucaggaaucucagguuuccugcuagcacccaggaaacugucaugcuaauuuguuagguuacaaguagauaaaaucucagccaggcacaguggcuuaugcguguaauccuagcacuuugggaggccaaagcagguggaucacuugagcccaggaguucaagaccagccugggcaacauggugaaauccugucucuaccuaaaauaccaaucaguugggugugguggugugggccucuagacccagcuacuugggaggcuaaggugggaggauuaccugagucugcugagauugaagcuacagugagccgugaucuuaccaccacacaccaguuugggugacagaguaagacucuaccucaaauaaauaagaaacaaaccaagcagaguaaaauuucauacccuucauaggucucaacacauuuuuugcauauuauuaaucaaacaguauuauuauuuuaaaaaacuguggaggccaggcccaguggcucaugcccauaaucccagcacuuugggagaccaagguggguagaucacuugaggccaggaguuugagaccagccugaccaacacggugaaaccccaucuuuacuaacaguacaaaaauuagccaggcaugguuuugugcgccuguggucccagcuacuugggagacugaggcaugagaaucacuugaacccaggaggcagagguugcagugagccaagauugcaccauugcacuccagccuggacgacagagcaagauucugucucaaaaaacagaagaaagaaaaacccauggagcauguacuguaagugcuuucuuaggccuagaugauggaacagaggcuuagagaaguuaaguaauguuucugcgaccuggcucuuaaacuggugcucucacagcaguuuauaguuauuccugucuuaaaggcauuuuauauaagauaaaauuaaauacugauggaguacuuuuacuauguuaaaaauaaauuagugcaguuuuaaaauccuuuuucuguaugggauuauggaauauuuaaguuaaauuguaacauuuaauacauuuugauuuuuaaaaaaucaugacuaauaauuuuuuuuuuuuuuuaagaauuguucucuguguacuucaggcucuaucugaaaccuucacaagauguucauagaguuuuaguggcuagaauaauucaugcuguuaccaaaggaugcuguucucagacugacggauuaaauuccaaauuuuuggacuuuuuuuccaaggcuauucagugugcgagguaaucuaaucucuuuuucuuuuguuuuguauugaaauacuuuugaucuugcaagaccauguuuuagacucaguaacuaaaaauucuaccuuaaaauaaaacauugauccaucauaacagaacuaguggauuccuaaagagacaaccaaguccaacacuuucugaauauccaauaugcagaacacuacgugaaguuuucaagggggagaugugucuugcugauguucuguugaccaggaaaguuaaauauccucuaagucauugcauuucccccauuuugaggaugguuuuaauauaccgagaauaaaauaaaauaggaaaauauuuuggaaguauuacuguuguacauuaguauggcaguacucaauguauaaugugaaacauuuuauaaaugguguuacaaaucaguuuuguuuauuuuuauacaauguuuuagcaggagggagagcuaacagaaguggucucuuaacaccaaauaagaacuaauuuuuugucagugugaaguaaugcugugauuuuuuuuuuuaaugaauaguuuugaaauuaagacuacuguuugaaaauuaggguuuuguuuuuuuuucuuucagcauaccacuucauaacuguucaguuuguacaguuuguucccccuguuauacccaguugagcuuguuuguuucuucacagacaagaaaagagcucuucaggucuaaaucauaucuuagcagcucuuacuaucuuccucaagacuuuggcugucaacuuucgaauucgagugugugaauuaggagaugaaauucuucccacuuugcuuuauauuuggacucaacauaggcuuaaugauucuuuaaaagaagucauuauugaauuauuucaacugcaaauuuauauccaucauccgaaaggagccaaaacccaagaaaaagguauaaaggaaauguuuacuguuuugaauuugcuucuucauucaaacauagaagucuaaguauaaaauuaguguucuuuaggaggauaugacuuuccucuggauuucucugguugauaauguuacuuagccaugagaauguuuuucauagaguuuuuagaauuugaagcagugguagcagauucuguuaugccuuucuauuuguucaauacaauauuagguauuaugggaaauacaaaaaaaucugagacauuguucccucuaggagcuacuuaugcaucaauacuuagauacuaaggggucugacacagacuguagggcaaaagaauuuaaagaaagcaggaucuuguuuauccaccuauuacuuuuauuagaagauaaaauacguaaauuggacuaaaaccagucagauuauucagcuccugaggaagauacauacauauuacuuuaauaggaauuugaggcagaaacagggaaauugcugccuuaagccucauaguuacucuagggcccuguuugcccuagaguaucacuuguuaaggagaaucacuuauucuccuuaauuccuucauauauguccuauaccaagagaguauugcccagaagguauagugcuuuucuguaguuaggaacuuuauuggcuggaacuggaguuuccucuugcucugucuaugauugccuuugggcuuauacuagccuuuggaccaacucaucauggcuaguauagugacuuucuuaaaacagcauaccacauugaguaauagcagcuauaauggaggaaaugucuuguagccacuuuuuuuuuuuuuuuuuuuuugagacagagucucacucugucgcccaggcugaagugcagugacgcaauguuagcucacugcaaccuccgccuccuggguucaagcaauucuccugccucagcguucugauuagcugggauuacagaugccuggcaccaugcccagcuaauuuuuguauuuuaauagggauggggucucaccauguuggccaagcuggccuugagcuccugaccucaaaccauccacccgccucagccucccaaagugcugagauuacaggcaugagccacugugcccggccguguagccacuuuuuaucaaaaguagcuguguauuuguuuuaugggcucuucuaauaaguauaucuagauaauauguagcccaugaaacuacuauaagugaaagaauagugacuuuuaauaguuuuucaucuuuuacucaccucuuaucuccaggaugaagaucaggcuuauuaggaggugauaugauauguuuagggauuuaguuaacugcauauuuagggugaauuuaaaauuggcaggaugaugaggaugccagaaaagcuaauguaguuucagacuacuuuaauagauuuuguaguaccuuguuugugagaaauaauagaccuuuuguuucgcauacuagucaagccacaguuggauuaccauguucaccagauuuuguauagucagcauuuuaaguugacuggaaugugucuugggaaagaugacugaaauggugagaagucugaauaauaugucauuuuuacacuaguugaaggaacucguaauauuuuucucuuaggccagaaaaaggcauacggagaacuugguccucauaugaaagagggaacauauuaauuguauuugccucaggugggagaauaaauuggagaaagacagauuuuaggucagaauauggaagaaauuuauaagaaacacaguuaucuaaauguaaaauggacaguuaugaaauagaguuugucaaggaucuugucagaagaggcauuaguacugaauggaagguuggaccaggugucuucuaacgcugaugcagcuugacagcugaauaauuuugugggagcuagcaguguaaacagaguacauacauaaaaauuacauuuuaauuuuuuggauuacaggugcuuaugaaucaacaaaauggagaaguauuuuauacaacuuauaugaucugcuagugaaugagauaagucauauaggaaguagaggaaaguauucuucaggauuucguaauauugccgucaaagaaaauuugauugaauugauggcagauaucugucaccagguacaguaaguaggucaugucacauuuagaaauuuccuguuaauuuuuuuuuuaaacugggcauuuugggcuuuuaaaaccuguguucucacaaaaagccuauaaaaugacucuguacaugcaacuauuccuuucaaacuaucagaaauauuuggaauuacccuuuuaacuuaaaaguuaaugcuuuugcagauauuugaaaacuaacaaugaacuuuuucauucuuaaaugauugucucuaggaaauaaggugacccuaacccuaaugauucgauucgacucgacuguauucuacaaagugcugggauuacaggcaugagccaccaagcccagucuguuucuuuuuugcaauuaagcuagaguucacauagcauaaaauucacgauuuugaguuguacauuucagugguuuuuaguauuuuuacuauguuguacaaccaucaucacuaauucuggaaacuuuuuuuauuuuauuuuuauuuuuuugagauggagucuugcucugucacccaggcuggagugcaguggcacaaucuccgcucacugcaaccucccuuucccggguucaagugauucuccugcaucagccucccgaguagcugggacuacaggugccugccaccacgcccagcuaauuuuuguuuuuuuaguagagacuggguuucaccauauuggccagccuagucucagacuccugaccuugugauccuccugcaucggccucccauagugcugggauuacaggcgugagccaccgugcccagcccagaacuuuuuuaucaucccaaaagaaaccucaucccuucuuagcauucagucccaauucccugcaucuccuagauccuggcaaccagccacuaaucaaucuugguuuuuguggauuuuccuguuugggacaguucguuuaaauggaaucauacaauaugugagucuuuugugucugguuucuuucacuaagcauaauguuuucaaaguucauguuuuaccaugaaucaguacuucauucauuuuuauugcugaauaauauucaguuguauggauauacuccauuuuacuuacccauccaucaccugauggccuaauguuucuuaaauaaaacucuguuccccagagauuugguuaacauccugaguaguaauuucacucugucaaauauuuucuuaauauuucuuaaaauuucuuaaauuuaaaaacuugaaucccuuugaaaguaaagguuuuugcuuuacuuuuagauuucuuagugcuuuuaguaaauguucccaggaaauaaaacuaaugcauuacuugguaauaccugcuuucuaaagugccauuacugucaugcaaaauguuuguuucuuacuauguuaucagauuuauauguuucuguaauguauuacucuugcuuuaugaguucccuguaucuucauuucagaaagaauuuuuuuucccccuaaugaaauauuagaagacaauagcaaugaaaaaaguguauuuggccaggcgugguggcucacaccuguaaucccagcacuuugggaggccaaggcgggcagaucaccugagguugggaguucaagaccagucugaccaacauggagaaacucugucccuacuaaaaauacaaaguuagcugggcaugguggugcaagccuguaaucccagcuacucgggaggcugaggcaggagaaucacuugaaccugggagguagagguuguggugauacgagaucgugcuguuccacuccaaccugggcaacaacagcgaaacucuggcucaaaaaaaaaaaaaagaaaaaaguggauuuauuuuuauuuuacagguuuuuaaugaagauaccagauccuuggagauuucucaaucuuacacuacuacacaaagagaaucuagugauuacagugucccuugcaaaaggaagaaaauagaacuaggcugggaaguaauaaaagaucaccuucagaagucacagaaugauuuugaucuugugccuugguaaaguguuaccauuuucucauucagugucauuuuaaucucuuguauguuauuuuucagaaaacuuucaguggaauccuuucaucucaaccagaacuaagucauuugucuacccccaaaccuauuacuagcaaagggauaugugauugccaugacaaaugagaucaaucauuaauggcucauuugcuugggccaagugcagggccaccuauuuuaaucauauugucauagcaaguuaagaaggaggacuggcucucugauaggcaauuagaagugugcaccucauggaauucacugaauuguacgcuucaacaauagauuuuagcauacguagcaccuucuaauagaauuaggaagaaguuaaagauaaucuuaagaaaucacagaauaauuuugaccuuaugccaugauaaaaaguuauuuucucuuauuuucuaucuucuuuauucucauguaacguucacauauauuuaaguaaucaaauaaauuauggauacuuuggaaucccaaaauauuagaucugguaaggauguuuagaauuuaucuaguucagccuguuugcuuuacugaaaagaaacugaaacccagagagguuaagcaacuucuguagggacagagauuuauagauuauagucaaacucgugaucagugcucuuuugauuaccauguugauggaauguuuaaguguaagugacuucuggggaaaagcauauugauuuagauaccuauugcuuaagcucauuuuuauauaguuaagaguagcuauuuaagauucuuaauuuguccuuuuagucaagaguaauuuauugaacaccuguuaugggcuaagcguuagauauacagagaugaauaacauaagacuccuauucuuaaguaucacacauucuagagaauacacagcaaauguuuauuggauuaacugaauuaauguaaaggaaaaacaguuuuuuggguuucuuuguuuuccuguuuuagaggaaucguuuggugacuaaagagcaaggauguacaagauaacucagaaauaaaauauugcuaaauauauauauauauauauauauauuuucugagacggaggcucacucugucacccaggcuggagugcaguggcacaaucuuggcucacuacaaccuccaccucccagguucaagcaguuauccugccucagcguccugaguagcugggauuccaggcaugugccaccaugcccggcuaauuuuuguauuuuuaguagagacuggguuucaccauguuggccaggcuggucucaaacuccuaaccucgugaucugccugccuuggccucccaaagugcugggaaaccaccuggcccaaauauugcuaauuuaauauccuuuaaaauauuuguuuaagggaaacuuaacagcuuacccagcuagccaaacguugacaauuuuccugccaauuuaggaaguaggacauaguaacuauuaacagccaguuuauuuuuagaguacuauggaaaugauggugauucucuaauuaggauauuguaagaguaccaugucuauauauuuccuuuuaguuuguuaaugugauggaauaguuuucaaauuauccuuuuuuuuuuuuuuuaggcuacagauugcaacccaauuaauaucaaaguauccugcaaguuuaccuaacugugagcugucuccauuacugaugauacuaucucagcuucuaccccaacagcgacauggggaacguacaccauauguguuacgaugccuuacggaaguugcauugugucaagacaagaggucaaaccuagaaagcucacaaaagucagauuuauuaaaacucuggaauaaaauuugguguauuaccuuucgugguauaaguucugagcaaauacaagcugaaaacuuuggcuuacuuggagccauaauucaggguaguuuaguugagguugacagagaauucuggaaguuauuuacugggucagccugcagaccuucaugguaaguucagcaugcauuaugucugacuuacagauaaacacacacagacacacacacacucacauaucccugaucauuuucauaguuuguuacuucaguuaaagaugucaaauucuauuucagaugcuuuucuuguuuggccgagaagacuuaauaaaugcauaagugaauuuaguuucaaauguugacaaauuauuaaagacuaauguuaaggaauuucuuuuuuaguuaaaaaauuuuuaauugaucuauaauagaguuauauauuaucaagguacaugugauaauuugacacacucauaugacacacucauguagggugaugggauaucagcacccuacguaucuuuucuucaugcuaggaacguuugaauuauucucuucuugcuguuuggaaauguacaauagauuaauguuaaccguagucacccuacugauguaucggacaccaggucuuauuccuucuaauuguauacguguauccaaaagacuuucuuuaaagaauuaugaagaguuuaaauuucuuuuaugugcaauuuaucauuauuuauuaaauagccauguuuaaauuguaguacuaugcacuguuaauaaacgagcuauuuuuuaaucaagaaucuucccaaauguaaucagacuuuuaacaguuuuuauguucauuuagucaccuuaacuaaauguaugugccaggcacuguccugauagauaaagucuuugccccuccaauagcuugcuuuucacaauuguccuuuguuuuguuauaguccugcaguaugcuguuugacuuuggcacugaccaccaguauaguuccaggaacgguaaaaaugggaauagagcaaaauaugugugaaguaaauagaagcuuuucuuuaaaggaaucaauaaugaaauggcucuuauucuaucaguuagagggugacuuagaaaauagcacagaagugccuccaauucuucacagguaauuuaaguucauuagcaugcugcuguuuuuuuuguuuguuuuaucaggcucucuccacuuauuugaugccagauggcuuuauuuuauaauaauaaugcagaauuucccagaucuaaccuuaauuauuaaauauuauguuuguuuuuacaguuaucugugucuuuaugccugauugcuucugaaauaaaggguugucucacugugagaauaugggggaugugcaugaaaaaugcacauauaauucuuugagcauuuauguguuccuuucugauuuuuuaaauaaguaaguccauauauuugagucauguagauccuggauccuuucucauaaugggagugucuuuuggguaaaagauguuuuaugaaugaggugaggaaacgaggaagacaaaacaggauguaagcacuaggauaaaggaauggagucccucguccacuuaaccuuuccacagauugguaauuggaaccaaaugauuggagagcagaccuccgaauggauccaauuaaaguacuuuugcuuuaauuuuacaaccuuuuauuuauuucagaaauaauguuaaacaugcuguuucuaaacaguauuggaaaugauaauaacaaugguuguccuccuuaaauuguccuuuuagauauuaagaaauuuaguauagaugaaagcaauuuuaaucuaggauccaaauuuuagaagucaagauuuauagcuaaacauggauguuaaaguuuaaaguauucuuuacauggcuuuuggucuucuaagugaagcuuuuuguuuuucuuuguaguaauuuuccucaucuuguacuggagaaaauucuugugagucucacuaugaaaaacuguaaagcugcaaugaauuuuuuccaaagcgugccagaaugguauguuaucuaauaaugcucuuuaucauuuuaagcuauagcuuuaauuacaaagaugauaauuuuagcuggguaguagcugcaucuuaauaauuguaaacuaaauugguccaaaaaaauugcaacuguuagccagggaagagguuguuuuaauucagugauuguaaucuauguuauauaacauuagaccaagcuuacuauuuuuuaaugcuguauaguauaauaugugacaagugccaaugagaaaaacugaaugguuaugcugggaaauuaagaauauaaaauuuauaugaaauaaguucuuaaagauguuacccauuucuguacaucaacuaugauuugacuauuuguuagcuuuaaaaacuaaugauaauugaaaacaaaaauaaaucuaaaccugaguuuaguugauugacucaagagacuuagauuguauugcugugacugaaaaugacucacuggcacaaacauuccuuaucucccucaagagggcaaaaggaugcguaacugcuuaccuauaccagauguuaaagguuuuuaaaccuaugcucuuuacuuccucugcuuggugaaaaaagggauauguuugcagacaauguuaugcuuaacauuuauaucugguguuuuuaaaaauacuuucugaauuugccuuugagauuguaacuuguauuuuuucucuaucuauuaguaaaauuugcuacugaauaaugacauuugauauaaguaggucucaaaguccgaagaagagaagcauuuaaaagaauaaucuauuaauuauauaaguagucuuugaaugauguagauacuagguuaauguuuuccuuuguaauauauugcuaauacauauaaggcaaagcauuagguacuugguuuauauauuaaagaucuuacuuucuugaagugaacaccaccaaaaagauaaagaagaacuuucauucucagaaguagaagaacuauuucuucagacaacuuuugacaagauggacuuuuuaaccauugugagagaaugugguauagaaaagcaccaguccaguauuggcuucucuguccaccagaaucucaaggaaucacuggaucgcugucuucugggauuaucagaacagcuucugaauaauuacucaucugaggugagauuuuuuaaaaaaagaacuaagcuuauauaugauucaacuuugguaaacuguuaggaaggagaaauaggggcaggaaaaacagcaaggauggugggaggcuucauuuuaaaagcaaaguggcaguaaagggcucuaaauuggacaacuuagcauaauuaaaggaaaacucaagaauaauaauuugaguacuuccuuuguacuggaaauuaugguagacauaaaauaauuccuuguguagguuagugaggaauaguaagaguuugagcauagggauuauaugaugaaaaaaaccucuaaauacaaaggagggaaauguuacaguaauagaaaagaacacgauguaaacaaaucuaauagauuuugguggcaucugaagagagaugagugauuaguaaagacaauaaauggacuagcaauuauuuuagacgucaucuaggaauuuccuuuagccucaaaaucacgaguucucuucauguauacuauucucuugccaaaacuugcauuuuuuaaaaugugaaaugucuuucuaccuauuucuguguauucagaucauccacaugugaaaauccuugcuaacgccuuucuuagaaucucagaaaguaagauucuaagaauuuuuauuuuugagacagagccucgcucuguugcccaggcuggagugcagugacgugaucuuggcucacugcaaccuccgucuuccaguucaagcaauucuccugccucagucuuccgaguagcugggacaggcgagugcuaccacgcccagguaauuuuuguauuuuuaguagagaugggguuuugcuauguuggccaggcuggucuuaaacuccugaccucaggugauggacccgccucagcaucccgaagugcuaggauuacaggcgugagccacggugccuggccuaauaauuuuucaucuuuuaauuucauaguacuuaauguuucacauuuuuaauggcaguuagcaucuucuuuauaccauggauauuuacauaugguuuguauacaaauaucucuugaacuauaacucuuaaacauaaacucuuaaaagggcauacauguuuuuauuuaucuuuauauccuccacagugccuuauuacaugguaaaugauuaaauaaagccuacaauccauucaaaggagugaauucgguagccagggaaaaugacuugaggacaugagaggggacagugugccucuuuaugaucuuuacugacauucuucugcaccacaauuguaaccacuuucauuacaaaguaauuuaguuuuguauauuuucuccuaaaaugccguuuccuacccuguaggaacaaaaaaaaucugaacauuuuguguguaacuuagcagauucuuaguaauucuauaaaauugucuaaacuuuuuuuuuuuuuuuuuuuuugagauggagucuugcucuguugcccaggcuggagugcaguggccugaucucggcucauugcaaccuucgccuccuggguucaagcaauuuuccugccucagccuccugaguagcugagauuauaggugccugccaucacgcccugcuaauauuuguauuuuuaguagagacaagguuucaccacguuagccagguuggucucgaacuccugaccucaggugaucugcccgccucggccucccaaaguguugggguuguaggcgugagccaccaugcccggccagcugucaaaacuuguaucuacuagaaaaaauguuuuaugcuauucuguggagucuaaaaagcugaauaagucaagguuccuauucuucagaagcuuaaaaugucauuuuaaugucucuuuauaugacuguaauuucuacuuguguucuaagacuuacagucauuuauuugccugugaagcuuuuuuucuuuucuuucaucccuaccucaaauauuuaagggccuauguguacaguacacccuccacccuaagaugauauauccugcuuggccaucaggagauacuuaggcuauuuuucuugagaauccugguuauaauucuacagugaucuccuaguuguuuuuagagcuauccaggauaugccaccuuuaacucaguuaacugaacuuuuguuuuuuaauauguauguagaauuuguucuuacaaaagauagaguauacuaaauuauuuaugaaauauauauauuuuuauuugugguuuacuuuaagauuacaaauucagaaacucuuguccgguguucacgucuuuugguggguguccuuggcugcuacuguuacauggguguaauagcugaagaggaagcauauaagucagaauuauuccagaaagccaagguaggagaauuuauacuaauaaaguuucggauaaauuugaaugaaauguauuccugugaaaauuauuacauuuguuuggaagacauuaaauuuuaugcagguuaacccuuucucuuuuauuuauguaaugugagaagaaauuauacuauguauuuuuuaaauuguuuuaauuguuuaauuuuuaauuauuauuauacuuuaaguucugggguacaugauguagagcaugcagguuuguuacauagauauacagugccauggugguuugcugcacccaucaacucgucaucugcauuagguacuucuccuaauguuaucccuccccuagcccccgacccccugucaggcccugguguauaauguuccccucccuguguccauguguucucauuguucagcugccacuuaugagugagaacaugcaguguuuguuuuucuguucuuguguuaguuugcugggaaugaugguuuccagcuucauccaugucccugcaaaggacaugaacucauccuuuuuuauggcugcauaguauaucaugguguauaugugccacauuaucuuuauccggucuaucauugaugggcauuuggguugcuuccaaguuuuugcuguugugaacagugcugcaauaaacauacgugugcaugugucuuuauaguaaaaugauuuauaauccuuuguguauauacccaguaaugggauugcugggucaaaugguauuucuaguucuagauccuugaggaauugccacacugucuuccacaaugauugaacuaauuuacacucccaccaacaguguaaaagcauuccuguuucuccacauccuguccagcaucuguuguuuccugacuuuuuaaugauaggcuguaagcaugaaacucuuucuuaucucuugguaguacucugucacugguaugauuugcaagaacagaguauaagauuugccauuuuaaaaaauuguuaaugaguuuugcuuauacuguaugacuacguggaacuucuaaaaacauuucauuuuuucucuuaagugcacuuuauuuuuuauuuuauaguauguccaagaucaaaguacacuguaaaaagcaauacuaaacuauaauuuuaacuggaauuugcauuuuuccuucuauucacaauagucucuaaugcaaugugcaggagaaaguaucacucuguuuaaaaauaagacaaaugaggaauucagaauugguuccuugagaaauaugaugcagcuauguacacguugcuugagcaacuguaccaagguaagauuuucuucuucuuguuuuguuuuuugagauaggaucuuucucugucacccaggcuggagugcagugggauugucacaacucauuguagccuugaccuccugguuuccagcaauucuccugccucagccucccaaguaauugggacuacaggcauguaccaccuagcuaaaauuuucuuuuuacuugaaaguguagccuaugcagggaauugaucacugguugguguuacuguuuugguguccacucguaaguuuauuuuuuacuuuuauuuuucuuuuuuuugagacagucucucacucuuucacccagagugagugaucacaucacugcgauccagcagccucgaccuccugggcucacagcagccucgaccuccugggcucaagugauucucccaccucagccuccuuaguagcugggacuacaaguguacaccaccaugccuggcugauuuuuguauuuuuguaauuuuuuguauugaugggguuuuacacauugcccaggcuagucucaaacccugggcucaagugaugcuuacaucucaaagugcugugauuacaggugucagcuaccauaucuguucacauucauaaguuauacaaauugauuuaaaauucaguugaaugguacauaaagguaauauccagacaaauaagcaauaggaaucugaguuucucaugaaacuaauuuuauaauuucaggaauuuuucugagauugccuuaugacuuuuauauacaaccauauagaugacucuuuuauuccugggacacuuucauucauuuaauaaaaauuuuuugacccaaacuaugugguaugcguagcggggcuagugagcaacacaacaauaacuccagcacauaguuuacuuucuuuugcucagaucaccuuacauaacauuugguagaaagagugcuacuguguuuaaucuuuguuuuuaucugcagcagccugugggauagccaagccaggccccagaguauugauaauaauuggaaauauauuucaaaccuaguauuagguacauggccauauagcaauauuaucaacauauuucuugguuuuguaauguguuuuuccuccuuuuugguguaaguggggaaggagaaaaguagaauaaacucuaaccuauaauuauagcucacuuaucuuuagggucaauagcuguuacuuuaauguuguuaaagcacaaugaaagauguacaguauaguuauuauaacucuaagaaaagauguguuuuugaagcagcauauauauuggcccuaauaguaaacuauuuaucuacauuccauucaagauagagaaaacacugucugccaagaauaauuguuuuuauuucuuuguugcuugguucuuuguuugucuuaauugcagaagaguccaaauaagauugcaucuggcuuuuuccugcgauuguuaacaucaaagcuaaugaaugacauugcagauauuuguaaaaguuuaguaaguaugcuuccuguuuugcuaucauauuuugauucuaauaggcauaauuuuuuuguugaaauaucuuuguaaauaaggaugcaucucacaacauauagcucuuaacauuuuuacaaauguggaaauuaaggccaggugcgguggcucaugccuguaaccccagcacuuugggaggccgagguggguggaucacaaggucaggagauugagaccauccuggcuaacacggugaaaccccgucucuacuaaaaauacuaaaaauuagccaggcguggugacaugugccuguagucccagcuacucgggaggcugaggcagaauugcuugaaccugggagguggagguugcagugagcgaagaucgugccacugcacuccagccuaggcgacagagcgagacuccaucucaaaaauaaaaaaauuuaaaaaauuaaauaaaauguggaaauuaaauaauuugucuuguggggaaauauaccugauugcuucuuaauaucaauaccuagcauaguagugccugccuuuaguuucucaauaaauaauacauuuaaaaauugggaacgaaucauccaggcucacagcuauaucugcgcaacauuguaccaaaauuuaaaauaauuauuuguucuuuaaaagugaccaaaaaucuugccaggcaagcaacauauucuuauuguaguauuuauuuuucuuccauacaaaugggcuuaugccacauacauucuuuuuucuggaacacugccgggcauacaaaguaguuauugaaauaucuauugagugaaaacauauucuguaacuuauuuccauuuuaugacacaucuuaaucauuuuccaugucacuguacuuauuuuauaagcuaucugcuguuauacuuuauuuauuuagcagugcaugguauucuauuguguggugauagugaauaguauauauguauaugaaagcuuaucugcucuuuuuuuuuuuuuuuuuuuuuugagacaaagucuugcucuguugcccgggcuggaguucaguggcacaaucucggcucacugcagcccccaccuccuagguucaagagauucuccugccucagccucccaagaagcugggauuacagaugugugccaccacaaccggcuaauuuuuguauuuuuaguagagaccagguuucaccauguuggccaggcuggucuagaauuccugaccucaaaugaucuguccaccuuggccucccaaagugcuuggauuacaggugugagccaccacacugagccaaaaagcccaucugcucuuaauuaacauuuuaagugguuucuaguuuuuuggguuacaaagacuucugugguacagauuauuguacuuuugucuauuuguauuuguguguaugauggauguaggauaauuucuagcaguagacuugcuuguucaaaaggaaugugaauuuuacuuuuugauggauauugucauuguccuccaaaauagucauaccaauuuaggcauuuuccuacacccucuuuggguaacacuuuagguguuacaaaacuucuuaauauaagaaauaauuuugagggaggagccaagauggccgaauaggaacagcuccggucuacagcucccagcgugaacgacgcagaagacgggugauuucugcauuuccaucugagguaccggguucaucucacuagggagugccagacagugggcgcaggucagugggugugcgcaccgugcgcgagccgaagcagggcgaggcauugccucacucaggaagugcaaggggucagggaguucccuuucugagucaaagaaaggggggacggacggcaccuggaaaaucgggucacuccccgaauacugcucuuuugcgacgggcuuaaaaaacggcgcaccacgagauuauaucccgcaccuggcucggaggguccuacgcccacggagucucgcugauugcuagcacagcagucugagaucaaacugcaaggcggcagcgaggcugggggagggaugccugccauugcccaggcuugauuagguaaacaaagcagccgggaagcucgaacuagguggagcccaccacagcucaaggaggccugccugccucuguaggcuccaccucugggggcagggcacaaacaaaaagacagcaguaaccucugcagacuuagaugucccugucugacagcuuugaagagagcagugguucucccagcacacagcuggagaucugagaacgggcagacugccuccucaagugggucccugacccugacccccgaacagccuaacugggaggcaccccccagcaggggcacacugacaccucacauggcaggguacuccaacaggccugcagcugaggguuuugucuguuagaaggaaaacuaacaaacagaaaggacauccacaccaaaaacccaucuguacaucaccaucaucaaagaccaaaaguagauaaaaccacaaagauggggaaaaaacagaacagaaaaacuggaaacucuaaaaagcagagcgccucuccuccaccaaaggaacgcaguuccucaccagcaacggaacaaagcuggauggagaaugacuuugacgagcugagagaagaaggcuucagacgaucaaauuacucugagcuacgggaggacauucaaaccaagggcaaagaaguugaaaacuuugaaaaaaauuuagaagaauguauaacuagaauaaccaauacagagaagugcuuaaaggagccgauggagcugaaaaccaacgcuagagaacuacgugaagaaugcagaagccucaggagccgaugcgaucaacuggaagaaaggguaucagcgauggaagaugaaaugaaugaaaugaagcgagaagggaaguuuagagaaaaaagaauaaaaagaaaugagcaaagccuccaagaaauaugggacuaugggaaaagaccaaaucuacgucugauuggugcaccugaaaguaacggggagaauggaaccaaguuggaaaacacucugcaggauauuauccaggagaacuuccgcaaucuagcaaggcaggccaacauucagauucaggaaauacagagaaugccacaaagauacuccucgagaagagcaacuccaagacacauaauugucagauucaccaaaguugaaaugaaggaaaacauguuaagggcagccagagagaaaggucggguuacccugagagggaagcacaucagacuaacagcggaucucuccgcagaaacucuacaagccagaagagagugggggccaauauucaacauucuuaaagaaaagaauuuucaacccagaauuucauguccauccaaacuaagcuucauaagugaaggagaaauaaaauacuuuacagacaagcaaaugcugagagauuuugucaccaccaggccugccuuacaagagcuccugaaggaagcauuaaacauggaaaggaacaaccgguaccagccgcugcaaaaucaugccaaaauguaaagaccauugagacuaggaagaaacugcaucaacuaaugagcaaaauaaccagcuaacaucauaaugacaggaucaaauucacacauaacaauguuaacuuuaaauguaaauggacuaaaugcuccaauuaaaagacacagacuggcaaauuggauaaagagucaagacccaucagugugcuguauucaggaaacccaucucacgugcagagacacacauaggcucaaaauaaaaggauggaggaagaucuaccaagcaaauggaaaacaaaaaaaggcagggguugcaauccuagucucugauaaaacagacuuuaaaccaacaaagaucaaaagagacaaagaaggccauuacauaaugguaaagggaucaauucaacaagaagagcuaacuauccuaaauauauaugcacccacuacaggagcacccagauucauaaagcaaguccugagugaccuacaaacagacuuagacucccacacauuaauaaugggagacuuuuaacaccccacugucaacauuagacagaucaacgagacagaaagucaacaaguauacccaggaauugaacucagcucugcaccaagcagaccuaauagacaucuacagaacucuccaccccaaaucaacagaauauacauuuuuuucagcaccacaccacaccuauuccaaaauugaccacauacugggaaguaaagcucuccucagcaaauguaaaagaacagaaauuauaacaaacuaucucucagaccacagugcaaucaaacuagaacucaggauuaagaaucucacucaaaaccacucaacuacauggaaacugaacaaccugcuccugaaugacuacuggguacauaacgaaaugaaggcagaaauaaagauguucuuugaaaccaccgagaacaaagacacaacauaccagaaucucugggacgcauucaaagcaguguguagagggaaauuuauagcacuaaaugcccacaagagaaagcaggaaagauccaaaauugacacccuaacaucacaauuaaaagaacuagaaaagcaagagcaaacacauucaaaagcuagcagaaggcaagaaauaacuaagagcagaacugaaggaaauagagacacaaaaaacccuucaaaaaauuaaugaauccaggagcugguuuuuugaaaggaucaacaaaauugauagaccgcuagcaagacuaauaaagaaaaaaagagagaagaaucaaauagacgcaauaaaaaaugauaaaggggauaucaccaccgaucccacagcaauacaaacuaccaucagagaauacuacaaacaccucuacgcaaauaaacuagaaaaucuagaagaaauggauaaauuccuggacacauacacucucccaagacuaaaccaggaagaaguugaaucucugaauagaccaauaacaggaucagaaauuguggcaauaaucaauagcuuaccaacaaaaaagaguccaggaccagauggauucacagccgaauucuaccagagguacaaggaggaacugguaccauuccuucugaaacuauuccaaucaauagaaaaagagggaauccucccuaacucauuuuaugaggccagcaucauacugauaccaaagccaggcagagacacaaccaaaaaagagaauguuagaccaauauccuugaugaacauugaugcaaaaauccucaauaaaauacuggcaaacugaauccagcagcacaucaaaaagccuauccaccaugaucaagugggcuucaucccugggaugccaggcugguucaauguacacaaaucaauaaauguaauccagcauguaaacagaaccaaagacaaaaaacacaugauuaucucaauagaugcagaaaaggccuuggacaaaauucaacaacccuucaugccaaaaacucugaauaaauuagguauugaugggacguaucucaaaauaauaagagcuaucuaugacagucccacagccaauaucauacugaaugggcaaaaacuggaagcauucccuuugaaaacuggcacaagacagggaugcccucucucaccacuccuauucaacauaguguuggaaguucuggccagggcaaucaggcaggagaaggaaauaaaggguauucaauuaggaaaagaggaagucaaauugucccuguuugcagacgacaugauuguauaucuagaaaaccccacugucucagcccaaaaucuccuuaagcugauaagcaacuucagcaaagucucaggauacaaaaucaauguacaaaaaucacaagcauucuuauacaccaacaacagacaaacagagagccaaaucaugagugaacucccauucacaauugcuucaaagagaauaaaauaccuaggaauccaacuuacaagggaugugaaggaccucuucaaggagaacuacaaaccacugcucaaggaaauaaaagaggauacaaacaaauggaagaacauuccaugcucauggguaggaagaaucaauauugugaaaauggccauacugcccaagguaauuuacagauucaauggcauccccaucaagcuaccaaugacuuucuucacagaauuggaaaaaacuacuuuaaaguucauauggaaccaaaaaagagcccgcaucggcaagucaauccuaagccaaaagaacaaagcuggaggcaucacacuaccugacuucaaacuauacuacaaggcugcaguaaccaaaacagcaugguacugguaccaaaacagagauauagaucaauggaacagaacagagcccucagaaauaacgcugcauaucuacaacuaucugcucuuugacaaaccugagaaaaacaagcaauggggaaaggauucccuauuuaauaaauggugcugggaaaacuggcuagccauauguagaaagcugaaacuggaucccuuccuuacaccugauagaaaaaucaauucaagauggauuaaagacuuaaacauuagaccuaaaaccauaaaaacccuagaagaaaaccuaggcauuaccauucaggacauaggcaugggcaaggacuucaugucuaaaacaccaaaagcaauggcaacaaaagacagaauugacaaaugggaucuaauuaaacuaaagagcuucugcacagcaaaagaaacuaccaucagagugaacaggcaaccuacaaaaugggagaaaauuuucgcaaccuacucaucugacaaagggcuaauauccagaaucuacaaugaacucaaacaaauuuacaagaaaaaaacaaacaaccccaucaaaaagugggcgaaggacaugaacagacacuucucaaaagaagacauuuaugcagccaaaaaacacaugaaaaaaugcucaucaucacuggccaucagagaaaugcaaaucaaaaccacaaugagauaccaucucacaccaguuagaauggcagucauuaaaaagucaggaaacaacaggugcuggagaggauguggagaaauaggaauccuuuuacacuguuggugggacuguaaacuaguucaaccauuguggaagucaguguggugauuccucagggaucuagaacuggaaauaccauuugacccagccaucccauuacuggguauauacccaaaggacuauaaaucaugccgcuauaaagacacaugcacacguauguuuauuguggcauuauucacaauagcaaagacuuggaaccaacccaaauguccaacaaugauagacuggauuaagaaacuguggcacauauacaccauggaauacuaugcagccauaaaaaaugaugaguucauguccuuuguuagggacauggaugaaauuggaaaucaucauucucaguaaacugucgcaagaagaaaaaaccaaacaccgcauguucucacucauaggugggaauugaacaaugagaucacauggacacaggaaggggaauaucacacucuguggacuguugugggguggggggaggggggagggauagcauugggagauauaccuaaugcuagaugacgaguuagugggugcagcacaccagcauggcacauguauacauauguaacuaaccugcacaaugugcacauguacccuaaaacuuaaaguguaauaaaaaaaauaauaauuuuuaaaguuugcauauuauuuuguuauguagacauauuacagguuauauauccauuuuacuauuguuggacauuuaguagaaaaaguacuguaguuuucauacuuacacaugaaccuugaauuguuugauuagguaaauuuuuuuuuuuuuuuuuuuuuugagacagagucucgcuucgucaaacccaggcuggagugcaguggcaugaucucagcucacugcaaucucugccuccugaguucaagugauucuccugccucagcuuccugaguagcugggauuacaggugcccaccaccacacccagcuaauuuuuguauuuuaaauagagacaagguuucaccauguuggccaggcugguuucgaacucccgaccucaggugauccaccuggcucugccucccaaauugcugagauuacagaugugagccacugugcccagccugauuagguaaauuuugacuacagcaugcuccugcaagaagccaucuugaacaucuuuguuucucuuccuugaaggcauccuucaucaaaaagccauuugaccguggagaaguagaaucaauggaagaugauacuaauggaaaucuaauggagguggaggaucagucauccaugaaucuauuuaacgauuacccugauaguaguguuagugaugcaaacgaaccuggagagagccaaaguaccauagguaaauacauauuuacuacuugggauuucuuuuacuucuuuauauugauuuggcaguauaagaggccucauugauaucaauuuugugcuuauuucauuuucucuuaguauagccuuuuaggauuguuccuuucuuauauacuuuauuuuuuuuuuauuuuuacuugaauuuauuaguuucauauuuuauucuucauagaaggaacuuaagauaacuauuaaagaaauaaaaccaggccaggcaugguggcucacgcuuguaaucucagcacuuugggaggccaaggcgggcugaucaugaggucaggagaucaagaccauccuggcuaacguggugaaaccccaucucuacuaaaaacacaaaaauuagaugggcgugguggcgggcgccuguagucccagcuacucgggaggcugaagcaggagaacggcaugaaccuggggagguggagguugcagugagccgagaucaugccacugcauuccagccugggcgacagagcgagacuccgucucaaaaaaagaaauaaaaucauaugauagguuauuuccucaauagaaagcaggaaaugaaaacacaccuguaaugccauugcuuuuaaccuuuuucuauuauuucucuguagaaacauucaaaauuguagucaacaucaacauucacauguuaugaaugccuguuuaauuauaaguauuuuuccagguaguugcuuuucuugauagucauacuuuuuaauggcuucaccauuuuucugucauaaauaccauaauuuacuugacauuuuuuauugucagaaauuuagauucuuuucuauuuuccuacaauaaacauuauugcaaugaucauuugucuaaggguuuuuuuuucucauauuuuaaauuauuucuugacaacagaaucuuggauaauuuuucaaaaagacuuuugaagcuuucaguauauaauuaauuucacuauaauuuugcuuuucauauacuuuuuuuugugaagaggaggaaauuugaguuaauaugacuauauauggcuguugugcccuucucuuaguguuaaugagugcuuuuuauuuuuaggugccauuaauccuuuagcugaagaauaucugucaaagcaagaucuacuuuucuuagacaugcucaaguucuuguguuuguguguaacuacugcucagaccaauacuguguccuuuagggcagcugauauucggaggaaauuguuaauguuaauugauucuagcacgcuagaaccuaccaaaucccuccaccugcauauggugaguuacguuaaaugaagaagcucuuggauuuuaucugauguugcugacuaaauguaaugaguugacauguaagaaucacauggugucuuugaagaauugaaauugcuuucuugagaaaugaaccugagacuaguuggaaaauaacacuuuuaacgugcugugagcaaauuuaaguggaugcugaaauauuaaaacuuagauggguuuuggauagauuuauucucuuuagguuuaauuguuauaaauuauuuuaauuaggcuaagaaacauagacccugaauguaaaaauauuacauaacauuguguuugaaguuggaaccuugccuuugaccuuaguuuauauauuuucaguuuuuuggauuugauuucaaaaugauagugaaguuacaagaauacuacaguuaacguuuuaccauauuugcuuaaucauucccucucuccacacacacacucauacgcagauacacacaucauuuucucugaaccauuuugagaugaaaucgcacacgugaugcuccuuauacuucaguguauauuuccuaaaaacaaggauacacuucuguuuagccacaguauaaucaucaaaaucaggaaguuaacauuuugucauugcauuuagguguguagucuguuuagucuccuucaaucuggaacaguucuuuuuuuuauuuaucaugaccuucauauauuugaauaguacaggucccuugcucugaguuugucugauguuuccuuaugauuaaauuuauacuuugacgagaauguugcaaaaguaauuccucuucugccuucacccuguccauuuaucugucuguugauagauaucuucaaauccaagccaacaucacacaguuuaucuuuuuuucuguccaaauuuauaaauugcuuuacuagcaguuaaaaaaaacaccccaaaaccugacuauccacucaaccugaaugcauuuacuuauuugcucaacaaccuuauauauaacuaaucuaaccaugugggccauuuucuuagcccuagccccaguguauguggagguagagccucuggccuagcgaguagcaaguuggguccuaggucauguccccaguuccagcaaauugucacacaugccuggugagucccuaauuagaaccucugaucacaguaaauuguaggcugagucauugguggaaucccuggucauguuucccacccuuggugaaaaugcacgucaaucccuuagagugagaagacaaguuugguugugcccuguuugggccccugguuuagguccucgcagauacucaagucucuaucccugaccaagaggaaguuacaugcuuuucuugaaguauugauguuucaagucacuucagaacauucaguaaccucauguacaugacucucaugucaaauaaugaaaaggaucauuuaauuuccuuuguuaauaucugaaaaggauuaagaaauauauuauucuauauguaaauaggaaaaaaaaucccuuauuauuucaguauagccagaaaauuauuugguaguucucggaaacuggcugcccagauaauaacuaccauuauaacuggucguugcagcagcccuuucugugcauaguaccauaaagagccuuacaagauugccuuaugggaagauaggucaagguuuuugacuucuucccugcccaugauuaucucugcuuuccaaaauucauuaauaguuuucaaccacuggucuauuauccccaagcauuauuuugggagaguggagacuuacaguuucagaaucuugcucaagcucuuaacugcaacagugguaauaaugaucauuuauugaauuccacaauagaagcuagacuuuuacguuuauuuucucuaauccucacaguuaucuggccagguaagugauauaucuucacucuacugaugaggguacgaaggcccuagaugacauaaggcaaguuuuuuaccagaaaaguuaaggcugugguacugggauuugaauuuucuguuugacuucaaagccuuuuguuuuuacuauacaccucuuaaauauuuacagcuguguguguguguguaugugugugcauguaugaauuuauguuuauauacuuaaaaaaaauuuuuuuuugagacggaaucucgcucuguugcccgggcuggagugcaguggcgcgaucucggcucacugcaaccuucgccucccagguucaagcgauucuccugccucagccuccugaguagcugggauuauaggcgccugccaccaccccuggcuaauuuuuguguuuuuaguagagauggaguuucaccauauuggccaggcuguucucaaacuccugaccuugugaucugccugcuucagccucccaaagugcugggauuacaggugugagccacugcacccggccuauguuuauauacuuuuuaaaguaaaugauuuguggauaaaccugauuuuuuucccuccuaccaucuuaguaucuaaugcuuuuaaaggagcuuccuggagaagaguaccccuugccaauggaagauguucuugaacuucugaaaccacuaucguaagaaauuaaaaccuuauguuauguucacuuuaaaguuauaaaauaacugauguguucuguuaagcuuauaaaguugaacuuuuuuuuuuuuuuuaccacagcaauguguguucuuuguaucgucgugaccaagauguuuguaaaacuauuuuaaaccauguccuucauguagugaaaaaccuaggucaaagcaauauggacucugagaacacaagggaugcucaaggacaguuucuuacaguaauuggagcauuuugguagguacagucuauuuugugguccuauuuuucuuuugcuaucuguggauacgaaugcaaguuuuguauccacaucagugauuucuucugaucuuccuacauagcuaauacaucuuuuaagaauagcagaauguaauuuguguuucccucagucgcuugaagaacuacauugcuuuuuguuuaaggcuuggcuuucuaaaccguuuaacucauuucucugcaaauuuugaaucacuuaauaauuugacauguauagugaauaaaggauaacaagccaaaaucaguugaauuguucauguucccuaagugaacaaauuggccuuguccuuaucugguuauuuuaugcauauugucacauuccaagauaacacccugauacuuacagaggagcacauacauauaauuuagaacccuuguacuaucugauugcuaaguaauucuaaaucaauagacuguuuuuuguuuuuguguuuuuuugagauggagucucacuccaucacccaggcugcaggcuggagugcaguggugcuauaucugcucacugcaaccuccgccuaguagguucaagcaauuguccugccucagccuccugagcagcuaugauuacaggcucccaccacaaugccuggcuaauuuuuuuguauuuuuaguagagaugggguuucaacacguuggccaggcuggucccaaacuccugaccucaagugaucugcccaccuuggccucccaaaguguugggauuacaggugugagccagugcacccagccugaaugugguuuugaaaucuucaauauaccaaacaaagaaaucuucaauauaccaaacaaagaaauuucuuucuaaaguaaguuuacuguaauguaguuuagccauucuaugguagcccccaaaaaaggacauaaugguauaaaacaaauaauauacgcuaaaaugaauucuuuuacacuaauuucuuuuagcuugaauuuuuggcaaggugaguauguuggcauauuccacauaaugacaaauaaguuuagcacagaaagacauauuggaaguaacuuacaauaaccuuucagugaguuuucugagugcuuuuaucagaaugauuauuuaacuuuggaaaacuuacuugauuucaggcaucuaacaaaggagaggaaauauauauucucuguaagaauggcccuaguaaauugccuuaaaacuuugcuugaggugaguuuuugcauuuuuuuaguaagaucuccauugaaaauuuuaaagcagucuuuguuuguuaaugaguaauuuuucucuauuucauauuuaaccacaguucuuuucccguaggcugauccuuauucaaaaugggccauucuuaauguaaugggaaaagacuuuccuguaaaugaaguauuuacacaauuucuugcugacaaucaucaccaaguucgcauguuggcugcagagucaaucaauagguaaugggucaaauauucaugaaguauuuggaaugcugcagauggcaguagaaugucuuacauaguaacagcucacaguugcaauauuaaaaauagcuaacacuuguugaguauauacggugugccuggcauuuauguuuauucuuaauucuuauacuucugucacuuagauucuauuauuuccuucaauuuauaaaugaaaacugugacuuagugagguaaaguaacuugcuuaugccacagagcuaacaagugguugacucgagugaggugugucuacuaucauguacaggagauacggacuguuuggaaauuacugugauuuuaugugaguuuaugaaaugauaauuagcacauuuuacauugugcuaauuacaauuauauuuacuugagugaacauccagugaagcacuggaaggauucuaucaugaggaucuuuuauauuugaguacuggaauaaacauauauuaauuucauucuuuuuuuuuuuuuuuuuuuuuuuuuuugagauggaguuucgcucaugucucccaggcuggagugcaauggugugaucucgguucacuucagccucuaccuccucgguucaagcaauucuccugccucauccuccugaguagcugggauuacaggcgccugccaccaugcccagcuaauuuuuuuauuuuucguagagauggaguuucaccauguuggccaggcuggucuugaacuccugaccucaggugauccacccaccuuguccucccaaagugcugagauuacaggcgugagccuuuaaucauguaguuuuugucauucguucuguuuaugugauggauuauguuuauugauuuguguaugcugaaucagccuugcgucccagggaugaagcugacuugauagugguggauaagcguuuugaugugcuggauucaguuugccaguauuuuaucgaggauuuucacaucgauguucaucacggauaauggccugaaauuuucuuuuucuugugucucugccagguuuuggaaucaggaugaugcuggcaucauaaaaugaguuagggaagagucccucuuuuucuauuguuuggaauaguuucagaaggaaugguaccagcuccucuuuguaccccugguagaauucggcugugaaucccucugguccugggcuuuuuuugguugguaggcuauuaauuacugccucaauuucagaacuuguuauuggucuauucagggauucgacuucuuccugcuuuaguugggagguuguaugugucuaggaauuuaucacuuucuucuagauuuucuaguuuauuugcauagagguauuuauaguauucucugaugguaguuuguauuucugugggaucagugguauuauccucuuuaucauuuuuuauugagucuauuugauucuucucucuuuauuagucuugcuagcggucuguuuuguuaaucuuuucaaaaaaucagcuccuggauuaauugauuuuuuugaaagguuuuuuuugugugugugugucucuaucuccuucacucagcucugaucuuaguuauuucuugucuucugcuagcuuuugaauuuguuugcucuugcuucucuaguucuuuuaauugugauguuaggguguugauuuuagaucuuucccacuuuguccugugggcauuuagugcuauaaauuucccucuaaacacugcuuuagcugugucccagagauucugguacauugugucuuuguucuuauugguuucaaagaacuuacuuauuucugccuucauuucauuauuuaccuaguagucauucaggagcagguuguucaguuuccauguaguugugugguuuugagugaguuucuuaauccucaguucuaauuugauugcacugugaucugagagacuguuacgauuuccauucuuuugcauuugcugagguuuguuuuacuuucaauuauguggucaguuuuagaauaagugugauguggugcugagaagaauguauauuacucuguugauuugggguggagaguucuguagaugucuguuaggucugcuugguccagaguucgguucaaguccugaauauccuuguuaauuuucugucucauugaucugucuaauauugauggugggguguuaaagucucccgcuauuauuguguggaagucuaagucucuucguaggucuaagaacuugcuuuaugaaucugggugcuccuguauugggugcauauauauuuaggauaguuagcacuucuuguugcauugauccuuauaccaucauguaauguccuucuuugucuuucuugaucuuuguuggauguuuguuuuaucagagacuaggauugcaacccuugcuuuuuuucuuucuauuugcuugguaaauauuccuccaccccuuuauuuugagccuaugugugucuuugcaugugagauggguccccugaauacagcacacugaugggucuugacucuuuauccaauuugccagucucugucuuuuaacugggacauuuuagcccauuuacauuuaagguuaauauuguuaugugugaauuugauccugucauuaugaugcuaacugguuauuuugcccauuaguugaugcaguuucuucauagugucaauggucuuuacaauuugguauguuuuugcaguggcugguaccagcuuugccuuuccauauuuagugcuaccuucaggagcucuuguaaggcaggccugguggugacaaaaucucucagcauuugcuugucuauaaaggauuuuauuucuccuuugguuaugaagcuuaguuuggcuggauaugaaauucuggguugaaaauuauuuucuuuaagaguguugaauauuggcccccacucucuucuggcuuguaagguuucugccgagagaucugcuguuaagucugaugggcuucccuuuguggguaacccgaccuuucucucuggcugcccuuaacauuuuuucauucauuucaaccuuggugaaucugaugauuaugugucuugggguugcucuucuagaggaguaucuuugugguggucucuguauuuccugaauuugaauguuggccugucucgcuagauuggggaaguucugauaauauccugaaggguguuuccaacuugguuccauucuccccaucacuuucagguacaccagacaaacguagauuuagucuuuucauauagucccauauuucuuggaggcuuuguuuguuccuuuucauucuuuuuucucuaaucuugucuucaugcuuuauuucauuaaguugaucuucaaucucugauauccuuucuucugcuuaaucaguucggcuguugauacuugcguaugcuucacgauguucucauccugcauuuuucagcuccaucaggucauuuauguucuucucuacacugauuauucuaguuagcaguuccucuaaccuuuuuucaagguucuuagcuuccuugcauuggguuagaacaugcuccuuuagcucagaggaguuuguuauuacccaucuuccgaagccuacuucugucaauucgucaaacucauucuccguccaguuuuguucccuugcuggugaagaauugugauccuuugcagcagaagaggcauucugguuuuuggaauuuucagcccuuuugcgcugguuuuuccucaucuucguggauuuaucuaccuuuggucuuugauguuggugacuuuuguaugggguuucuguguggacauccuuuuuguugauguugaugcuauuccuuuuuguuuguuaguuuuccuuuuuacagucaggccccucugcugcagaucugcuggaguuugcuggagguccacuccagacccuguuugccuggguaucauccauggaggcugcagaacagcaaagauugcugccuguuccuuccucugggaagguucgucccagagcggcacccgccagauggcagcgggagcucuucuguaugaggugucugucgaccccugcugggaggugucucccagucaggaggcacgggggucagggacccacuugaggaggcagucugucccuuagcagagcucgagcgcugugcugggagauccgcuauucucuucagagcuggcaggcaggaacguuuaaguccgcugaagcugugcccacaaccaccccuuuccccaggugcucugugucagggagaugggaauuuuaucuauaagcuccugacuggggcugcugccugucuuucagagauacccugcccagagaggaggaaucuagagaggcagucuggcuacaguggcuuuguggcacuauguugggcuccacccaguucgaacuuccuacuggcuguguuuauacugugaggggaaaacauccuacugaagccucaguaauugcagacgccccuccccccaccaagcuucagugucccaggucgacuucagacuguucugcuggcagcgagaauuucaagccaguggaucuuaacuugcuggucuccaugggggugggauccgcugagcuagaccacuuggcucccuggcuucagcccccuuucuaggggagugaauggguccgucucgcuggcguuccaggugccacugggguaugaaaaaacacucuugcagcuagcucagugucugcccaaauggccgcccagcuuugugcuuuaaacccagggcccuggugguguaggcacccaagggaaucucuuggucugcggguugcaaagacugcgggaaaagcguaguaucugggcaggaauccaccauuccucacagcauagccccucacagcauagucccucacggcuucccuuggcuaggggagggaguuccccgaccccuugugcuucccgggugaggcuacaccccacccugcuuugacucucccuccgugggcugcacccacugucuaaccagucccaaugagaugagccaucuaccucaguuggaaaugcagaaaucaccaccuucugcguugaucucacugggagcugcagaccagaacuguuccuauguugccaucuugcuguucccuuguuuuauuuuucucuaguauuuaugauaacgugaaacauauuuuaauauauuuacuucuccguauuccacuaguauauauguuccuaaaggcacugguuuuugucuguucuguucauuguuguauuuuuagcaccuaaaacaauacuuggcaugugauagguauccaauaacuguuuuaaaauaaaugaauguacuugaaaaaaaauuacaugaugcuucaaaaacaucaaagcugaaaaucauuugaguaacuuuaaaauguaagcaaucaauaauaaaagauuacuauauuguucagcagucacauaaaguauuaaaacuaauauuucaguauuugaauaugccgacaguaauguuuucauaaacuagauuuugugucuaacuccucagguuuggaacuguuuuuaguaagaccauaaugcauugcaaggauuucuaaugaauauguuuaguaguucaagcccuuauuaaauuucacagauaaaagcaaauguaugcugaacuuuaaggacugagguaauauaagacugaauugaauguaauaaggcggcaguguagugguggcauuaaaaaaacugaagauucaaaaaguauaaauucaagaauaacaugcaaguagcauucuuuuuuuuaauuuuacacuuguuagauuuugucuuagucccuuuguguugcuauaaaggaauaccugaggcuggauauuuacaaagaaaagagguuuauuuggcauauggcgucuacaucugguaagggccucagacucauggcagaaggcaaagaggaaucagugugugcagagaucacauggugagagaggaagcaaggguggaggcggggaaggccaugccaggcucuuuuuuuuaauaaccagcccuugugggaacugaauagugagaacucacucauuccuuacccucaggccuuaaucuauucgugagggaucugcccccaugacuccgacaccucccauuaggcauaaccuaauggggaucagauuucaacaugacauuuggagggguuaaacauucagacaauagcagauaucuaauguucagcuauuuuaagagcagugagugaaacuagaagaaucagaggaacauaaacaauuauaaaagcuucgauuacuaaaaaaggauaaaagacaaaguugauuaaagaguuauccuuaaauauguggguguuacgcaaaagguguacugaucaacuuuuuuccaucacauaaaacaaaauuuaaaugguacauaaaaacauuaacuuacccgcuuucagagugauuaaauguuagagcagguugacauuggaaucuguggacucaacuaauugguguucggccagagaacaguuuaucuuuucuggcuaguuugaguucagugcuguucaaauuugagcaauaguuaaaauauauuuugagacccucuucaguucuaggagaaaauagauuuuguauucaagaccuuaauacuaagcugcuggucugaaccucuuuaaauaaacucagguuuuguuagucuuuaagaaagagcuaguauguuauuaugucucacagagugauuuauuuuuguucuggaauaugcuuuggaaaguaggguuugaaauuagaaaauuauuucacuuuuuguuuguuuguuugcuugcuuguuuuaagauuguuccaggacacgaagggagauucuuccagguuacugaaagcacuuccuuugaagcuucagcaaacagcuuuugaaaaugcauacuugaaagcucaggaaggaaugagagaaaugguaauuuuaaguaacauguauuugcuguuaucauaugcuugcuaugaauaucccauaaauuacuucaccaaguuugguauaagagaguuuauaauccaguaguuuacaguauaaagcugcucuaaaacaacuguaugaauugauugaaacugcauucuuucugggucacaaugggucaaaucauagcaauuucuuuugguuuagcauuuuuauggagaaacccaaaauuuaacugaguuuuuaugggaguauaaauggcucccuuuuuuauuuuaaaaauccuuuuauaugugaucugauuaaaagcuaauuaagggaacaggugacaaugggaagaaauggauugaggagaagaaucucacacaaaaucaaaucauugugguguuuacagugaaacuugugauauuucacguuucuguagaauaauauauuuuuuaugguaaugauuaucuuagaguucaaauuuuuucauuuauuuaugcccugguuuguuucuuacaaguauuuaagguaguuaaauaacugucaagucugugauagcaggaaauugaaaggaacaauugaaagaaugugaguuuagaaaagaauuucaauagauuagaaagauaaguguaaauaacauaaaaucuaaugagauaauguauauuauacauuuuaaaucagccugucaucugcaaaaagggaaaauacugaucugacagcaauucauuuagaaaaagaccuaggaaguuuuguaucuugugauuauaguaugaaucaacauuguauuacaguuaccaaaaaggcuaacucugucuuacacugcauuaauagaagcauauugucaugaacaaaguuaauacaagaacuuggaucuuuuauacuuuuugcuuuauuuuuagaucuuuuaauuuuuauggguacauaguaggggugugugugugugugugauacggguauacaaugugaaauaaucacaucauggagaaugggguauccaucccccaaacaaauauccuuuguguuacaagcaauccaauuacacuguuuuaguuauuaaauguuucuguauuuuuuagaggauaacuauaauguuugguuugguucugaguaaaguaaaagauuuuuagccagaauguuauagaucugugucuuauaaaaaauggaugaaggaauugacuuaguggaaagcucacauuuguuuuuaaacaugucagugcuugugauuuagcaaagguauugguccuuacucuuucuuguaccaaaagacagaacuaggauuagugaguaggagguuucugaaauguguauagcuugucaaaaaaucuggaguucaguugggauuuuauaauugauuguuaaacauuuacauuuuacauuacauuuuuuuuuuaauuucuuuuuaagucccauagugcugagaacccugaaacuuuggaugaaauuuauaauagaaaaucuguuuuacugacguugauagcugugguuuuauccuguagcccuaucugcgaaaaacaggcuuuguuugcccuguguaaaucugugaaagagaauggauuagaaccucaccuugugaaaaagguauauauggaugaguauuuuauuagaagcuuccuuaggucacugugaaauaauuuaaaaaguuaaagcuagauuuucugaguggcacuuauuuaagacuaggaaacaauuuuauuuuuuagguugggaauauuggaaagcaguuauacaaaaacuauucaaaugguauauuuaugguaugcacuguuucuuacauuccauuuaagagcauuucacaaggcuuucauuguacuaacaagagugaaugacuuguccaccagacugaccaggcuuuuggaaauaguauuuauugagggaaacacauggagacaagagcagcauagguguuuugcccgguagauucuggggcagcacauugggauccagcagggccagaagucaaauuuuagagcuaucaggcuuuuaaguucaguuaucaggggagaaggacuaggguccaagccuuauaauuacuacaucagcacaguauuauagaauguuggccccgucucuuuuccaucaccucagcauuuaugguuuaggaaguuccagaccuuuccauugcaaauuuuuaugugauaaaucagugguaggucaguggacugauauuaugccaguuaacauucuaccagcauaguuuccauggugcuuuggaguaagccagccuauaaucaguuagccuuuuaccucucaguauaagacuuguucgguguuucuuaaaaguauacaaauacauuaccuaauaaucauaaguguuauguauuguuuggauuuuucuuauuuggauuuaagccuaagagaaauaauuuuacuuuauauuuauuuauuuauuuugaaagacagggucucacucugucacccaagcuggagugcggugaugugaucauggcucacugcagucuugaccuccugggcucaagcgauccucccaagccuccugaguagcugggacuacaggcaugugccaccacaccuggcuaauuuuuuuuuuuuuuuuugagacggagucucgcucugucgcccagacuggagugcaguggcaugaucucggcucacugcaagcuccgccuccuggguucaugccauucuccugccucagccucccgaguagcugggacuacaggcgcccgucgucacauccacacaccuggcuaauuuauuauacagacgggcucuugcuauguugcccaagcuggucuugaacucuugggcuuaagcaacccucccuccucagacucccaaagcguugggauuacaggugugaaccaccacuggccaguaauuuuacauuaaaucuuccuuuaaguauaaccaaauguuggaaacucuuagcauauuuuuauauuuuuauuuacuuaacauuuauuaaggguuugcuaugugucagauacugugccaguugaguacauuuucuuaauuauuauucccaucucauagaugaggaaaucaagaaaaguugaaugaauguuguuucuagguccuacucuaaauaauauuaacaagcauuuaaaugauuuauuuuuuucauuuuucuuaacacauugacuuuuugguucgugcagguuuuagagaaaguuucugaaacuuuuggauauagacguuuagaagacuuuauggcaucucauuuagauuaucugguuuuggaauggcuaaaucuucaagauacugaauacaacuuaucuucuuuuccuuuuauuuuauuaaacuacacaaauauugaggauuucuauagguaaguuuauacaugacauaugugaaauuuguuuaauuuaaaauuaguuaacaauacuuagcaaguccccucaccagcaacacacauaccauacccauacacaugugugugugggagccuacauaguaugagaagcaggacagcuucuuuuaauaagaauguauugaagggagucacuggacuucagaucugguccuagcugugccaacaaccagcuaucugacuuuggucaaaccacauaaagacccucuaugccuugguuuuuuaauauguaaaguaagcaaguuacacaaggagaucuuucagguccuuuucagcuuuaauauuugaucaucuuuccuuuggaaaaaauugaagauaaauuacuaguagcugguuauuucugccuuguuuuucuuuucuguugcuugacuauaggccucuuaguuauuacuucuauuagauuuagaaacuuaauguaaaacuuuauuuugcuaacuuuaacucuguagaagaaaaauuugaaaauggagagguuugaaacaacuaaaaaguaauguuuagguaucaggaugaugggaaggcaucucauauuuguugaacaugcucuguguuauggacuuugcuaugcauuuuacauguaguguaucacagaucugaguuucagacuuauccuaauagaguuuucuaauagauuaugaguuguauguagguaguuuccuuuaagaaggauauuccuacaaaaguaaauuuagugguccuuauaguucauucauuuuggcaagaacaauauagcuauaucucuguauaugcgagggauucauuccaggaucccccauguaugccuaaauuuacgcguacucaagucaccaaguuggcccugcagaacccacguauaugaaaagucaguccucuguauauacagacuuucacauccugugaauacuguuuuucuaucugcauuugguugaaaaauaugcaaguauaaguucaaacccauguuuuucaagggucaacugcauuuauguuaguugauuaugcagaagaaauaaauauaaauucaagucuccauuuuuauuuguuuauuguuuuguuuuuucuuuuugcuaagggugcuacugaacaaggucccauuuuuaaaucccauaauuaugguggugguauguucuaagcuuucuaauuuuuuuaaugugacuauuuagaauuuacuuaauuuuuccauuuauaaaauuaaagaauguuuaauaaucuggauaaaguaugauacuuuaaugcugaugguauuaaaacaguuuuuaagaacuauuuuauaaaauuuuacuuggaaaaguuauauauaaccuguauuuuaaauuuuucuauuuuuagaucuuguuauaagguuuugauuccacaucuggugauuagaagucauuuugaugaggugaaguccauugcuaaucagauucaagaggacuggaaaagucuucuaacagacugcuuuccaaagauucuuguaaauauucuuccuuauuuugccuaugaggguaccagagacagugggauggcacagcaaagagagacugcuaccaaggucuaugauaugcuuaaaagugaaaacuuauugggaaaacagguauggcuucaauuuuuauguacuuuucauucccugaaugauaugagauauaaccuuuaaguuuuaaggcuauuuauucgauuuauucguauuuauauauugaaacuuagcuugugguaaucauuaucuagcauagccaacccaugaauuuuuuugguuaugucguguugucucccucugauuggcuuuuaacuaaguagaaauguuuuaaauuagaaauaauccaaaaaaccauuugaauaauuuucuucugccauuuaaaaauuuauuuuaacuguuguaauacacgaaugcaaacugguuguuaaagucaaggaauacuaaacaguguacagaaaaccuucacucccucuucaaucucaccaagcuuuccacuuuucaagaaaaacaaccgucccucauuccuauaguucucauacccugcuguuuguuuuuuugugacacuuauuaccuucuaauguaugauacaauuuaccuuuuuuuucugucuuugcuuuuguuuuugagacagagucuuacucuuuugccaagacuggagugcaguggcaugaucucaguucacugaagccucugucuccuggguucaagcaauucuccugccucagccacccaaguagcugggacuacagcugcgcaccaccacacccagcuaauuuucauauuuuuaguagagacgggguuucaccauguuggccaggcuggucuuuaacucuugaccucaggugaucuucccaccucagccucccaaagugcugggauuacagauguaagccaccuugccagaccauaauuuacuuuugaauuauguuuauuauuuaccagucuucuccaguauacauuuuucucucuuuuuuuuuuuuuggcugauguaucucuaauauauuuugaguauucauuaaauguuugucaaaagaaggagucaaguaaggaaggauuuaaaaagcuucguuuguuuuauaaucauuuauauacauuuccaaaauuuuuugaagcaacuuauauuaaaacauacauacaaauuuuuuaagauaaaaaagcuguggucaccccacauuuauguauguauuuauuuauuuuggauauaaguaagggauaaguaaccaaacuuggucaauauuagauaaacuucaagggaccuuuuuuuuuuuuaguuuccuaguuaucuauauugaaccaagaaauggaacagcaaguuccuuaguugcuuagguggaccuauucagaacugguuguaagucugcagucugaagggaaauggugagcagaggacuccuuucccaaagacagcuggaacagaaauaggcacuccagagguuauggaauuugagagagauacucagccucuagccacucccauucaaucucccagcuuagucuucugagcauucuuaaucuuacuauucuuuucuuaauguauucaaaccaaaagacagcaauuuuuagagccugaauagguuuuggagggaaaaguaauuacguucaacuucgauugaaacucuugccucaagaaugaagaacagcaaaaauuaaaucacaguuucuuagcuuuuugguuaaagauguaaguuaaauucuuggccgggugcgguggcuaacgccuguaaucccagcacuuugggaggccaaggcggguggaucaccugagaucaggaguucaagaccaaccuggccaacauggugaaaccccaucucuacugggugugguggugugugccuguaaucccagcuguuugggaagcugagucaggagaaucacuugaacccgggagguggagguugcagugagccaagauuguaccacugcauuccagccugggcaacagagcaagauuucgucucaaaaaaaaaaaaaaaaaaaaaaaaaagaauuguauaaaacacacaaacaaagcaaggaaagaaugaagcaacaaagccagagauuuacugaaaaugaaauuauacuccacagagugggagugggcccugagcaaguggcucaagggccugguuacagaauuuucugggguuuaaauacccuucagagguuuuccauugguuacuugguauacacccuauguaaaugaaguaguggucuguaaucagucugauugguuauaggaggggaccaaucagagguacuuucaauuucuuaucugccacaguaaaagggaggggguugcaaagggaguagccucuuguccuuuuguuacuugagcauggaaaguugggguuuuccuuuugauuucguucuaggaggucagcauggauugaccuuagguucccugccuccagaccuuauugcccugccucauuuacguuagguuucuuucuugucaccuucuaaaauauuuuuuguuauuaggaaguauguuuuugaacuuccuuaugcauuaaguaaauuagccauuuaucacuguaauuccuuauuuggaaaguuguuauauucacccuuaagacuucacaauucucauucauuuaacuaaagugcaacauagcagacuuauucuuuauauuuagagaauuugugucuuuugugaagcuaccugucuauagugggaaguagauuaaugaaaaguccaaaucuguuggggaggguuuuauucuacuauugaugaaaggggauguggaucgcagcuagccuuagaauuugggauggcacucaaguagaagucugggaagaaguuacgcagggaacaaagaugacauuguucgcagucccugggaauucuuaacaguaaaguucuguaauugagacagaauucccaaauaaagucaagaguaaaauucagauagaggagcaguuauacaucagugggaaauuugguuggcagaaaaauuaccaggucauacaacuuaaugauagaccugaagucuuauuuaaaaugauucucuaaaauugaagaauuggauuaagggggccuuguuuggcugauuuucauacuuuuuccucuuagucuacagguuggcugcauagaagaaaaagguagaguuauuuauaaucuuguaaaucuuggacuuugagucaucuauuuucuuuuacagucaucgaauacuuuuggaaauaagguaauauaugccuuuugagcugucuugacguucacagauauaaaauauuaaauauauuuuaauuuugugcccuugcagauugaucacuuauucauuaguaauuuaccagagauugugguggaguuauugaugacguuacaugagccagcaaauucuagugccagucagagcacugaccucugugacuuuucaggguauguacauuuuaaacuuagagaacuagcucuaacuucacaaguuuuuaaagaaguuuauugguugacaccuucaaugucuauuucaauuuauagacaucacucuuuuuaaaaaauuuucuuuaaaaauagccaccuuugaauugagguaauuaccuauccucuuuuaccauagucuccccacaguaauuacucuuucuaaauugaccacuugguuggccaacccaauaaccuuuucuuagucuuucuguaauauuugaacauugugccaucuguuggcccuugaaauuuuuuucuucauacacauuauuccuaguucucuucucuuuaucuaggucuugccuuucuagaucaccuuuucuuuuuuuuuuugagauggagucucacucuguugcccuggcuggagugcaguggcauaaucucggcucacugcaaccucugucuuccaggcucaagcuauccuuccuuccaccucagccucucgaguagcugggacgacagaugcacaucacugcgccuggcuaauuuuuuauauuuuugguagagacgggguuucacuguguugcccaggcuggucuugaacuucuggccucgaaugauucccccguguuggccaaccaaagugcugggucuacaggcaugagccgccguacccagccucaccuuuucuuuauugugcguuauuaucuguacaauuuaauuuggaugugaaugucucugaguuguauaugaacaucagaguuguuucccuggcuugauuguaagcuacuugaaaauaugcuuuacuuuuuuuuuuuuuuuuuuaaugugcccuacugugcugggcauauaaaauaguaauaauaucugagaaaguacuuucacauauguaauuucaugcugucuaaauaaguguugauugccaugucuuaaaguacugcuuuuacaguacuggcauagagcuuugauucugaucugaaguaauacugaggcucauuuauugaacugccuuuuaacuuuauaagauuuuuuaagaaaaucauuauaagaucauuuaagauuauuuaaguuacugagggugaaagguauuuagauaaucugauuuauauaucuggacugugauaugucauuugugauuuuauugaaaguauaguuuuucaguagaaaaaugguuuuugaauuuggggguuauuaaaaucuaaauuuucauuuuggaaguucacuggucuaugaacaaaacuuuuuaaaacgaugacuguauuuuuucccuuaacucuguuagggauuuggauccugcuccuaauccaccucauuuuccaucgcaugugauuaaagcaacauuugccuauaucagcaauugucauaaaaccaaguuaaaaagcauuuuagaaauucuuuccaaaagcccuguaaguauacaugaugaguuuaauaauagaacauuccuucuuuuuuagcuaaaaaaacuuuguaaauacaucuuaaagaggaaaaguaaacaaaugaaaaauuuaucucauaauuaaaaaggaaaacauucauuuacaaguuuaaaugguauuuuacuugucagcauuaauugaaauauguuacauaugagaacagaaucuugugacacuuuagugauauauuagcucagggaauauaucuacuuuuucauaggaauauacuauuuaauuguaguuuacuuucugaaaauuaaauaaauuggcaauaguuuaagauaguaauuuucuuaauguaacauuuuguacuugauaucaaacccaaaucuaaauucuguuauuuaguuauuuuaaauauaaaauguguagguauucaaauauuugaagaaaaaauauaaaguguauuuauuguagccgaguaucuaauuaaacaaguuuuuacuaaaucuguuuauuuucuaggauuccuaucagaaaauucuucuugccauaugugagcaagcagcugaaacaaauaauguuuauaagaagcacagaauucuuaaaauauaucaccuguuuguuaguuuauuacugaaagauauaaaaaguggcuuaggaggagcuugggccuuuguucuucgagacguuauuuauacuuugauucacuauaucaaccaaagguaaauaacauauuuagaccaauauauaagcagucuuucuauccuguucuuccuguuuuuuugcuuuguuuuguuuuguuuugagacaaagacucacucuguccgcccaggcugggugcagucacggcucacugcauccucaaccuccuggguucagauuauccuuccuccucacccugccggguagcuggggcuacaggagcauaccaccaugccugacuaauuuuuuguguuuuuuguagaggugggguuucaccauauugcccaggguggucucaaacuccugggcucaagcgaacugucagccucagccucccagugugcugggauuacaggcaugagcuacuaugcccaaccuauccuguucuuuuaauugaaaguuuauaugcuucuaagagguagauaccagaauguugcuuucugaauuuugcuuuuuaagaugucuauuauauuuacuuauuaguuuuuaaaaauugcgcuacuugccugggaaacauagcagaccucguuucuacuaaaaauuuuuuaaaaaagaaaauuagggcaaggugugguagcucacaccuauaaucccagcacuuugggagguugagguagguagauugcuugagcccaggaguuagagaccagccugggcaacaugaugugaaaacccaucucuacaaaaauuuuuuaaaaaauaagccagggauuguggcaugcaccuguagucucaccuacuccagaggcugaggugggaggauggcuugcgcucaggaggcagagguuacagguuacagugagcaaagauugugccacuacacuccagccugggagacagagcgagacucuugucucaaaaaaaaaaaaaaaaaaaaaaaaaaaaagaaaauuauccaaguaugaugauaugcgccuguaguucuagcuacuuaggaggcugagguaggaggauggcuugagcucaagaguuugaggcugccagugagccuugauugcaccacugcauucaugccugggcaacagagugagacuuucacucaauuaaaaaaaaaaaaaaaagcacuacuucuccaauucuagaaaucuuaagaaggaucuucaacauuuuaauacuaauauucuagcuauugauggccucaaauaaauguuacuauagaauugggguuguucggccggguguaguggcucacgccuguaaucccagcacuuugggaggcugaggcggguggaucacaaggucaggagaucgagaccauccuggcuaacacagugaaaccccgugucuacuaaaaauacaaaaaaauuagccaggugugguggcaggugccuguagucccagcuacucaggaggcugaggcaggaaaauggccagaaccagguaggcagaucuugcagugagucuaauucgcaccacugcacuccagccugggcgacagagcaagacuccgucucaagaaaagaaagaaaaaacaaaaacaaaacaagaauugggguuguucaauuuagcaucucugaucuuuuccauugauuuuaaugagauuucuauuuuuuaaggucuuuuuuauugugguaaacuauauaacauaaaauuuuuuauuuucgccauuaaauggccaguucaguagcaucaauuacauuuccauuguugugcaaccaucaccacugucuauguccaaacuuucauuaucucaaacugaaccucucuacucauuccacaauaacuccacauuccuccuccccacuggccauugagaaacuaaucuauuuucugucucaaugaauuugccuauuguagauauuuuaaucuagaguuguacaauauauguccuuuugugucuugccuuguguggucacugaaaacuuuguaccuuagcuuguguuuagauaguguuugauagagauuuccuuggauaccaagaguguugggaugaggaagcaugagaggagaaaacuuuuccuaguguuugcagauuggcuuuaugcuaggauucuucuucaacacuuagccaugcuugcauugcuugggaucagccccaaauacaagcuuagggucuucucuggucuuuucugagcaagagucuuaucuugagcauguguguggcuuucugaauucccccuaauuugugggugcuuuugaauauacuaauuucccaaagaaauacgcuccccagcuacuccuaggcuuuaggcagccucuuguaugucucaacaguaaucuuuugcccuaugcaccugcagguuguuggucugccuuacaaaguuucaagcaacacccauaucuuuuguagcugguaugaaguuaaacaaaacagagcuacgcacuuuacaucaguccuugguuccagacagguuagaauagacauauacaauaguuugcaacuaaucuacuuagcuccaugaacuaccaugagccagugucucacaccgaggauauaggccacugcuuuugugauuguugccacgcugggguaggggugggcaaggacaaguaaaguuaccacaaagcuuuccugcuguuuuucaguuggauuuuucuugauucaauauuuuccugauuacuguaaaccuuugacuauuuuacagaauucuaacaaaauuaguucugacaauuuugccuguuuuucaauguuucuauuaaaggauggaagcuuagagcugccuauucugcauuuugcugaugugacuucucuuuuuggcuuauaagccauuaaaauauuuaugucaaggcauauaagaauuagagaugcugaacaaaaggacuucugaaugaauuuauuucagaguaauuuuccagaacuuacugguuguuguuguuuuuuuuucucccuauauuaggccuucuuguaucauggaugugucauuacguagcuucucccuuuguugugacuuauuaagucagguuugccagacagccgugacuuacuguaaggaugcucuagaaaaccaucuucauguuauuguugguacacuuauaccccuuguguaugagcagguggagguucagaaacagguaauuuucugacucaucuucaaaaugguauuuaaaauauauaaaguauuguuagaaggauuugaguguuuuauguuuauuugguauaauuggugauuuuauugagaauauuuuuuguaaaaugauuggaaaaauauucuuaaugaauuaaccuuuguaaucaauuacagagcacuugguacuuuugauaguuuuaucuacugugcugaaguagagagguagucaaaacuagggauagcaguucgcaacguuauggugguauuugaguuacuacuuauauaaacuguuucauuaauauuggcauuuuuuuuaaccucaguacccaucuuguaguaguaccuuacauaguuauugaauuauuugaaaacacagaaacuaaaagcuggguaucuuagacguaauuagaacauuuaaucugaucuagguuaauagauuuuaucauuuauuacaguaaguuuuguuggcuuacuuuaaaauuauuucucuccuuauaauuuuuucuuuuuaaauuauauuuagguauuggacuuguugaaauacuuagugauagauaacaaggauaaugaaaaccucuauaucacgauuaagcuuuuagauccuuuuccugaccauguuguuuuuaaggauuugcguauuacucagcaaaaaaucaaauacaguagaggacccuuuucacucuuggagguaauaaaaauuucaucaucuacuauuuuuuauuagagaacauaguaguacuuuucaaaaaucuguaaugcucuagcaguaaaaaauggaaucuuuucuuuaauugugauuaaaaauauauacguaggccaggcacauuggcucaugccuauaaucucagcacuuugggaggcugaggcaggaggauugccugagcccaggaguucaagaccagccugggcaacauggcgaaaccccgucucuacaaaaaauuagucgggcauggugauaugugcuuguagaaucagcuacucagguagcugagauggaaggaucaccugagcccuggaggucaaggcugcaauaagccaagauugcuccacugcauuccagccuggaugacagagugagacccugucucaaaaaaaaaaaaaaaaaauauauauauauauauauauauauauguguguguauauaaacacauacuuguguguguguaacgugagaucuaccuacuuaagaaauaaaaaaaugaaucuuaauguaucucuuugcauugaagccaaaguauaaauaacaaaacuuccugguaaagauccaaauuguaaguuuucaaggaaugugauguaaaauaguuuugauuuuaacacauaagauccuaagguccacugauagcucaaaacuaccaauggaucuuuucaaugucaauuuaauguuuguguuagagauaacguuuaacuuuugaaagcauauuuuaaguuuuaaucuuuauaaaccucgaaauuauguuuagguauauucuuccauacauaucuuaauuauaauuuuuaaaugauagucuguauuugacucuauguaaauauaaaaacauauuuaaguauguuaagauguaaaguuauacuacuaaagagaaauuuaagcauuuccuuccaguugaguaugcuauaacaaucuugaagucuguguuaccaugagagagucuauuagaauuuaaaggauuaggcugggugcaguggcucacgccuguaaucccagugcuuuggaaggcuaaggcgggcagaucaucugaggucaggaguucgagaccagccuggccaacauggcaaaaccccaucucuacuaaaaauacaaaauuagcugggcgugguggcacauuccuguaaaugccaccuuuucaggaggcugagacauuagaaucacuugaaccggggaggcggagguagcagugagccuugauagcgccacugcacucuagccuuggugacagagcgagacucugucuaaaaaagaguauuaaaacauuguaggguuugcaguggaagaaaucauuuauuucuuccuugauuaguaguaauagagacaugagucagugucuauaaauggcacuuaacuaauuuuuuucuuuuauuaaguuuuauuucacaggcuuaaccaauacguguuaaaagcaaguuacauuuucucuuuuaggaaauuaaccauuuucucucaguaaguguuuaugaugcacuuccauugacaagacuugaaggacuaaaggaucuucgaagacaacuggaacuacauaaagaucagaugguggacauuaugagagcuucucagggugcuaauuuuaaaugacaugggcuauuucuaccuguuucuuuuugaaagaauauuuugcaaagucuugcucuugguuucauugucacagacuuaguucagacucucaucauuuaguucagacccucauuucucaucuaacuguaaaacugguccuaacuggucuucucacccugaacucuuccuguuuuauucauccucugccagaugauuucucuaaacccaaauaugaucauguuuuucuacugccuaaauuuuuuuuuuaagagacagaguuuuuuuuuuuuuuuaagagucucacucugucaccuaggcuggaguguaguggcaccaucauaacuuacuaugaccuugaauuccuggguacaaggaauucuccugucucagccuucugaauagcuggaacaacaggcacacaccacuacaccuagcuacuuuauuuauuuuuuuuauuuuuuguagggacaggggucccacuauguugccuagguuggucucgaauucuuggccucaagugauccuccugccuuagccucacaaagcauugggauuagaggugugagccacggcaucuagccaugcuuaaacauuuuucauuucuuuuucuuuuuuuuuaagacggaguuucgcucuuguugcccaggcuggaaugcaguggcacuaucuuagcucacugcaaccuccaccuccugagcucagauucucgugccucagccuuccuaguagcuaggauuacaggcaccugccaccaugccuggcuaauuuuuuguauuuuuuuuaguagagacgggguuucaccauguuggccaggguggucucaaacuccugagcucaggcaauccgcccaccucagccucccaaagugcugggauuacaggcaugagccaccgcggcuggcccaugcuuaaacauuuuuaacaccuuccaaccauguaaaagaaaauuuuaauuccuuagagccagacauacaaguuagucuugucuucuaguccaguuuaccugaaugaaagaaauaugucucauuuuaauacuuuagucauauguguuaugugugucuauauauauguaaguauguauuuguaaguuuuucuagcuugcuuguuaauuugauuugaaauguacauuauuacaguauuugggaaacuuucuacuuuguguuuugauuuucaucuuccuauaccaauuaauuucauauuucuuuuuuuuuuuugaaacgaagucucacucugucgcccagguuggagugcaguggcacagucucagcucacugcaaccuccaccuccuggguucaagugauucuccugccccagccucccaaggagcagggauuacaggugugugccaccaugcccagcuaauuuuuuguaucuuuaguagagacgggguuucaccauguuguccaggcuggucuugaacuccugaccucaagugauccaucugccucggccucccaaagugcugggauuacaggcgugagccaccacgccuggccuaauuucauauuucucuuguguuguuuuuacucucaguacuuuuuaaaaugaauuuuaguuuugacuaucugagcauagaguuucuaauacauuugagauauauaaaauguauguaaauagaaacaccauuauuucuuguacuuguguucuugaguauuuuaugggcuagagaucugccuugugcauuacagccacuagccauuuggcuauuuaaaugaaguaaaauuaaaugaaauuugaaguucaguuuuuucauugguacugaacacauaucaaguucucaguaguacauuuggucaguagugaucauuggacaguguagauuauagacauuuccaucauugcagaaaguucugugggacagugcuggucuaaacucuaaauguuagauguuaaaaagccaagcaggcucccaaagucccuucuagcuuuaguguugaaugauucuugugcuucuguuugugauuuugcuaagguguugacuuaucugcacaauuuguuuaagacauuuuauuuucucuguugucacauauugcuaaucacuuucaaaagaaucuguuguauuaaggaaguucagauucauucccuacauauuuuuugagcuacucaugacuuaaaaccuuuuuuaaacuuuauagaaguuuucuagucagauaauuuaauauauaugcaauuauaaacaaaaguguugucuucaugcuaguuuaaacuaauuuuuaaaaaauuauuucuagauaauccgcaagaugggauuauggugaaacuaguugucaauuuguugcaguuauccaagauggcaauaaaccacacuggugaaaaagaaguucuagguaaacuacagucaugcgcugcgugacauuucagucaacugcggaucacauauaggacagauuauaauacuguauuuuuacuguauguuuucuguugccuguaguauucaguauaguaacaugcuauacagguuuguagccuagguguguaguaggcuauaccaucuagguuuguguaaguauauucugugauguucacgcaaugacagaauugcccaaugacacauuucucagaacauaucugugucauuaagcaaagcaugauuguauuggcggaaugaaugugaguuaugcgguggucaucuuuauuauaugagugguuaucuuuauuauaucuucaaaauaagugaggguuugucauuugggauauuggggaaauaugagaugcuagcuaaguuacaugccuauuuaauuaaaaugucccuaaaaaggccccuuuuguacuuuucuuccuuaaauauucauauaaaaugaaaaguuagagauuuacauauguguauaacuuaauuugaaaaugccuuguaaauauuuaggaaagucagaaauacuuguuuuuagaguuaaguugcaaauaaauugacugccgauauauuuuauaaauacauuauaacugacagguacucagugucuuuuguuauguagcagacauaagaaugaagacuuggagggcuagauuaaacuuaaauaauuaaaaaccauucaaguccuuuccuacagccauuugaggggaaaccuaauguaaaauaagaagccaacaucaucucuaguuuagguguuuagauuuagugaccacgggauggagaaaucaccugguuaaagucagcuugaagcucucgugaugguuuuuguuucuaauuagaaaaauaggaauaaguaguguuucacagauucuacuaucuuucuucaacagccuuaacuucucauuaggagccuaauaucuacaguacuuccuuuuuuguagauuuuaaaaaauugagauauauccuaauauagaaaaguauacagaucaaaaauaucuagcuugaagaauguuugcagaguacgcuuguacauguagcacccagacuaaaaaacagaaucuuaccagaacuguagaaguuuucuuuaaccaacauacuuaccuccuuguccauaguggcacugcuuuuauggacagaccugauuuacaacagaagcccuaaguggcuuuccuguguagcauaaaauuaaugugguuuguucucacagcuuucccccuaagaucaggaaugagacaaggcuguccacuuucacuacugcuguucaacaguguacuggaaguucuagccagagcaauuaaacaagaaaaagaaauuaaaagcaugccaauuagaaaggaaguaaaacuaucuguauuuacagacgacaugaucuuauguauggaaaaucccagagaauccacaagaaagcuacuguagugcuaauaaaugaauuuagcaaaguugcaggguacaagaucaacacauaauuagugguguuuguauauacuagcagugcacaauccagaaagaauuagaaaagcaauuccauuuacgauagcaucuaaaagaaauaaauagccaggaauaaauuuaaucaaagaggugaaaaacuuauauacauucuguuuguuagacgugagucacuaaguacagaccacacucaacgggagggaaguuaggcucuacccuuugaaagaagggcucucaaaaaauuugugaacauauuuuaguaaauaccaucaugauggaaagagcacgaagagcccucuggguugcugaaaauguccugucuucaucugguuagggagaacacaggcagaaaaaaauguguauuuguauguauaaauuuucauugaacuguguguuuaagauuauggaauuugugugauaccucaacaaaaauuuuaacaguuuuaagguugauucucucucucuuuuuuuuuuuuucuuuugucacccaggcuagagugcaguggugccaucuuggcucacugcagccuccgccuccuggguucaagugauucuccugccucagccuccugaguagcugggauuacgggccugcgccaccacgccuggcuaauuuuguauuuuuaguaaagauggggcuuuaccauguuggccaggcuggucucgaacuccugaccucaggugauccgcccgccucugucucccaaagugcugggauuacagucgugagccaccgcacucggccuuaagguuaauucuugaaguacagaaaaacagcauuauaguuuugaaauuagaaaauuucaguuuuauguaugaucucuuaccuaugacucuacugaaauagaauuucuauauguagaggcuguuggaagcugcuugggagaaguggguccuauagauuucucuaccauagcuauacaacauaguaaagaugcaucuuauaccaaggcccuuaaguuauuugaagauaaagaacuucaguggaccuucauaaugcugaccuaccugaauaacacacugguagaagauuggugaguauuuauugauaccuuauauguaaucucaauaugacauucauggagaaugauacuucacacaaauagauauucucaguaacuaaagcuuuguccuuuuuuaaaucucagugucuuuaugaaaauucuuauauuuuuauuaauucacauaauuauuuacccuacuaugugccagacacuugauauaauggugaacauuccagacaaggucccuguuaaaauuuuagugggacuagacaaauaaacgauaaauaagaaaaaugccagaugguucuacacagaaaauuaagauaggggaauauaaagggagauguuuuaggcucuugucaguaucagaggugccacucuccucuaagcgaggccuuauuuugauccuuuuaaaauaagucguaaagcagagagguuguuuuauaauccuagaagucuuaagcuaaucagacagggucuucuauuacuuauucucugugcaaagcagaauugcaccacauaucaaaauuucaacugguugguugagauuacuuuugcgugcaugcucuuucucucucuuauuuauuuguugauugauugauugguaucuuugaguacuccaucaccaccauauuugaugguagccucaaaggguuuuccucacaaccaggcaccuuucuaagauaaauacguguuuugauuuuuuucuguacuucccuuccuccuucucuugaggaauaaaugauuggcaauaaugucuaacugccauguuuccguuauugauuuaauguaccuguauauuucuuucuuuuguuguuguuuuuguuucauuaaacaaauuuguaugguuucuuuccaaacauuuuauuauaaaaaguuucaaacauacagcacaauggaaauaauuuuauaguaaacacccauaugcuuaucauauaguaucuauauuuuaugcuguccuugcuuaaucacuucuagccauccgucuauccuuguguuaacauguauuaauucaucucucucuuuuuuuuuuuuuuuuuuuuuugagacagggucucgcucuaucacccaggcuggagcgcaguggcaugauaauacaucauagaucauagcugacuguaaccccaaauucuugggcucaagcaguccuccugccucagccuccuaaugugcaaaguuuaugugcuugagccacaccacacucagccaguucaucucauuuuuuaaauguauaucaagguauaucaagcacaguuuuugaagagagugccacagaaaauuugcgagcauuaaauguuucauucauuucauaguaauucgaaauugguuuuucugaaacagaugcacagaaauauuagugugacuucaacuuaagaauacuaggaagcagguacaaguuuuuuguauuuuucuuuaacagggaaaaacuuuagaucuucaagggacuuuagcauaugaagauguggacaaaaggauucccagaauuuuuauuacuuauauguauuagaacauauuauuuucaaguauuucuugagucuuuuuaauuuauaguagucacaauuaaacuguauugaaugaagggaauugcaguugcagugauuaguaauucaaguuuacugaaugacuagugaaaguccuuugauacuuuuauuugauauuggagaauuuuguaaauguaaaguuuccuaauacaaauuuuaaauuuuaguuuugaaauuuuuucaguggagguuaacauucaucaagauuaauaacugguguacuugauaggcauuugaauuguuuuuuucagugucaaaguucgaucagcagcuguuaccuguuugaaaaacauuuuagccacaaagacuggacauaguuucugggagauuuauaagaugacaacagauccaaugcuggccuaucuacagccuuuuagaacaucaagaaaaaaggucucuuaaguaauaaauguuuauugaauacccagcauaucuaaaacaguucuguuugcugugggucaugacuguuaaauugcuugaaauaguauuguacuaacuauuaaccuuuccuauaaguaauuuaagccauauuucauaaauccagggaauguguuauuuuuaauuuauuauggcaguguggaaaagcucagauagguaaccugaggaaauaguaguugauuuuugggggaggggaaauucuuaaagacagaccuuguuuuuuuagaaauagaaagcgcuacuuugcucccaugaaagcuguuagcucuggguaugguuuauaguuauugugauccacaaguguuuauuuccaugucaaguuaacauaucacaauccccuggugaaauauaggaagacccauagauuucucccuuuuuccauguugauaucguaauaagguuccacuguaaguauucugugaagcauguuuaagaacacuuguuccuuccuuagucuaagcauuccucuuuacuaucuucuuuucauaaagugacugagaaauacacaguuuaguuuucaccaauuuaauuucagggcagaaacccaacauugaagcaguacuuucagugcaucauaaauauaauuuuaguguuaguaaaauuacugguaauauaaacuguuaaugaaacuaauaauauaaccuggaaggcauuauaauucuaacauuuuaaaaucucauuucauuuugaaaucaagucucugugguagauguggucuaguuuuguucaagagacagaugagucagaguuugugauuuguguaauaugcuacuaaugagugacagagcugagaguagaaccuaauuuuucugcugccuaaagcagcaguuuuugccauaccacucugccucuuguauaaacauaaauguuuucaucuuaaaagguaaacauugccuccagauuuaguuuuaacuguauuuagcuuuauucagaaagauuuguuauacucauuuuguguaggaaagguacaaugauuuccacuucucuuauuuacauuuucuaaucccuuucuuucuaguuuuuagaaguacccagauuugacaaagaaaacccuuuugaaggccuggaugauauaaaucuguggauuccucuaagugaaaaucaugacauuuggauaaagacacugacuugugcuuuuuuggacaguggaggcacaaaaugugaaauucuucaauuauuaaagccaaugugugaaguaagaagauuaauuagucugauauaauuccuuguuuaugaccuguuuaucuaaagagugcugugauacugcacaucaucuucacauaauaucacccccacucaaacuguuguaaauuuauuaaagugagcauccguauuuagucauaacuuuaugcauuagguuucagcuucgggauagcaacauacuagaggaguucuaaggggugccuugaauaauuuguuacuaaugauaguuaaaauacugcugauuauaaauuauuugcauuaaccaagagccuguucuaacuuuguuuacgucuucugauaagagcaccuuuauuuucccugauaugcuuucuugaauaagaaaaaggaguggggcagcaaucagcauagcuuuuuuauuuuugaggauauaguacaauuuaucucaacgaagaguaaagguacauaccaaaugaaacaaaguuuguacucuuccaucaaauguguaaucuaaaacagcauacuaugaugcucuaagauuuacagaguuaauuuauagcacugucaaaugugauucaacagaaaugugaaaauacaacaucugaugaggucaaacaucugcugauuacagauaacugauagagaaguauuuucguaauguacucacauugaaagcaauguaagaagcaguucuuauuuucuacagaaaaaguagugacagugaauaaaacaucaccuucucugcaauacuacaccgcacucauaccaauucagcagagugguacccugaacacacauacagcuuauuucucauuagugaacaaagcuaagauuuuuauaaaguuuuaccuuugagccagaaaauaaaauguuccaaauauacauauguacacaccccauuugugguacuuuaaauucucuagcucuaaaacugguguuuugccuugucuuugguuugaaaaagaaaaagggugcaauuaguaaucuauaaccugucuuaugugugugaaguaugaugaauaugauggauauggaguguaaugauucauucauauguuaaauauggagugcggugaauagcaaaaguaaagcugaauacuguuuuaaugugccagauguauuggagcacuuuucugcucuuuggaauauaccacaaauaauuacccaaauuuuaugcccagaaguugggcuuauuaaaaaauaaacauuuuuaacaugacuguuguaguucuucacugagguuagaaaaugcauaaaaaucagauuuccaacuuuugucuuaaacuuuugauaccuuuuucccucuucuaucauaucagaaaacuccuucuguuacuaacgcuuuucaacucugaaauuguauuuaaaguggugauauaauuucauuuguaagcaauauucuguuucauuaugguaauggccuagacuggaaauaaacaguuacagugucacuaacauauauauuugauauugauauacuagccuagugugguuuuuuaaacaccaccuaauacauguuuuuuguuuguuuuuuuagcaguauguugaguuuauggcagauuaaucuaucaucuuuuagaaauuuaauaugucaacggggcaugaaaauuuuaaguaaaauguauuaauuuuacucauuuuuacucaaacuauuggguggauuuguuuguauauucuaggugaaaacugacuuuugucagacuguacuuccauacuugauucaugauauuuuacuccaagauacaaaugaaucauggagaaaucugcuuucuacacauguucagggauuuuucaccagcugucuucgacacuucucgcaaacgagccgauccacaaccccugcaaacuuggauucagguauucuauuaaauuuuuaacauuaauacuguaaacucaguucuagagaaagauggauuuaagauggaaucccacuaaaagcacuuuacaggauuaaaucuauaaccucuaaauuuguuucuucaucuauggaauggagauaaaaguugccaacaguugcaacaaguuuucaaugaaauaauguguguaaagugccuaggauaguacuugauguauaguauucccucaguacauuuuggcuauugauaaugggucaacuaauugagcuuucaauaugugucaggcacugugcuugcacuggcaauauuaaugugaaaaagaaacacccacauucuagcaauggaaaaaacaaacacaaucagauauuuuagguacuguggugcagauacgauagaauuuucauauuuucagagcucuggccaacucaauuuaaaaagcagccuuuggccgggcacaguggcucacgccuguaaugccagcacuuugggaugccaagguugguggaucacuucaggucaggaguucaagaccagccuggccaacguggugaaaccccgucccuacuaaaaauacaaaaauuagccgggcaugguggcaggcgccuauaauugcagcuacuugggaggcugaggcaggagaaucacuugaacucaggagguagaggcuccugaggcucacuagccaagauuacaccacugcauuccagacugaacgacacagcgagacugucuaaaaaaagaaaaaaaacccuuuguauaacuauaauuaacauuuaguguauauccuucuaauuguuuaaaacaaaaauugaacuguacuuuauuuacucuuauaaccuacuuuccuucuaugacauauaauggguauuucucaugccaagagcauaauagcaaaagaaauuccaccaaggguuggguauguauaauacauauaugcaugcuugaaggcucauuaugggucaguuuuuuaaaccuaaauuuuauaaaaggauacaaaauucacagaucuuuauuguuaacugucuuuauuauauauuauuaauguguuuuauaugcaaacauaaagcuaggugcaaauucacuuguuguacuuaaagaccaaucaauucuaauacaaauguugauuuaaugugauauuuugccacaacuaaucugcuccucccaauccuuccagucacuucagcaaagguugugauuacucaguucuuccaauuguuucuuuuaguuuuacugcuacaaccuucauuugacaugacucuaaugucauuuagacuucaguuugcuaugcuuuauauuuuauguauuuuauuuucuguuggcuaacagcaauuacaaaucuacuauuuggaaaaauauaaauuauaaacauagacauagaugcccauccugugauccuacuagauuauaggcuguucucuaaaugaucuagaaugugcuuauaugaauuuuccuuaggccacugaaaugaaaauccuaaaauaaaaauucucauagaggcuuuguaaacuaucuaaaauguaucucuuaucuuuaauugggaaaauacagguauaagugauuuaagcauuuaaaacuuuaauauguaauuuacaguacuauuaaaaacaauuuuuauuacauaguuuaagguaaucauuguuuaugauaaucugguaauuuguuaucaugaacauggccaagacuuuuuucauguuuaucacuuauguauuuaugucacaaccauuggaagguaaaguaacuguuuuauuuuaucuguauacagugccaauauuuuuauuaccuuaagugaaaauuuaaacuucacauauaaaauucuguuauugaaaaggaaauacauauuuuuguaaaauuuaaaugguguaucuuuucugauggcuauaagccucauugccuucacuaaacgucccaugugcaucucaaacucagcuguccaaaagcaaacgugucaucuucuucaucccuucccccagccuacuuuuuuaaauguguaccuuuuugacaaauggcacucaguugcuuacucuagaaaccucucucacguauuucaucugauuaccaaaucuugccaauuccauauuaugaauaacuuaguccauuuguuucucucugcccuuagcauccuuacugcuuucuagcuccaugauuuagcacaguugaaauucuuucauuaaauuuuccaaguuauuucuugcuuccagccaucucagauauuauuauuauugccuguagcacuauccuuuccugcucugaugacuauuacucuucuuucagauaucacuuuuucuuuuuucuuuuuuuuuuuucuuuuuuucucuugagacagagucucgcugugucacccaggcuggagugcaguggugcaaucucggcucacugcaaccucugccccucaggaucaagcaauucccgugccucagccuccugaauagcugggauuacagaugugugccagcaugcccugcuaauuuuuguguuuuuaauagagauaggguuucaccauguuggccaggcuggucucaaacuuggccucaagugauccguccgcaucagccucccaaagugcugggauuacaggcaugagccauugcacuuggccaguaucacuuuuucuaugaaacuuuucuugucuaggugagguucccucugcuaagcuucuguagcauuuuaaacuuuccuauuauaacacuuaucauauuguguuguaaugucccaggcuagucagugaguucuguguggucugacaugaucugucuuguucaugcuuauauacugaggaccuagcacauaaaagaucuuauugaaucaauuaauuaguccuccuuugaaauaaaauauaaauuacaauguaaguucucacuuuuuuuaagauaacaguuucuuuuaaaagcaaaagaaauccuauuaaauuccuucagaaccaauuuuguguuagguacugcccaccagaaccuuauagcauagugggagacagacacauaaacaagaaggaagaagguguguaagcaagaaugccugggacugaggggagauauuuuuguuugucagagucagagcacuuuuuccgaugcuguuuggauaaaaaaucacaaagaacaaugcuugcuguuguggacuacaugagaagacaaaagagguaauguaaugaguguugcuucuuacguuuaggaucuagaguguaacuuguuaacuaucggcugaauuuuaacaugauuauuuuaggugaagguguugcaaaguguuauauuuaauuugugugauauuuauaucuccuugcaguaauccauauucaggauagcaguuugguuaaaucagugucaagaacucucaauucuaguaccagcuguaccaguaaccauguuaccuuuguuaaauuaugcagccuucuuggcuccaauuuauuucaucuauguuagggauaggagcaaguguuuuuccaaguuacauuuagcuguauuaccccucuuuuuacuuuucucuuugcuuuaguucuaagaaguaaauagaguuguguaaaugucuucuuuauguaucuuuauuuuaagauguaaguuucuuuacugugugcaguggucucaaaaucuguggcaauacugugcugugacaauguuuauuuucuuguuucugguaaauuguuuuauaguauaguaucuuuguuccuguuauuucucaugagauuuuuaacagugcauacagaaauugcuagaauggauggucugacugaugaguacugcuugagaguugaccagaacucugaagaaauaguguaguaggccuauaauuugaauagguaggaaucgaugucucauaaguguguaugguggugguaggggugguugguaaagaaugagagggagaggugagugaaaaaugaaauguuuuuaagccuaaaugcauuaauaucuuaaaaaauuaauuccuauguagucuuaaaccauucuucuucucuaguagaaaaagaaguuuuaugcuuuucagugucuuugcuucugguuauuuuaccuuagaguuuuauaccagauuaucuucugaggaggccuaucagaagcuuuaauguaguggagagcauuuguuuucuugguguugggaggcaguuuuaccuuugagucauucauuucagacuuaccauugggguagaaugguguugacauuagcaggaguuggagaagauaaaaauucuucauauuccauuuuaaugcugaauaagauccugaagaauauuccuggagaaaguaugaaugggauauagaaaaacggguaaagacaugcauucaaguccaagcuugugcuguguaaaaauuacuuguuauccuguacaguauguugggcaaaaacaaagaacaacaauaaaacaacaacaacaaaaaaauugcuugcugucuuugaaccucagucuuaucaucuuucaaaaucagaauaaugucuguagugucuuccuuuccauggggaaauuauuucacuucucugaacuuaacauucaucggaaaauuaacuuuaguugagugcuugcuguguaguagggugugccuuauucaucagcuuugcaggcauuauuuaauuguugcacccauucuccaagguccauguuguuccagcauuugcaaguaaggaaacuaggaaacugagguuuaagaaguuaaguugcugaagaucacacagcugguaguaggcaauauagcuagauuugaaccuaccuguauuguacuucaacacuagugcucuuaagcacuaccaugucccaucucuacaaugcuaguuuugaaaaagauacuaucuauggucccuuucaaucuugaccuaccuauuaacacaguggaagauuuuuauuaaguaacucaaccuaggcaauacauuaaggagaaaauaagucacaauaggaaagacauguauuugugucuuagaugaaacaauauuuuuuauuaaauugacuguuuuaaaguguguguuggggggugcuugugugcauuuguauuagcuauucuguguauccuauucuuagucugugguacauggauuucuugguagagagcagauaugaaccccaauuuuguaucaggugauagucuacagguuuuaucagauucucugauagguuugagggaaaaaagaaaaaccaaaaagauuaauuaaauaggacucuucagccauguuaucuuauaauguuuauagguauauauuggggaaaugugguuuuugggaauuuguaauuuucuguuaagcagucacuaccauuguauucuauaucaacaugcuuuuauuuugauauugaaguuuaaaaaagugaaugacauuauaucucauuuuucuuuagaccuucuucaggaacaauuuuuaaugaugcuuucuggcuggauuuaaauuaucuagaaguugccaagguagcucagucuugugcugcucacuuuacagcuuuacucuaugcagaaaucuaugcagauaagaaaaguauggaugaucaagagaaaagguaauggaauuuagaauuuuugguuuuuaaaauuaauguuggcauugucucaauaaggguauauaguaaagauuuauuuugccuccuguuccccauuuaaaagauauuuuagauagaaauuuuguuuuaaagugaaauuauaauaaauuuuuaaaaaggaauauguaauuccuguucugaaauaauaggaaugcuuauuacuuagguauuauaaaaauuuaacagauagcaaauuccuauaggacagaguccauacuuaauuuucuguauauuccccauaauagcccuagcauugagaacuuaauuuaagggugauaaauauuuuucaaaugauuaaauuauuuccuaacuucagucagauuagauuuaccacuaauuucuaaacuauucaagauucauuuuggauauaaaauauccaaaauuauaauccaaaauggcuauaaugugacugauuuauuucugugacuaauuaaguuucauuucuuuaucuaccuauauuucuagugaauuuaauucgcuuuccucugacugaguuagaacugucauaagaaucuaauaaauauacuccuagaucauggggaagaacaaaaaauaagaaaguaagaguaaaaaauaaaguaaaacacuuuauuaucccaacugcucuuuucaaauguuuguucguuugaaauggccugggucucauuauuucgcccaggcuguggugcaguggugcgaucauagcucacuguagccuugaucuuccgggcucaagugauccuccugccucagccuccaaguagcugggacuauaggcacacaccacugcauccaacucauuuuuuuuaauuuuuauuuuuaauagagacaagaucuugcuauguugcucaggcuggucccaagcuccuacguucaagcaguccucccaccucagccuuucaaagugcugggauuacaagcaugagccgcugcaccuggucccaaauuguuuuuuaaagcgguuauacccauuuguguacagaaauguaguugauaaggaaguggaucgguaggaagccuuauauuugaagaagggugccaaaguauaacuguuccuaguuuaguuaaaaaaguaaagaagguugggcacaguggcucacgcauguaaucccagcacuuugggaggccaaagugagaggauuacuugugaccaggagacugagaccagcuugggcaacauagugagaccucagcucuacuaaaaauaaaaauaaaucagcugggcauaguggccugcacauguagucccagcaacucaggaggcugagggaggaggaucgcuugagcccaggagggagaggcugcagugagccaugauugugccacugcacuccagccuaggcgacagagcgagacccuaucucauaaacaaaaaaaaaaaaauuaagaaacuggaauauguauauagguaaauauuagaggcaguaucacuuaugauaguauuuauuuuauguacuagauuauuacuguuauagacaccacagcugucaugguuuuagaauugaaguuacuuacagaacugaauguuauauguauaaaaugcauaaaguuaaggccuugaaguaggcaaaucugaguucuaauccugacugucaaacuuucuaguuuuauagucuugguuuaaguggauccuacugaucuacuuccuuuucaauaguuaauaucagaugucuuaaauuuauaucuguuaaguauuaaauucugucuuauuguggucuuuauuugugugucuguaauuauugauuggguugaauuucaggugaaaccacugacagaguauauaguaccugaauuggauggcaucugcucuauuuuuaaacaauccaaucucuuuauaaauaaucauauuuuugcauauaggcuucccauauguagauuauucuuaaaauauaauuuucauucacaaauuccuuuuccauccuagguauaaaugguauuauguuuuaaaguauaagugauuuauucuguuuuguuugccaccuucauuaguuuuuuucugucaaagucuauaguauauguauucaggagcuuccaaauaguauguucucauuaaaagagguguucuugugacaaacagaagucuugcauuugaagaaggaagccagaauacaacuauuucuagcuugagugaaaaaaguaaagaagaaacuggaauaaguuuacagguaaauauuagaggcucuauuauuuaugacaguauuuaucucauacuuuggguuauuuuguuauagacacuguacagaugccaugugauuuuuaaacugaauuuacuuacuggacuaagcaucauauauauaaaauuauggucugaagcuuaagccuuagaguagacagacuugaguucuaauacugacucugccacuucuugaguuccuuaucugaaagacgaagguaaaaccaccugucucagaguuuaugccaugcauuuucugccauagcacccuguucauuuccuuuauagcacuuaggguuuauaauuauauauuuauuuguuugcuuguuuauuguauguuacagaagaagcagauugccucuucuauaaauuucuugauauccauucuuaaauuggcucauguuacugucugggaugcuugccgaauuucuuuggucaacucauuccuccacaaugacaauuucagcuucuccauucugcuuaaaccucucaucuucucuucuaugccgcugcuuucagccugccuccuacuuggagaaaauagaaggcauagagaggaaaucucgccacaucccacucucaaacauugaaaucuccuggcaucuccuccuuuaauaaucuuccgucauguuacagaaacaguuuauccuucuauuugagacuaauucuuccugugcuuuguuuuuuuaucugcucuuucucaggugcuuuauuuuuuaauaugcuguucucccucugaacuauguucugaacauuuuaaaaccucuccuguuuaaaaauucccuuucucacaaagacaaaauaauuucccucuucccuauguucucuuuuagguaucacccucucucuuccuuccucucacagacaaacuuugugaaagaguuguccauauuugcugucugcauuucccccccuuccauuuauuccaguaaaauagcacuugcuaaugucucucauaaacuucauguugcuaagucugguggucaccuuucauucuuccuuuuccuuaauguuuuauuaauacuucacaucaucaaccaugccuugcuugaacuguguucuguuuaccuuuuugauccacucuccugauuuuucuccuuucacuuuugccuucuucauaggcuccuccucucuacugaguuuuuggaauaucguguguguacuaagcacugugcuaagcauggguacugaacuuuucuacucugaggacuugauuucacguuaugaauagaaacauuugaguuggaacuauagaauuaugccaauauaaaugaauuuguguguagaaaauauuucacagagcaagcaccauauaggcaguucaauugcuugaucaauuuucuaugcaguauaguuccuaguuuuuucuauuuuauuuuuuuuauguuuucauuuuuauuuaacugagauuguuuuaaacagaauauaucuuuucuguguaaauuuuacaacaaagauuucaguaaccaaacuacuuuauccauaucaaauuuuaccaauuccaauacaguuuugugcuauuuuucaaagaaaaauccacgaccuuuauucuuaccaaauugaguuuucaagagucagacuuuguaggacuguauuuucuaauguacaguuuuuuuguuuuuuuuuccagacaggaucuggcucuguugcccaggcuggagugcaguggugcagucauaacacacugcaagcucugccucccaggcucaagccauccuccaaccucagccucacaaguagcugggacuacaggcaugccccaccaucuccagcuaauuuuuguagagauggguuuagccauguugcccaggccgaucuugaauuccugagcucaagcagucugccugccuuggcuacccaaaguacugggauuaaagaugugagccacugcacccagcccauguacaguuuuagguguugacaagauuguuugguuuuguuugugugauuuuuuuuuuuuuaugugauauaagccugguaggucgguacuuauuucuuaucuaauucaugaaauuguaggcaauucuucucggguagacuacaguccuccuguugucuaggaccagucuacuguguugcugauccaaaucauuaguauauacaguugacccuugaacaguguaaggguuagaggugcuaacccccugugcuauuaaaaaucaggguaaaacuaaauuaguagucaaaaguuaacuacuaauagucuacuguugaccagaagcccuaccgaugauauaaacaacacaauuuuguauauguauuauauacuguauucuuaaauaaaguagcuugagaaaagaaaauguuauugagaaaaugauaaggaagagaaaaugcauuuacagaacuguacuguguuuaucaauaccguaaguuuauaucaucuguuuacaaagaaucaucugucugaaauuguaggcaaccacugcugguugauauguacuuuaggccucaaucuacagaauguaucaaacaauucaccuuuuucuuguaauggcaugacuuuucucugcaucuuggaagcaccuccagccacugugguguuaaucaaggcuuauaguauugcaguaaacacagugaaaaaauacaugagaaccuggagagauuacuuuucauuucuggauacaauuuacuagagaaaugaacugcucauguggaaauuauuagugucacauggcauuuuaagcagauacucacaacacaauaaugcuuaccacaguagcaacugagguagcugcaaaauuauuacaauaguacaauauguacgauaguuaaucuuaugcaauuaugauuuaauacugcaucuuuacauuuguuuauauuugucuuaaccacaaauaaugcuguguacaguguguguguguaaguuuugauaaauuuuaacucuuuguaauagauuuguguauauuuuaugguaguaaaugaugaaauguaucauaucaaauguauacaaaugauggaauguguagacuaguuguacauuuauuuuaugcauucaugacauaacuuuuaaaaaauuuuucaguaguucuaaacugugugguuugugaauuuuuucaaauuguggcaaaccuccaaaaaguuuucaauauauuuauugaaaaaaaaauccacauauaaguuguccugcacaguucaaacucguguuguuugaacuguauuucagaacuguauuucagaaucauuacauuuuauuucuauaacauaacauuuagaguugggaguuacauauugguaaugauacaauuuaaaauuugcuaaauuuauagaccgauuuuuuuuccuucuucaauuuuuguuguuuccauguuuucaggaucuucucuuagaaaucuacagaaguauaggggagccagauaguuuguauggcugugguggagggaagauguuacaacccauuacuagguaaauugcauuuuucuaaacaacgguauaguaauucuguuuaugaaggaguuauguguguguaaaacccaaagcuauuuucacaaucuuuucuuauagacuacgaacauaugaacacgaagcaauguggggcaaagcccuaguaacauaugaccucgaaacagcaauccccucaucaacacgccaggcaggaaucauucagguacauuuuuucccagauuugguaaagccaucacuaguguagugcugagguuauuucaguauguugguggauauuuacacagccagauaaacucuagagauaagacuagaacuuaucuguuuuucagaggauuaggcuaaacauucagggauacuccugaagcagagggaugcaaaaaaaagagaaaaaauucagggagacacaggaaagucagacaggucauugaccuaaaagauaguguagauuucuugaucauaguguuguuggauaacaacagaagacauugcucgagcauauacaaugugccagguaguguacuuacugcuucacauggaaaaucuuauguaaacuauuucucauaguuugcaacagaguuggucccagaaccuguuguuucuauuacuggcuaauacuccuuagccauucuuccaugaaauauuagagcccuuugagcucuauuuuuguguuuuuugggaaacauuaaacgauauuuugggauuaaaaaaauguuuuuggccaggcgugguggcuugcgccuguaaucccagcacuuugggaggccgaggcgagcagaucacgaggucaggagguccagaccauccuggcuaacacggugaaaccccgucucuacuaaaaauacaaaaaaaaaaaaaaaaaaaaaaauuagccgggugugguggcgggugccuguaggcccagcuacuugggaggcugaggcaggagaauggcgugaaccugggaggcagagguugcagugagccgagaucgcgccacugcacuccagccugggcaauagagcgagacuccaucucaaaaauaaauaaauaaauaaauuuuagagauaaggugucacccuguuacugaugcuggagugcauuagcgugaucauaguucacugcagccuugaccucccuggcucaagggcaccucucgcuucagccacccaaguagcuggggcuacagguacacacuaccauacccagcuauuuuaaaaaaaaaaaaaaauuguagagacaggucuugguuuguuguccaggcuggucucaaacuccugggcucaagugauccuccugccucagccucccaaagugcugagauuacaggcaugagccaccacacccagcugauauuuugggauuuuaaaugauauugugaacuaaaauuugucuaaguuaauuuguaucuuugcuguuuuuuucucugguuuucuguugauaucuuugauuacuuaacuuaaaaacaaaauaacuccuguuuaggccuugcagaauuugggacucugccauauucuuuccgucuauuuaaaaggauuggauuaugaaaauaaagacugguguccugaacuagaagaacuucauuaccaagcagcauggaggaauaugcagugggaccauugcacuuccgucagguaagaaauuugacuugauuuuuuuuuuuuugccucucuccucauucuaaacaacaacuguuuuucucuucuaugaauauaacaggaguuguuuuauauauauauauauauauauauauauauauauauauacacacacacacacacacacacuauauauauauacauaccauauauauaguguguauguguguauauauauauaaaaaaauauauaguagauguugcaagcuauagauagcccuaaauccuucaguaagauagcaauaagcaguuaaugcaccuaggcuugaauuuuacucucuuauuccauuaggacaacuucaccccaccccuaaauauuucuaaaaacagaaauaugaaaaggguuuucgaaaugaguaucaucucgcauaguuuguuggacugaggcaugccaagaaaaguauaggcauuccucuuucuacuuccugcuacaaacauuuuagucaguaagauagcacuuauauuggcuggaggauccacaaaggacugcuuaucuuuauuuaugaaauauuuucuuuuauuaaaaaauaauacggccaggcacgguggcucaugccuauaauccuagcacuuugggaggccaaggcggguggaucgccugagcucaggaguuugagaccagccugggaaacacggugaaacccuuucucuacuaaaauacaaaaaauuagccaggcguggcagcaugcgccuguagucccagcuacuugggagccugaggcaggagaauugcuagaacacgggagacggagguugcagugagcugagauagcaccacugcacuccagccuggacaacagagcgagacucugucucuaaaaaaauaaauaaaauaaaaaaaauaauaugccuacucagggcugggcacagugugguggcucacaccuguaaucccagcacuuggagagcugaggcagauggaucacuugagaucaggaguuugagaccagccgggccaacauggugaaacuccaucucuacuaaaaaugcaaaaauuagcugggugugcuggagcaugccuguaauccaagcuacucgggaggcugaggcaggagaaugcuugaacuugggaagcagagguugcagugagccaagauugcaccacugcaccccagccugggcgacagagugagacucugucucaaaaaaacaaaaaaaacacucaguuacccaggaagauaacauuuauaaucuguauauaaggucaccauguuuucugaaugaaaagccaagcaccuaaucuaauaaaggauuucauauuuauguaaaguuuuuugauaauguaaacccuaaaaaauuaauuauguuuaaguauguuuuguugccuuuguagaaaaaaaaaauuauuggccgagcgcgguggcucaugccuauaaucccagcacuuuggaaggcugaggaggguggaucacaugagguuaggaauucaagacaagcuugggcaacauggugaaaccccaucucuacaaaaaaauacaaaaguuagcugggcaagguagcaugcaucuguagucccagcugcuugggaggcugaggugaggggaucccuugagcccaggagguggagguugcagugagccgagaucaugccacugcacuccauccuaggcaacagagugagacucugucucaaaaaauaauaauuauuggaaugccuuucaaauauuucagacuguaagacugcuauaaaauuagagauauauccucauauuuuaaaaaccuuuuccugugcgaguugauucuugcuugccucuguaaaucaauauauacuauucuucuccuuccucuuguauuucagcuacacagaccucucuguguuuucuugucaggccaagcuguuucuauccaagggccuuagauguaucuucuccuuuucccccaguuaccaugcggguggcuucuuuucauucggacccuaguuaaauaauaauguaucuucagagaggccuuucuugauuacccauucuauaauagccaucuagccauuuuguuuuguuacccuguuuuaauucucugcaugucccuuguuacuuuccaauacuuauuuauugucuguuccuccaaaccagcacauaaauuccaugagaguaaagaccugaucugacuuguccacuugugaauuccccuugugccuagugccuggcacauaauagguauuuauugaauaaauaaaugaaaguagagcauauuuagaaccaggcagaguaucugaguaauuuccuuuuuuucugcuuaaagaauuuaaaugacucauaaaauuuguauuucuuaccaaaaauucuagaaaugcauuuuuuagaauggagaaauguuaauuuaaaaauuuuguccuuuggugaagcuauuuauacauguauaucuuaggguucuguuuuuaaguauauuuuuuucuuugacuuaucucacagcaaagaaguagaaggaaccaguuaccaugaaucauuguacaaugcucuacaaucucuaagagacagagaauucucuacauuuuaugaaagucucaaauaugccagguauuaugaaaagacaaaguuacuguauuuuaacauuuaaugucauggcuucuuuucugaaaacuugagaaacaauuuuaauguaaggauuugcauugaugaagagauaaagacuugguggcugugaucagauguuuccuuguaauucucugcccuccuucaaaacaaauuguuucugggauuccagguucauucuuuacccugacccuucaagaaaguuuuggugauucccucuuuguucucuuccuauacaaguauccugagaauuauaucuugucucuuuugguaauuguauggcauuuaguguucuaauuuauaaaauuguaacucacgguuaauacuuacaaacuuguuuugaggcacaaaugugaugaggcaugaggaaauaauuauaaugggguaaacaaaugcagcauuuuuaaagccguagugacuuaauaaauccuauguuuaucacagaaauaaaauuuacuaucauuuaagugccuaugauaugcuagccacuguuagacucuuuucauauguauucucuaaucaugacaauaacuauggaugugaaaaaaggcuuagagaaguccaguaacaugcccaaaguuacacagcuauaagugacagaacugcaauuuagaucuaggucugugugauuccaagguuuacaguugauccuugaaccacuuggagguuaggagugcugagccccuccuccucacacauuugaaaaugugaguauuacuuugacuccucaaaagcuuaacuacuaauagcuuacuguuaaccagaagccuuaccaauaacauaagcaguagauuaacacauauuuuguauaaguauuauaauaccauauucuuacaauaaaguaagcuagagaaaagaaaauguuauugaaaauuauaaggaagagaacauauauuuacuaguaaguggaagugggucaucauaaaggucuucauccuugccaccuucauguugaguaggauaaggaggaaggguuggucuugcuaucucagggguggcaaggugggagaaacucugaguguaaguggaccaugcauuuaaauuuguguuguucaagggucaguuguauuuuguuuccacugcuauuuuguauucacuguugcuuguuaguauuauuagaucaguagcaaagccuaugaugagaacucuuuaacaacaaauuuaaacauuuauuucccugaaaaccucuucuuuauuuucagagugucuuuucuuuuuugcuacuagaguaaaagaaguggaagagauguguaagcgcagccuugagucuguguauucgcucuaucccacacuuagcagguugcaggccauuggagagcuggaaagcauuggggagcuuuucucaagguauguaauucguaugacuuuguuauccuaaagugcagcuuuucuguuaccaauagugacuuuaaaaaauaaaaacuauaggccgggcacgguggcucaugccuguaauccuagcacuuuagaaggcugaaguggguggaucacuugaggucaggaguucaagaccagccuggccaacauggugaaacccuaucucuacuaaaaauacaaaaauuagccagguaugguggugggcgccuguaaucucagcuauucaggaggcugaggcaggaaaauugcuugaacccagcacaacaggcagagguuguggugagccgagauugcgccauggauuccagccugggcaacagagcgagacucugucucaaaaaaaaaaaaaacuauguagagaccaaauguguguguuucuuuccuuuuaucaagauauaaguugauuagcccuagugaauugugcuuuuauuaaacauuuuccaaaauagucauuguaaaaauuuaaguuuuaaaaauucagcuuaagugugcuuuucucuuuauaacuuuuucccuggccuaccaagauaaaauuguuuccucauguuuuugcauagcaugauaacacuccauucaguuuuagcacuacauuguauuacugucauuuuaucucugccuugcuaaacuagaagcucccuuaaaagugggaaccauucuauuguuuauuguuguauaccuaguguuuuuguuuuguuuucuuuuuuuucuuuuuauguuuuuuugagaccaagucucgcucuguugcccaggcuggagugucaugguauaaucucagcucacugcagucuccaccucccagguucaagcgauucuccugccucagccucccgaguagcugggauuauaggugccccgacaaugccuggcuaauuuuucuacuuuuaauagagacgggguuucgccuuguuggucagccuggccucgaacuccugaccucaggugauccacccgcuucagccucccaaagugcugggauugcaggcguuagccaccaugcccggcccccaauguuuucucuucuggugacugauaauuauguuuaguaaacauucaguggauaguggaugucaguuaauuuguaaaagguguucagaaggaauugcuucuuauaauggugagagggaaaugauccagggauuuuggaagaugaaauaguauaguuacucaggaugcuguagaucuaaauucuuuccuuuuaucaagauauaaguugauuagcccuagagaauugugcuuuuauuaaacauuuuccaaaauagucacuguaaaaauucaaguuuaaaaaauucagcuuaaaagugcuuuucucuuuauaacuuuuucccuggcccacccagauaaaauuguuuccucauguuuuugcacagcauguuacacuccauucgguuuuagcacugcauugcauuacugucauuuuaucucugccuugcuacuagauaaaagaaguggaagaguuguguaagggcagccuugagucuggcaggaugacaaaguaaaguguuuuggguccucaguuuccucauuucuaaagucagggauuuguauucgauggucucuaaagccccuuuuagcccugcuauuuugaauuacuauuauuauuauacgagggaagaaagaggauauaaaugacuaaggucacucuaccuuuaugcaaaaauaaaauuuggaauauguuuuggaaguagaaaagagaaggaaauuuuagagucagaagaaaauaauaauaguuuuuucaaaaugacauagcagaagacauacauauuaauguggcuuaggaggaaaauaaaggaacaaaagucuuuucugcuuucauucauaaguacauuggcaguacuuacugccagaaaucaagaaauuuuuccucugaaugaaagauuauccugcugaaaagaguacagaauucuuuaagaaacagugaauagaaugguaguaaccagaggcagggaaggguguuguggagggagaggaugaagaggggcugguuaaugagugaaaaaacacagguaaauagaagaaauaagaucuaguguuugauagcacaauagggcaacuguaguuaacaguaauuuacuguauauuuuuaaauagcuacaaaagaagauuuggaauguuuccaacacaaaugauaaauguuugagaucauggauaucucaauuacccaaauuugaucauuacacauuguaugcuuguaucaaaauaucacacguaccucauaaauauguacaacuauuauguauccauaaaaauuaaaaauaaauuuuaaaaagaaacaccuaaagaauaaucuggcuguuucuuugguagagaaauaggaagaagagaagcagagggaagguuggaugaacuggugcacaaaugcuuaugcucucagauuacauuccauucauauacaucaaccaaaacauuaaauaauaacaaacuaaaugcagaagcagagauaagaauucaucucguucuguuaauccagacauuaaagagauuugcaaaaaugcaaaacagugccaugcucacuaaguuuuguuuuguuuugggaaguauacaguugaaauucuuuaucuacagguuuccaucuauggauucaaccaaccgcagaucaaaaauauuugaaaaaaaaauuuuaaagaauaggguauaacacuuauuuacauagcauuuacauuauaguagguauaauauguaauuagagauuuauguauaaccugugcacauucuccuauuacacguaaucuagagguuauguguaauacuuuuuggaaauguuuaauaaaagcacaaucuagagguuacguguaauaggaaaaugcccugccauuuuaaauaagggacuuugaacaucagcauuaucaaggugucuuggaaccaauuuucugcagauacagagaaacuacuguaguuauuuuuccuaaaaauuguuauuuaugauauauaguagauuuauuauuuuugaauaaauuaauacauuuuagauuuuucucagucuuucuaauaugauaucauaucuaauaucaguagauaugguccaacgaucgaaaguucuuuggggucuucaauaauuuguuugauuguaaaggaguuccgcaaaaaguuugagaccugcugugguagggucauuuagagaggaauugaaguuuugguuccuagcauuuuuguuacuguuccuucccuaucaagcaacuaaaagagcuuucauuucuuagucaucacuuugucaucuuacucucccugcuuccucuuucuuauuucuuucaauaaaugucccugaaggauuggguaguauuucauaguucaguuauuugggaaggauacuauucauauaaacuaauugugcaauaugccuuuucuguuccuuuaauaauguugguaaaugaaaccuuugccagaugccagcuuuuccuucacuggauugugauuuuuuugacagcuauaauuaugcaucaagucauccccaguagggggucccucauuuccuugcugacauguccucauuacuacaggcaguauugaagcaggacuaaagauggaggcauucuuuaugauaggucugaugaauauguucuuguuucagaagaguauuuagaagggcugcuuuuuguaaugucagaguauuaaaaauuuuuuuugauguuugucaucugugaccucucugcuaauaacucuuaagagcucugaccgcauagcauuuuguaguuuucuaaauuuugauccauauguaggauuauuuacaaguucuagucuugucacuacaaaaguuccuuuguauuauuauaauauuauaucguaaguuccagaacuuacauaguuuuuuuuuuuuuuuuuuucauuucucuugcuuacaugaacucuaugucguggcauucagaucagucacacauagacaacucucugaaguauauauuaaguggcagaaacacucccagcuucucaaggacagugauuuuaguuuucaggagccuaucauggcucuacgcacagucauuuuggagauccugauggaaaaggaaauggacaacucacaaagagaauguauuaaggacauucucaccaaacaccuuguagaacucucuauacuggccagaacuuucaagaacacucagguaaauacaauuuaaaacuaugucaucuuaccucuugacuuuccuuuuauuauuuaaaaaacagaaagccugagggaaaaagaaaugucauuaagagauagagaucucuauuaauauauaguaaaaauaauuguuuaagaguucccauuuuggaauuagaucugacuuuuaagccuugggcaaggguacuuaaucuuuucucaaccucaauuuccugguuauaaaaugagaagauacguaacuuacuauauugauaacaauucagugauuuuauauacuguguguauguacacacagauacacauacauacauauagagagagacagacagacagacagauaggcagacgugggguggggagaugucaugcagacagagagguccuuaagauagucccugacaaguaguuaaguccucaaugaaugguaguugcugcuuucauuauuauuauuauucaugguaguaguaucaguaguaaaaguauuuauucccauaugucauuuucauuucagcucccugaaagggcaauauuucaaauuaaacaguacaauucaguuagcuguggagucucugaguggcagcuggaagaagcacaaguauucugggcaaaaaaggagcagagucuugcccugaguauucucaagcaaaugaucaagaaguuggaugccagcugugcagcgguuuguuuuuuuuauuggcuggauuaguguuuuacuguuauuuaaaaaaacacaaauguacuuuaaaauauuuuuaauaacaauuuuauuagagccuugaaauuaguaauuuauuaacaagauauuguaaaacuagucuugaaaauuaauuuguaaaugaaguuuagaaacuuuuuccuauauaucacaauucuaucaguccaucauguggucgauucauuuaauauaucccaguauuaagccuuuaacuuccuauagaauucaagaaagguaugugggaaaugaaugaaauagcuacucuaaauuugaaaugacaagugaaaaaagggaagaggaaaugaaugagagaacuaaauuagaaaauaaaagcaaguugggacaauuagguugucaauccaaaugcuuugaaaauaucacaucuaauauuuuaucuaacauuaccuguugguuuuugcaaacuuauguugcuacuucagcuguaaacccagcauacacacuggauaaaguagaggcauugguguccccaagguuugucuacaguggugucccacagacauguaccugcuuagugaauaucagcucacugugcuuuauuauuuauuuauuuauuuauuuuuugagacggagucuugcucugucacccaggcuggagugcagugguacgacaucggcucaccgcaaccuccaccucccugguucaagcaauuccccugccucagccucccuuguagcugggauuacaggcacaugccaccaugcccagcuaauuuuuuuguauuuuuaguagagaugggguuucaccauguuggcaagacuggucucgaacuccugagcucaggcaaucuacccgccuuguccucugaaagugcugggauuacaggcgugagccaccacgcccggccuuuacuguacuuuuugauguugggcacucauuguauagcaucuucuguuauuagagaaaucauuauaccaaagcacugagugccaauaugauauguguaaauauugcuuaauaguauuggcccugaaguaugugcugucuggaguuacccaacuuccuuguaccucaguuuucuaaucugcaaauugggguaauaauaguacuuauuuaauaggauucuugugagaauuaaaugaguuaauauauauaaagccuuuacaaagugucugacauauauaaguacucaauaaaugugacuugcuccaauaauggcaauaauaauaauaaacagaggaugaucauuuccuacaugggauuauuaaaauaguuguauggcaaaagcagaugaggaaaaacuuuuuuuuucccacccaccaaggaaaaacauuuuuaaccugcuuuuuuccccguacaugaagggcaguuggguacagucaugguaaugcauuauauuuuaagauuuugccuuucuuauacagaacaaucccagccuaaaacuuacauacacagaaugucugaggguuuguggcaacugguuagcagaaacgugcuuagaaaauccugcggucaucaugcagaccuaucuagaaaagguaagauuuuuggagcaacccuuaagauaguuacuuagcaugaauaugcuucaucuuuucaucaagaucaauauauuuccaaagcaaauaaaaguaugguuuuauuuuucuauauauuauuacuguuguagcucuguauagucucuaggguggagugaaacauuguuacaaaacaaagcagccaauuuugaaaguaagcccaaguauaguaucucuucuuccuccuuccuaccuccacuaccagcuacccuuucagcagguugcuucugaucauuucuucauuuaugcaucuacaaaaauaacugauuaagaauaggcaagucagcccuugcucuucauuagcccagccacccacaaguaaaggcuucaauauacuagccccuuugacuuuccuguuucucccucuuauuccuuuagauucacuaauuuuggaaauaguuaccucacuaaauaaguguaacaugaaacacaugaugcgauugucuuucuuuucuuuucuuuucuuugagaugaagucucucucugucgcccaagcuggagugcaguggcgcaaucucggcucacugcaaccucugccuccuggguucaagcgauucuccugccucagcuucccaaguagcugggacuacaggagugugccaccacacccggcuaauauuuuuuauuuuuaguagagacgguuucgccacauuggccagucuggucucgaacuccugaccucaagugauccaccugccucggccucccaaagugcuggcauuacaggcuugagccaccacacccagccugauugucuuuaaauuuuauaaaguucucuguuuuugcagaguucuuuacaaguauuagcugucuggguuauuucuacacugucaaaguuguuuugaaaagucaagaaaauaccauaguucagggcuguccaaucuuuuggcuucccugggccacauugcaagaagaauugccuugggccacacauaaaauauacuaacauuaaugauagcuaaugagcuuaaaaaaaaucacaaaagaaaucucauaauguuuuaagaaaauguacgaauuuguguugggccacauucaaagccguccugggccacaugcggcccaugggccguggguuggacaaguuugcaauaguucauauaauuuagcuagcuuuuauauguauauaaguuaaauuuuaguguauuaccuuaauuugagugauucuuuagauguauuuaguauuuguaaauauaauuuaaauugguuguguuuucuugaaggcaguagaaguugcuggaaauuaugauggagaaaguagugaugagcuaagaaauggaaaaaugaaggcauuucucucauuagcccgguuuucagauacucaauaccaaagaauugaaaacuacaugaaaucaucggaauuugaaaacaagcaagcucuccugaaaagagccaaagaggaaguaggucuccuuagggaacauaaaauucagacaaacagguaacuagguuucuacaagugacaauuuuauguucaccaguuaacugagugaguguuuuugcauagaaagagugacuuggucuuuuuaucugauauaguuuugagcucuaaaggucggcuuaacuauauauagauuaucuuggucuuuuggguucuuuucgguuuuuguuuuuuguuuuuuuuuuugagacaaggucucacucugucacccaggcuggaguacaguggcgugaucacuguacuccagcucacugcaaccucgaccuccuggacucaauugauucucccccugagcccccgaaauagcuggggcuacaggugcacgccauaccuggcuaauuuuuguauuuuuuguagagaugggguuuugccauguugcccagguuggucucaaacucaugggcucaaacgaucugcccaccuuggccgcccaaagugcugggauuacaggugugaggcacugugcccugucugucuugguccuacuguaguuaaucacaaauuaguauguaagauauugacguguucuuuugugaauaauucaugcucugcuucuaaguucauuguggagaauauagauauuagcuuucuguuuugcuuuuuugguuuguuuguugguaucauaguggaaaaggagauagauauugaaauuaauuacaaaaguuaccuauuuugauguaauuaaaucccuuuauuuaagccugucuugaaucuguauauuuuaguguaagcagagguguaaguuagcuaaauagcuuggggagaguccccuuuguccuuugaugcuuaggaaggugugugaauugcacaguuaagacaaaaguaaguuuauucccuuuauaauccuuagaaguuugcuuuuuucccugggauaaaaacccaacuuuuuucauuaaauguuguauaucaugugugauuuuguaguucuguuaaaguucauggcuuuuguguuuuaccuuaauuauucuaugcaagauacacaguaaagguucagcgagagcuggaguuggaugaauuagcccugcgugcacugaaagaggaucguaaacgcuucuuauguaaagcaguugaaaauuauaucaacugcuuauuaaguggagaagaacaugauauguggguauuccgacuuuguucccucuggcuugaaaauucuggaguuucugaagucaauggcaugaugaaggcaaguguuacucagcccaauauucuacccugugcuugaaaaacuuagacauaagccccuugaugucaggaaucguguauaccucuuuguauuccuagcacuugguccagugcucuacacauaaguagcauuuuguaguuuucuaaacuuugauccauauuuaggauuauuuacaaguucuagucuuguuucuacaaaaguuccuuuguauuauauaagcugacaagcuguaaaugaugcaaguuuguguggaggugauagaauuuagcuugguccuaugucuuugcaguuaccauaggagagggucuagaauggggcauuagauuggaggauuuagaaagcaguuaaagaugaugugaucacagguggguuuucccccugcugcagaaauaugggauuuuuacaauaaauuacuuuuguaaguagagaaaauauauuuuucagaaaaugucaagacagcaguauuguauaaguuuuucuuugaaaaccuuagauuauagugaugacaccuaauauuaaauuuaaguugacaagcuauauauuguuagucaauuugaagguuagagauaaaauguuucuccugcaggaaaauaauaagacucauaauagauacagucaaucucugcuguaguauacacuaaauauuacuuuuggccuauggggaaaagcaauuacuucauuuuauuguacacugacuucucaggaaucaagaucacagucacacucagaucacauuugucuuccuuagauuuuuuggaauauaaacaguaccaaguauucuaguucugaauccaguuuaauuuaggaccaaauauuuugauuuaccaaugcauuaaucuagaguacccauuagaaagaccuucagauaagaaaagaaaugaaggaaaacaauauaguuagugaaguuuuguuaaccacuugugcuaauagaggagcacugucuuaaaauaacuuacuugcuuagaugugagaauauuugaaauaccuuguuucuuaauuuugugucuuuuuuuuaaugguagagagacggaaugaagauuccaacauauaaauuuuugccucuuauguaccaauuggcugcuagaauggggaccaagaugaugggaggccuaggauuucaugaaguccucaauaauguaaguaaaccugaaaaucaaaccacaauaauuauuuuuauucuauuauuacuauauauuauauaaaguauauauaccauucccucuaagaaauggaaauacaaaauuuuguauuuuuugucuucucacaucacauaaguuacucauuuucucucucuaauuccucauaggccucugccuuuuucucacacaugcaggcauacacgcucuacccacugcaguaucuagacaguaauacacauuuuaauguuaagcaaaaugaaaaauauggauuauauuuuuuuguuuauuugcauaaaucuaauaguucuuuucuuacagcuaaucucuagaauuucaauggaucacccccaucacacuuuguuuauuauacuggccuuagcaaaugcaaacagagaugaauuucugacuaaaccagagguagccagaagaagcagaauaacuaaaaaugugccuaaacaaagcucucagcuugaugagguauuuggauuaaacauacguaccuuuuagaagugugauauucagucuuuccuagaauauuucuuuuuaaaaucuuguguuauuaagaugccaucuaaaaucgguucaaggcuggcacgguggcucacgccuguaaucccagcacuuugggaggcugaggcggguggauuacuugaggucagaaguucgagaccauccuggcugaccgacacagcaaaacccugucucuacuaaaaaugcaaaaaacagcugggcaugguggugggcaccuguagucccagcuacucgggaggcugaggcaggagaaucacuugaacucgggaggcggagguugcagugagccaagguugcgccauugcacuccagccugggcaacaagagcgaaacucugucucaaauuaauuaauuaauuaauuaauuaaaauugguucaaaauuccuuaauauuugucaaagcauaggagauaccaguaguaguuuacuuuuuuccucaaagcaguuggcaaagugaaacaauagauuuugaaaggcaccuaagucauugacgagaguauguaucuuugauguauuucauuuaugacuguuuuguuuguaucugaggaauuauaaucauuccauugucuagauuugugcauaaauucuguuuuucucuuuguuuuucuaacucugagaaguuuaaauguuggguaguuccuuauguaauguuuuuuguuuuuuauuaauaggaucgaacagaggcugcaaauagaauaauauguacuaucagaaguaggagaccucagauggucagaaguguugaggcacuuugugaugcuuauauuauauuagcaaacuuagaugccacucaguggaagacucagagaaguauguuuuuuuuaaagaagaaacguuacuuucuugcuguguuacucucuguagagauauauuaguuauagagccuaauaaguaaaucugcuuaaaaucacaaacguaauccaaaagcuuaauuuauaucugauggcuucagcauucccugguuacuuuuucacuuaauaucucuuaauagaacugguaauaggugacuacacuaaauuaauuauuugauuucuucugauaaucuucuggcauacauacuuauuacagagaauugcauaauagaggcaagucuauuaaaauaauugaauaacugaacauuucuagccucaaaaguuuuuuuaaacgaugugguuacuaaaacugcccugggacuuaaaaacaaaaaaaggcuuuaccauuucuuccauaggugcuaaaaugccauuauuuaauuauuauucuugcugugucaguucaaauaauuacaagcugcuauauaaucuuugguuuugugacuagucucuaaguaugcuucuaaguaucuccccauacuuuaauaauuguauuuuuuucuauucagaaucauaucuucaaguuuaaauucuuauuacuugaaaacgaaugggacuucacauauuguuucucuaagcaaacaaaaaguauugacaugucuuuuaguugcauuuaaugguaaugugacaggaguauguuaucuauguacuaugcaaacuauuacguaauuauuuuaagauguuuagucugguuccucagguggaaucuggucuaguuacccuugucagguaaccugcaaauuuacuugaagcuacauuaaccacuguugagcuuugacucugagcugcauaguggccaaagcccagagucuucauuucucaaucagagccugaaccacagauuagcaacaaguuggggccagugguaucugcugacuauuccugcuugaccuucaaugcuguuccucaguuugucacuaaaaucucuucauuuuuaaauacagaaggcauaaauauuccagcagaccagccaauuacuaaacuuaagaauuuagaagauguuguugucccuacuauggaaauuaagguaauuugcaauuaacucuugauuuuuuuuaaacuaaauuuuuuuuauuagauugaaccauuugaaauaguauuuuuauguaggucaaaauugguuaaauauuggcaaauuucauauguuucaaccuauaauuucucaguauuauauuuccuuugcccaagcccuaaaauacucaaaagcuucuccugcuuucuuuuccauugccuucuguucuacaccucccaucuuucuuaugaaggucuauagacuguuacuuucauuggccagaaggagaguuuccgugugcuuaugccaagauuaauuuuugacuuggcaaggaagguuccaauugucauauauuguuuuuaaaaauucuaugugcaguaaaauguauuggcugugauauaucacaguauuaaguaauauaguauguauuauuauaauauuaagcugacuucauaugcaugauacacuuagcucuguucuaauauucuuuuauugcaagaaauaauggaaguaauuucaugugggcagggauauauguaauaaggguuauaaguuuagaaaaugaucaucuuaaauacauugucuuucuuuucauuuugcaguuuagugcuuaguaucuaguuacuugauuugaaauguagcuguaucauguggauuaacugcuguuuuucuagcuauaucagcuaggugauuucgcugaauguuuccuuaaaaugccagauuuagcaguuauaacccagaaaacuccuucuacuguuuuccaaaauuuacuuuauguuuucgugaggaguuauuucucagaugacuuuacauauauuagugaaucuuugaugaaacaguaguuaaaguuacgagcgugagccaccacacccggccuaaaguuguaguucuuaaccacuaucacaucgucauuuguuucucuguuuaauauuaaaauugccauuuauaauguauuuuucuuuaagugcaaauaguguaucugaccuauuaucaaucauguuuauacuuuuauuagguggaccacacaggagaauauggaaaucuggugacuauacagucauuuaaagcagaauuucgcuuagcaggagguguaaauuuaccaaaaauaauagauuguguagguuccgauggcaaggagaggagacagcuuguuaaggugagccuucccuucucuggcuuagcccuuagaguuuuagugaugaaaauuuuuaguucauauuuucuuucugcuuuauuugggauuuugucuuuauuuugaauacuuacaaaugaggaagauuuguagaguagaaaugcauuauuuucuagaaccaggcuuuucuccauuuuuuuugugucucugaaagacaaucauuauuauaugguugauucaaguaaaagaauaccauuaacauguacagacauguacagugagguugcuucuuaugaaaaaaaauacuuuggugucugucucuuauuuccuugaauagugcaaguugacguccuuugcaucaguauaccgggucucguacugugccaagugcuauuuaauguaccaaaaagggagagcauucuucccuuaccauuugcugacgagcucuuuggguccuacuggggagugguggaaagacacagugcuguuuuacucagguguuugcaguaugccuuccuaggggggacuuccaguuaaucuaauuacagaaguagcgaggggaaacuuucuaaaucaguguaaauguuguagcuuauucuaaaugaaagaauggcaguagguauuuaauuauuugggagacugucaagaggugcacagaugcucagauugguuugagugcccuuugcuauucucagaugacucuguguuuuuauaauaaaauaaacuguacuuguuuauucaugcuuaauuauucugaagggccgugaugaccugagacaagaugcugucaugcaacaggucuuccagauguguaauacauuacugcagagaaacacggaaacuaggaagaggaaauuaacuaucuguacuuauaagguaacuauuuguacuucuguuaguucaccaaaaacauauaaaagaugccauuugguugggugaaguggcucaugcccauauucauaaugcuuugggaggccaaggugggaggauugcuugaggccaggaguucgagaccagccucagcaacauagugagaccccaucuugacaaaaaguuaaaaaaaaaaaaaaagccagagaugauggcaugugcuuguagucccuuagcuacaugggaggcugaggugggaggaucacuugaguccaggaguuugaggcugcagugagcucaaacucugcagugagccccaguccagccugagcaacacagcaagaucccguuuaaaaaagaagaagaagaagaagaugccauuauuuggaccaggagucuacaaauguuuucugugaaggaccaaauaauaaagauuuauuuucuuuguaaaaaguauuuauuaauguuaauuauaguuagguguuucuuauagucaacugaaguauuuuuuccuuuuuuuucuacucaacaauaugucacagaaaucuuucucauuuuuuaacagcugcauuguguguauguauguaguuuuuuauacaaguccuuaucgaugggcauuuguguuguuuucagucuuuugcugcuacaaacaacgcuguauuguagugaauaaccuugaacauacaaauuucauacaugcgcaggcaaauuuguagcauggauuuccaaaaguuggauugcuggguuagaggauacaugcaucuguaaucugguacauauugccaaauuacucucaaugggaguguacccacuuacauuuccucuagcuauuugccugagaagacaauccucagucacauucuaugagcugaucaucuuugacucuuauauuaauuauucauuuaaccaguuuagaaauaacaauaaauccuuauuuugaagggccuauuuuccauagguuugucuuuugugauuucauuccuguaccucauuuuuaaacuuucuccuucuauaaauguuguaacagggacuaugggugacaugugcuuuuuuauauauuucuaguuuuccacuaugaacguguuuuauuuuuaaaauaauggcuaaauuaaaagcccuaaauaggggagugaagaagaauaaauuagaucuacccuccaaaaugcugcuugaguuaggcuauuguaauaaaaagcagaacuugguuuugagcuucuuaacugcuuucagagacuaaauauaaaacuuauugguugggagaggggcauacuguucauuaaggaaagcacaauuuuuuccguagccuucaaguuugugagaaauuugugacauggaaccuucugcaauaauaacuaacauaauagauguuuuccauuagcaguuuaaaaagcuaauuaauccucgaugaaugcaaaaagcaaaaguugcucuauaaaggcuacucuguagagggauuucuuugaugugguuaagaucauugguacucaagcuuuagcagacaucauagucacuuagagaguuuguuaaaaacacagauuucugauccccauucuuagaauuucuaauucagcaagauuaggguagaaccugugaaugugcguuucuagcaagauaccaguuauguugaugcugcacugguccagggacaacacuuugagacccaccagucuacuuguucuaccaucuauugaccugacuucauuuuagaacaaaguugaugaucuauuagcuaucuccuaucugacagauaauguagagauugcuaagaaguuuuuagagacuagauauucuguaaugugaaugaaaggaaauuguuuaugcucuaaauaccaaacuuuuagaugacaaagauaauaggugaagaauuggguuacaaaaguaugggcuauaggagcaccuccugaacucucagaaaguagcuaagauuuccaagcagauacacaauugaaccuccaaaguucauugcuguaaagcacaaaaaagcaaaugccugaccuagaauaucuugaaagcagaaauuacugaacuuucaucucuaccuuaugacuuuuucaacagcuaguuuucacacaaaacuauuuuaccauauaaguuauuccauuaagauuucuagccgggcaugguggcccacgccuguaaucccaguacuucaggaggccgaggugggcggaucacuugaggccaggaguuugagaccagccuggccaacauggccaaaccccaucucuacuaaaaauacaaaaaaauuagccaggcgugguggcacaugccucuagucucagcuacuugggaggcugaggugagagaaucacuuaaacccggauggcagagguugcaguugagccgagaucacaccacugcacuccagccugggugacagaccgagacuucuucucaaaaaaggaaaaaugucuagaggccagaugcaguggcucaugccuguaaucucagcacuuugagaggccaaggcaggaggaucacuugaggccaggaguuugaaaccaaccugggcaacacagcaagaccucaucucuacaaaaaauuaaaaauuuagccaggcaugauggcaugcaccuauagucccagcuacucaagaagcuaaagcgugaggauugcuugaaaucaggaguuuggggcugugcaugagcugugaucaugccacugcaguccagucuggacaacagagcaagaacuugucuuaaaaaaaaaaaagugggguugggggguaacccagauaauuaauuauuuaauguuauacaucucaauauuaaaguaaaaccuguaaacacaacaguuuagguuugacuauuucuuagaauuacgacaauaagccaguaauguuauuuugagauuacuccaagaaugugaaaguugugucaucauuauguuaaacuaaguguucuugccuuuaguuaagguucccuagacuacagcgaaguagucuacccaguccagucaucuguagagucauucccaauccugagauucaggucuucuguggucauugugucaacaagagcauacauugacuaccuggaacuagaucuugguauacaaaccuugugucauugugcaaccucaaaaggagagacuuguauauugaggcaugccagauaucucuugucagagagaaucagauggaaaugaagacaguucuuauuguguauguugauagcucagacauagcccuuaacauuaaccagaauuaggguggcuggccccauuuuucuccaccaaaacuaugcauuguuacaaaguauacugaacaagucuaaaaucuuaggugucagaggauuuguuuucuaaaaggcaagucucuaauaaacaauauuuaagugcugaaaggagcuuugcacuuaaccugaucauccugccuugugccaauaaauaauuuuuauuccuugucaugcauauuucagagcaucuaucucagucaugguucuggggagagaagccauaauaucuuaagacauucacugaauauaaugaauuaacuucauuucuguguaucuaggaugauaucagcuguguacuuucagagaacugagaaaauagucaucaguccuuuuuugugguauucacacaaaauacccagauacccaguugaaaucuuccagagagucuuuaguaccagagaaaacacugucauuugcuuuuugaaauucaaauucagcucuuucuccaacaaccaacaucacaguugagacucuaagcugagguagaaaaaagccaacccauuccuuucuguaucaaucucucaacaaaaaauaaggguuugauucccccuccccgccccagagcuagauauugauagagaguaaucaauguaaaagagacuuuagacagaguacacuacacugcaagaauguuaaugugaucaagcaucaggggucacagcuaacucaaagacagcaggggagagggcauguagaauacuuauuaggcaggaagggaaaucagaaaggccaugagaucauucauuuguuuauucaauaaaugugaauuuauauaccuacguuggguuagauacucuacugagugcuaggucuauagaaguaguaaaacauugcccuaguccuuaagguguucacauucuaauagggaaaauaaacauaauaaacauaauuauaaugcaaaguguauuguuagagaugguaccaccuucacuugguugcucagacugaaaccuagaggcuuuauuuucuuuuuacuuuuauuauuauggaaaauuucaaacauacaaaaggagacaauaacaucaugaacccccuuguacuugucacucaguuucagcaguuaccaacucauggacaauuuuguuccauuucucuuuccaccaacuuccuuccaauauuauuuuaaagcaagaugucauaucauuucaucuguaaacauuucaguguguagaucuguaagauaaugucuguuuuaaaaaaccauucucacaauacugucaucacuccuaaaacaauucacaaaaauuccuaaaugucaccaaguaaugggagucauuuuaaacucuuguuucucucuucucaagucuugucuauuccaucagcaaguccuauuggucaacuuccaggcaggucacuuuaccaccccugcuauuaccacccuacuucugcagucacaucucuguagauacuagaguuuaaaccaacaguuuacuucugcucuugguuuuccaaagcuaguuuuauuaauaacuguuagagugauccuuuuaaaauugucuaagacagaguacucuuauucgguaucugugggggauuguuuccagagcccccuguggauacuaaaaucaagucccuuauauacagugguguaugaagcauuugccuauaaccuaugaaccuccucccauguacuguaaaucaucucuggguuacuuaaaauaccuuauauaguguaaaugcuguguaaauaguuguacuguauugguuuuuaaaauuuuuauuuuuuauuguauuguuuuuauugagguuuuuuuggugaauauuuuugauccacaguugguugaaucugcagcugcagagggccagcuguauuccauuuuccuguucagaaccccacaugaguucacauuaucccugaaugacaauucucuaaguuaagugaucugccucugcuguucucccuccagccuuaucuaccacucuccucacacuccucucacuuucugcuuguauagaugagucaucuccaccugacuuaccuggucuuuugcaauugcuuagacacaccaauuuguuucugccucagggcuuuucugcuucugccugcaaugcuuuucccucagaucuucacaccagucacucccuuacuucauucaggcuucugcugcaguguuacccucagaaaggccuccgaccauguugccauuacccacuuucucucuuuuuuaaacuuaaguuuuguucucuuauacuuauuaucuaauauuaugaaauguuuauuaggauauauguuccucaccagaaugaaacuuuaugagggcauagucuucaucugccuuuuucccacucuguucucagugcccuagcccuguguguaacauguaauacgcccccaacaaauaaauguuaauaaauuaaucaaaugcuuccuuaagacacaaaacaguucaacauaugugagaaacuuaaaauuuaaaaauguauagaacuaaagacaccauaaggacgagugaccagcugagaaaacgaauauaauaauguuaauuagaacaaaaaggaucauuuuaauauaaagaacaagggauuuauaugaagaauacaaugauauucaacuuuucuaguaaucuggaaaauacaaauuaaaaccacagugaaauacuauuacccucagauuagcaaaauauaaaaagccugacaauauuaaguauugcgaaaguuauggaauaacucuacugguggguauauaaaucgguacagucacuuugaauaguuauuuggcaauaucugguuaaccgaggugaagauguaucucuggcucagcuguuaaauuccuggguauauacccuagagcagacuuguccaacccacagccugcaggccacaugcagccuacaggauggcuuugagugcagcccaacacaaauuuguaaacuuucuuaacauuaugagauuuuuuuugcaguuuuuuuuucuuuuuuagcucaucagcaaucauuaguguuaguguauuuuauguguggcccaaggcaauucuuccaguguggcccagggaauccaaaagauuggacaccccugccuagagaaacugaaauauguucacgaguaguuuauuucauugcagcaguauuucauggaaauguggaaacaauguaaauguuaauaugcagauuggauaacuguuguauuuauguaguauauagcuguuaaaaugaaugauguagaguuaaauaugcucacauaguuaggauaaaauaguauugaauaaaaaaccaaauuacagaaauauacauauaguauccuaauuuuuuuacuuaauacuuacaacuauuuguguacauauagcuuugaaauaaaaauauaccaaaaaauacaagaacaugauaaaccagcuaacagucaucuugauggugggagggacuuagggucagugaagcacacaagggggagcuucaucucuuccccagcaaaugugagaaaauccuagauuugauaaagcuguuuaauggauaaaaggguaucuguuaauaucauuuucuauacuuuauguauguuuauaauauaauuuuaaaaaacuuuccuaguaaaguugcuuauuuuauauuuaggaguacauuuucucucugugaagauaauaagacuaaagcaagaguacauguaauuucaauaaugaaguuacacuaaaauugagaccacauucauggguaauaauuuccaagugaaacuccccaaauuuaauugauacuaaaauuuuaaggaaagcaguuaauuccucuccuaacuggacaaacuaaguauggauuaaugacagaugacggugaguauaguuaacaggagugaccucucagagaaucguggggauugagugaugggcaggcucucaaacaucuaggcagcaggcuggaaaauuauauucuuugagcuuaaguuuauuuccgauugguuuccuccaaggagcuuugucuucuauggacagagaaauauuaauacaacuugaaaaaaaaugcuuugcacugacucugauagcugaaugaucaucaaaugcucuuuaauggccuuuuaaaauuaaaagguauuuaaucuguaacuccaggugguuccccucucucagcgaagugguguucuugaauggugcacaggaacuguccccauuggugaauuucuuguuaacaaugaagauggugcucauaaaagauacaggccaaaugauuucagugccuuucagugccaaaagaaaaugauggugagugacacccaaaauuaaagguuauuguaagauuauuuaauggcuuauuaaagcugacagcugucagauauuauagaauacaaaaaaacuuuaauuucaucagguaauugucaaagauacuaaguaaaagaaaaacucaucagaaugaaagugugugagugaaaaaggaaggauuuuaaacuacauaauaugucaacccuugucagauaagaaauguaaagguuauucaaugugugcugauuuguuuucaauuugggauaaacuaauucuuagcaaacaaaacacuaaaaugccaggcacgauggcaugcaccuguaaucccagcuacuugagaggcugagucugggggaucccuugaacccaggauuuugaggccagccugggcaacagagcaagaccccaucucuaaaaaacaaacacaguaaacaacaacaacaacaagauuaugaaguaauuuuuuaugaaacugauauagaaaaccuucugagacauuuacaaugucacauuggccaucuagucugauauucauucgcugaaucagcaacauuuauuguauguuuucugucuaccagguacugugcugacuuaagacuucacaaauaucaaauauuacgacuaaucaucauaauccuuauccucauuuuaaaaugagaaguucagagaacuugcccaaggccagugagcuaauaaacagagcaaggauuugagccuugucuaaauccaaaauccauuuauuguucauuuuauugugcuuucugugacauguuuuuuaaaaugugugauaagugcuauagguguugugauggaagucuguacagggcacacaggguacaguguagguauggaggaggaagugcuuaguucugccugggguggggagaauagacagaaguagauccaagaaaugcuucacagaggaaaaggugugugagccgaguuuuguaaaugaguuguuuuuccaggcagaaggagcauauaagcaaaggagaggagacaugagcaggaaaagacaacauaagcauaggcuuaguguuugaggaagaaaagaugagauuggagcaguaauuguuggucaaaagauggaguguugcuuuaugaaaugcaaaggaguuugcaccuuaugcuauaggccucauaagacccuaaaggauaguaauaucagacuugcauuuuagaaagaaauuccgacggcacuguggguucuauuuuugagaaugcaaacuggaggcaugagauggucugaacugagaugaacagcaguaggaagggagaaucguggguagagaugagaaauaugaaggaggcagaauucauaggauuugauugcugauuaaaaauaagguuggggggcgggugugguagcgcaugccuguaaucccagcacuuaaggauaccaaggcaggaggauugcuugagcccaggaguuuaagaccagccugggaaacauagugagaccacaucucuacaaaaaauaaaaagucagccagguaaugguggcacaugccuguaaucccagcuacucaagaggcugaggugagaggauugcuugagcccaggggccaaaauugcagugagcugugaucacaccccugcacuccaguccaggugacagagacccugucacccugucuccaaaaaaaaaaaauguuggagaaaaggaguagccagugccucccaguuuucuguuuggggcagcuggguagauggugaagcucuuuacugcauugaagaauagaagaggugacuaaaguuugccagagaugaaguauuugaauuuggaagugauccaagugaagaugcugaaugggcagcuugagaagcacauuaagcuaaagcuuaauaaagauaucugggccaaacagauuuagaaaucaucagcacauagauggaagggaguugaagucgguaagcuuugcuucagguaguauuuuauggcaagaagauguuggaggauagagaucugagucauaucagcugccaucuaugagggauucuucuguucuuucucuuuuccuguuuucuauugcaacccaaugcugugaugccaccugagguuaucuggaacuacuuaggcauuucuguguuuauuucugcuuaagaguacaggauuauucaaauuagaauuuaaucaaaacaaguaacagucacuguaggugugcuuccucccccaacaauuaauauggaaauccuaaagggauuaucacuuguaauuaauugcuucccuguccagacuguuagcuucuuguagguaauguauccuguucaucuuuauugccccuauaucugucauauuuuuauauaaaaauguguauauuaguuuaauugaacacaauauugaaaaauaauuauauauauucucuauuuaaaggaggugcaaaaaaagucuuuugaagagaaauaugaagucuucauggauguuugccaaaauuuucaaccaguuuuccguuacuucugcauggaaaaauucuuggauccagcuauuugguuugagaagcgauuggcuuauacgcgcaguguagcuacuucuucuauugguaaucuucuuguacauauaguagauugagcacuuuguuguuuggcagguuuuauuuuuguuugauucagcacuuuuucuacauucugaguugcagggggaugauagugaugaugugguuaguaaccaacccaucuucauuauuaaaucauauguuucuuguucauccugauucuuagugucuaccuuuuuauaacuuaugcagaagagaauucuccuacuucaauaaauaauaaaaagacaggguuuucuucuuuguuuuauagugaauauggcauauuuucucuccucucaauauauuauuuucugagacuuucuuuggaaaauaaugaaaccugugauaacuuauuuccuuuaauuauuuuuguucuuuugcauauaaccucuaaauaucaucaccuagugauuaauacuuuuuaauagaauuuuguuuucagaauagaaaccaugagauauauuuaaauauuuuguguacaauauauauuuugacuuuuuuucccuaagaaauuagaauagguagauaguaugguuaacaaaauccuagaguaugagaacuaauguaaacauuagagaucaucuaaucuauuuguuguuuuuuuuuuuuuuaacuaaagacaacucccuccaucacuuacauacuauaccccaggaaggcagggcauguauguuuugaaagaguucccagguaauugugaaacucucuucuacauagagaaucacuaaucugauacaacuaguuuauaaacaagaaaguaggccuaguuaaugacagagcaagccagacacccagucauucugauucccuacccaguguguuuuuuuguaaugccaugugauuucucccauuagugcaugucaucaucugucuuaaauacagaaaugcaguuuuuuggggggauacacaccuggugaaaugaauuaaugauuaauuuguguuaaauauaauucaucaaggagaagaaaguuucacugaagagugaagaguuuauccauagacuucucauuuuauaaguauguucaauaaaaauuugaguacauauaaugcacagcuuugacccagguaaauaaugggucucaacuuuagccacaauaauuuuuuaaguacuaauauuuuaaaaugugugccuauuaguaaagagaaaauuuuuuuagcaaaucaucuaggauuuguaaaaugcaauaugcauuaaaauagcuggcaagauuugaguuaaacucaacauggccgguuaugcacaucauuuaaguaggcuaaaaauccuaaacuacuuaaagauuauaccaagucaguggucuuaauugaaauuauggcuauauauuagaaagagauggaaucagugauuucagauuguuuguuucuuuuuucuccaguugguuacauacuuggacuuggugauagacauguacagaauaucuugauaaaugagcagucagcagaacuuguacauauagaucuagguaaguaauaaaaucuauguaucuauucuuuuuaguaaauauuuggucaucauggaauguuguuugccuaccaagauauuacaaauauaagagacagauaaauugaagcaguaaauauuggguuuuuuuguuuucagcauaaacaguuguccuagaagaaacaguuaacucugccugggguacugagugaaacuuaauagaugaggugucuuuugagccuggucuucaagaaagaaagaaagcauaauucagacagaagauagagcagauucaaaagaaggaaucagggcuauuccaccaaaacaaggaguaauuuuaagauguagcauguugugggaguggugagacauuaaaugugucuggagugaaguaagccuguaguugagucgcuugagagagagauugguacuagacuguaaaaagccaggcuaaggaguuucaacuucauugcauuaaacuauaggaaauaaaugaaggacaugauaauauuuuauuuucagaaauauaauuucaggagcacuuuggggagugguauuggcagcaggaagaaaaauuaagggauauuguaauaguuuagaugagaaaugaugaagauuuauacuaaaguuguagaaaccagaauauuggauuugagggacauuuuuguaguaaacuguaccagugauauuagaugaggaaauagugggggaguggggcccccagauaacugaagcuucuaacuaaggaauauaucaaguuuuguaaauaguaagaaagugaugaauuuaguuuugcucauuauuuugaaguauuaauggaauuucuagguggaauagacaguuuaauauauaagaaagaaagaauauauagcuucuauguauauauauagacaguuuaauauaaaagaaagagaauauauauagcuaaggaauauaucaaguuuuguaaauaauaagaaagugaugaauuuaguuuugcucauuauuuugaaguauuaaugggauuucuagguggaauagacaguuuaauauauaagaaagaaagaauauguagcuucuauguauauauauagacaguuuaauauauaagaaagaaagaauauauauagcuaagaaauauaucaaguuuuguaaauaauaagaaagugaugaauuuaguuuugcucauuauuuugaaguauuaaugggauuucuagguggaauagacaguuuaauauauaagaaagaagugugaauguaauguaaagaagugugaauguaaugacaaacuucuauuaaacaguauuaaucacuaggugauaauuuuuagagguuauaugcaaaagaacaaaaauaauuaaaggaaauaaguuaucacagguuucauuauuuuccaaagaaauucucagaaaauaauauauugagaggagagaaaauaugccauauucacuauaaaacaaagaagaaaacccugucuuuuuauuauuuauugaaguaggagaauucucuucugcauaaguuauaaaaagguagaugcuaagaaucaggaugaauaugaaacauaugauuuaauaaugaagcugguuugguuacuaaccacaucaucacuauuaucccccugcaacucagaauguagaaaaagaagugugaauguaaugacggagauccagaaucuucagcaaauagauuucaguugaagucacugggcuggaggagguucugaucucacacaucauccgugauaaagagaccuaaagaugaaaucauaagggaagugagccuuggaaaggcugagccagaaaaaaacugagaaguacucaaaggaagucaggaucuuggaaggcaagaggggaaaaucuuuuaugaaagaaguagugcucaauaguaucugauacagaaaggucagagaggaugaaugcugaaaauagaccuuugaauuuaacaaguaaucaauccuagaggccuuggaaguccccuuuggauagaauggaggaaaccauacuguaaaaaggcaaggacugaauggaaguuaaggauguguagauuaagaauguggaaucugccaggcgcgguggaucacaccuguaaucccaacacuuugggaggccaaggcagguggaucacgaggucaggagauugagaccauccuggccaacauggugaaaccccaucucuacuaaaauacaaaaaauuagccgggcgagguggugggcaccuguagucccagcuacuugggaggcugaggcaggagaaucacuugaacccaggaagcagagguugcagugagcuaagaucaugccacugcacuucagccugggcggcagagcaagacugucucaaaaaaaaagaauguggaaucuuccuacaagaaguuuagaagggaagggaaggauggcagagaaauuugcugcaggaaugagagacacauuugguccuugcuuuuuuaagauaggagagguuuaaaccuguuagauauugaagauacaggagaaaaacaaaagauaauugaaauagcaagggaaaucauaaaguacgugagucugauagcauuggcuuuagauuggaggcauguuagcuuuucugcugagagagaaggaaaagugaugccaauaggaaagucuuaagcuggagaggaaggaguaugagggaauuauauuugcuauuguguuuuugcugagaaauagaaagcaugcucauuugcuaagaauuggagggaugguaacuggccuuaaaagaacaaauaaaauucuaaaauuuaccauggaaaugagaccaagaccugacuagaaagggauaaauaaauaagacaugccaagcaguuuaaggggcacuuucaauccuaaauuuguaguggagccaauaggguuguuguaugauuuuccagcaguccucaacauccuuggagcuuaaguuguaguuuaaaaugggagaugugguggagggacaaggggacaaggagauuugaagcacugaugagaguaaucaaacuuauugucucuaccccugggcugaguuagggaaagaagagggcuaauaaacuagaaaucucagucaaauuugaagacuguuuaguaagaauaagggguagaaggagaagagguuuugauuagaauguacaauuuacaaugucuaagaagcaguuuuagcagacucauuucuggaguacaacccauaugagugguucauuaagauagaaugaaauugaauuccauuagaacagagacagucacggauauuauaugguuuuccccagaaugaauucuagaguugggacagaggggaagauugugagcuagguccaugccaacauucagcgaaugugagagaaaaccuuacagguuuacagaguaaacgugaagauggaagggauuuguuagagcuagaagguggggaucucaacagaggagccagacuuuaucugagaaugaaaggagaguggucuggaagaugcaaauuagagguaggaguaugccaaccugaguccauucaggucgugcuaaaagcaucuauaaaugagaaggguaaauugguacaaccccuuuggaauauuguuuggcauuauccacuaaagcugacuuuauguauauccugugacccaucaauuccacuccaacacaaaugcauacauauguauaaaaauguuuauaguagcauuauucauaauagccccuaacuggaaacaauccagauauccaucauagguagaauggaugaacaaauugucguauauuuauauucucuuuguauauaaugagauugaaugaauaauaacacacaauauagaagacucucacaaauauaaugcuaagugaaagauuccaacauaaaagaguacacauguauaauuccauuuacauaaaauucaaaagcugauaaaauuaauguauaguguuagaaaucaggauaguggugacccuuugaaagaggugauuagugacugguaggagggacugaaagggggccucuggaaugcugguagaguucuguuaacguggauuuguucacuuugcagaaaucccagugagucacacuugggugauuuguauacuauucuguguaugucuguuugguuaccuguugcugcauaacaaaccaccccaaaauuuaguagcuuaaaaucacaauuuauuuauuauuaucucucauagucuguugacugggcucagcuggacaguuuucacuuaggaucucucaugcagcugcaguuagcaucuggggcuggaguuaucuuaagacucagcugggccagaguucaugauugcuucuucacuuacaugucugaugcuucagcacucccauguggccucucuguccacaauaguguccuggaccuacucagcaucuuggggcuccaaggggaaggaaguggaaguuaagggcuaggccugcaacuugcacaguaucacuuccaucacauuaugucaucacauagucaugucauaggguccauccugguucuucccuguuucugggacuccaguaacccuauguuaggccuuugcaauguaucauuuauacuguuaccugcuagucuauauuuucuaaccuuuuuuuccuuuuuucugacucacuccuuggugucaguggacauauccggggaaccuggacuuucagcccuacucagcuauagcaagcccuuucccuauugagugucaguggaggccaauuggggaaucuagucuucugcccuuaccuagcaguaacaagguggugacucccaaaggcauuaaaggcagaaguuuaaggaagauccugagucucguaauaacuaaaagguguaggugucaauugaaaaucauuaggcauaccuggaaccaggaaaaucucaacuuuaaugaaaaauggccaccuguaggugccaacacugagaugacaaugauguuggaauuaucuaagauuuuaaagcagccaucauaaaaacacugaaggaacaauuacaaacaugcuugaaacaaauuaaaauauaguaagucucagcacagaaauaaguagucucaguauagaaguagauauaaaggagaaccagauggaaauuuuagaacagaaaaauauaguaaauaaaauaaaaaauuucaacugcagaaugaggagacagaagaaauuaucagugaauagaagacagagccguagaaauuacccaagcugagcaacagaggaagaaaauuaagaggaaaccuucagcaucuagggcuaaacagaguuccuagacuugauaccaaaagaacaaucuuuaagaacucucaaaacuuaacaacaaaaucuacuuauaaaauggccauguacuacaaauguguauagcagcuuuauucauaauagccaagaaccggaaaaauccagauguucuacagugggcaaaugcuuaaacaaacuguguuacauccaugcccugaaauacuacucagcaaugaaaagaaacagaacuauugauauacauaacaauuuggaugaaucuccagagaauuaggcugaguguaaaaagcuauucccaaaagguuacauacuguaugauuauuccacuuccauuuauauaacauacuugaaaugacaaaauuauaaaaauggagaacagauuaguggcugcuagaaaaauagggggucagagggcugggugauaggcuaugggagggaaauaggugcagccguaaagggcaguaugaaggauccuuaugauaggaauauuauauaucuugacugcaucgaugucaguaguaguauaguuuugcaggacauuacaguuggggugaaauggggaaaaggcauaagggaugaucuuuucuguaugauuucuuacaacucgaagugaacauauaauuaucucauaaaaugucauuaauuuuuuuuuuuugauggaguuucacucuugucgcccaggcuggagugcaauggcacgaucucagcuccauguauccuucaccucccagguucaagugauucuccugucucagccucccgaguaacugggauuauaggcaccugcuaccacacccagcuaauuuuuguauuuuuaguggagacaagguuucaccauguuggccaggcuggucucuuaacuccugaccucaggugucaggccuccucagccucaaggugcugggauuacaggcgggagccaccacacccagccuaaaaauuuuuuaaauauaaauauaucaucuccauuuuaaauuauaccaguaguuacuucauuuuuaaaaaucacccuuuaaccuagauuucucuaguuggguuaagaaguaguuagguuauuuggauuugagguggaucucacagacagugacaaagaugaggaaggcagccagagcagaaguaaacuacuguacauacuaguguucauagaacguagguaacaugugguuucuugccuuuguaaaguucacauucuaacuggaaagaaaguaaauuagcugucaaaccuccuaacuucacuguauucuuuacuuuagguguugcuuuugaacagggcaaaauccuuccuacuccugagacaguuccuuuuagacucaccagagauauuguggauggcaugggcauuacggguguugaaggugucuucagaagguaagugauaugaaguaaaggagggaaauaauuuuugaugucaaaauuacaugggcugggcaugguucuuugcaccuguaaucccagcugcucaagaggcugaagugggaggauuguuugagcccaggaguuugaguccagccuaggcaauacagcaagacccuguaucuaaaaaaauacacacacacaaacacacacacacacacacacacacacacacacacacggguuagagauuuguauagauuauagaauuuagugcuagaaucguauuccagugccuuaucaauacuaaggaaaagacccuggguaaaagcaauaauaguuccucuuccuuccacccaccugggaccuaagcccauguaacauacauacuguuauuccaaaccuccucuggaagcaucccaccuuuacuuuuaacaccucuauccuggcugacuccuucuuaaugauccaaacuacuauugggugcucaucacugugcauauagaagagacuacauuuuuauuuauaggagcuuguguucuaguauaacauugugcuacuaaaaaagcuuugcaguuccuuguaguuuucccagcauaggucuguguacucaacuuggauuggggcagauugcagucaguguaaacuaauaauugccacaauaaucaaagacugagagcugagcccaguggugcaugccuguaaucaauaguguuguguuauucuuguaaaugccaagcuugugaaauagucaaauacauauuuguauucauuucaaacgucuaaugaaagcccacucugccaaguauuaugcuauuuugagauacagauauguagauuauuaagcauaggcucagcauacuacacaugagaguauacagauaaagauacguugacaacauugguguguaacaaaauccguauuuauaauguguuugacucuagaugcugugagaaaaccauggaagugaugagaaacucucaggaaacucuguuaaccauuguagagguaaaguauuuuauaaggaagacuuuauuuuuuuucuuaccagguagacuguguaucucaucaggaagucacugaugugaagagcacugcuucauuuuaacauagggggauguggcugggcagcagaaaggaggagauugugcacuuagccuuuucacacauccaaaaauacugguuuagaaaugccuucagcccccuugaguuucuuggaauguuagagcauuguaaguagucucuaguuuucaauucauaaaucaauucuuugacauuuagauauuccauaugguauuauuauuuucagaaugguuuccauuaggguuuaagaaaaaucagaaauuuauaucuccuuuuucccugcucagguucagaacuaauuagucagacaaauggagaucaaauugucagcaucauuacuagaggaacauggcuuaggaaugagggccagacuaguuuacugcuggugcuaccucaguaccucucugcugucuuaacuuugggacagcucaccugaauaggguuugggccugcagagcaaacacauguaaucaggaucacugccuugucuugauccagggcagaaaaaaggaagucaaacaaauuucagugucugugcuguuaguaccuaugccagucauucaccaaucugguaaggguaugugagacaagaaaucaggaguguggccuccccagggaagcauggcagguagagugcaguaugggcuugccacuuuuccacuacucagcuuuucuuccuuuaaccugauuuauguuggacuggcugcauguuaguauuacuuuuacugcauuuaaaaaacauugaugcugaucaaauucaaaccagguuucuagagauggggcaggaauaugugcauuuuuaaaaaucucuccuacuguucaacuaggauaugagaacugucuuaauucauuggcauuaaccauuaagccuguggucaauaaggguggggcuuuaucccuuggaagaugaguaacaguccaucagggugguccugugugcaccuuuaugaaccgaggcaucuuuauagaucuccuuuggacugcagaugguaauacagauuuugcuacaaggaguuugcugaaauaggucccaauaauacguugguaaaauuaaauccaaggcugugcuauucccaagguuaaaaauacauucuuuuuucuuuuaccgauuucaaauucuguucauacauguugucauuuguuacaguuugccauugguucugcaguaagaauaaaugauaagaaaauaagcaugauguguaacauuuuaaaaaaauaauacaugguaacauggaugccucaauaaugucgaaauuaaacucuaaaguuauauuaucuugcacuuuuucauguaagaaaaagagggcugggcgcgguggcucaugccuguaaucccagcacuuugagaggccgagacagguggaucaccugaggucaggaguucaagaccaguuuggccaacauggugaaaccccgucucuaauaaaaaugcaaaaauuagcugggcgugauggcgggcaccuguaaucccagcuacucaggaggcugaggcaggagaaucgcuugaacccaggagguggagguuguagugagcugaaauugcaccauugcccuccagccugggcgacaagagcaagacucugucugucuuaaaaaaaaaaaaaaaaaaaagcccaaacuuuucaaauuaaagagucaaagcagcuuaacauauucuuuaguauuuuacucuaccuaguuucagucagaagggauuuuuaugcuaagguggauuugggaguuucuuccaguacuuguauccuaccuaacacucaccagaagaagguaguucuuuuagggccucagaaaucuuacuaguuuaaugccaaacugcuuauggacuucacuuuuuagaguaguaggagaucaaaugagagaagugacaguggccagauccuuugccauuguaaggacuuuggauuuccuuugagugaggguuuugagucugaaaagugauuugcaucuccaccuacaauaacugucaccuuuaaacacacccuccgggaggaggagccaagauggccgaauaggaacagcuccgguauacagcucccagcgugagcgaugcagaagacaggugauuucugcauuuccaucugagguaccagguucaucucacuagggagcgccagacagugggcgcaggucagugggugcacgcacugugcgcgaacugaagcagggcaaggcauugccucacuugggaagcgcaagggucagggaguucccuuuccuagucaaagaaaggggugacagacggcaccuggaaaaucgggucacucccacccgaauauugcgcuuuuuggaccggcuuaaaaaacggcgcaccacgagauuauaucccgcagcuggcuuggaggguccuacgcccacggagucucgcugauugcuagcacagcagucugagaucaaacugcaagguggcagcgaggcugggggaggggcgcccgccauugcccaggcuugauuagguaaacaaagcagccgggaagcucgaacuggguggaacccaccacagcucaaggagaccugccugccucuguaggcuccaccucugggggcagggcacagacaaacaaaaagacagcaguaaccucugcagacuuaaaugucccugucugacagcuuugaagagaguagugguucucccagcacgcagcuggagaucggacaacaggcagacugccuccucaaguggguuccugaccccugacccccgagcagccuaacugggaggcaccccccagcaggggcacacugacaccucacacggcaggguacuccaacagaccugcagcugagggucuugucuguuagaaggaaaacuaacaaacagaaaggauauccacaccaaaaacccaucuguacaucaccaucaucaaagaccaaaaguagauaaaaccacaaagauggggaaaaaacagaacagaaaaacuggaaacucuaaaacgcagagcaccucuccuccuccaaaggaacgcaguuccucaccagcaacggaacaaagcuggauggagaaugacuuugacgagcugagagaagaaggcuucagacgaucaaauuacucugagcuacgggaggacauucaaaccaaaggcaaauaaguugacaacuuugaaaaaaauuuagaagaauguauaacuagaauaaccaauacagagaagugcuuaaaggagcugauggagcugaaaaucaaggcucgagaacuaugugaagaaugcagaagccucaggagccgaugcgaucaacuggaagaaaggguaucagcgauggaagaugaaaugaaugaaaugaagcgagaagggaaguucagagaaaaaagaauaaaaagaaaugagcaaagccuccaagaaauaugggacuaugugaaaagaccaaaucuacgucugauugguguaccugaaagugauggggagaauggaaccaaguuggaaaacacucugcaggauauuauccaggagaacuuccccaaucuagcaaggcaggccaacguucagauucaggaaauacagagaaugccacaaagauacucuuugagaagagcaacuccaagacacauaauugucagauucaccaaaguugaaaugaaggaaaaaauguuaagggcagccagagagaaaggucggguuacccucaaagggaagcccaucagacuaacagcagaucucucggcagaaacccuacaagccagaagagagugggggccaauauucaacauucuuaaagaaaagaauuuucaacccagaauuucauauccagccaaacuaagcuucaucagugaaguagaaauaaaauacuuuacagacaagcaaaugcugagagauuuugucaccaccaggccuacccuaaaagagcuccugaaggaagcacuaaacauggaaaggaacaaccgguaccagccacugcaaaaucaugccaaaauguaaagaccaucgagacuaggaagaaacugcaucaacuaacgaacaaaaucaccagcuaacaucauaaugacaggaucaaacucccacauaacaaaauuaacuuuaaauguauauggacuaaaugcuccaauuaaaagacacagacuggcaaauuggauaaagagucaagacccaucagugugcuguauucaggaaacccaucucacgugcagagacacacauaggcucaaaauaaaaggauggaggaagaucuaccaagcaaauggaaaacaaaaaaaggcagggguugcaauccuagucucugauaaaacagacuuuaaaccaacaaagaucaaaagaaacaaagaaggccauuacauaaugguaaagggaucaauucaacaagaagagcuaacuauccuaaauauauaugcacccaauacaggagcacccagauucauaaagcaaguccugagugaccuacaaagagacuuagaaucccacacauuaauaaugggagacuuuaacaccccacugucaacauuagacagaucaacgagauaaaaagucaacaaggauacccaggaauugaacucagcucugcaccaagcggaccuaauagacaucuacagaacucuccaccccaaaucaacagaauauacauuuuuuucagcaccacaccacaccuauuccaaaauugaccccauaguuggaaguaaagcucuccucagcaaauguaaaagaacagagauuauaacaaacuaucucucagaccacagugacaucaaacuagaacucaggauuaagaaucucacucaaaaccgcucaacuacauggaaaccaaacaaccugcuccugaaugacuacuggauacauaaugaaaugaaggcagaaauaaagauguucuuugaaaccaacgagaacaaagacacaacguaccagaaucucugggacacauucaaagcaguguguagagggaaauuuauagcacuaaaugcccacaagagaaagcaggaaagauccaaaacugacacccuaacaucacaauuaaaagagcuagaaaaggaagagcaaacacauucaaaaguuagcagaaggcaagaaauaacuaaaaucagagcagaacugaaggaaauagagacacaaaaaacccuucaaaaaauuaaugaauccaggagcugguuuuuugaaaggaucaacaaaauugauagaccgcuagcaagacuaauaaagaaaaaagagagaagaaucaaauagacacaauaaaaaaugauaaaggggauaucaccaccgaucccacagaaauacaaacuaccaucagagaauacuacaaacaccucuacgcaaauaaacuagaaaaucuagaagaaauggauaaauuccucgacacauacacucucccaagacuaaaccaggaagaaguugaaucucugaauagaccaguaacaggagcugaaauuguggcaauaaucaauaguuuaccaaacaaaaagaguccaggaccagauggauucacagcugaauucuaccagagguacaaggaggaacugguaccauuccuucugaaacuauuccaaucaauagaaaaagagggaauccucccuaacucauuuuaugaggccagcaucauucugauaccaaagccgggcagagacacaaccaaaaaagagaauuuuagaccaauauccuugaugaacauugaugcaaaaauccucaauaaaauacuggcaaaacgaauccagcagcacauccaaaagcuuauccaccaugauccagugggcuucaucccugggauucaaggcugguucaauauaugcaaaucaauaaauguaauccagcauauaaacagaaccaaagacaaaaaccacaugauuaucucaauagaugcagaaaaagccuuugacaaaauucaacaacccuucaugcuaaaaacucucaauaaauuagguauugaugggacguauuucaaaauaauaagagcuaucuaugacaaacccagagccaauaucauacugaaugggcaaaaacuggaagcauucccuuugaaaacuggcacaagacagggaugcccucucucaccacuccuauucaacauaguguuggaaguucuggccagggcaaucaggcaggagaaggaaauaaaggguauucaauuaggaaaagaggaagucaaauugucccuguuugcagaugacaugauuguauaucuagaaaaccccacugucucagcccaaaaucuccuuaagcugauaagcaacuucagcaaagucucaggauacaaaaucaauguacaaaaaucacaagcauucuuuuacaccaacaacagacaaacagagagccaaaucaugagugaacucccauucacaauugcuucaaagagaauaaaauaccuaggaauccaacuuacaagggaugugaaggaccucuucaaggagaacuacaaaccacugcucaaggaaauaaaagaggauacaaacaaauggaagaacauuccaugcucauggguaggaagaaucaauauugugaaaauggccauacugcccaagguaauuuacagauucaauggcauccccaucaagcuaccaaugacuuucuuuacagaauuggaaaaaacuacuuuaaaguucauauggaaccaaaaaagagcccgcaucggcaagucaauccuaagccaaaagaacaaagcuggaggcaucacacuaccugacuucaaacuauacuacaaggcuacaguaaccaaaacaacaugguacugguaccaaaacagagauauagaucaauggaacagaacagagcccuuagaaauaacgccgcaugucuacaacuaucugaucuuugacaaaccugagaaaaacaagcaauggggaaaggauucccuauuuaauaaauggugcugggaaaacuggcuagccauauggagaaagcugaaacuggaucccuuccuuacaccugauacaaaaauuaacucaagauggauuaaagacuuaaacguuagaccuaauaccauaaaaacccuagaagaaaaccuaggcauuaccauucaggacauaggcaugggcaaggacuucauguccaaaacaccaaaagcaauggcaacaaaagccaaaauugacaaaugggaucuaauuaaacuaaagagcuucugcacagcaaaagaaacuaccaucagagugaacaggcaaccuacaaaaugggagaaaauuuucgcaaccuacucaucugacaaagggcuaauauccagaaucuacaaugaacucaaacaaauuuacaagaaaaaaacaaacaaccccaucaaaaagugggugaaggacaugaacagacacuucucaaaagaagacauuuaugcagccaaaaaacacaugaaaaaaugcucaucaucacuggccaucagagaaaugcaaaucaaaaccacaaugagauaccaucucacaccaguuagaauggcagucauuaaaaagucaggaaacaacaggugcuggagaggauguggagaaauaggaacccuuuuacacuguuggugggacuguaaacuaguucaaccauuguggaagucaguguggcgauuccucagggaucuagaauuagaaauaccauuugacccagccaucccauuacuggguauauaaccaaaggacuauaaaucaugcugcuauaaagacacaugcacacguauguuuauugcggcauuauucacaauagcaaagacuuggaaccaacccaaauguccaacaaugauagacuggauuaagaaaauguagcacauauacaccauggaauacuaugcagccauaaaaaaugaugaguucauguccuuuguagggacauggaugaaauuggaaaucaucauucucaguaaacuaucgcaagaacaaaaaaccaaacaccgcauauucucacucauaggugggaauugaacaaugagaacacauggacacaggaaggggaauaucacacucuggggacuguggugggguggggggcggggggagggauagcauugggagauauaccuaaugcuagaugacgaguuagugggugcagcgcaccagcauggcauauguauacauauguaacuaaccugcacaaugugcacauguacccuaaaacauaaaaguauaauuuaaaaaaaacuaaaaaaacaaacaacaaaacaaacaaacaaaaaaaacacacccuccaaugcuuuguguauuuuacacucaucuaccuaaucuucccuccguaaaucuguccgaauuuccccaaaucauuuggugugauuguuccaaucuucaagaauaauuuucccagugaucuuaccacaguaagacccuuucugccuucagcuuuaggagggugcuucucaauuagcauccugguucccaguccucugggacaucauuucuuuccucucuuggauucauuucuuuucuucucuuagauuucauugaggcacagucacuauuucugaacugaucuccccgcuuccuaagccccuccuucagagcacuuuaaccuggguguauuucccuuuucuuuucaguguauuugucucuccuggccuucaagauuuuauuuucuuccuaauggaccauucucuccucuaagauuuuauguguuaugcuaaggaaauauaucucucccucuaacucagugaugcuuagccaagagcaguuuuguccccuagaggacaguuggcaaugucuggaggcauuuuuauugucacaauuggggaugggagaugaggauaguauuggcaucuacuggguagaggccagggaugcugcugaacaccucagaauguacaaguuagcccccacagcaaagaaauaccccauccaaaaugacaauagugcugagacugagaaacccugcucuagcuuaaucagucuguauuccuuuacuguuuccaaccacuucugucuugucagacugaaacauaauuuuuuacuuauuccaguuccuccuuaauucuaauauuugcaaguaugauuccugacacaagcccuugguuuugaaguaauuuagauuuuucuucuacuucaacccaagaaaaccaucuagucuguauuagaggccuucauuccuuuucauuaguucauuaauaaaauauauuaauauuucccuuuugugggugaaacugguuuggaucucugaaaucuaaagccaugucagugcccaacuugaagucacauaggaaaccuugaacuuaacggacaagcuacauguaaucaagcucaguuucuccacaguauuuaaugguccuggaggacacucaaaacagcauuaaaaaauagagagauuuugguucugcuaaucuaguacguguccugaaacuaaaucugcuaaaggcauuuuauagucccaaccugcagauuuacugagaaacuguauacagauagcagcaaaaaaguguuccaaccuuguaauacuggaaugcccuguagaaucauucuuuauauugucuccacuuauuacuaagauuuguaagcauuugcuaaagccuauuuuuuuuaaaguucuguguuuauaaauaccagagcaguuagcuguucugaacugccaauaucagaaauuccucaugaacucacuuucuaaaauuuacgaccuaaagcuacuugcucuagccaugucaguuguuuugguauccuaauucuacaccuaauauauaucucaagauuccaaacgcagcaccaaaccuuggguuuugaggagguuucaacaaauuauaccuuucuggauccacccagauuuagaacugagagaaaaagagccauaggaauaggguggagaucagaauuucagauuuguuacugauaaaacuauuggagaagacggcuuaggagugagguccaaauaggcuugcuggugcucuccaguucccacaucccaaucuauaccuugagacagccugggcugaggaagaauugggcccuacaaagcaaauacacuaacccaggguuaagaguagagagagaaggaaagaaagugacuaaccuuuuaauagauuaguuucauccagucaggaaacaugggucaagggaugucaccccuaaccauggaggaagaaugaauucagaaugaaaugagaagcuuggagcauuaugcuaggauaguuuccucaaggaaacaugaagugugcaugauguuuguuccccucccccaucaacuaccaugugacuggcuuauuuguaugauacugguucuacuguuucuaaguaugugauuaaaauguacauuguucuuuuaauacauauguucucucuguuuagguccuucuauaugauccacucuuugacuggaccaugaauccuuugaaagcuuuguauuuacagcagaggccggaagaugaaacugagcuucacccuacucugaaugcagaugaccaagaaugcaaacgaaaucucaggugagcaguauuuuaagaagguccuguugucaguuuuucagauuuucuuauucccaaggccuuuaaacuguucaccucacugaaaccuuuguguuuuuguccuuagugauauugaccagaguuucaacaaaguagcugaacgugucuuaaugagacuacaagagaaacugaaaggaguggaagaaggcacugugcucaguguugguggacaagugaauuugcucauacagcaggccauagaccccaaaaaucucagccgacuuuucccaggauggaaagcuugggugugaucuucaguauaugaauuacccuuucauucagccuuuagaaauuauauuuuagccuuuauuuuuaaccugccaacauacuuuaaguagggauuaauauuuaagugaacuauuguggguuuuuuugaauguugguuuuaauacuugauuuaaucaccacucaaaaauguuuugauggucuuaaggaacaucucugcuuucacucuuuagaaauaauggucauucgggcugggcgcagcggcucacgccuguaaucccagcacuuugggaggccgaggugagcggaucacaaggucaggaguucgagaccagccuggccaagagaccagccuggccaguauggugaaacccugucucuacuaaaaauacaaaaauuagccgagcaugguggcgggcaccuguaaucccagcuacucgagaggcugaggcaggagaaucucuugaaccugggaggugaagguugcugugggccaaaaucaugccauugcacuccagccugggugacaagagcgaaacuccaucucaaaaaaaaaaaaaaaaaaacagaaacguauuuggauuuuuccuaguaagaucacucaguguuacuaaauaaugaaguuguuauggagaacaaauuucaaagacacaguuaguguaguuacuauuuuuuuaaguguguauuaaaacuucucauucuauucucuuuaucuuuuaagcccuucuguacuguccauguauguuaucuuucugugauaacuucauagauugccuucuaguucaugaauucucuugucagauguauauaaucucuuuuacccuauccauugggcuucuucuuucagaaauuguuuuucauuucuaauuaugcaucauuuuucagaucucuguuucuugaugucauuuuuaauguuuuuuuaauguuuuuuaugucacuaauuauuuuaaaugucuguacuugauagacacuguaauaguucuauuaaauuuaguuccugcuguuuauaucuguugauuuuuguauuugauaggcuguucauccaguuuugucuuuuugaaaagugaguuuauuuucagcaaggcuuuaucuaugggaaucuugagugucuguuuaugucauauucccagggcuguugcugcacacaagcccauucuuauuuuaauuucuuggcuuuaggguuuccauaccugaaguguagcauaaauacugauaggagauuucccaggccaaggcaaacacacuuccuccucaucuccuugugcuagugggcagaauauuugauugaugccuuuuucacugagaguauaagcuuccaugugucccaccuuuauggcagggguggaaggagguacauuuaauucccacugccugccuuuggcaagcccuggguucuuugcuccccauauagaugucuaagcuaaaagccguggguuaaugagacuggcaaauuguuccaggacagcuacagcaucagcucacauauucaccucucugguuuuucauuccccucauuuuuuucugagacagagucuugcucugucacccaggcuggagugcaguggcaugaucucagcucacugaaaccucugccuccuggguucaagcaauucuccugccucagccucccgaguagcugggacuacaggcgugugccaacacgcccggcuaauuuuuuguauuuuuauuagagacggaguuucaccguguuagccaggauggucucgaucgcuugaccucgugauccacccuccucggccucccaaagugcugggauuacaggugugagccaccgcgcccggccucauuccccucauuuuugaccguaaggauuuccccuuucuuguaaguucugcuauguauuuaaaagaauguuuucuacauuuuauccagcauuucucuguguucuguuggaagggaagggcuuagguaucuaguuugauacauagguagaaguggaacauuucucugucccccagcugucaucauauaagauaaacaucagauaaaaagccaccugaaaguaaaacuacugacucguguauuagugaguauaaucucuucuccauccuuaggaaaauguucaucccagcugcggagauuaacaaaugggugauugagcuuucuccucguauuuggaccuugaagguuauauaaauuuuuuucuuaugaagaguuggcauuucuuuuuauugccaauggcaggcacucauucauauuugaucuccucaccuuccccuccccuaaaaccaaucuccagaacuuuuuggacuauaaauuucuugguuugacuucuggagaacuguucagaauauuacuuugcauuucaaauuacaaacuuaccuugguguaucuuuuucuuacaagcugccuaaaugaauauuugguauauauugguaguuuuauuacuauaguaaaucaaggaaaugcaguaaacuuaaaaugucuuuaagaaagcccugaaaucuucaugggugaaauuagaaauuaucaacuagauaauaguauagauaaaugaauuuguagcuaauucuugcuaguuguugcauccagagagcuuugaauaacaucauuaaucuacucuuuagccuugcaugguaugcuaugaggcuccuguucuguucaaguauucuaaucaauggcuuugaaaaguuuaucaaauuuacauacagaucacaagccuaggagaaauaacuaauucacagaugacagaauuaagauuauaaaagauuuuuuuuuuguaauuuuaguagagacaggguugccauuguauuccagccuuggcgacagagcaagacucugccucaaaaaaaaaaaaaaaaagguuuuggcaagcuggaacucuuucugcaaaugacuaagauagaaaacugccaaggacaaaugaggaguaguuagauuuugaaaauauuaaucauagaauaguuguuguaugcuaagucacugacccauauuauguacagcauuucugaucuuuacuuugcaagauuagugauacuaucccaauacacugcuggagaaaucagaauuuggagaaauaaguuguccaaggcaagaagauaguaaauuauaaguacaaguguaauauggacaguaucuaacuugaaaagauuucaggcgaaaagaaucugggguuugccagucaguugcucaaaaggucaaugaaaaccaaauagugaagcuaucagagaagcuaauaaauuauagacugcuugaacaguuguguccagauuaagggagauaauagcuuucccacccuacuuugugcaggucauaccuccccaaaguguuuaccuaaucaguagguucacaaacucuuggucauuauaguauaugccuaaaauguaugcacuuaggaaugcuaaaaauuuaaauauggucuaaagcaaauaaaagcaaagaggaaaaacuuuggacagcguaaagacuagaauagucuuuuaaaaagaaagccaguauauugguuugaaauauagagaugugucccaauuucaaguauuuuaauugcaccuuaaugaaauuaucuauuuucuauagauuuuaguacuauugaauguauuacuuuacuguuaccugaauuuauuauaaaguguuuuugaauaaauaauucuaaaagcauauacuaagacu

SEQ ID NO: 21458 - RNA, 253075 nt, Homo sapiens
gccccccucgcgcugguguguggagccggagucggcggcggguggcggcgccuggaaccuggagaccgacccaccgcccccccccccccgccccggaauguacugacuccccuucuucgcucuccuccccuccccgcccccuugcaggagggaggcgcccuggagucuccccuccagcgagaggggcugcgcgggccgggccgggccgggcugggcuggagcagcggcggccgcgggagccgagcuugcagcgagggaccggcugaggcgcgcgggagggaaggaggcaagggcuccgcggcgcugucgccgccgcugccgcucacucucggggaagagauggcggcggagcggggagcccggcgacuccucagcacccccuccuucuggcucuacugccugcugcugcucgggcgccgggcgccgggcgccgcggccgccaggagcggcuccgcgccgcaguccccagguaagcggcgggcgcgggcccggggguucgcgggggcgcggcaccggcucaggcggccgcggcugcgguguuuuuguuuaggauccaggaggaaacgugcaggaacuucucugccucggcuccgguugccgaagagaaaggggaucgcgcgugguggggaggagaagggcgagagggggcgccaccggggaaggggcggcugccggggggcaggucgggggcgcaggggucuaguucccagcuuuguaccuggaggcagguucaccccucgccucucuccccucccccaggcucaucccacuuguaagagugggacauucuugugcucacacuagcaccaguagaggccacuacacaccucauuaaauaaacaaucagacggccaauucauuaauuuucaggaaaggaaaggggagggggcuugagcuccugguucccuggccagggauuucccagcuuccgaagucucgaggaagagcuggcuagucucgagggacuccucgcgcggggauuggagcccgagucugcggaagagcgggggugucagaggggcacaauugcccgcucacaaccccugguguugauuuaacgaugaggacgccuuggagagcggcucggagugaucguaucuguuaguguuuccguuaugaaaugccucuucuuuccuggggauuacaacuauauuuacagccuauuaaccacucuuaaccaagggaauugucuaagcaucagauuuuagguacuuguacaauguuuucagauggcauuguauaaacauugaaccucaaaagccauuuucaguucuuuuuuggaauauuauagauuacugaaaccaccugcauuccuauuaaggggaccaacgaacaaaaaugccaagccuuccgggaaggaccuuacgguauuguugagcaggauacacucagcaguugaaaggcaaauuagcauguaaucuguuaaaauuauuugaccaaggugguguaccauaaaacuugacaaaacuuucacucgugugagauaugauauuuuuacauuugaaagcagucuuaccgcugaaccaguacuuguuuuucccugauuuauaugaaauaauauuuaaaaucacacugcaagguaacuugacugauaaacuuuucauuuccuugcagaguguguauguagcucauggcuuuugccaauguuaaagaacagcuuuaaacguaaaguaccacucgguauucucuaaacagcuacguaaacaauaguguuuuaaugucaaauuaaacaucacuuaugucaugauguacccuuauacauucaguccguauaugguuuagaacacauuuuggugcugaaaugcagguuacugauccaacugucucuuagaugagcaagagaaauauaacuauuuuggaaaacaaguuccuguuacucaugaucuauuuuauauggaaauucauauguaguucaccaaauuucaaguuuuuguuuaaaguuuugccgauaauuuuguaaguaacuaaaaugcuaguaauuuuauuacuuaggauaauaaaaauaaugcaagcagucucaggaaguggucuuaacaucuguuucaacauuaacucaauugacagguuuuuauuuugcacagaugaggugcaaggcauaugcucucugccuucauggaguuuacagucugguguguggguaggaaagauagccauccaucuacugauuauauaauuaaguaauugugauaagcacuacaaaggagaauagguuuucacaaaguggguacuggagugacauaaccuagucuggguguuaagagugucucacaagaacugagaucugaggaguggguaggaguggagguggggaggcucacagguaauuagucguuuaauugggucuagaacauagaucuccugauucucgguccagaguccuuccuguaaaccgcucugcuucauuacaaaagcgagaggaauaacugcaauaaggagggguuggucaguucugccauaaaacugcggaagagaucaagagacuggagaacugaguaagcagcaacuggaacaagcuguccgcaaaucagauguccuuugucaguaguuuuauuuuuuuuauuuuuguagagugauagacuuauaaaucuuuuuauaggggauuauagugaauagauuguagggaaguggacauguucaguaguagaagguggagaaaaauagagaugugggacaauaggauaaauggaaaguguuuuuccaucugagguuauagacauacggagguggaggaaaaaguaagaaguaaaggacuggugauagaaaauggucagcaagggaggaggguuggaauugaguaggaacauaaucugguauucugaaaaagggcagauuacugaaaagauauguagagaccuuggggaagaugacauggcagcagccugugcaaugcaugucuucucuauuuagagugaacauucuucaccgaggacucuguagcuucugccugaaccauuuauuucaugaugugauucauugccuuacaggguaguccauuucuguguugaauaacuucuguuagaaaauguugcuuuguacaguacauuucacuguaguuuucacccuccccacccuucuuacauuuuuuccucuuugcuuaccuuuuucagcauuacucuaucuucagguuaaucucuucucugauuaauucuucauuugucuuucuggcuuuucuugaacucacucacuuaaauauuaguaucuaaagcuuaucucauuauacauacucuguuugcccucaguugccaccuguaagcuaaggacucucuuaguccacacuuucucacuugccacucgguaccuucacuaaauaggaucuuagguuacugaaguccgaaguuaaacucugugucauuuucccucgugcuuccuucauccccauucucuaaacaugaacaaaccaguuccuggccccugugucucauguuguuggaaggauugcauggauuugucuucuuguguugccugucuuggucaucacuguucauccacuugcccaagcugagaucaagaagaccuccucuucccauugccauagcggauaguucuuuuugcuuuuuaccucucagcuguuucuugacucugaaucgguaucuuuucaucuucauccccaccuggacuaacaguaguggcuccauaauuaaucucuuugucuguacuguuacccucuagaagucuguccugcuagaaugagcuuccugaaauauuuuccugagcaugccacucuccuacuuaaaaucuguuacuaguguucuguagcuuggguguuagaacucuuuggcauggagauugugaggcccuuuguauucuuuaccucuguucucccaaacccaauaaagccucaucucuugucaccccuaacaugcaccuugcauuccaccacuccagauuaacgacacagcuucagaucuccgugccuuugcacaugcuguucuuucuguuaagucacuucucaccuuguccacuucugaaacuccuuaucuagucaaugaauuuuucucuaccagcuuucucuuccaaagagaguuauggucacuauucuguguucccauagcuuccugaguacuuuucaucuucuguuacuuauuuucuugucuuuucugcuagucucaaccucugaagggguuggccggguugucuuauucaccuuuguuucccuaguguagcacuaacauguagcauagagaagauaaccaguaaauguuuguugacugaauguugaauugccuuuguuuuuaacccguagggccauacagcacaaaucugauuccuuuauaugauggcccuucaugugucuaaucacauuuccugugugcaugugugugugggcccccccugcccuuccccucaaaccuuauccuuuuuaaguuaaccauccuuaauuccuucagccacucuucacauuacuuaguuuccagaucuuuugugaucuuggucauccuccuggauaugcuguaguuuuagcguuuuuuuaguuuugucaucuuuggaaagaucuuugaucuuacugagucaucuaaaagaaaagacugauggcguugcucugccugucuguuagaaugaggcacaaaagagaucauagaauucugggaugaaugcucaaagaagauaagaaauaugacugauuuucauaaacuguaugaaaauuaauacaugaugugagauagugaaaagacauacaugaaggcagaggauaugggguaugacuugugguucugcaacuucacauacaucuguaaguugggggauauaggcaggcaagaauaauaccuuaccuaccuaacuggauugucagaaaaauaaaauguaaaauuguucauaaacuauaaaguacuguaccuauguagaauggcuucaguguuucuuugugaacucuaaaaauauacuauauuaaauuauuugaaaguguagacuuuuuuuucuuuuggcuuaauugaucauugcugguuucuuccuuaugaguuuuucucuaccucaaugaaaauauugggguaaccuuaauaaaucucauuauauggaggcuguauuuaauagucuuuuuuccaaacacuuuauuuuauuagugacuuccaugugauugggagcuauuuaccauaucauugguaaguguuuagguuucuggguaaaauugcaucaauaauuggagaacagucagaggaaaugacuguagguaagaucauauugaccggagagcuaagugaagugaggagaaguuuuguguuuacgauuuugaaaaauuaacuuugucauggacauagcuagugaaagaugauuuuaaaauagagcucaaauuuuggauucauuuagaaugaagagaguuuuuuugauucaaaaauuuuguaaauagugacaaaaaaaggcauucagacccacugguaugauuuugguauauuucuuucuacuuacugccuauauggcacauuaucuuuuuacauuguaaucaugguguauguauaacuugaaauguuuuccuuugacauuauaccauuuuucuuuguugucacauuaucuuuaaaucauuuuauuuuaaaaacuuauuuaaaaauacauaaauauauguuuguuugcagucaaacaauauaaaaauacauagaauaaaagauuuuaucacuucuacccacaaauuccauuuuugaaacccauaaguaaccccuuuuaauaucuucccuugcaugugcauauguguguaugguuuuauuuuuuuacagauaagcaggaucauacuaccuauuguuuuuucaacuugcuuuuucacuuaguauguuggagaucguuccaugccaguacauacagauuuuccuauaaccauuauuuaaaauguguguguaauauuccagggagcaaauauaauaauaguggcuaauuaaaguaguaguuacagaacacucccugacuuccaggcauugugccaugcucuuucacauguauuuaaucuuuuauacaguccugugaggaagaugacaauuucuucacauuccacagaugaggaaacugagucucagauauuaagugccuugccgaaggucucacaaccuuucaugugcaagaguuggcauuggaauccagguuuuugcaacuucaaagccuauguucuuuauuccucugcauucugcugcuaauuguguauucuccuguuauggauauggaaguuguuuuuacuguuuugcugugauaaagaaugcugugaugaacauauucuuucuauauuuuggauucccccauauaggauugcuggugaaaaguuaacuuguguguguaugugggggucaggguuccauuuauugcagaaaaguaaugaugucauuaagaauaauuccauugacuaauacuuucauaacuuuuugaagguuuuaccacuuuuaauugugaacuuuggguacuuaaggccauguuuuaaaaugcaaguucaucuguuaacugaaagguuaagcuaauuaauaaguaauuucaaaggucccuucugccuuccagguuucucuuacucugaaguccauaaaauggaacaguggguuuauuucagcuuaauaacuucuauucaguuauuguguuccaacacuggucauuucugguuuucagaugcaaaagucaccuuuuuuucauucgcuaaagcucagguuauuguauaucuuuuuuuuguagugcaaaguaggauaugauuggaaaaucgucuauguuacuugcaaaugauuguauaugauuuuauuuuauauguguaaaaauagcuuuagggcugaguuauauggcuucaguguuaaguaauugugagguauuuuaagauacaguauuaccagaaauauuagaugcuuacucuuaggcuuggaagggauguagaguaaauugaccagguuacagagcuggcuuauguaaacagguuuugauucccugucugaccccuuuacauaaagaaaaggcagagagguauggugguuauauauguuuuauuuuacugaaugaagucaguucuucaguucugaggaguuagcagguugguggucugaagugcagauuacgugucucugcuuuuccuuuuuuaaagaaccauuagaaauaaccuucuuuaaaauuauuucauagcgagaauccuuacauuuaacuuuuuauuaagucaguucuauaggcaaagcuaggaguugcaguaauuuuggcugguugcaaacguuuaucuuugagggcuaauuaugcacaaaacuacacuguggaaauaaagaugaauuggacgugcuuucuguccucaggaagcauuuggucuaaugguggagguaagggagauauuagguaacuugauuuggcgagagaaagugccauuacugcuguagguagaaaaauacauucuggaaucauuguguuacuguugaucaaggaauagugcugcuuucccucauaauuuugguucuguaucuuuagaguaguccuaacuuaguuuuauaaagccaguagacuagaauucucaagaaggaguuauauaucauuuccucugauuacugcaguguuugaauguaugagaaugcucauaauugagcugucuggggguacagcuacucccauguuuuuuggaaaucuggagauugaucauacugauuuucagaauugauuauuggucauuaauaguacaacuuacuaagaaguccugagcagagugaauuuuuguaaugauacuauguggaaauugaaaacagaauguuucuguuuuucugcuguagugguaaaaaaaaaaaucaccaaaauaugucuuuauuuaugaggucuaguuaagauaauagcauuauaauuuacaaauuuagggauagaauaacaaauuauaaguuucauucauaauuuuuuaauucacagcauagcuuuaaauguaacaaguaaaauuugaaaaucuuuuugguuaauuguugaaaguuuuugaaguuggagguaggauaacuaguuuuguuuguuuguuuguuuguuuguuuuuucugagacugagucucacucuguugcccaggcuggaguguacuggugcgaucuuggcucacugcaaccucugccucccagauucaagccauucugcugccucagccucccaaguagcugggacuacaggcgugcaccaccacacccugcuaauuuuuuuuguacuuuuaguagaaacaggguuucaccauuaauggccaggcugguuucaaacuccugaccucaaaugaucugcccgccucggccucccaaaguguugggauuacagacgugagccaccgcugcacccaggcaacuaguuguuuuaaauuuauagaguguuguauauucaagggauugugugcagaaauucuuguggugauaacccuuuuauuuauuuauuuauuuugagaugggcucucacucuaucacccaggcuggagugcaguggcaugaucacagcuuacugcagccucaaccuuccaggcucaggugauccccagccucagccucccaaguagcuggggcuacagucaugccucaccaugcccagcuaauuuuuuuggguauuuuuguacagacaggguuucaccauauugccaaggcuggucucaaacuccuagacucaagcaaucuacccgccucagccucccaaagugcugggauuacaaaugugacacugcacuggccuaaccuguuuauuaaucguaccucaccuacauaggacucaaccauuaugcaaccuaccuccggaauauaacugaagacuagggaauaagagaaauaauuuucaaaguaaaugcauuucuccgagucccaaaggacuuuguucagagccuaucuuuaauucauaggcaguucuaacaaacaguauaaucuaauuucugagcccauagcugaucagaaguggguagaaagacuaucuugggaaaugcccccugcagcagaagguagugacaguugcaaggaaagauacuuaaaauaagcguaagaacacagagauaucuucccauaaacggaaguuacugucucagccaaguugaggaaaauuucuuucccuuuccauuacugcuaauggauauugccuaccccuggccuuuccuuuuauccccuccuacuguagauacaguugcugucugggagauagaucuucccucagaaaucucuugagucuuaaucucuccucaaauuaguaaggguucagguugaugccugagguaggaagaaaggaagugugaccaggaggggaggugagguggcaggguaugguuccuaccccucuggccaugacauuuaucuuuauuaacagcguuacuaaaccugauugcuaaaauauguauguggauuuuuaauuuggggguaaaguuaauuguugaauuuuuauuguuaaaaauguaacaguucauacuauguaaaauaaaaugugaaaucauacacuccaacccuucuucccagaguaaucacuuuuaauagcuauggucuauuuuauauauacaauuauauacuuaaaauaucugguacauauauaacaacaauaacaaguuggauuuugcugugcacacugacuuuuaacuuguuuuaggacaucuuuccaugugaguguguauaaauuuaugaguuguguugauagccauaugaaauuguauuuucuggauauaucauaauuuauuuaaccaauuucuuuuugaugcucccaaauuuuugauugcaaacaaaugaugcagugaacccacguuuauaaauguccccauuugugcacaugugcaaguaaaccauagaauaaguuuguggguguggaauuguagggcaagagggcauguguagucacauuauuuccaaauuguuuacuaaacagcugauuuacacuccuuugagcagcaaaugagagugucuguuuccacacuuccuugccaacauauugguuauuuucagacuuccuagucuuuuugccaauuugauagaagaaaaaaaaccucuguaaauuucauauuuuaaaauuauuaauggaguugagcaucuuuucagauuuuuauugaugguuuauauuguuucugagaauugccuauucauguguuuuauucauauaucuauaucuuuuauugaaucauugauucauuuauaaauauagauaauacguaauuaagaauaggaauaauuuaaaacuuuauaauuugucaaaacuuccauagcugcuugugguucuuaacuuagugauaagcaaacugaguaauuggguuaguuaccugacuccugcuaaccacugcucaugcuaaccugauguggauucauaagcuuuaaaacuguucuguuuugaggaaagaaaguuaaauauuuuauucauugauuugaguaacaaauaggaauugaaacaugcuauuaccucuuuuaagacagaaagaacaauuuugguuugaagugauuaaguucauuuagucaaauacuugagccaguuuggcccaagguacuguggugauuuaaaguggaaaguggauuaaaaauguggcagaagaaacaaguuugggaacaauggauauugguuccauuuuggacaccuugagucugaaaugucagcagaacaucccuguaaaaggguugcagaauuagggcucaguugaaaagucuaggcuagaaacguaggcucacagguuaucugauagagaugauaguucaagucauaaguguaguucaugacacuuaggaaggaaaaagaaagccuggggcaaagacuuaggcauacaucuauauagauggguuuccaaagggaggaagcguuccucuguuuacugaagaagauaccacuauucaagauaccacuagaccuagaauaagaauuauauaaaaugauaaaguucauuucgccuauggaggcuuauugagaaacaccugugugaauaaaugagcuagugcuaaaguaaugucacuucuuucccuaaccccugcaggcaugucauggcccuggguuagaacaguaggcagggagagcaaaggcauacagagccaauuuugaacaauucuuuaagugacauauaucauaaccacccacucuacugggcugaaaugaacaaagaaugacuuaauaugugucccugcuuagaacaaagccuggcuuauucauggaauguaaacuguuauuauugucguuuuuauuauuguauacuagauggagaggcuagcuaaaaauacaugaaaauuagauaacaugauuugguuuuuguuuuuauuugauggcuguguguaaauagauuguuaaaugagugagcuuauguugaagaggauaaggauuuguuuaguuugggauauucagcuaaguuucuuaagacuugagcugauuuugaagccguaaguaggguuuuuagaugcgcagccuuuuuuguuuguuuguuuguuuguuuguuuguuuuuuggccaggaggguaaaauacagagcauuaugaggcaaaguaaaggcaaaagcaacagaaauguuccguaagcuguuucuuguaagguucauuuuuauucuggaauuaauaauuugucauauagcagaggggugaugaugaugaugaaaucauagccagauaaucugucaugguaggaaggaggguggagauagugcauguuccaauuuaaugaaaauuaacuuuauuauuacguauuugcuuuuuaagacuucauuuauuuccuguuagauguugugggcaucuuuuaugaaucagcgauuucucuggaguuuguucaaagcccgagaaguaagcuucaggauuguguguauuaggaaguucuaaggaguuagcguuugccacuuucugaagaauacuuuaaaaaaauucuguaagcuuuguggaagagcgaauuuauuucuucuucagaguaguuacaguuaaguagaggcauuucuguuucagagucagccuuguuaguaauugaaauuuugggguaagaaauguagacaacauugugauacuuggcaguuccacuuuguucacacuuaaacucugggauugcagugugaugagaugcucauacuaaggcauucuggagcugagcucagcugguagaaguucauaucucauguuuugugcucauaugaauggcagguagaauggcuuguucuauuuaaauuaguucauauucucucucucuuugucucucucauucucauaguugaauuguuuuaacuuaaauguguguaugauaugacuucucuguacuuuauguacuuuuauuaaaaauuaauuaauuuagagacauagucucacucuguugccuaggcuggagugcagugguguggucugagcucacuguaaucucugccucuugggcucaagugauccuccugccucagccucccaaguagcugggacuacaggugcacaccaccaugcccagcuaguuucuuaauuuuuuuuuuagaaacaagaucuuacuauauuguccaggcuuguuuugaacuccugggcucaaguaauucuccugccuuggccccccaaagugcugggauuacagaugugagccacuacacuuggcccuguagucauauauuuauguuauguuuguagcacgugguuagguuuuguuuucuuuugccugacaguuuuugucuucuuacuaaaucaugucuauuuaauguaauaguucauauauuuggcuuuaaaccucccauuuuauuauuuacuucugcuugcacugcuuauucuguauuccccuuucucucuuuuccugccuuccuuggauuauuuuaaguuacucuguauuucccucucuuuuagcuugccaguuauaauuucuuucacuauucauuuaguguuuccuaaaugcaucuuuaacuuguuauuuguaugauuucauggacagugcaaggccucuauaacaccugaauuccauuuguccuucucuuuuguuuuaauguuauuauguuauuguuguguauuuuaguucucuguauguuuaagauccaucagauguuauuucauacucacuauucauuuaguuuuaguuauuuaaauucauuaauuuauucauuuagauuuacccacguauuucguuugugaguugcucuucauuuuuuuuuuuucugcaucucugaucuuucaucugggaucauuucuuucugccuggagaauauaauuuagcauuuaguuagguuuguuggagaugaauuuucucagcuuuugucugucugaaaacauuuguauuucaccuucauuuuuagauuuuuguggagagggugcuggauguagaauucuagguaaacaguguguuuuuucaacacuuuacauauguuguuccauguccacugaacucuaucuuuucuaguaagaagucaacugucuuauuuuucuucuuuugugaguaaugugcuuaccucccgucuuuggccacuuuuaagauuuguucuuuaguuaugguugucagaaaugucacuaugaugugccuaguuaugguuuucuuuguauuuaucccgcuuauugagcuuguuguaugugugggcugaucacuuucaucacuuuuggagaguucuuggcuuggcuguuaaucccuucaaauauuuuuuucugaauuaaauuccauuagaauuuaguucacuuaggcucccuuacauccuuaucucucugauggguucagaaaaacuauagauuuguagcuugucugcccuguuuugguuguuaggaaaacaguaauaguccugauaacuuuacauucugauuagaggcagcacucucuauauugaauucuuaauuucauuuuauugaccuuuucaguucuguaauuucuuuuuauuucuuucuuucuuuucuuuuuuuuuuuuuugagacggagucuugcucugucacccaggcuggagugcaguggcaugaucuuggcucacugcagguucaugccauucuccugucucagcaucccaaguagcugggacuacaggcgccugccaccaugcccggcuaauuuucuuauuuuuuguacguuuaguagugacgggguuucaucguguuagccaggauggucuccugaccucgugauccacccaccucggccucccaaagugcugggauuacaggcuugagccaccgcaccuggccucuuuuuuuuuuuuuuuuuuuuuuaaauaguuugcaggucucugcugaaguucuccaucuuguguuuuuauuccuuuaacccacuccagcauguguguucccguaggaguuuugcuuuuaugucuguuuuaucaccugauuugggaggguuucuuuucauguucuuaguugugauugaaugacagguguuguguaugaaaaauuaucgagauaaucuggaugauacugucuucucaggauuuaccuuuacuucugguaggugguuaugcuggagguacuaacagucuccuaccacauuacauagggauugaggugauuuaaaauuaggcuuuagacucuaugaguugaaauaguuuagguauaccuuuaguucuuagauguagcccuuugaggcucugauccacaguuuaagggguuuacccucccucuuggcaggcccucacuccaguuuuuguccccuuagggcuugggucugucgaaagcuaugcucaucucagccucuucagcaguagccuuuagaaucugccgauagcucuaggccaaaaggagccccacauaccagauuugucccuuuggcuuuucuuucuuuuugcaucuugguuccucaauuccucauugccuugauugccuuuacacagauauuuuguguuuugucuaguuucuuuaguuauucucagcgggagaauuggucuaaaccaucuacucuaucauuccugaaagcugaauucucucaaugccucuuucaucauuucuguuauuuguggaaguuugucugguuuuucaucacauguagucugcuguuuggugucccauuuguauuucuuuggaaaauuauugaguagccaaaagcaauccuccugauuucagauuguucuguuuucauauacacaguauucuuuuaaguuucuuuaggauuucuguaauugggauuucugcaguugggaauucuaaugauauucuaaaauuuguuucucucucucuguaaauuuuccggggaaauuuuugcuccaguugauagaacaaucauucuuuuagcuucuaggucuuuucaaaugucuguuuguggugaccaugaugauaugauggugucuauauauauucaguauugcugguugacauggaugcuuuucuuucuuuuuuuuuuuuuuugagacagagucucgcuguguugcccaggcuggagugcaguggcaauaucuuggcucacugcaaacucugccucccggguucacgccuuucuccugccucagccuccugaguagcugggacugcaggcgccugccaccacgcccagcuaauuuuuuuuuuuuuuuuuugagacagagucucgcucugucccccaggcuggagugcaguggugccaucucagcucacugcaagcuccgccucccagguucacgccauucuccugccucagccucccaaguagcugggacuacaggcgcccgccaccaugcccggcuaauuuuuuguauuuuuaguagagacgggguuucacuguguuagcuaggauggucucgaucuccugaccucgugauccaccuguuucggccucccaaagugcugggauuacaggugugagccaccacacugggcccugaaauggaugauuuucaagcuuguguggguuccuguucuaauauuucagguauagaugaaagaagagaaaguuuuagauuugcaaccauuuaacaguuugauugacauuccuagauuauugguuuaacagaaugaucuacauuccuauaucauuaguuuggugguuugcagggaguaggggcaagauauagccagauagcuaugagacagggagguuuacugcuaacgcauuguuugcaaugcugagauucaucaguuguggagcuagcuguggcagccuccuguauuuuuguuuuugucccccuaccccccccccuuuuuuuuugagacagugucucacugcacccaggcuggagugcauugguggguucucggcucacugcaaccucugccucuuggguucaagugauucuagugcccaauagcugggauuacaggugugcacaaccacaccuggcuaauuuuuguauuuuuaguagagaugggguuuugccauguuggccagguuggucuucaacuccugaccucaagucauccacgugccuuggccucgcaaaguacugggauuauaggugugagccacugcaccugguguguuucugucccucaucucuaauccucaacaugagugcugaaccagaugcuuugccagccuuuuuucuuggagguaucauggguccguccacauaugcuugucgcuauucugugauuuccaguggagguacagauuuucccccuugguguuuuuauuuauuaauuuuuuaaaaauuuguucaguuauuuuaguggauauuaagauaagguguuggugggcauugguuaaaugcaugagcuuaguuuugccaucuuggacugagaaucuacacuggguauuuuguuguuguucucauuugguuuaguuugaugucugauccaauuaaaaagaauaguguuuuuuuuuaacuuuuauguacauuuagauugaaauucugcaaucacugaaggacugugcuaggcuaguuagcuccugacugauguaaaaccuuugauagaguggggcuuuuuuuuuuuuuuuggagacagggucucacucucaccuaggcuggagugcaaugggguaaucacagguuacugcagccucgaccucuuggguucaaaugauccuccccccuucagccucccaaguagcugggacuacagucaugcgucaccaugggcuaauuuuuguauuuuuuuuuuuuuuuuuuguagagacaggguuuugcuauguugcccagcuggucuuaaacuccugggcuuaagcgauccucccuucuuggccucccaaagugcugggauuauaggcaugagccacugcgcacagccgaguaggggcauuuuuuauucaacagacauuuucaugauugccagcugcguuuuggggcagugccagauuuugggagcacagaugucagcacguucuuugaucuuauauaccuguuauugaggcagagauaccuuucucugaggccaagagacuuuuuuuuuuuaaagagagagaaacaguguuugaucaaaguuuuuguuuuuuaacccauuaguuagauuguugaauaucaauuaauauauaaacauugauaauaguuuuuauaucuauagaaaauauuccaguuaaaaucuuaucuauaauuucaguugaauuacucauuuuuauaguaaauuucuguuuauucucugacuagaugauuauaucaauuaaggguuuaugguuuauauauuuuuauauauauacacauacguauauauauacgcacacacgcacauauaauagauauaauuuacccauguuacacauauuuagaaaguaggauaguauggauuuuauggcauuuuuauuuuuuaauuuguuaaauaaggaauucagaguuuaguaagguagguaggacaugagacagaaaaguagaggcauuauauauucauuuuuacuuaaaggaagaagaguuagcagucugcuuccaccuuaaagcuagaguuugcuaguugggaaauaaugcuuuggaagugguuugacagauugaguauaguauaaggaauugggaaaaagcaggcaacuguggccaaaaaguagauuggaaaggaaaauggcuagcuucaauauguuggcauggggaaaacaagguuauaucuguuagaggcauaaaauacucuguacagagaguugguugucuucauuuuauauccaacaagaauaguacaauuuagggaaaguuauuaaauugaaccuuucagacuaaugcuuugccaugauguagguuaauuucccuauaugucguucauccuugcucaaauauguauuuuauuuguaauauuauaaaguugauauaaaaaauacacuugaugccagauuuucaguuuuuaauacaguggcuuucacacuuguucagguguuagaacaucuggaaguagugguauacuuugagagauaucaugaacuauauuuuaauuacaugaaacaaaugaaguguaauuuuacuagcuguagauauaacucaugugaguguaacucaacucgguagaaauauuuaaggagcauuuguuauguaucauaaaugcauaauuucaugaugaaagugaaucauggaagagcuagaagaaaauagaaaagagguuuuuaaaaagccuuaucaauaguguauacaguaguccccccuuauccaugggagauacauuccaagauccuaguauacgccuugaaaccauggauaguaucaaaucuauauaccaguuuuuuucccuguacauacauauggcaaaguuuaauuuauaaauuagguacaguaagauauuaauaauaacuagaacaguuaugacauauugucauaaaaguuaagugaauguucugucucucugucucacagauuaucuaaauauuuucauaucaugguugacuauggguaacugaaacuguagaaagugaaaccguggaaagcaaaacuguggauaaggagggacugcuguaauaucuuuuaagauuauaucuucaguaggggcugguugccuuagccauuggcagcaugcugaagugauucuuuuuaaaaauauuuuuagagucaggaucucacucuguaacccaggcuggagugcaguggcaugaucauagcuaacgguagccuucaacuccugggcucaagccuccugaguagcuuggacuacaggugggugcuaccacaccuggcuaauuuuaaaaauuuguauagagacagagucuugcuauguugcccaggcuggucuggaacuccuggccucaagagaucuuccugccuuggccucccaaagugcaggcaugaaccaucgugccuggcccuaagcgauucuuuauguguaguuacuacuuucagggcaucauuacacaucuacugagagaaaauuugugguucuggggccuggaaaucugaauuuugagaagcaucugauggauuuuguauucauaaaguuugagaaacauuuucuaagugcugauugaaaagaacaggauauugcuucagaauuuaaaagaaacaguguuugagaaugaacuccuccuccagggaaaaauguaauuuauguaugaugggguaguugcuauuuauucacuuagauguuuuuuguuuguuuguuuguuuguuuuuuugagacagagucucacuccaucacccaggcuggagugcagugcugccaucacagcuuacugcagccuugaccuugugggcugaguugauugucccaucucagccucucaauggcugggacuaccaugcuuggcuaauuuuuuguauuuauuuguagagacaggguuuugccauguugcccaggcugggcucaaacuucuaggcucaaaugaucggcccaccguggcuucccagauugcugggauuacagguguaagccaccacaccuggcccacuuuuguuuuaagaaaugucuuuauaacugaauauugaaaacaauugccguucucugaaagucuuuuaguuguuuuuccauagaaaugaucauacuauaucugauggcuuuuaauuuaauuuuguuuguuuguuuguuuguuuguuuuuugagauggaguuucacucuugucacccaggcugaagugcaaugggccgaucuuggcccacugcaaccuccgccucccagguucaagcgauucuccugccucagccuccugaguaguugggauuacaggcaugugccacuacacucagcuaauuuuuguauuuuuaguagagacaggguuucaccauuuugaacaggcuggucuugaacuccugaccucaggugaucugccugccucggcuucccaaagugcugggauuacaggugugagccaccgugcccagccagcuuuuaauuuuuuuuuuuuaacugugaaaugucauuagaauuuggauuguauuucauuaauguaauaucuggaagauucaaaguuauaauuuuuaaaaguuuuaauuuugcuuuauuaacugacucaacuguuggacggaagcaggaacauaaaugaaaaggucaucugaaagucucauguauacaagcuuuuucuaacucuccaaaacaaggugaauuucagacaaauucaguaaaccuuuauugaguacauguugcaugcucuauguugggaccaugaggaugauuaaaacuuacauccuguccugguaaaguucacacuugugggaaugagauaggguaggaauacauguaaacaagcgauuugugcuuugccuaaauuuaaugaauuuaaaagguuauuaaauaaagugaccaucauaauacaugaagaaaaagugugugugugcuugcgugcauggaggugggguugugguggugauggucauguuucauacuuaggcccguuguaguagccuagguaguuuacagagguaaauuggauuagcaugauggcaguguagagaaguacauggaauagaaagauauuuagaugauaaaguagaauuuggugauggauuggauaugguggugagggagagggacaugucaaagaugauuccuaagguucuuuaggauuugcauagcaggaugaugggugcugaugucuuuuacggagaaagaacuaaguuugggggacaagaagaacaugcguuuaauuuuggacauuaugaauuugauacaccuuugugauauccaggggcagcauuacagucuggagugugauggaagacaugggcuguagauuugugagucauaugcuuagaaugugguugaauugagaaagauggguuauuauaagacagagaagugagcggagaaguaggaggaaaacuaggagaagguuguaucacaggaaccaaggaggagaguaucugauucugcuggcagaauuaaguaugcugaugauuggagagucuuuugcauuuaccugucagucacuguugaccuuacugacagcuggagauggaauuuggaagcagguugagggacaagugggaagggaggaaaugaagacugaaaaguuccagaaauuuagccaugauggggaugacugaauguagugguugaggucucaugaguugggugugugugugugucuguuuaauggaugagauucuggagcguauuuaaaaauggaaggcucuauuugagagggauaguuuaaguaugcaaggaaaaugggauaacugacaguguaaguuuccugggaagguugggagaacacgggguuuugagcacaaguagaaagauuugcauucgacccauuguaggagagagaacucuccuuuaacgagagggaaggaacauaagaacaggugaauauuauuguuaaugaggcagugaggccuuuugcuguacgugauaagcaggaaaugguuuucaggaguguugaggaauugguugaccagagagguaggauuacuauuaccagaacuaauaugagaauguaccauacuaggagauuuaacaggauuguaaauuauaugggaauaguauuguuuucagugccuuuucccccucaucugccaggccucagugagcccauuggagauuguagauucccaguaaguauuuacccuacucuagaaucuuaaaugaaaaaugcauaaacaguagcuacucuugucugacuugaauuuuguggacuaaugauagaauuaauaagugaaggaggucucuuacuauaacaguguuuaauucaccauuucaacaaaucucucccugcagccuacuaagcuuuuucuuuaauuaaguaccugauuuacacagcagauuuuacucauuugaggacucaagucaugucuaaacagauaaagguaucagcucaggcauaguucagguaccuuguaaaugcaaucagaguuguucugcaggguaauucaguuuuagacauccauuucuaaaaacggguucugucugaaaauggaggccuuaauaaccaauuucucguuauucagaggccaguuaucuaguuuauuuaucaagauuaggcagucaccuuguuuuucacuccuuucuaaucucucugacuguuuuguuguuuuaaacucaugaguaagauaaggagaagaaaaacagagaauguacauaaauuaauggcuaaaaugaaguguuccuuugcauguuucuuuuucuuaugcuuuauuucugugacucauacggagcuguuagaagugacuucauauaauauuauacaguguaauaaaauggguuuucgaugugugaggauacccucauguuauuuagauuauggacacaauuaacaauuccagacagaauuauuuucucauguuugaaguaguauaggcacauggcccuuuaugggaggggggaagcucuucucugugugcccacuuuucacaucccucuccagcaugacucuccccuuucugucagucuuaccccaggagucccuggccuccuuccucuccuugacacuguuugcuuugcaagcauaugaaauacuggcacccuaugaccaggguagacuacaaccaggguuggggugcaggagccagauggagaaauucaaauuaugaucaugagaacauguuccucuagguaguggccauacuuuuaucucuauauccuuaggacguaacacagugccuggcauauaaugugucuccagaaauauuuuguuuuugaauuaaagacuauuucaaaauuacagagucauaggaggaaucauuuaauuuauuuuucugcuuuuauaggugaaaaaagugaggcuuagauucauagcaccuauuuaaguuccucugacaugaccaguuaugcuuuagaccauacaaagaaguaagugaauaugauauacaauuccagccuucuagaaguccaaaguuaaauagaacguccagcagccuuuuaucuagcagggauuuuugugggggcgggaaagggacagagggaaggaugugaugguggugcuuuguuuugguuguggugccuguguugcuugauacuguguuauggcagguacagaguugcauaauauagcuuuugcccuuaaggaacuugucuaauguaaccugagacaacauauuaagaaucagugugucucaaagcaguauaugauuaaaugccagaugaguggugcacuuuuauguaugccaacuuuauaaaaugaaaaaaugcuaaugauccaucacgaggcagacaugcacuuucaguugcuauucugaaaguggaaacagauuggacuugggggaacucugcaucuagaaguacaaguugaugauuauuguccauuugauagagacacuggaagggugucaguguaaacacuggccaugugaagauugagccuguugaugguuucuuuuguaucauaggaugccacgucaccaacuagggaauucugcccaaucaguugagccaaauagugcuguccuauuguaaaauuguuuaaucugugugcuugugugugugcuugucagaauuugugaaucauagaauuguuuuaacuggaagaagacccccaagaucaucugcuucaaccccuuccuuccucucuuuuccagagagguugcacuuuacuugagcugugacuaggauuaugccacauucuuuuguaaguuguaaccuauuuuugucuguuuugaauuuccuuuuuuugcuaagcuuuagcacaaaguucaccagguuuugaaugaaugucucauauuugcaauaauuuagggaacaguugagcauggaaggagagaauagaaauauggggagggagaucgugaaaugauguuuccaguggaauuaauagaaguacaaaggaccaagaauuaaggugcggcucagaucucccuuuugucugcuuuugguuugugaugguauaacauugccugcaaacagccacgaugaauauuuucauuuuuauuaauagcaauaugggggcaugaauagauucugugauauuuuuagauacgcagagacugugaagaaaaugacauuuaguauauaauuuuuacccugcucuuaagguguuuguaaucuaguugagagguccuaccuucaaaagguuuacgaucugauuggagacugaaggaccuaaagaaguuaaguaacaaugucauaucucuguccuuucugcuaaaugaaugcuacuuacuauuuuuccagugccuagaagagugccaggcccauaguugauuuucaguaaguauugguuguauagauaaauagaagguacugacaguaagcaugagaggaccucugagugguguggcauuuggagaaggccugggaucuuguacagugcaaagcuuaaguaacuucauucuaaguuuguauuuccaacucccccaaccucagcauguucuccccacccaccuccucacaccccaaagcagucccugucuuuuguuaacugauuuuuuucuuuggaagcaagccugaucuuucucacauuuauuuugcuacugcucaggcuaccuucuuuucuuaucucuaccuuuccucuuucucacaacauugcuguuccucuucaaggauuuagaaggaucauguuuugguuuauaagacaacuguguuuucuuagguccuucuucucuccagggauuauuguaggagguaaggcacuuucuguggaagaacugaguuaucagaaaaaguucagaaacauauucuaugauuauuuagaggaaaacuguaggauagugauaucuuauaauaacauagcaauuuuuuuaaauuaauuaauuuauuuauuuugagacagagucucucucucuggcacaggcuggaguguagugacaugaucucagcuccccagaaccucugccucucagguucuagugauucuccugccucagccucccgaguagcugggauuacaggugcccgccaccacgccuggcuaauuuuuguauuucuaguagagaugggguuuugccauguuggccaggcuggucuugaacuccugaccucaggugauccacucaccucggccucccaaagugcugggauaacaggcaugagccaccguuuucagguugucauaacuacauucuaauugacugcauauuuuuaaacacaaauuaaacuaguuauguucuccacccuacucaguuuuggcaguauaaaggccuguuucacagagaagaacacauaaacaaguaaguacaaggaagcuugugugaaugaaguucugcuguacagcucagugacuuucucugauuuaagauguagcucuuggcaauuucaaauaguuuguguucucugaaggagaaguccagucuauuuaacuguguuuagcaaaaacuaauuaugauucucugaugggaaauagauucucagacucauuuauucauucaacaagcauuuauugagcagcuauguaugaggcacugugcuagguaacgggagaaauaaguuaccagucuaacaaauggcauaucauacguaaaaauaauacugcugaggagaaggugauauaugcuguaaaaggggugcagagugcuuuggguuuucuaaaaaugagaagguuacuuccaugaagcaacucaguguaagcuuuaugggaugauagaauuugauagaucuugaaggcuggguacaugguuccucuguccauugcgcaggauguuggcccuggcuuagcaguggagacagaccuauggcgaugggaagcgggagaggaaguauaaugagcaaacauccagaagugggaaagcauuggugauaugggcaacagaaaguaauuuacuuggagguuuaggguggugaugugaaguggcacaagaaagggauagaaaagaagcguccuugaucugacagugguguauacugugaauuggaagaguggguucagucuaggcuguuuacccaaguugguguuucauggaccauuguucuucuaaucuaguaguuuaauaguuuuauauuaggggaggggaaaguguucccuguucaaguaagcuagagaaucccugcaggagaagcagggagaaggauauugacaauguagaaugcuuucugugauauacuguauucaguuguguugccguauuaaacacaguggauguuugaauguucuguagauuuuuaucaccugaaauuuguugguuuucaugcugaugucuucaaggaugauucaggaggagcaguauagguggcuggucuaguuucauuucccagccccaguccacaaagggcucuguuuaucuaaaacaauggcaguguuuccuaccguccugcuaaauaagaggucuaacacacaguaaaguguucuuaaaagauuuuagggacacugagguguaggguguggcacgggcaaccguugguugcacagauacaguagaugcucuauguuucuauugaguuaagauacaguuagcuguauuuuccuuguaucuuucugcagaucucuuccuucaugccuccucuagaaacacuagcagcgcuggguguuucuaaggucuuggggaccuuaggcaagcugguuaaccucucugugcuuuaguuuucucauguguaaagcacugugugcuggagauuuuuaaaaaguguguugauauaguaagucauuuaaucugugguuauauaccuaguaaaugacaagcaggaauuugaacucaggccaggcucuuaaccagcuugcugcauuacgaaauacuaaacagugugguuuucccuccuggaauucccuuucuuucuaagugcauuaucucuuauacccuuuguuuagucagacuacuuccucuauuucaaagagaaaggaaagaagcucuuuuuuaauuguucagaguuguguauggcaaagagaaugcccaaauagauuuuguuuuggaaucuuauuguuacugguuguuuacugccccacauccuuagcuccaaagagcagagaggauuuacugugaaguuuggcauguauuguaggcuauuaugccauguaauaggcccaaaauuguggcccuaggaauacaaauuauguuaagacauuuaaggcaauuucuagaaaucuuuuucccuugaaaagaguaccaauaauuuuucucgcuaauggccaaaauuacucaaaucuuacuuuuggacuuuuaaaauauauuuuuacugcguuauaguugaaauguagguaugguugaaacguaaaucuagaucuuaaguguacuauucaaucaauuuugcuguugguacuauucaaucaaauaggccaguggguuuucuuuguauuuaaucaauuaguaugggaaaauauuuuuauuuuaaauaaaugucucucuuuauuuuuuguguauuucuaaauucauauguauuuucaacucauuuuuucacucggauacauaguuuaacaacagccuauuggaaguacucuuuuauaugaguuucugcuauacuugaauaguuucccuucagaaaugaacuguuuguguuggagcuacauagagugaauaaauuuccugggcggaaacgauaauaaaauauucaggaaguuauuaggaaaugagaacuuguguucuuguucagucagauaagcuucugagaccuuugcauauaucaaagcagauuguauuagaggaaggaaugagagauuuggcaacuuucuucuaauagugauagggaccuuggucaauagaaugauggaauauaugauguauaaaugaaagaaaaauucucaaagcaaaguuguuugagaauuguuuuuucucucucuuuuuguuugucagggaagaaaagugagagcuuucugaaguuagguuauguaaauaacccaguagggaaaacuguuccugggggagaccuacaaauaauugauggcaauaagcuucaggaguaugaaagaaguggaugaguaugccuuucccccauugauuccacucacauuuuuucuucucugugcuuugcucucuuguugccauuagacaguuucuaucuguccuuaauuuuagccaguuuguucuaaaguaacugugaacacuguaacucucuagccagugccuuucuuuuauugaauggaauugguguacuaguuguuuuauuuaacaaacagaguuuauaggcuuguuuuuuccucaacaugucuucauggcagagacaauuuacccuuaaguuggugagcccuggauccccucacuugcauagaccucuucuaggaucugggagaggcucuagcaguguaguguguuuguuaguuacauauuuuuguaacauuugcaaaauugaaaaauuuuuuuccauuuuuuuuuuucuucaaaaaggcccucaaauuauauaugcuucaaauuucacaaaacucaggucagccuugguucaugguagagguuggguguugauuucuaauuguggccgagguagauuugguuaguggauuaaaggacaugaggaaggaagcauuagugaggaaguugaaccauugacugguguguauaguggccagggaucucuuucugagugucaggggucaucucuucucccugcaaacaugggccagaaagaggcgggagaaguuggguaggacuggaagaaggacaguggagggaaaggugugcugcagccaaggugguaaacaaauuaagguguucuccuuagauuucaaggaugcauuugcaaauagcguuuucaauagcauuuuaaaauaacugaagagucauuucaagauaauauauuucaucuugauaauaauacauuuuaagaauuuuagaauuauugaaaaauuugaaaagucaauuucauaauuaacugauugacuugagauuaaagucuuuaucuuauuaauuagaauauauugcugaacacauaaaacacagacauguucauuuuugaagggcguugcuguaacuuggguuuugcuagcuucuugguuugguagauguuucaucucucuccccuuuuucucauugucucaccuguauuuuuuucuaccuuuucauuucauguucccuuuacuuugggauucaaacuccucuuagacuucucaggauuuugaaugacuggacuauagauaaucacauuuuaaaacugcauuuuaauauucuguucucuuuaaagaaaauuagguacucugcauggccuggggacaaauuuacaguuaaauagaaguauaauguucugagggccaauuguaacuacccugugguuaacuggcucagguucaaauacaguuaaaauuauuuuacuuuuccuaaaauuccuucuaauuggacuaacuuaucaggguugauaaaaacauuuccagaacguaguauggaucugccaccugguggugaaauauuacagcaaguacuaaguguuuuguuuuuuuuuuucugagacaaggacucacugucacccagacuggagugcaguagcaccaucacagcucacuguagccucgaccuccuggacucaagcaaucuucccaccuuagcccccagaguagcugggaccauaggugcaugccaccacaccuggcuaauuuuuaaaguuuuuguagagauagggucucacuauguugcccaggcuggucuugagcuccugucucagccucccaaagugcuggcauuacagguaugagccaccacacccagccaaauacuaguauuuuuuuuuuuuuuuuugagauggagucuugcucugucacccaggcuugagugcaguagcccaauuuuggcucacugcaaccuccgcacucccugcuccgggcccaagugauucuccugccucagccucccgaguagcugggacuacaggcaugcaccacugcauccagcuaauuauuguauuuuuaguagagaugggguuuugccacauuggccggacuggucucgagcuccugaccucaggugaucugcccaacucggccucccagagugcugggauuacaggcaugagccgccacgcccagccuaaauacuugauaagaauuuaauaauggauucuugccuuuguggccauaauauuuagagucgagucuacuuaagcucuuuagauauguaacauuuuccuccccuaaguuuuuuucacugagaaaauguuacuuaaaugcgauagaguagguaaauuuugacugauguguuucugucuaccgcaucguaauauaagaugacauuuguagaauuacugagcugaaauaaauucugcacacauugagaauguacucuccuuaaauuugaagaugagcuuuugagaagagaagauugcuguuaauuuuucuaaaauuucaauguggauagucauugauucacagaaaaaacaguaauaugaaguucacagaacaaagaaaaaacaguaagaugaaguucacagaacaaaggauuuuuuuuuuuggaaagaaagcauuuuguuuauucacuuaaaaauauuagcaggcauauuaaaacuacuuuuagcaaauagacuaacaguuuuaucacccucaaaugaauuauuaauacauaucaguauuuuauauaugggcacuguguuagguauacaugauaaaauagugaaaauaaaaaugucucuuguccuccuggaguuuauaaucuagcuagaaucuguaaucuaacauaauguuaagggccauaaaggagaagugcauaauagggagaguucacccuggcuaguguaucagagaaagcuucccuaaggaagugacguuucagcugagaucugacagauacagacccuggcuaaaaugugugucuguaucccuuuaaagugggaaggagaguggcaaguaugaggaauugaaaauaacagagugccuggaauguagugagagaagggacuguggugugaaugaaaacaggaaagacgguaggagcaaauaauucagggccuuguuggauguguaucaaggacuuuggacuucaucaugagaguaauggaaagcuguugaauuguguaguuaagcagugucagaucagauuaaugagaaaugaauuggagcagggcaaaacugaaaagaggucaggcaguugguuagaaagcaauugugguaguuguggcuuggacuagagaguguaaaugggcgugaugagaggcugccauauuucaaauauauuugagguagaauagacaagacuuggugauugaaugggauggaagggggagagguagagggagaugccaaggaugggcccaaauuucuggcauucauacauucaauaaauauauaaauauaaaacauauauauauauaaaacacaguuugguccuuaaagauagaaagucgaguagccccagcguucaguucacaauacauuaucauuggacagugcaagauaucucuuauuuuguauuuuuuacucugccuucaucugccacacucagucccauuucccuugucuccuuaggcuucuacucuaauauguuuuauauauguuuuugaauaugcauuaaauacauaaaauaugaaauguuguuuuguguguuuuuaacuugugauacugugcuguacauguuauuuucuucguuauucugccuuauguuccuuauuacuagcuguauggccauagguaaguuauauaaugauuuuucuguuuccucaucuguaaagugaggauaacaauaguauuaacaguacuuagauuauagauaaacuuuuuuaauccucccaacaaguauucaggugucugccucaagggauccuccugccuuagcuucccaaaacacugggauuacaggcaugaggcacuaugccuggccuguuuuucauuuauuuuuuauuuuauuuauuuucauugacaaauaaaaauugaauauauuuauuguggacaacauaauaauguuuuaaaauauauagggauuguggaauggcuaaauugagcuaauuaacauauguauuaccucauauacuuaacguuuuucuguagugagaaugguuaaaaucuacccuagaacuuaaaguauaauuaaaaaaaaaaucucccagcgauuuucaagaauauaauacauuguuauaauauuaacuacacuaaccuuauuguacaauagaccucuugaacuuauuccuccuaucuaacugaaauuuuuuauccuuuugcuaacaucacccaaauccccacccuucaaccucugguaaccaccauucugcugucugcauuuaugaauucuacauuuuuagauuacacauuuaagugacaucaugcaguauuuguuuuucuauaccuggcuuauuguacuuaaaauguccuccagguucaucuuuauugucacaaaugggaagauuuccuccuuuuuaaaggcugaauaguauuccauuguguauauauaccauuuuuuccuuuauccauucaucuguugauggacacuggguaaauuccacgucuuggcuauugugaauaaugcuguagugaguauggaggugaagauaucucuuugauauacuuauuucauuuccuuuggauauauacccaguggugggauugcuggaucauagggaaguuuuauuuuucauuuuuugaggaacuuucauauuguuuuccacaauggcuauacuguccauuuauguuucaauuuuaccuuuuucuuuuuguguguguguguguguuuaauguguguguguuuaauguguguguguguucaguggccccaggucuucuacaguuucuucuuuaauaguuuuagguuucaucuuuagguaauaaauauuuauucaacaacugccuuguucuaggcauuggauguaaaaccgugaaccagguauacaggggccuuagcugaccccauggagaaacaaagcaacuggauggauagugguagugauuuaggaaauauggaugaugaggaaguuuggggcagaaguggggguuggauagaguaaagaucauuaguucaguuaaaaaaguuuuuuuuuaaacuacagagggcccuuaugccagcuuuuuguagucaagcccucccuccacuccuaacucuuggcauucacugaucuauucaccaucccuuucccuuuuccgggcauaaaauauguaaucuuuuggggcuggcuucuuucaccaagcauaaugccuuuaucacacaacaacauagaugaaucucaauguuguaugaaaguuuguuccuuuucaucacugaguaguauuccauuguaugaauguaccauagcuuauccauucaccuggugaaugacaacuggguugccagcaguucguagggauuaugaauaaggcagcuauaaacauuuggguuuauaacguuagguuuuugcgucaacauguuuucauuucucuagggcauauaucucagaguaagauugcugggucauaugguaaguguuuaacuuuaugagauacugcucagcuguuccucagaauggcuguaacuuuaaaauucccaccaacaguguaugggaguuauaguugauuggcauccucaccaguguuagguauucucaguuuuguuuuguuuuagccauucuauuagguauuuuagugaugucucauaguuuuaaauugcauuucccuaaugacugaugauguugagcaucuuuuucugugcaacuugcccuuuuuggugaaguguguaugcaaaucuuuugcccauuaagaaaauugggguuguuuucuuguuguugaguuuugaauucuuuauauauuuuuuauacaauuuauuuuguuaauaauuugcaaauauuuucucccagucugucuuuuuauacuuucaaugucuuucacagcaaaaguuugaaauuuagugagguucgacuugccaguuuuuuucuuuuaugaauuauguuuuuaguguuaugucuaagaacucugugucuaagccagguuuacaaagacuuuucuccuuuauuucuucuaggaauuuuauaguuuuacauuugacauuuagauuuaugauccauauugaguuaauuuuuacauaaagucaagauuuucuuuugcauauggauauccaguuguuccaaccuuguuuguugaaaagacuauccuuuuuccagugaauugcauuaggacuuaugucagaaaucaguugaccauaguugugugggucuacuucuguguucucuguuugguuccauugaucuauauaucuguccuuuugccuaucccacauugucuugauugcuguagcuuuauaguaaguuuucaaguuggguaguuugaauccuucaauuuuguuuuucuuuucugaaauuguuuagcuauucuacuuucuuucuuuuucccuguaaguuugucaguuuaucuuuaugaaaauuuugguugagauuaugacuggaauuguauuaaguucauagacuaauuuaggaagaaugggcaucuuagcuaucaugagucuuucaauccaugaauauaguaugucuuuuuuuuuuuuuuuuugagauggagucucacucugucacccaggcuggagugcagcaguggcacaaucucugcucacugcaaccucugcauccugaguucuaacugccuguuucuagauuucuuuuuuuuuuuuuuuuugaguuggagucucuguugccuaggcuggagugcaguggcgcgaucuugauucacacgauucuccugccucagccuccugaguagcuaggauuacaggcacaugccacccaugccuggcuaauuuuuguauuuuuaguagagaugggguuucaccauguuggccaggcuggucucgaacuccugaucucaugugauucaccugccucgaccucccaaaaugcugggauuacaugcgugagccaccgcgccuagccagaaacaauuuuauuuguuccuuuucauuuguaugucuucuguuaauuuucuuugccuuauuacacuggauaggauuuucaguacagcaaaaaauggugaauguggacaucuuugccuuguuucugauuuuagggagaaagcacucugucuuuuaccauuaaguaugauguuagcuuuaguuuuuuuguagauucucuuuuuugaguuaaacucccauucuguuccuaguuucugagaguuuuuuaaaaucaugaaugguaguugaauuuugucaaauacauuucugcaucuguugauaagaucaugugguuuuccuuuauagucugucauuaugguggcuuacagugagugguuucugaauguugagcaaucuuauauuaggauaaaccucaacuugguaguggcuuaauauuccuuuuauuuauuauauguaacuggauuugauuugcuaaugcugcauugaagaucaugccaucuuuguucaugaggaauauugguuuguaguuuucuuguacugucuuugucugguuuuagugucagaguaaugcuagcugcauaaaaugaguugggacauguuccuuccuuuuuuauuuucuggaaaagaucauguggaauguuauuucuucuuuaacuguuuaguagaauuuaauacugagaugaaaugggucuucuacaagauaaauuuacuuucauaaucagaauaauguaauuguagaaacuuaaacuauagaaaugaaugaugagaauaucaugucucacaauucagaugauuauuaauauuuuggaauucuuuuucuaguuuuuuccucuguauacauaauuguauauuuuugaauugcauauaaauguggguauauauuuaaaacaaaauuugugauuauacuacaaauaccauuuuauuucuggacccagugugguuucuaauuuuguuguauggauaugccauaauuuuacauaaacauucuucuaauguugaacauuuaagugugauaaaugucuuuuauguguuuuuuuccugauaauuuauuugacuuauuucuagaaaagaauuugacauauguaaggcugcucacacacauugcuaaauugcuuucuagaaaguauauauacguuuuuacucuaaaauagguaccuuaaaaaguauguuuauaucuucagauauguaaagacauauaaaauauauaguaauauauaucugacuaugcauauucauauuuuuuuuuaaaggaaggaguggaagugaagagaauauauaucaagggguuagcaagauuaagggaaagacuaaagaaauuuuucuaugagacaucuuuguagaucagggcaaagauucaguggaaaggaagauauugaaccaggagcaaaaaugcagagaguuguuugaaaugaugaaauauggucuggaugaaaauguagggaaaaaugauaucaaggagagaaaugcaggaaacaaaggaacugugcuucuuuuagguugagaccugaaauagcugauauuugaccaguuuuuaccuaaaaacauguaguuucaaacacuuuuaccugauacuugugauggaaaguaaagaggaaagaugcaaaauaaauuuugaagugcaaagaagagaaauucaauuuauagaaaagggauugcauuuucccaaauaggaggcaaggcuaucuuaauagaaugggucaggguaaaaagagugaaaaaguuuuguauaaauaguguggggaauguacaguuauagucacagacaaagaugaguuaaggggcaguagucucaacacaaaaugaaggcuaggauuaaaggagagggaaaggacugaagaggauggggacauucaaaagagagcauuuuaguuaauuuugguaaauuaauugggcgugaaauagagaagaugaaguaagagagaguaaagucuugaggcuagaaaaacuccuaagaagaaggaagaugcuuccuaagaagauucagaaagaguaaggaaggaaaaguguuagauuuuaauuuguugagcuugaguugacuugaaggaagagauucagauuugugcaucauuaugguugauaguugcaguucugagaaugaaaaagcucuuugaggaaacaaauacagacaaaaggucauuuuauuuuuauugguuaguaauucaacaaugucagauauuuucaaaccacuuaucuuucugucuccugauuauaaugaugagugaacacuagauuuuuauguuugauuaaaagcaauuuauuuuugucucccuacccccuuuucagaagugggaaauuucacuucuuuuuaagaccggacauaaguauguguaguaaagaauaagaauaggaggauagauuagaauuaauuaguucagugauuuguauguaccugauaaaguauucuaauaauuguuuuugguaucuuagagaaaaaauaucuccuaggcaauauuuuuuuuucugcauauaaaugaaaauguuuugacauaugauauaggacuagugaaccaauaacuucuccugggcaucuaccucaccauguagaaaauggaaugaagacuuuggcaagcagucaaauaaaaauaugcaaugcauggaaaauaacaaaugcguuaaaaagauaauauugcccauauugagggaaguacaaguuaaaacaacuuacaccauuuuuuuuuuuuuugcuccuuaacuuggucaacauuuaaaggcuucccaguguugacaaagaaaagggaaaaugucuuucucauauacuauugaagggaauauagauugauacagccuuuuuuguagguggugauauuuaucaaaauuuaaaauauacauuauuuuuuacuuaguaauucugcuucuagaaaucuauccuacagauaccucucaagugugcaaaaaguuaugggcacagagauguuccuugaagcauuguuuauaauagcaacaaauuggaaaugacuuaaacacugaccguuggguauagcccuccuacauaggaugaccauaugucuaaauuugcuugggacggacccaguuuacaccagcauaauuauuuagagcauuuuauuuuacucucagauguguccugguuuggaagauaauuuaccuguuugguuuauguucacacuaauagcauggagaacuauguagcuguucaaaauaaugagauagaacuauaggaauugauauagaaauauauucaagauacauuguuaugugagagaaacaaguugcauaacaauauauauuauuccauuuauuuuauuuuauuuuuauuuauuuaagagggagucuugcucugucgcucagguuggagugcaguagcgcaaucuuggcucacuguggccuccgucuccuggguucaugggauucuccugccucagccuccugaguagcugguacuacaggcgcaugcugccaagccuauuacuccaugcauuuaaaaaaguaaaaucucuaagcucucugcaugugagugagagagaaugagagacaggaguuaaaaaugucuggaaggauucauacuaauuuguuaauaugauaaucucugcuuaaagauggcagcccaaugaauaggcauauauugaauuuuuuaaaauauaaaagcagcaauaacaaaaaggugggaacuguugauugccagcagaugcuauaauuuuuaaccagagagcauuaauaaacaacuauuacaauucuuaacauaaaauuauaaguauuauacucuguccuguauaaauaacuauuguauuagaaagaauacuaauggaaaauuuaaaaauuaucacuaucauuccacuauuaccaaucauuuuacauguuaccuccuguuccucguaucuuuauguacauaauucuuacaucguuauaaucagagcauauaguuucauauuauuuuaaauuacacccuauagcauauuuuuuguuacaauauaguaucuagcauuuuuagauguuuuauaugugcuaaguacuguguuaaaugguuugcauguguaauagacuuaauccucccaauugcguuauugaggcaguuacuauuaucccaaucuuauagaugaguaaacugagaauaaguaauuugcccaaggccacacagauacagcaaauggcagaacugggauuugaacucaggcagccugacucuugaacccacgcucuuauccacuacuauuacuaccucccuuuacaauuuuuuagugacuguguaauaacagcauaccauaauuuacuuagccguuuuccugguuguauauuuaauuuguaggcuuuaaaaucugaaccucaaaaguuuuuauuaaacaagcugaugccuacuaugugcaggaaccuauuugagguacuauggacauugguacacauaugcaguuauggucuaguauuguuuuaucuugccuuauguauuacauuccugaaaagcuauauacguuugaggugaaaauuuguuuauacaaacuuuuuuuuuccaaucggguuucauuauuuuaaagauacauuauuccagaaaaacaaauacuuaaaaacuagaaaauauuuaauaaaaauuagcagugagcucagcacuguuuggugccuuuaaggguucugcuuuugcgcauagugaacuguauucguuuuguuguuguuauuguuuguuuguuuguuuguuuuucugagacagggucucacucugugucccaggguggagugugguggcaugaucacuacuugcugcaaccuugaccucccugggcucaggugaucuucccaccacagccuccuguggagcuggaacugcaggcauacaccaccacaccuggcuaauuuuacacuuuuuuuuuuuuuuuuuugcagagacuaaauggauucuguaggauauugugggaaagacugggaaucuuucccaguagaggucucgcuauguugcccaggcuggucucaaauuccuggacucaagugauccucccaccucagccucccaaagugcugggguuaaggcauaagccaccgugccuggccugugagcuguauucuuucaugugacaguugcaagaaaaauuacuuaaauaaaugcaugccaggauuugugauuaccgaauaaaaguacauaaaauugaacucucuauucagauggagaaauuacauggguaaucuccaaaucuuuuguuuaccuuuagaauauuuauuuaugcuuauauugaaauaaggugaaauuacaacuucaggguucauacagagaagucacauuuguaacucagguggauuuauuagauagcguuuuaacuacuucuguucccuggauuagucaccuagucaccacucuugucuuugugagauagagauaucaauuuaauagaggaaccuaaguacuacacaagugucagcugcuguaguugauuaagggggauaauuaagagcuuuauuuuaaagcucaccugcugaauaucuagauaccuguuauauaagagcaaaacacaugguuaucuaacaaauaacuuauaauccacuuuacuuaauuauggcauuaguuuuugauuugcugauccuucuauuaaaauuuuauauuaaauacagcauuuaguugaugaguuucauugaaaauguucauuuuuaaauugauauugaauguaguugguguuugguuacucaguguaucuucuguaccuggucuuuuucaguguucuuauauuuauauuucaagucagucauaaagauuuucacacauaaauaagauuacuauuuugaaauugaaaugauaaaauaccauaaagugcccagcuuuagaauuuuaaauuauuuuaugucauaauuauugcuuuuuaauaagcuuuauuuuuuagaucaguuuuagauuuacagaaaauuacaguuagugcagaguucccauauacuccacacccaguaucucccauuguuaacaucuuauauuaaaaugauacauuuguuacaauuaguaaaccuauauugauauauuaacugaagucuauacuuuauucagauuuucucaguuuuuaguuuuuaaccuaauguccuuuuuuucuguuccagaaucccauccagcauaccauauuacauuuaauuguuaugucuucuugggcucucuuggcugugauaguuucucagacuuuccuuauuuuugaugaccuugauaguuuuaaggaguacuggucagguauuuuauagaauguuucucuguuaggauuugucugauguuuuucucaggauuagacuggggcuuaugguuuuggaaggaugaccacagagguaaagugccaucacaccauuucaaggcauugauacauaauaucaacaugauguaucacuauuaacauugaccuugaucaccuggcugagauuguguuugucaaguucucccugguaaagucaccuaccuuuuuccauacuguacucuuuugagaagaaagucaccaugggcagccugcacuucaggaguggggaauuauguucucccucguagagggugguguuucuaugugaauuauuuggaauucuucugcaugggguauuugucuuuuuucuccauuuaaaaaucuuucaacuguauauuaugaacucauggguauuuauuuuguacuuuggauuauaauccaguaauccuuuauuuuguugcuuaaauuguuucagcuuugaccaugggaaguuccuuuuuuuuuuuuucuuuuuggauacaaggucgugcucugucacccaggcuggagugcagugacaugcuuacagcucacugcaaccucugccucccaggcucaggugauccucccaccucaaccucccaaguagcugggaccacaggcgugcacuaccaaccacgccuggcuaauuuuuuguauuuuuuguagagacaggguuucgccaugcuucccuggcuggucucgaacuccuaagcucaagcaauccaccugccuuggccucccagagugcugggauuauaggcacgagccacugugccuggccggaagcuccuuaauuuggccccggugucucauugacauaccuccaucauugugcuuuuuguuuuguuuuguuuuuagcacuuccuuaccuuugggcacuacaacaugcuccagacucaucauuuguauuucuugccuaauuuuagaauuaaccauuccuucaaggagcccugguuccuucuauaacuauuuuuuuuaauugcgauauaacucacauacuauauaauccaccuauuuaaaaugugcaacucaguagcuuuugauauauucacagaugugcagccauugccgcaaucaauuuuagaacauuuucaucaccccaaaagaaaucuuauaccccauaagcagucuacuguccauuucucauguuccccgguccuagauaacacucuuuugauuuaccuauucgggauauuucauguaaaugaagucauauaauaugugaucuuuugugccuggcagcuuuuacuuagcaugauguuuucaagguucguccauguuguagcuuguauuaguauuucauuccuuuuuauggccaaauaauaacuucauugucuggauauaauacauguuauauaaucauuaguugaaggacauugguuuauuugcguguuuauaccuuuuggcuauuaugaauaaugcugcaauguauauucuauacaauagccuuucuaaagauuuuguuguuguuugaauuggaauuaguaucuacacaauugauugguauacguuuuaaguuucuuuuaagugauaauuauccccucuucaccucccuguuuucuucuuugucauuuguccagaagaauuuccacaugguugggauauugcugguugcuuccccaugguguuucuuaccaucuuccucugucuuuuuuauuuuuauuuuuguuucuuaauuguuaguuggaucuagagauuugaucauuucaggguuuuguuggacugccacauaggugaugguaauuuauucuuucaucaagagguguguaaugucuguuugggucuguuucucuguugcuauuagcuaccaggguuuagaaaaccauagcuaggcugggcacgguggcucacaccuauaagcccagcacuuugggaggcugaggcgggcggaucacgaggucaagagauugagaccauccuggccaacauggugaaaccccgucucuacugaaaauacagaaauuagccgggcaugguggugugcaccugaaguuucagcuacucaggaggcuaaggcaggagaauugcuugaacccaggaggcagagguuguagugagcugagauugugccacugcacuccagccuggcgacagagugagacucugucuuaaaaaaaaaaaaaaaacuuaacagcuaauggucaguugucucuggcuuguuuuuuaaauaaccuauaagcuaauguugauuuuuacauuuugaaaguguuuuuaaaaaagaauuaaaaaaauaagcaaaggagaauuugcgacagcaacuguguguagccugaaaagccuaacauauuuucugucuggcccucuacagaaaauauuugcugacuucuguaccguuuacuuuuuauugccuagagcuguugauucauuaggaguugcaaaauagugauaaucuaucauuuuuucauuuauuugguagaguacuucuauaaacagaaacuuucaccaacaauuuuauugccaccaggaacaguuugauggggaaagauguuuaauuuuuuuccucuuccuuuugaaaaguuuucaagaugauuugguucuauagcauucacgaaagaugaccaauuagucuuuauuuguuuuuuuuuuuuugagauuaaaguaauggaauucaacagauuugaccauuucaguuguuuuauuaucauuauugaagccuaaaugucccaugggucuucagaaaguucauggaaaaugcauauaugaaaaaacuaugcauggauuucaaaauuucuuuacaucaaaauaaacuuguguuaacuuguuauaagaugccugaauaggaucuaguuugaggugcuaccagggauaaaacaucauuuugagaaaagccccuaucagagcaguaugaauucugcuaaaauugaagcaagaacaaacgucaaauuuauggugaagcuuggguggaagagugcuaaaauauugaugcuuacgaaaaguuuauggggacagugcccccaaagaauucagcagguuacaaauagauaacucauuuuaagaagggacaaaacagcguugaagaugaaacccacagcagcagaucaucuacauccauuugcaaggaaaaaauucaucuuguucauguccuaauuaacagcacaaacaauagcaaacacaauagauaucucgguugguucggcuuacacaauuaugacugaagaaguugagcaaacuuuucacucgauagauaucaaaaccauugugcccagaucagcugcagacaaaagcagaacuuugcauggaaauuuuagacaagugggcucaagauccugaagcauucgaagaauugcaacaggagaugaaacguggcuuuaccaguacaauguugaagacaaagcacaaucaaagcauuggcuaccaagagguggaaguggugcagucaaagcaaaugcagaccagucaagagcaaagaucauggcaacgguuuuuugggauggccaaggcauauugcuuauugacuuuuuggagggccaaagaaugguaacaucuguuuauaugagaauguuuugagaaagccaaaauuuuagcagaaaauugcacaggaaagcuucagcacagaguccuucucccccagggcaauacuccuggucauucuuuucaucaagcaagggugacuuugugagaguuuugaugggaaaucauuaggcauccaccuuaaaguccugauuuggcuucuucugacuucuuuuuguuuccuaaucuuaaaaaaucuucaaagagcacucauuuuucuuuacuuaauaauguaaggcugggugcagugguuacaccuguaauuccagcacuuugggaggcugagguuggaugauugcuugagcacaggaguucaugacuaaccugggcaacauggugagacccugucucuuaaaaaaaaagaaaaauuagcugggugugguagcaugugccuguggucccagcuacucaggagauugaggcggaaggaucaauugagcccaggaggucaaggcugcagugaguugugaucaugccacuugcacucuagccugggcuacagagcgagacccugucucaaaaaaacaauuaauaauaauguaaaaaagacugcacugagauggcuaaauucuuaggacugaguucuuuagggauggacuaacugguugguaucauugcuuacaaaaauguuuugaccuuguuggggagcuuguguugagaaauaaagacgauauuuuaaauuuuuaucuuuuaauuucauuuuuccacgaacguuuugaaguccucucauauuuggccagucagagccucuuuuuuuuuuuuuuuuuuuugagaccgagucuuacucccaucacccaggcuggagugcaguggugcagucuuggcucacugcaaccucugccucccagguucaagcgauucugcuggcucagccucccagguagcugggauuacaggugugcgccaccaugccuggcuaauuuuuguauuuuuaguagagacaggguuuugccauguuggccaggcugguccggaacuccugacuucaggugaucuguccaccucagccucccaaagugcugggauuacaggcgcgagccacuaugcccagcccagagccucuuuugaguguuugagaugaccuuaguggccauugauaguuuuauuuucuauuaugaugagauguuucauauucaucucauuuucuaaucccagaccuggaacuagccuuuuuuuuuuuuuuuuuuuuuuguaaguucuuuucaguggaaaaugaugcguagagaccaaaaccugaguauggaaagugcucauugccacuggguuggucaucauuacuaggccuuuuaagugaagugagcuaggaaauaccuauuuuuuaaaguaguaaaaugaauuuauauuaguacuuaaaauugaaggcuaaaagauuauacuuuaauguuacugauuuuuacaucuauaguguuuuucuucuacaccaagaauaucauguucuccaaaucaguaaaguuacucauuugcuuuaucccacaacacacacacacacacacacccucagaauaacaauacuaaugcuaacugcaauaaaauggucauuaaaacagcuuaaauuuuuuugcaguucuuuugguccuuagaguauauccuacuauguauaguuugguuacuggguucuuaaauucucucgaacuaguucucugugugauuuuaaugacagcuggucaauuagguuugucuaauuuauacuuucaauuuuuagagauuuuuuaaaaucuaauuuuguuuuuuaauuauguaaaauguuuacauagccucaaagucaaaucuaugaacaaguucugugaagagacuuagccucaaucccugucucuuucaccauauuuccucucccuguguguauuaaaaguuauauauauguguguguguuaauauccuacauuucuuagguaaauacacucauuuuucuccaaacuuacuuguuuucacuuaauuuguuauagaaaucacuccaugguagaaaauaaacuuauuuuacagucuugcguacaacugcauaguaccuccuugugucagugugucauaguuuauucaacaugucucuuauugagggacaucaaaguuguuuccagguuguuacuacaaguagugguacagugaauagccuugcuuguaccugccuguuuuuauauuuuggccaguguaucuuagggagagauucauagacaugggauugcuagguaaaaggguaaaugcauauauaauugcgcuagauuuugcagauuuuccucuauagugaaugcacuauuuugcauuuccaucagccuauuuuccuauauuugccuacagaguaugucaucaaacauuuggauuuuugccaauaugauaggugagcaauuguaucucacuguaguuuuaauuugcauuucuuuuauuaugaaguugagcaucuuuuuaaaugauuaagggccauuugcauuccaguucaguaauuaauucuacaucuguaugaaaaugauaugcagcaguguggauagucuuauuuuacuccuggagaugcauuuacaacugcuuuugguuuauauauauaugacuucauuguggguauuuugagguugguguccuauucuucugaugcuguuaacuucuuucuuagauuuuagagguuuccccucuuuucuucaauauuauuuuguaucacaaguguguuaucaaacuuuuaagagcucaacgaaugaaugaaauuugucuaugacaggacgacagcuuaccaaugcaggacugaguuaagaagcuuuugaauuuaguuuaucuuuaucaguaaaugcacaguugaauagaagaauucuagaaccugguuuacagaccuugugagacuaugacaggauuuuucuaacacaucuguuuauuuugcauugaaagcuuguguaugcauagaauucuuugcagaaacuagcuuugauaauauaagauucauuauuaaggauuuuuaaucuuguguucuuuuccuuugcuuauguuuaaauuguuagauuguccuaugggauuucauaaauauuacuucuguuaguaaagcugcugacagcagaagcuuucaauaaauuauucaugugcuauuuguuuucuguguucaugaauuaauucaacuuagaauuuuuuuaacugaacuugguaacaauuuguagacauauggguacuugaauaaaaucuguaauacuuguuuuccauaugaggaaaguacucuuagcaauauuuagagcaacaucagcucucuagaacauagcugauuacuaaggaguaauggcaaaaucgcuuuaaaaaugugaaauaauuacucuuauaaaacugcugcuuuuucaagaugugagccacggaauuauaucauuuucuacuuuucuuguucacuaucauuuguauacuuacuguucacuuucauuuauugaaaacuucagauguuauuuuacgucuuccucuccauuccaaaucuaccauuguucucgauaauuuuuaucuacuugacuugcauucucaauagcauuuucaguucuuuaaccucgucaucuccagucacuucucuuccaugccauuucaaacaccagcgucuauaaaugugcccuaucgcuuugucaucacucaggagcgcuaaaauauuaaaauaauaccccagucucacauagucuccagucguuccagguuccucacauuauagccgugcuauuuuuauccaucucaguucaguccuauuuauuuccuucccugccuuagauuccauguacaaccauuuugauaucuuuuuuuuuuuuuugagauggaaucucacucuguugcccaggcuggagugcaaugguauaaucucuacucacugcacccugugccucccagguucaagcgauucuccugccucagccucucaaguagcugggauuacaggugugugccaccaugcccagcugauuuuuguauuuuuuguagagaugggguuucggcauguuggccaggcuggucuugaacuccugaccucagaugauccacccaccucagccuccuaaagugcugggauugcaagugugagccacugcacccagccacuuugaugucuugaacccucuucauugucacuuucaacucaucugccuagaaaaguuuaauuucaaaugucuacuuuccuuccuuuucuacuuuauaaaaucacauucuccuauuugaacuucuuuaaauacaguuaccaacgucagcugggcucucaguguagcccaguaauucuguuuugccucuuuagugcucucuuccauucuugccacagcuauuucagauguuuuccacuaccugcaaauucugguccuucccaacaccaccacccuucucucaucaucagcagaugaacucaucucauauuuuagaggcuauucaagccguuaaugauuccuguaacuaacuaccaccagaccuacucauauguucauucuucuuucuuguuacaagaggggcagcauuccuucaauccaaaauuaauccuucuacacaucuuuucucauguaagcauuuuaaugcuuuaacuuucccuuuaagcguuacuuuaguugcauuguccacauuagacaugcuguauuuucauuuucauuaaauucaaaauauuuuguaauuucucaugugauuucuucuuugaucuguggguuaguuuauaaguguguugcuuaauuucuaaauaucuuaggauuuuccagguuucuguuauugauuuguaguuuaauuccauugugguuagaaaacaaacuuuguacaauuucaauccccuuaugugcacauuaauagucaaggggauucuucugccaaauucuggaguaugcacgcucucacgcgcacgcgugcgcacacacgcucucuuucccacucucucucugcagcucuuuucuguuuguacucugaucugcaaauugcagccaccuuggccuccccaauccuaaucucugccucuucaacuccgugagacugcaaagcucucuuugguuucccccaccaugugcugaggccuggaaauggucuacaggcuguaaaaugguaucauuuuagggcuuacuuuguuuaccucucucucaagggucauaguccugugcugucuauuguccagugucugaaaagcauugucucaucgauuuuguccaguuuuuaguuguccaaggcaaggagggugagucccauccuugauacucuauuguggccagaagccugcaucaucuuaccguguaauugccuguaucuauuucagucuuucuacugguucuuuccaucagcuuuucaacaugcucaagucucuccucuauugcaaagaauauagaagaaaaccaagcucaugucgucuuuauuuaccaaccuaucucuccucuaccuuuuacagccaaacuuuuugaaaguuaucucuauccuugcuacucaaaaauauuguuuguggacugauagcaucuuugucaucuaauaacucauuagaaauguaacaucucaggccccauccuagaacuacugaaucagaaucugaauuuuaguccaggugcggugauucaugccuguaaucucagcacuuuagaggccgaggcgggcggaucaugaggucgggaguucaagaccagccuggccaauauggugaaaccccaucucuacuaaaaauacaaaaauuagcugggcgugguggcacaugccuguagucacagcuauucgggaggcugaggcagaagaaucgcuugaacccgggaggcagagguugcagugagccgagaucacgccacugcacuccugccugggcuauagagcaagauuccgucucaaaaaaaaaaauuuaauaagguuuaacaagguaauuagaauauacacuauaauuugagaacacugucuacauuuuccuucuucacuuuccaucuuguuccuuaguguguuguagucugucaucuguuuauaggacuacauuagagcuguucuugccuggaucaucagugacuuucucaauguauaucuaaugaaugggggucucucuaucuaaugaauggcuguguuuuacucucagcaguucaucuuccuuucugauauauuccuuuggcuuuugggaugcccuguucucuuguccucugaccucuguggccuuuucaggcuuuucuuucucugccugucucuuaaauguugguguucuacagaauuugguccccagcuuucuucagauuuuacauuucucugccugucucaucuuuuccuguaacuccaguuucaacauguauucuucauucugaaucucuccugaguuccaggauuauauguccuccacauaagcaccuuaaacucuccauguuacuguggacacaugaucuccuucaucauguccuccuccucagugacuggcaccauuuagccaucguccaagcuagaaacuugucauucaucuucaacuacuccaucacccuuuccccuccuuuacucaccuuacuuucgcauuuauucagucuuaagacguauugauuccacucuaaaaauucaucaugucugccauuuuuuuuucugucacuauugcugcuuuccuaaacaggacuucaguagguuucaacugagauuaccacaguggcuucccaacugguuucccuaucuccaaucuuguucccuuuaaacuaaucuccauuuggcaguaagaaugauccuuuuaauauuaaguaaaugugaucuuuacuuaccaucuuaaagcccuucaagacccuuaccaacucuucuuaacuuccaaacuuauuagcuuaauguaugaaaucgucacuaucuggucacugccuucccaguugugaauuucuuugaguacuuugccacuuccacugccagcuuguuuccaggccuuuguaccuacuguuccuuugacagagugucuucugcucuucacuggcuggcuccugagguuucaugucauuuugcaggaauguccuccuugacugucuaggccgguuagauucucuucauguacguauguacuuuguacauauccugucauggcuccuaucacacuguucugugguuguguuuguggcugugaucauaucauuguauauguccuccacuauaagcacucuuaagggcagauaguaagugucuuguucccuuaaccuaggugcuuagcauguggcacccacucuacaccaggcaggguuccugcucucauugagcuaauaguguauuguggggauggagguggguuagggugcaagaaacaaaagcaacaaaagaaaaauaauuuuauucuuauacaugauagauccuuaguaauauuuuugaaagaauguguaaauuauuauuauuguuuugagauggggucucacucuguaguccaggcuggaacgcaguggcaugaucauggcucacuauguccuuuaucuccugggcucaagcaguccucucaccacagccucccaaguagcugggacuacaggcacaugccacugugccagguuaauuuuuuuaaauguauuuuuuguagagauggaggucucacuguuuugcucaggcuggucucaaacuccuaggcucaagcgaucaucuugccuuggcuucccaaagugcugggauuacaggugugagccacugcgacuggccaaauuauuauuuuaaagagcccuucaagugcagaaaucuugaauguuacugacauuacugacuuaaguucuugaaaguucagcuuucuaaacugaaagcuaaguucagcuaucuaaaaauguaauauaccuuucuggaccuaguguucugugguaauuagguuauuguucaaacccuucaaaucuaauucuuaguuuuuuuguuuucuuauguaguuucccugaacagaacugugguaaucaaggacuaguggagguguacuuuagaaauagcagugagaauuaaugguuagcuuugaaaauagaaaaguaaaauaauagguguucuaugguauaauuguuuuuuauuaagaaaggauauguuuuauucauuguauuuuauaaaguucaagccauugaugcuaaaauuagaaaaaguuugucaucaaauagcuaaaauauugauuugauagccaacagaugaaguuacuugaaauaagcuauauuagucuauucucacacugcuauaaggaacuaccugagacuggguaauuuaugaagaaaagagguguaauugauucacaguccugcaggcugugcaggaagcauggcuggggaggccucacaaaacuuacaguaauggugguggaaggugaagguggagcagggcacaucuucacauggagaaguaggagagagaguggaggggaaggugccacacacuuuuaaacaaccaggucucauguaucaccagaacagcaaggggaaaugcgccccaugauccaaucaccugccaccaggccucaccuccaacacuggagauuauaauucaacaugagauuugggcagggacacagacccaaacuguaucauaggcagaauauuuagagcaccucuugaaaaauguggucacuuuauuaauuuugaacucuauaugaaaauauuuuauuaaauuucuugaaaaaucuuaucuacucaguaucagugaaguguuuucauuauaagcaucagaaacauuaacuaacuuaaguacaaagggcauuuguuaggaugauaugggguugcuuaaaggauaaacagaaaagauaaagaaccaaacaaauguccacuguuucaguugggccagaggaauuacuuuucugcgaaugauuacuuuucugggcagggcauuggauuucuugagucuauacgccuaagagugccugcugcguguuguguaguuucugguuuauuguaauugcuuagacaacaacccaaugcaguguuuucucuugaugucuuaauauuguaaaaguaucuaggaauaaggacauuuuccuaaauaacaguaucauuaaucacaucuaagaaaauuaaaauuaacucaguaaugcugucuaauauacucagcauuuaaagucaucuggauauucuccaaauguuuuuuguugcccaggauccaguaagguuucacucauugcauuugcuuguuucucauuagucucauuaguucauguaggacagucuucuuauugccuuuguuuuuuaugacauucacuuuauuuuacuugaagaguccaggguaguugucuuguagaaugucucacauuuuggauuuguguaauuauuuuuucaugcuuagauuuagguuagacacuuugggcaagaauacuacaugcugcuuauugcaucucaucaggauguuuaugaagccagguugucccacuacuguuaauaaugaauuugaucauuuaguuaagaugguaucugccaaaucuguccauugugaagguacauuucccccuuuguaauuaaugauuuguggaugacacucaaauugugugacuucuuuuuuccagugguuuuagcauucaucaguaaugaaucaguuauuacugaacuuuuaaugaaaaguuucuaaaaaguuuccuuucuaaauagacauuucugauuaggcacuaaagagaagguacugguagucacuuaaaaauccuuccauuuuuacuguuuagaugucagaccaguuguauuagacagcugggaaagagcuuugcuuugauuccucacaauuauugucaugauucguauuaaucuuuuaccuuuuccagaaauaauacaauuuuuuuauuagagaacuugauuauuuuaaaacacauuaaugaaggguaacauaggccagugcagugcuguacaauggaaauauaguacaagccaaauacauaauuugaaaucuucuagauagcacauuagaaaaguaaaaaacagguugaacuaauuuuaauaauauauuuuauuuacaugaauauauccaaaauauuuuaacacguaauuaguauaaaaauuguugaugaauauucuacauucugugugugugcaauaagucuucuaaaucugguguguauuuuauauuacuuaaaaucuuaauuuagaugagcuacauuaaguuaccaauaacuacaugucacacaucacugucccuauuggauagugcagauauggugguuacaaucuugggcacaaaggaaccagacuaacuugauucagaucuugccuucuucaccagcuggcaucaugacuuugggcaaauucuucauucucuuugugguguaguuuucccauuguaaaauggggauaauaauaguucuuacuacuagggauggggaauugaaauaauuaauguaggaaaagcacugaauccaucucuggcacauaguaaaugcuuaguaaauguuaacucuuaucauuaugccuuuagacuucguccaauaauucccauucugucuuagaaguguccuuguauuuuguaagggaaguuaggacuagauauuggaucccuugacuucuguuuuauaucuugcugguuuuacccucagucccuugcuuuacaaacucuuuuguagugacuuucuaaaccaauaagaugaaauagauuuuuuaggagacuuuuaauuucaagcauucucgccccuuguuaccauaauuuauugaaaugaaugggaaaacccagcaccucugcaaauggcagugaguaaaugagagauuuaucauuaugauuuuuuaaacccacaaaagauugagagcuacaauauauuggguugcuuuuucuuuguaauacaaauacaucucucccacagaagccuauguaauuguagcaguaagguaaaacagauucacauacaaaauuaaggugaucucgaagauugaugaaguguaguuguaucuaguucagaguuauuuaggauggcuuccagauuuguugauuacccagucuuauauuaggucauaauaacugcagaagauagagaagggaguauuaaaugaaguuuugcaaaggagauguccuguuuaaaaauaacuugaugguuuacugugauauaacauuugguaccuagaauacuaguaucauugcccaucauagaaaaauaaaacaucauuaaacaaagaaguaucaguuaguugaagccuuuguaagcauucacugaaucagcauuccuaaagacggugauguugcuaaaaugaaauggugguaguugaauauuacaguguaaaacaaugccaucauucaggggauugaauuguaccuccaaguuaauuuuuacauuauauuaucauugcagccauauuuucaucaguauagcaaaaguggaacugaaaaauacucauuucagaaauuuaaaagacuuugcaacuguauugggugaaugugcaucaguauugggucuuacucuuaggagaaucuucuggccaccaguauuaaaaaguggcuuauaagauauuucuaggcugagugcaguggcucaugccugcauucccagcacuuugggaggcuaaggcgggaggaugacuugaaaccaggaguuugagaccagccugggcaacauagugaggcccggucuguaccaaaaagacaaacaacaacaacaaaacccaaaagcuuucaugaacguucuguaauuaaugugaaacaauucuuauauauuucucaucuagcagaaugaaaaaugaccaauucagauuucccccacuuuugagcuaaaguauagcuaaauaugagcuaaauauugcuaagacuguuuauuauuaauggacuuuuccugagaauuguuuuggagaauuuccaaguaacugguuagaacauuaaugguacuguuugcagguuaucacauugccccuugucuucuugcacaucaugaagaaauuauauaaaauauuaacuuuaguuauuuaugguacuuuaagaaguuacauaaaacauuuuuacaaaggacagacuucaagucaucuugagaucaaauuuuggagacuaaggcugaucuuagaaaaagcaauggagauuugauguuauccacagucauuaaguaccacuaauacuuaauuccaucuuggcccaggcaccuuuccuaccuauaggacacugaaaaaggauaaaacaaaacaacaaacaaaaaccaaggugcaaauagccauggcaagacgggucauuuuaauacucucuaauagucuagccugcucaugggaagauagaccuuagaaaagaggaaaaagcaaacagguaauugcugugaagauuacacauagcguagaaggauagaggacuaggaucucuucagaaauaguuguuagaaaaggccucuguagaagggacaguuugguuaaaacaugaaggaagaagcuagccaugcgacagagagugggugcagggcaaguguuccaggcagaggggauggcacaugcggaggccccagcgugagaaaggacauggcuuguucaagagacugaauaauguggcuuauucacagcccauugagagaagugagaggaagugugauaggagauuagguuggagagaggcaggaaccagauccuguaggcaggccaugguaaugaauuuggguuuuauuuuagcuguacuggggaguucuuuaaagauuagggaagaaagaugaucaaacuugguuuuaagaucacuuaauauuauuuuacacauaacaguugucaaaauaugcguagaaguacaguccauauuauuuuauacauaacaauuucuaaaaugugauugugaaaacuaagguccuagacuguuagcgauuuugggggagauauuauagguuuuugaacugugaauaguuaacuauuuauugaggacguguuaucugccaagcagugaggaauuuuauacaaauucucucucaucuucacagaaauuuccuugaaaggaggcauaauuuuuccuguuugaugggggagaaaauguuagauacagagagaaauuaagcaacuagcacacaagggcuaggauucaaaaauaugucugccuuacuuuacugucccauagcuuuuuuuagugucuuuuugcagggaggaagauggaggggagaagaacaaggcugaaaauugaagaaaaggaaagcacucuuauaaauuuuuguggaauaaaggaauuuagauuuuuuuuuuuauuugggggagugguugggaagguaguggcuguaaauuagaacaguguaucaagguacauuacccuauagaaauugaaucacccuagaauuucccuauaggacauuaugauccugaacaagaauuuuagaucuagcuuugauuagacauugacauccaguguuuuuaugguauaguuguaugccgugaaguuuuaaaagcauauauguuuaucagacaauuaaaaugaucuguauaauauuaacaauuaauugcauguuuuccccaggagagggguucuguaaaguugaaauauagggaagaugaugugucugagguagaucagucuuuggagaaaucagcugugcagggcagagagagacugaacucuggaaccaggagcacuaacuguuacguagcaaagcaggguggaaaauguuuguuaacgcuuaaguguugccugcucuuaguuaauaacaugaauguuguugagaucuuugaauguuaaauuauuuuaauuuucuaauuuucuaagguaguugagaauuugaagcaagauagucugaaccgcauagugauaguggacacuaaagaaucaagauggaugaaauguaggauuuggagacugacgagaagggaugggaugguugaaagaaacauuaacaaguaguaaaaaaagaaaaauaggaaguccuuugacaguagugucuuagcuuaugauaauaaagugauacuuuucuuacaaugaacauuauacagaaugcuugcauuuguagguauauaaaaaugcuacuuauccuucugcccugaguuucugcuacuacuaaacuuugaaccucuuuuggcaauaagacagguuucauuuuacuucugcaaguauucagauaccauauguuaauguuuuacucuggguacaauaaaguuuagaauuauuacuggucacacacaauuaagacaugcaccgagggauaugauuuguugauguuguugggaguuacaacagaaaggaguucccuguggauauuuucuuucuguaagauggaauucuaucaagaagugugaaguauucuaucagaaugugaggaauagucuaucaagaagugagagcuauuccauuaagacgugagaaauuugaagagacuugggaauguagaagauauuagauaggaucauuaaaccuauuucaaaauggaauccagugacucuggccauacuaaaccaaaauuaagcaaauauaauuggcugggagucaggucccuggggagaaguauaagccaguuuuuauacaaagucagcuaaggagugaguguuugauaacccuuuuauuguaacaaaaaguggguaaagaaaaugaugauagaucuuuuagaaaauaaucuccuguuccaagcaaaggauuguucuccaccaccaccaacaaaauuuuuguuacugaaaaaaaagauaagaagaauguguaugcaauuguucauauauauacauauauaaaaguagcaaacagaaauacacggaguaaaaaguguucucccuguacgcucucugcucucuuuuggcagcucaaacccacuacucuccccagggagaaaacaauguuaacuguucaguguuuguuauucuagucuuuucccuuuguauuugcauuuaaauaugggcacacaagcaucuguacauguguacauauuuuaauaucagaagagucauacucgacauauuuugaacguacauuuuuuauuauuuauguaucuugacaaucuuuuaaucucagcauacaaauguaccccagacuuuucauaauguuccucuccugugcagacgauauguguguaugaauuuaugaaugaagauggcuauauuucugcuuaaguaauacuauuuuuauguaaaauauuuagacaauaccaaaggugaaagaaaaaauuaaaaaucaacugaaauccuugagauaauccuuauuuuggcgaccauuuaaaaaauguuuuucuuuagcuauuuacacgagugugaacauacaucacaccugccacauauaaagguauaauauuuauuuauuuauuuauuuagagacaagguuuucuuuggucauccagacuaggucucccucagucacccagacuggaguguagugguguaaucuuggcucacugcauccucuuccucccgugcuccagugauccucccaccucagccucccaaguagcugggacuacugguacaggucaccacuccuggcuaauuuuugucuuguuuuguuuuguuuuuugguagagaugggguuuagacauguuguccagacuggucuugaacuccugggcucaagcaauccgccugccuuggcuccccaaagugcugggauuacaagggugagccacagcacccagccaauguaguauuuauaaguggauuauacauacaagaugauuuuugucauggaacuauuuuaucugcuuggggauuuuuaucuuuccucuacucccuuucuccuaucuuuccucucccaguaaccaguaguaacaaccugguguacauuuuuccuaccuuucucaaugcccauauaaucauauacauaugaaauuauauaauuuacacucaucuucauuauucauuuuucacagaacugauucuacaucaacugaaauguagcccacucauuuuuuuuuugcuggauaauauucuaaggcaaggaucagcaaacugcaauaaacggaucaaauccauccagccaccuauuuguauaaauaaaguuuuguuggaacauagcuucacccauuuuuguauugagcaguuuaaccuuuuaaauucuuuaccuguuauaugugacacaauuuuccccccaauccauugucuuuugcuuuguuaugguauuuugccauaaaaaauuuuuuuuuaaugcaauaaaguaaaacaugccucuucuuuucuagcuuuuaguuuccuauuuugauuuaaaaggcugccuaacuccaggauuauccuuguauuuuccuaaaauuucuucuaagguuuuuaucacuugcauuuuuuauaggccuggaauacauuuuuaugucuauauugaguggcauuguaguauaacguaguauaagaucacagauaaugaacaaauagcuaacaauaauguaguauaagaucacagacccugguucugugauuuacuaccuguucgaccuuugacaagguccuuaacauuuauauguuguuuuccucucuaaaauggggcugauucuuguaccuguuuuguaagaugauagugaagcuuaaaugagugguuauuauguagaaaauauuucgaacauuaucugguacauagaaacaugugcuuuuacuguuauuacauggugugaguaggcaucucauuuuuuucccauauggauaaccaguuguccuaguaacauuuauugaguaguuaguucauccuuuuccucaaucgauuuaaaaugucaucucuacuacauguuaaguuuccaaauauauauagcucuguuugggggcuuuauagccuguuaugugucuuuauccucugcuccagagccacaguggcuuaguuacuauagcuuuauacauacuuguaacuaacaaguggagucccuuuacuuuguuuugcagaauuacuuuggcucuuacuggcuuuuuuuuuuugcucuuccauauaguuuuguaaacacucaucagaauuuacaaaaacuguuuguuauuaagucuuaguguggaaaggagugauacuaaguggccauuauuagaauggaaccugcagucucuuauuaauacuuuaaccauuggaaguuuuuagaaguuaucugguuauguaaucuaaagauuagugccauccaccaugcuagguggguacugggaauauagcaaaugaaaacuguacaaagauagaucauaagccugcauuucccaaacuauacccugagauacccaaaggaaccucagagaacucccagggucauuucaaacuucuagggaaacauggccacaucuguuggacauuaugcgaacuucuagcucaagguaguucacaguuucaacagcugauugugccaucuucauuuuguaccugugauaucuuugugaaguugagcuuuuagugguuacuguuuuaaaaagcaaguacuaugcaaaaaucaguguggaacaggaaauguggguggcaguauuuaguugcacagcaucuaaguuuuagaaguugugcagggcccuguaggugaaaacaucccauaguaacuaauugugguuauuuuaaaaugaaauauauauauauauuuuucaguuugcauguauuauuuuuucaaaaagguguuaauuuguugggacauagauacucauuuuguuugaaccuaacuguuaaaagaaauaggaugguuagcuaucucuuuugaccuauggaauucuugaaagaaauuauagagaaaauaaggguaccaggagccaagcaaguuugggaaccucucuacuuuaacuuaaaguuauuacaaauauucaaagauuaagaacauuuggagugcucuguagguagcgcauacaccaugcuugcuuagaacaggcaaaacuaacauugccugggcaccugggacagacagcauuucugagcaaaugauauuuaagcugagcuugaaggaagacugagaacugacugaaaaggagugguggugggaauagcuugugugaagaggcgggagcgguggggaacugacugggagagcaaugcaggggagcuggaaauaggcagaagcuagaucagguggugacugacguggcagucgacuaaaggaguuucuucagguuucuuuguaaaaggcaacggcaagccuuugagggguuuuaagugaagagaggauaucuuaggucacugcccuccuacugagagaacaaaauacaaaacgauauacagaaauauuuaaguaacuuuuuguaaaaauuuugaagugccuugauuuugaaaggcauuuguaagcuuuccuuugaguguaauucacucuuacuuuuucaaacacauauacuuuuuuucguuguucaaccuggcucaauuuuaaaaaugaaauaaaaagcaagacaguguuaaacugcgaaacauuuaaauuguaauuuuggggguauuuuuucaaauggcaaaaauuguguuguaauuuugaaauagaauguauuuuauuaucaguaauacaauauuucagauuuuuaauuuguguauuuuaaccaccaaucuaacacauuuaucuuuuaaguuucugaguuaaguuugggggguauaauagagauuuaauaguuacauaguaaagauauaaagguaauuucucuuaguuuagcuaucuuuuuauacuuuuuauuuauguguuuauucuacuaugauuccaguaaacuaaugcaacauaaacauuuugauaguaauaagaaacuaauugcagguuacuuuuuaaaaauuucuaagcuuauuuucaggaauuuuaagacuugaaaaauaaauuucauggucauuaaaugggcauagagaccugaaacacuuuuuuuuuuugagacggagucuggcucuugccaggcuauagugcaaugguguaaucucggcucacugcaaccuccaccucccagguucaagugauuuucccgccucagccucccaacuagcugggacuacaggcaugugccaccaugccuggcuaauuuuuguauuuuuaguagagaugggguuucaccauguuggccaggcuggucucgaacugcugaccucaugauccacccaccuuggccucccaaagugcugggauuacaggcgugagccaccgugcccagccaccucuuuucuaauaccugcuugugguguuugggaaaguguaauuagucugauuagaauuagaauuuguuuaucauugaaguauuggaaaacuuuuaaaacaauugaauguuauuucuuuuccucugccaguguguuuuauauuucuuuagagguguuuguucauuauauaauauagaauuuaugucauccuuaaauucauaaugcaaauaaauuauaaagaaguguguagauauauucgaaaaacagucuuaguuucauuugcuggauuggguuucucugauuuuucacaugaagaaagcugaugacaacuugaguuguuuacaagggaauuggucagaaguuuucuugaagaaaagugauaaagcuuuaaguuggaaagcuuuccaacaggcugagaguauaagguuuauaacaaauauuuuucuuuaaauuuuguucuucccauguucaaagaacugacagggacuuagagaaaguaagcuaauuccuuccgugcucuuuacacuaaaaugaauucuagaugaagauuaaauguagaaaaucacaagaguaauagaacaaagcaaggcugaaauuuuuuaugaucuugggauaaaaaagaccuaaguauaacuauguuuaguuuuauguagcuuaaaauuuauucuuauaacaaauauuauaaagucaaauggaaaaaagaauauuuguaaaauaugauagcagauugcuuuuuaagucagucggaugaauaaauucucuagaaaauggacaaaguguguguauaguaaauuuaugaaaaaaauacaaauaacugauaaacauaaaaagauaccucuuaagaaucauuuuaauuuucugccucuuuuauguucaacagagaauuucacuuugaaugcaguaacuuaaaguauuuauaaaucugauucuaggguuugaaauaaaacuuuuauuagauacucaugucauuuaacaaggcuuguuuaucucagguagaagguuuuuuuuuccccuaauguucuucuaaauggcucaaaguuugguuuccuacuugaaaguaaaucuuauuuauuagacauuuguagugagaugacuauauuuaugugucacauucaaagaacaacaguuaauaauuuuuggacuuguuaguaauauauuuucugacaaauaauagaagagagauuugcuuaacuuuguucuuuuucuuuauuuuuguaggagccagcauucgaacguucacuccauuuuauuuucugguggagccgguggauacacucucaguuagaggcucuucuguuauauuaaacuguucagcauauucugagccuucuccaaaaauugaauggaaaaaagauggaacuuuuuuaaacuuaguaucagaugaucgacgccagcuucucccggauggaucuuuauuuaucagcaauguggugcauuccaaacacaauaaaccugaugaagguuauuaucaguguguggccacuguugagagucuuggaacuauuaucaguagaacagcgaagcucauaguagcagguaaguuuuaagugauuuuuuuuuuugcauuuucaaauauuuauaacauacaucuugauaaaagcacuguucucuuggaguuuucuuuuaauuaguagcaacaaauauacucauuuaacagauaucaauugugcauauacucugcguaugggaccuugcuguagggcuugcucagugccguagagaauaaacuguagcguguuuccacuugucugauggcuuaauauugcuaucagaaguacugagcaguucuuuucuccuuuuaaacuuggaaguggcagaggaagugguauaggaaaauuaaaucacuuugacggccaacuucuaucuuacccagcauaaccauuuaguaugguuuuguaaaacuugcaguaaagucagaauccugguuccuugaugccuuaaccaaggaaaugacauucaauuggauuaauuguuuuaaaaucuacagaguguauauuaagguggagagcagaaaguuauaaagagaggaacuuucccuccuuuucagaguauccuuauuugaagaaugauggaaaguguaagaaaaauuagggaucuugaagaguaagaugugguuucuaaguaagucaugucuguuuuguaguagauacuagcguuccugagauaguguuucuuuacuugaguaccagaugaaauaguuuuugugaagggucauguuauacaaaaauguuaucuuuaaguccuguauuuacucucaccuuggugaaacgcccacgugugagacagaaccucagagacaguagucucccaucucauuccuacuccaggauuaugguuucccaucucaugcucacuccagaguauauuugcuuauacauucagagcauaauggcugguuuuuuuccucuuuggggacaaauacucaaaguugaauuugggugugacaaaguuucuguaauuauuccauaaucauagauugaggauggaaaaauaaaagaagaaaaaaauggguccuuuugccaauuucccuuuucuuuccuuccuucucucccuccuucccuucuacccucccuuccuugcuuccuucuuuccucuuuuuauuuuucuuccuuuucuuuucuuucuucucucucccuuaaaaaauaaucuauuugccaggcuuucuccaacauguuucauaaauaaauuaguauaaugacugccucuacaacgucacuuaggucagugucuguuuauaauuuaaguucuuaaauaucucuuaucugggcuuuauucaugggcuccuuccucucggcuguccccccauauacuaucaucaaauccagugaauucugcuuaguaauuucucuguacuuaauccacuuucuccuucccgaggcuacucccagucuucccucaccacagccuuauaagcaucugccugcuaccuuauucuuccccuccuccaguccagucuccacccugucuagaguacucuuucucacccuucagugauccuccaguaacaccaucaagguaacaucuaacucuuaaauaacaggccuguugauuccuuuuaugagcuguccuccacuucuccaaccuuauuucuuaacauuucacccugccucuguccccacccccguccccuacauccaccaucacccucaccacaguuuuaagcacuggcaguacuguuuuguuuccuuucauuuauucucugccuuccagccuuugcucauggcauccccacugccuguuaauuuuauccuccaccuuuuccucacuuucuucuccucugcuaaguuuguccauucuuccucuuugauaccuucaggaagcauuuuuuugacccaguaucuaagcaagcagcaccguagaaggugauacauucugugaugacugcauacaggguucuguaggaaaguuauuuaaaccacucuuggcccuagguaucaggaguaaauagugcccaagcuaagggauuaaauaaaaguucuuuuaaauaguugcaugguauacauugucuagauauacauacugugauuuauuuaaagauuucuuuauugaugaacaauuaaauggauuaaaauuguuggauguuauaggcaauacuauagugaacugccuucugcaaaucuuuauuucuguaaaacagauuacuggaauugggauugcuggaucauaggauacacugugugugugugugugugcgcgcaauuaaaagguacuaguuugucaguuccucaaaauguuaaccauaguguuaccauaugaccuagcaguuccacuuguagguguccugggguaguuauggguuaugcagagugacugcaagugaguacaagauuucuucccggaaugaugaaaagguucugaaauuagauuauggugaugauuacacaacuuuguucauauacuaaaaaauauuaaauuauguacuuuagauagugaacuuuaugguauauaaauuacaucucaauaaaaccuaaaaaaauucugccaaauugccaaucuaaaagacuuagaguuuuuugguugcaagcaguagaaacugauuguagccaagucaagcaagaagggaaguuuuugaaagaacauuaaauagguaacucauagaauuaaguaugagaggucuuuuucucugagcugucucauuucuccacaaccaaaauuucuguuuuucugccugggcaguaugcuggcugugaguauuuugugcccagaggugggguaauaggguguucuaaauacagacauuguuaauaucuucuugucaacuccgggucuuaacucccacucuccuuuuucuccugcaguucuccagaggcagcaggacaaccggcuuccuucuugggagcgcaggaagcugcagcguucccugccuuguuaugucaguuacuaguccuccaucugcuuucccuacucagaaauuuuuugaaaucucuugucugccaauucuccauauguuuuugugagcuuacauuuuaaaaauuauuaauuuucaugagaccucaggaggaagaauuuuuugacucuuuaaaaauacaacugagcugggcgcaguggcuuacgccuauaaucccagcacuauaggaggccaagacgggcggaucaccugaggucaggaguuugagaccagccugaccaacauggugaaaccccaucucuacuaaaaauacaaaaauuagccaguaugguggugcccgccuguaaucccagcuacuugggaggcugaggcaggagaauuguuugaacccuggaggcagauguugcagugagccaagauugugccacugcacuccagcaugggugacagagugagacucugucucauaaaaaaaauuaauuaauuaauuuaauuuaauuuaauuuaauuaaaauagaaccauauuuugguuuuauugauuaagauuuccuccuuuccccaacuugaucaaauucuguguuuaucuuuguuaauucuuaucuucugauauucugguuucuuaaaaguagauuuuuggucaaaucuggggagcucaagguaaaaaagcagauuuuuuagauaauuuuaucuuuauuuuuuuccuucaaaaauccccuugaaauaaaaaaaaaauaagaaaaagaaaaaguuuauugcagggcuguaaaaccugugugauuuauguuuggacuaauucaccaucauaaaacuagaaaaccuguaaucauuucucaugauuuguuugcucuuccuuaaagaaacauauuguuuuauucugagcauagcaaucacuuuuuagauauuauaauagcuaguuaaguguuuaugcaauauacuauauauaaauuauuuauuuuaaguacuuuuuuuuuuuuuaacaauccugugaggccuguuauucucauuuuacuugugaagaaacugagucuuagggagugguuaaauaacuugccaacuucagacacccaugaaguggugguguugggauucagauucagauaugugacuugaaaacugaugcucuuagcugcuacauccuguggcgucuauauuuaugacgacauuuuugguucacauuuuauuuugagaucauuuuaaacguagggaguaggugcaagaauagaaccaagaaaucucauauaccuucaccuagauuaccugauuguuaacaucuuaucguaucugccuuaaccccccaaaaaugcauacauccaaagacauauuuuuucggagccaguaagaguaaauugcagacagguuuuccuguaacugccaccuaaauaccuacguguauauuucuuugaaacaaggacauucuccuagauaaccacagauguccaucaaaauuaggaaauuaaccuuaauacaauacuacuguuuaauuuagauuucacugauuaucucaauaauguucuuuauaguaaaaaccaaaagcagaguacccgccuguccuccucccacacauacucuuauuucuggcccaagauuacauauuucacuugguggcuguguccuuuaaaacucuuuagauauaacuugguuuuuccuugccucauuuugaguuuguuugauuucucccugaauagauucagauuccucauuuuugggagaaauaccacagaaguaaugcuguguucucagugcaucaugccaagaagcaugugauauuuuguucuguugcuggugauguuaacuuuuacuacuuaagauggucugugcaguguuucuccauuguaaagcuugguacuuuuguuaguuaauaaugaguauuuugggaagagauacuuugauacucuguaaauauacuguuccucaugacauuuuuguuuacuaguuuugguguccauugaggauucauacgugaaucaguuauuacuaucaaauggugauuuuucuaguuccaucauuucuauaaggcaaagcuuuuccuuuucuuccacuuauuuguuuauauuugcaugaaccgacagauucuugucuuauucaguggguuauaaugcauguuaauaccauuaucccagauuuaaucagaggaagcucccuucagucugacuucugugcccuuuugauauguccacauuguucuuuggacaguuuucuuacuuuacgucguaagauguaccagguucaucuugugcuuucucuccuucugcacucuuagaauuggccauuucuccaagaaauuauuuagaaaagguagagacaccauauguaccauugcuacugaaguaauauggaugcugcaccuucucuguggacagggcuaggaaauauauagggguguguguguguguguauauauauauauauauauauauauauauauacacauuauauauauuauauauauguauagcaaugaauaaagacuagacaaaauguguacauguuucacacauacuuuuauauuuauauagauaucauauauauuuuuauaucuaugauuauauaaaaccaugauguuuacacugauaccuccauucuagaccaguaccauaggacuuauucuacccaucuccuuuucaauguuuauaccuugcuucucuaacugugaggaaucugauuccaguuauccuuaaugcauuuacuuauuugcccaguaucccuguauuuagcuaauuuccauggacuuucuucucaacccugguucugccauauguuguagccaugugagcugacuugcuccuggcucccaagacaaaauuuuaaaguaauauuuaaauaaauuuuauuucuucucuuccuuuauuguccaggucuuccaagauuuaccagccaaccagaaccuuccucaguuuaugcugggaacaaugcaauucugaauugugaaguuaaugcagauuuggucccauuugugaggugggaacagaacagacaaccccuucuucuggaugauagaguuaucaaacuuccaaguggaaugcugguuaucagcaaugcaacugaaggagauggcgggcuuuaucgcugcguaguggaaaguggugggccaccaaaguauagugaugaaguugaauugaagguucuuccagguauuaacucauuaucaggacugaugguuuuauguuuaugaauggguaaacauuguucuguuagaauuuuuaaaaauaaugaauguuggccgggcgcaguggcucacaccuguaaucccagcacuuugggagguugaagcggguggaucaccugaguuccagccuggccaacauggcgaaaccccaucucuacuaaaaauacaaaaauuagccagacaugguggcaggcgcuuauaacuccagcuacucuggaggcugaggaaggagaauuacuugaacccgggagguggagggugcagugagcugagauugugccauugcacuccagccugggcgauagagcaagacuccaucucaaaaaaaaaaaaaagaggaauguuaauaugcgguaugacauuuuacugucagcauaggaagucucaguuucuuacagaagugaaaagaagaaaaugugccagaagauccacucuuuagggaaugcauuauuaaaaauuuaucaagcaauaaaguauauucacugucuaaugguauucuucuuggucaaaaaaauauuagugcugugucuuuugucaagccuucucuccaacaauaggauauuuuuauuguuaggucuuuucacuugugcaaaucagagacccauccaggcuaguucguauaagggauggguugggugguaaguguuaacaugguggcucuagagacaauggcaggcaagaguccuuggaucuuuauacuccccauuuuaguguaaauucagcuccuauuucagucuuucuucuuuuugugugucuucucaguuccugccccuucugguguuccucauaaucaauuuuguauaucuuuucucacuguauaacuucugcuuacucauaacuuccucccaguuguagcucaucauagccccucuagccuuuugguguuucaugacuguuuaccuucuguucucacugcuaggugcccccuccauauuucucaucucaaauuugaguuucugaauauaauugaacuaucccuacauuauuugggaagaguuauaugucuauuaaauaggcucauuuuuaaucuauggacugguucgcaaagcaggacugugagcuacaacucuugaggguguuccuaauagcccuucaacucauaaauguagguucuuuuuuugucguuaucccucgucauuccugucucaguauauucucagcaaggacaguaucuuuuaaagugugcguuugugcgugugugugugugagcgccugugcacgcauaugcauauguguaugugucuugagacacggucuugcucuguaacccgggcuagagugcaguggugcgaucuugguucgcugcagccuugaucuccugggcucaaguguuccuccuaccucagccuacgaguagcugggacaaacgguacacaccaccacaucuggcuaauuuuuuuguauuuuuuuuagagauggauuuugccauauugcccaaguuggccuugaacuccugggcucaagugauucuccuaccuuggccucccaaagugcugggcuuauagguaugggccacaguggccagcgugagauguauauuauuagaucuugucacaccuuugcucaaaacucccuaaugguuuuccaugucauucagaguuaaaguucugggcuguaaagauuuauaaucuuaauaccacuuccuuccuuucucuccccuaucccaucuccuacucuuuucucccucacucgaagauugugaucacuuuauguuucuagaacaauccagauaugcucuuggccauuuucucuuucuggaauccucuuuccucagauaccugccugggucacugucuuaccucucugcucaaauaucgcuuuaucagugaagccuuccuugaacacucuguuuaaaacaacaaucuuugauuuccacccccaguguuuucuccuucuaccuucauuuuacuucagaacauauuaccaucugacauguucuaucuuacuugucucucucccucauuaguauguaagcucaaccagagcagggaauuuuugucugcugccaaaaacacuuucuggcacauagaagccaguaauauuggcuaugaauuuguuuaauugauucuaucaaaauucaauuaaauauaccuaaguaauucaaguugaauuaaaaaaaagaacuauugccauauaccaauauuauucagucugcuugcucacuugcuuuuacaugacagagguaauacuucucaacaccuaggguagcauuuaagcaaauccucaaaaucugaauccaagaaaacaagauuuguagugucaaaaggugagaucacuacucaacaucugaaacgaaaacauaauguggaauguuuugcuuacuuaaguaagggagaguugugcuugucaaacauaguuuucuugagcaaagcuaaguccuuaucuccuauagaguuuuucagaagacauuguuuuggguuguacugguuaagagacagagguggauuaaugucagucauagaaauauguuuugugguugauuacggaggugggagcaaguuaaugucagccuuaaaagucagugacuccaccauuaguuggcugacuuuuaaagccugggcuuaucacugauuggcuuucaaagccacauucacccuugugaguugucacuaaucgauuaggcaauguuuccuuguuaccauggcuacaagacugucauuaauugguuagacaaguuuaaagcuaguccuggagguuguuaucauggcuguagaacaucuuuuccaaagcauaugggcacaagagucacaucucuucugccugagaccuuuuugucaaaacucaauauuaaguuaauauuaccuuauugaggagagaacucugucuucugcccacaagaguguggccuuuucauguauucacaagaggacaacucuauaaagugaacacacauuaauucuaaugucugaauaagaaauacaaaaauauagugguagcuagauuguugcucaguuacaaaaucaagggacugacagacugagcaaguuaaagagacgaaacucagaaagcuuuucagaaauaacacacagauacagggaaggaaaggaaaccucuuaucccugugaguaaggagaaugccauggguccugagcuugcucagucuccacuguuuguacacauggcuuuuaucuuaucuuucaaugugaaugggauucaugucaaauaucucucgauugauugacaaguacguacccugaaggcaggagcaauaaguuauacauccuuaagaccccuaaagagccuagcacaaugcuuugcacauagaauuuauuugagaaguguuugcuaauuugaauggaaauuuuuguaucacuuuugcuuaaaauauuuugucauauaaagccacacagacugaauaagaaccagucauuccucaagauuaaagcaguaaagugcuuugucguguguguaugugguaaugauggggucuugcuauauugccuacgcuggucucaaacuccugggcucaagcaguccucccuccucggccucccaaaguaucgggauuaugggugugagccaccauguccagccuguuuuguccuuuaauuauugucuuuguuaauuuuuuuuuuuuuuagauccugaggugauaucagacuugguauuuuugaaacagccuucucccuuagucagagucauuggucaggauguaguguugccauguguugcuucaggacuuccuacuccaaccauuaaauggaugaaaaaugaggaggcacuugacacagaaagguaaguguugucugccuaaaagccuucuucagccuuagcuugagacuuugucauaucccauuugggacuauugacuaauuuaaaaagauuaucaacuuuauuuaaacacaucauaaugcucauaugucauccuucaaauauguucauaugauauauaugaugaggauauuuaaagaaaaagauacuuucaaaauauuaagagauaauuauucccuuuguuccuguugaagccgcaguguacucagcuuaagucuucaggauuuucuucccuaaauuguugcaagagcuuugguccugaguagccugagucuucucacacauucucauaugcauuuuuuugauaguaguuuuuccacugcacaaucaguaugagaaacugggcuggccacaguggcucacaccuguaaucccagcacuucgggacgcugaggugggcagaucacgaggucaggagaucgagaccauccuggcuaacacggugaaaccccgucucuacuaaaaauacaaaaaauuagcugggcguuguggcaugugccuguagucccagcuacucgggaggcugaggcagaagaaucgcuuuaacccaggaggcgaagguugcagugaccugagaucgcgucacugcacucuagccugggcgagagaccuagacgccgucucaaaaaaaaaaaaaagaaacuguauuccucauccuguuguuuuugccuuuugaauccuaucagaaaucacaaauucuucaucuuucacaaaauaccaaccacuuuacuguccuuccuaucuccucucauuacuuccuuaugcagugggugcuuuucuuagguguguucucauaagagaugugggguggugguagguagguauguuuuugcuuccaaaauaaugcugucuugugcacuguaggauguuuacuggcaucccugccuucuacccauagguggcaguagcacuuccgcauugugacaaccaaaaaugucccuggauacugugagaugguccuugggaagcaaaauugcccccaguugaggaccauuguucuacagcagugcuguucaauugaaauauaaugcaagccacacauguaauuuaaaaaugucuuacagccacguuuuuaaaaaguaagaaguacauguacaauaauaaauauaauaguaauauuuuaugugauguaccaguuaaugugaaauguaguucuaccaaaagaauaaaguuuauguuuagugggaaacauuuuaacacagcuuuagcuuguacauuuauuuuaaaauuucagaaauucaguucugcagucauacaggccacauuucagguagccacaugugacuaguggcuauugacuuggacagggcagaucuagaguuucccaguugcaaaaucaaaagugaacagacaauuuuaauuuuuauaguucaguauccaagacguagaaacagguaucuaucuaguuaucugggugaucagccuucagugaucacuggggaagauggaauacaaucagauuguuccccacgugcuccauuagcaaaacauggcauccuccccaauaucaccugauuucuuucucaucauccauccacucaccaacuuccugucuucacauuuugcuuccucccugucuuuccacuccucuuuccagcuaaauauuacauaagcaaagaauuuauaagacuucauuuuuuuuuuuuuuugccaacugaaacauagggaaccuuaaaauagugauaaaaaugugaaguucuuacaguagaaauuuuaauuggcuacaaguuagaacaaaaucuuuaucaggaguaggaaggcugaaauauauuauuuuaaaacauauuuugucaugaagggacauucugaagauauaaaacuuauauauaaugauuuuuuaugucagaaauaaaugugaggcuuucuaugauucucauuuguucaauaauuacucaacaaauauuuaccaaaugcuggcuaugucaugcauguucuaggugcugggaauagaguagugaaccaaauggaguucuugaucuuacagagcucauagucuagugggaaagagucagauaauaaguaaaaauuuaaaaaugucaguuuaugguaagugcuaugaagaaaagacaaauuauaucaggagugucaagagaaauagagguaagauugcuauuuuauacaacguguuagauaauuguucuuuuaguagaaugauucucagacuggggucugagugggccaggguaugcacaucaugauagaaaaguuucauaucuuccugaaacauccaauuuuauucaaagauauccuugggagcagaugauuuuuaacuaaaucaaaugugaauauauuaugguuaauaacacugcucugaauuuuaaggauaaagcaguagacuuuaagauugaguuaacuuauuucugccuguaguucucuaggcuccugaauacucagauuagguggcugaaaagucugagaagcacugccuugguaugucacugucucaagaagcuucagaagaaaauaagagcaggacaguguuggugguguucacauuggucuuuccagacucuagcacagugcuuggcccauaacuggggaggggaagugguggccaauauauuuagcuugaauaacccaaaguaauguuggaaaauauaagugaauggagcacaggagugcuuuugguuggauguauguaauuacccaaaauaucuuuguuucugcuagagccuuaugagauauguagauaggccucagcuaauaaauuauuuagacccaaaauuagaaagaggcuuagaaguugaaagaaaaaaguggcuagaaauucagauaguguuaggcuggaucuaguaaaaaaaaaagaucuuaaauaacuaaacauccuucuuuauuacucaucuuaagacuucuuugaaagugaacuuaagaacauuuccauggcuuuuauaaauguccaaaaauugaucuauauauuuaaccuuugaucaaauuuguucagauuuacaauaaucaucgcuaaugaaagagggggguggaaauggaucccauucacuaaguaguuuuauuuuaaagggagagaaucuggaaaauauaaaugcuaguguucaaggugauugacagaaaaauguaauuuaguagucaaauaauguuaucuuuuaauggaaugauagaucugaaccccacugcaagggaacagguuaaaaugcuugauauuauuacaauugacaguaguagaaaaauaagauuauuuaaaaaguaaauggaagacuuccacuucugggaaaauugaguagauauauuuuucccuauuccuuuugcuaaauacaccuaaaaacccuggauguuacaugugaaacaaacauaagaagacucugaaagguagagagagaaagacugagauugaguagcuagggagcuugagacccaaggaacagcauaauuguuaguucuuuuuuuucuuucuugagacagagucucgcucuguuacccaggcuggagugugguggcgugaucucaguucacugcagccuccgccucccaggaucaaaugaguagcugggauuauaggcaugugucaccacugccagcuaauuuuuguauuuuucauagagacgggguuucaccauguuggccaggcuggucucaaacuccuggccucaagugauccaccaaucuuggccucccaaaaugcugggauuacagaugugcguuacugugcccagccaacuuggugguuaguucugugggcucaguuucccgccccccccgccgcauaagacccuuucaggaaccugggcuguguuuugccucauauaucccagacuuggagcuaaagaagcuagcaaccuggaaauccuacuaggcacaaacaaaaaaagccucaacagaaggugcucucuagccaaaggggcaggaaaagagcaucucagcaagacaaaagcuguuagacuguacuuucuccuacuccagucaaacaccgcagaagaaacuguggccccacccuaccaugccagucaaagaccaugccaggagccuagacuuccacccuucccagguuguagugaagcaucucagccuccuugcuaaguggugucaaaguuggaguagggagccaagacuuuuauccuagccaggcaguaaugaggccccucccauguaaguagagaacaaauggagagccuccacuuucaccccauccagccauaagaggcaacccuucccuucacacuggggugguaucaaaggaggcccagcggagagucaaagcuuuaccaucauguaguagcaaggcucgcuucauggugucaacaccaugugaccaugugggggaacaauaaugagacaauccuaccccuucuacccagggaggcaucaguggaggccuaguggggagcuggaacucccaacccugcuaagaagcaaugaggaaaccccuccccacuuacauguuaauggaggcugagugggaaaccugaacuacccccaccugacaguaaugagacagcacccccccacacacacccacuuucucugcuagagugguguuagaagaagagagcuaaaacagaaggauuaaauaagauccagagugucauaacauaguaccuaaaauauccagguuucaguugaauguaaugcaucaugccaagaaccaggaaaaucucaacugaaaggagaaaagacagugacagagauuuuagaauuaccugacaaagauuguaaagcagucaucauagcaucacuucagugagcaauuauaaacacauuugaagcaaaugaaaaaguagaaaucucaacgaagaaagaggucuccucagugcagguuugaaaaaauuuaccucucuuucaaauaacaacaaauacaaaacuaaauuaaacaguuuucuuuuuugcuuuucucuucauucuuaccacccuaaagaaguugucuuuaacaucuguuuucuucuccguuucuuuaucugauguaucugcaagauuuuaccuucuacaugucuuuggaauccauccaugaaggcaccaugugccuuauucuaaguuacagucggugcaguggccuccuaauuguucuuccuacuuguacucuggccucauuccaaauacaccuucacacuccugccagagcagucuuuucaaagcucuuauuuuaccacagcacucucaacccccuacccacuuuuaaaaauguuuaauggauuuccguuguucuuagguuaaggacccaaauucuuaaaaugguuuucaaagccuuaugcagucuggcuccauccucauccuccucuauuuucuuacacuuugccacacugauuucuuuuagauccccaaaccacugugauccuuucugccacaauuaauuugcaugugcuagucuaucuuucugaaauauuuuucgcaccucauuauuuaguuagcuucuacucauucuucagaucucagcuuaaggguuacuuugucaggaaaaucucuccucaucccuaauuuccuggcagguucuuuugcuauaccauuuuguagaguuaucuucuaugucuguguuucccacuugagaugcaugacagcacugauuguguuuuugcucagugcuauauccccagcugcuaccugacacauauagacaaaccaauuaauauuuguuaaaugaaugaguaaaucucucuccuuaccuucuuuauccaacuuuuuaagaguagucaauacuuuuuugcuuucuuuuugucccuauuguuacggccauaaucuuuugcucuuuaauucuggaccauuguaauuauauaaucaaacuucugcuuuaguguuuucccauccuuuuuuuguuucuucacgaagucugagugugucauuacucugcucaaaagccuuucccuaagaccugaaaccauaaaaauucuagaagauaacauucaaaaaacucuucuagacauuggcuuaggcaaagacuucaugacccugaaugcaaaagcaaacacaagaaaaacaaagauaaauagaugggacuuaauuuaaaaagcuuccacacagcaaaagaaauaaucaguagaguaaacagacaacccagagcucgggagaaaagcuucacaaucuauacaucugacaaaggacuaauauccagaagcuagaaggaacucaaacaaaucagugagaaaaacaagcaaucccaucaaaaagugggcuaaggacaugaauagacaauucucaaaagaagauauacaaauggccaacaaacaugaaaaaaugcucaacaucauuaauuaugagggaaaugcaaaucaaaaccgcagugcaaaaccaccuuccuccugcaagaauggccauaaucaaaaaaucaaaaguaauagauguugauguggauauggugaaaagggaacacuuuuacacugcuggugggaauguaagcuaguacaaccacuauggaaaacaguguggagauuccauaaagaacuaaaaguagaucuaucauucgauccagcaaucccguuccuguaucuauaaugaggaauagaagucauuauacaaaaaagauaacuugcacaugcauguuuauagcagcacaauuugcaauugcaaaaauauggaaccagcccaaaugcccaucaguugaugagugaauaaagaaauugugguauguauauauauauauacguauauauauauacacauacuacucagcaauaaaaaggaaugaaauaacaccauucacagcaaccuggauugaaugggagaccauuauucuaagugaaauaacucaggaauggaaaaccaaacauccuauguucucacucauaagugggagcuaagcuaugaagaugcaaaggcauaagaaugguacaguggacuuuggggacuuggaggaaagggugggaggcgggugagggauaaaaagcuacauguugggugcaguguacacuguuugggugaugggugcaccaaaaucugagaaaucaccacuaaauaacuuuuucauguaaccaaacgcaaccuguucccuaaaagccuauugaaauaauuuuuuugaaagccuuuccgcuuggucaaaaaauaaaaguucuccuuagcacuccaagcuuuuccagacugacccuaggcuacucagggauaccuuaugcccagcaauacugaauuuacuugaguccauuggcuguauauauuuuuucacauuguuuuuuuucuuugccugcaucuuugaauuuuggaguucuaaaggcucgauggucuuuuuacugugagccaugaacuaauugaaugaauuaauucugccaagcaaauggacauuauuucucccagccuuuuuuuaaagggaguaaaaucaaucccguuaagaaagacugacugcuaugcuacugguacucacauaugccaaauaucaggcacaucaaguaucaacaauauuuuuuaguguaauuauuagauauaaauuacuguaucucgcuuucaaaaaugacaacuaguguuucaaauuauguucaucucagcuggguaucauauguauacauugcugauuucucauuugaugaacauuaaguuuuuuguuucugaaacuuaguaguaaauuuuauccagguauaaaauguaggauuuuaauuuuuguaaauuuuucuuauuuugugaggcaccaaagacccgucuuaucucuccauuuauuuuaucccagucauuccugcucuauuccauuauauaauaucuuacuucuguguuucaucagguaaaccugggauuuaaggguguuauuaagacauuucugauaggaagguugcuugauaaagguuagucaugaccuugcagggucguauuucuuggagaagucaccaaaucugauucuggcuuucagcuuucuguguccagaaacuuaaucaaguuuaucagauucaggaagacugauuaccuagacuuuacaauguaaugaaauuuaagccagacuagcacuuuauuuauuuagaaugagaauuauaaauguggccaagacuguauagucauuuccucugauuuuuuuuuuaauccuauaaggaauucuuuuuuuuuuuugagauggagucuugcucuguugcccaagcuggagugcaauggcgugaucuuggcuuacugcaaccuccgcuucccggguucaagcgauucuccugccucagccuccguguagcugggauuacaggcaugcaccaccacgccuggcuaauuuuuguauuuuuaguagagaugggguuucuccuguaaucccagcacuuugggaggccggggcggguggaucaccuggggucaggaguuugaggccagccuauaaggaauucuauaugaaaagccaaauuauaaucagaacguuuuuuaauugauccauggacacagacuagaaauguaacaguauuaagauuuggaagaaaaguccagccugugaaaaccaguuuagauguggaacuucaaaauaaaaauguauguauacauuuauuauuguguuugguacuguauuuugaauuuaugucaucucugaaagugacuuuuaaaguggcagcuuuaauuagguacuugucccuagaauuaacugcaucucuugcccuaugucagguaccuuuauaugucugauuuuguuaguaacucuccaaauuaacuaaacuuguucacuuuauacaaauuugaucagaguauugauuguucuucaauguuauaggauuauuuucuuuucucuuuaaaucggcuuaaauaacucuguagaguuggccaguauucaucaacauccugguugauaauggcaugauggugacugauuugugcccagcuaccacacccagggagcugcucucuggcaaccauucucucuuucuucccuuccucuuuuccucucucuccuagauaagcuaccauagggaaacuuucaguaggcacugugaccccaugacuuacuguuucggaucuaacauuuugcccucuuuauguuuucuuucuguuauuaaucucaguguggcauagcuguggugguguaacuaacucucagauugauuccagacuucaaaauuacauaauuuggaaaaaaacuggccagaauagggagacagggaugggcugaaggaagugaaauugguuccaagagugauaccccuuuggaaauaacuagaagugucagggauaauucauuguaacauuugauuugcauuugugauauuuaugcauguaaaauaugagcaaagcaaauuggacuaaauuaaauucugguaauuuuauauuagucuugguucaucuauagcuauauaaauaauaauacucuuuaaguguuuucucuauuuuauguggagaguuuuucagguauuauuuuccuaguacugaaauguaucuuuuuuuuuuuuuuuuuuuuaacacagcucugaaagauugguauugcuggcaggugguagccuggagaucagugauguuacugaggaugaugcugggacuuauuuuuguauagcugauaauggaaaugagacaauugaagcucaagcagagcuuacagugcaagguauguaaauauuuacuguauaauuuaaaaauccuguguacuuucugggucugcuaauuuuuaagaaauauuaacaugggcgaggcaauacagcaaaacaauuaaaagcauaacuccuagaccagacugcuuggguuuaaauucuaaaucuuauauuuccuagauauaugacuauaggaaacuuauuuaauuucucucaaccucauuuuccucagcuguaaaauggaaauaauaagaauauuuaccuuauugggaugauuugaggguuaaaagagcuaauacuuauaaaaccccuggaauagugacuaggauauugugaaagcucaauguuaguuauuguuguuacuauuuguaguggugguggugguggugguggugacaggaaggguaugaucuggggcaucuggaagauucacuuuucuugucucaggauguuuucugaugaagacgucucuguucugugaccccgaauuauuucucuccucucuguugguguccuuuucuuuugggugaacagaucacccaggaaggaguacacugugccucucaauauaacuugguuugaugauuugguguuuauuuuccucucuucauacuucugauaaucacugcaaggguaguuguucuuccuuuuucuccuacucuucccuuuuccccuuauagguucuuugauucagacgucagaaaauaaagauggcaugacuacauagucuuguuuuuauccccauuuccugugccauuccuccauauggaaauguacccucaagugcuggcuagaggugacuaaagugaccaaaggucacuuuucuaccucuucuucccacccccucaaaacucccagauugguagcuuucaaccuaggaagacugcucccagugcuguuucucccuaagaguuaggagugcuguuucacuccuaagaaugaaacucugaccgggacuguugccugaggaaugccccacaaauuggaguaaaucauagugguucugagguuccugggguucuuugcucggggccucagccuccucuuuucuuaaguucaccauuuagauacaauuaagaccuggccuuuagugcuuucacaaacauauauauuaccagagugguugguacccuugaugcacguuaguuuauagccaagcugaacaccugaauaauacaauuacucucagauuggcaaccaagugaauaauguaugcuaucucauagauaauuacuggaaaagacugaccaagaauuaaaaauaaccauaaauauauuuaaggagauaagaaaaauauuugcaauaugaugcaaaaacaagaaaauauaaacacagaaccaaauagaaauauuaagaaugaaaaauauacuaaaaauaaagaauaaagcaaucugcaugauagagaaagguaucccauuuuuaaauuuuguuuuauuuugauuuuuuuugagacagggucucccucuguugcccagccuggagugcaguggugcagucucugcucacugcagccucucccucugucaccuaggcuggagugcaguggcacaaucucugcucccugcagccucgaccuccuggguucaagcgaucauccugccucagccccacaaguagcugagacuacaggcaugugccaccaggcccaguuaauuuuuguauuuuugguagagaugggguuucaccauguugcccaggcuggucucgaacuccugggcucaagugauccacccgccucggccucccaaagugcugggauuauaggcaugagccacugugccuagccagagaaagguauaacauugaugagcaaacucaugaauuggaagauuacauugaggaauucucugagaaugcagcauuauaugauaaagaaagauaacacauggaguaaaaucuaagagauacgauagguauagguagaaggacuaucuagauaaauaggugucuuagaggagagaaaggaagagggaaauauuugaagaaauaauuaagauaaauuuuucagaauuagacuuguagaacaccuuagacuaaaaggacuaguagacuguuaaauaggugaaagaaggaaaaacccaccuugaggcccauuuacaguaacauacaauaauguauaauuauauauacaguaacguauaauaucaaagacaaaaaaauucuaaaagcuuccagugacaaagagcagaucaccuacaaaagaaaaagauuggauuguaccuaaguguugauuugagaaaucugguaucgggaggacaauagcguaaucuuuuuaagguguuaaaagauguugaauacacacaauuuauaugcauccaaaaugugagacauaauaaaaauuaucacacaagaucucugaagguuugcugcacaaagauacguugaaaacacuuuuggaauaaauacucaauaaaagauauaccugggaaauacugcaagagccuuuuaaaacaaagggggaguuggccgggcgcgguggcucgcgccuguaaucccagcacuuugggaggccgaggcgggcggaucacgaggucaggagaucgagaucaucccggcuaaaacggugaaaccccgucucuacuaaaaauacaaaaaaauuagccggcguaguggcggccgccuguagucccagcuacuugggaggcuaaggcaggagaauggcgugaaccugggaagccgagcuugcagugagccgagaucccgccacugcacuccagccugggcgacagagcgagacuccgucucaaaaaaaaaaaaaaaacaaaaaaacaaaaaaacaaagggggaguuuuaaaacagcucccagauucuuugacuauccuucuauagaguggugggguuuauguccguugcucuugaaucuaggcaggcuuggagcuauuuggaucaauagaguauggcagaagucauaugugacuuccgaggcuuauaaaaagcugugcauugguugucauacuuggagagaauuuuuuuaaaaggaaaaaaagaaaaagcagugcggauuuuuccuggcucucucgaugcuaagaauauacaauggggaaagcauagucucuucaguagaugguccuggaaaaacuggauagccacaugugggagaaugaaaucagauccuuaucucauauauguaaaucacauauacaccauacacaaaaaucaacccaaaauggauuaaacacuuaaacauaagaccugaacuguaaaacuacuaaaagaaaagaggggaaaagcuuauugacguuggucuuugcaaagaccaacguuuuuuuggauaugaccccagaaaacacaggcaacgaaagcaaaaauagauaaauuggauugcauugaacugagacgcuccugccaguaauggaaacaaucaacagugaagagacaaccuauggaaugggagaaaauauuugcaaaccaaugaaaacagaagaagaaaaugauaacaagagcaaaaauuaaugaaauaaaaaaacaaacauucaaaacagagaaugucagcaaagccaaaaguugguucuuuguaaugcauaacaauauugauaaaucccugggaagacauacauuacuugacagagaucuuuaucuagacccgggguuggcagaguacagcuugugggcuaaaucuuccugacugcuuguuuuuguacagcuuguaagcuaaaaauaguuuauauauuuuuaaauaguugaaaaauaucagaagaauaauauuuugugauacaugaaaacuuuaugagauuucaaaauuuauuguucaugcagucuuacuggcauacugccacacucauucauuuauguauugccuauggcugcuuucaugccacuacacaggaguugaguaguugugacagagaccauauggcucacaaagccuaaaauauuuacugucuggcucuuuacagaaaaaguuugccaaucccugauguagguuuuacaaagaacuccuacagaucaguaagauaaacaaagacagaaaccaauagaaaaugggcaaaagacuugaacaucgaccuggaagaagaugucuagcuagcuauuaauauuugaaaaagugguugucguuauuagucuucagagaaaugcaaauaaaaaccauagugggauaucacuguauuccacuauaauggcuaaaguugaaaagcucaacaaauaccagacauugguuaggaugaaaaccacuggggacucuaauguacuguugacaggaguauacacugacacaaucacuuuaaaauucugcuuggcagaaucuauuaaaaacuguacacuggcuaggcgcagugacucaugccuguaaucccagcacuuugagaggcugaggcaggaggaucacuugaggccaggauuugaagaccagccugggcagcauagugagacccuauaucuacaaaaaaugaaaaaauuagcuaggcauaguggcacacaccuguauuuccagcuacucaggagacugaagcaggaggauugcuugagcuaaggaauuugagguuacagugaacuacgauugugccgcugcauuccagucugggugacaaagcaaaaccaucucuaaaaaauaaaaacuuaaaaaaacuguacacagaaauacccuaugauauaguaguuguauuccuaggaguauacuuaccagaaauguauaauuauaugcccccaaaaccaugcacaauaauguucuuacugggaauaauucaaaucuccaucaaaauacaaauguagaguagucuuccagucauacaauggcaaauuaucagcaaugaauauugacagaucacugcuacauucgacaauguggguaaauaucacaaacacccuugaagaagccagacacaaaagaauaccuacuauauauauguaauuacauuguuauauauaauuccauuuguguaaacuucaaaaacagacaaaacuaaucuaugguuuuagaagucagaauacugauuacuuuuggagaagggcagaaucguuaccgaauguugcacagcccggcuucugguguguuuauguucaguuucuuaaucugggugguaguuacaauucaagcuguauuguucaugugugccacaugagaucaucucuuuuuuuacuguuuacagauuauaacucauaaugugcaaaaacauauuuggaaaauuuuguuuugagcccugucccauaauugaaagcauuuauuuuucagauagggaaagcagauuuugagaaauaguuggagagauauauauaaauacagucauaccugucugacuucuguuauuuuuuuaagaaguuauagcuauaggaaaugccauagugaguguuaauguagaaaagguuguaaguucauuuuucaucuguuaaauguuucagauuuauugucuuaucauuaacuccuggaguuucuacacaugcagugacgugaauuagcccaucauguauuuccugucaucucagauuguugauaacacuuaaaaugggucaugaggguuuuuuaaaacagaaacuuuuccuuuuucucuucaaacaguuacaacagucugugauacacaugucucccgugccaccaaaaagaaauuuuuccauuuguauuuuuguggaacaaauggauaaauucuaaauuggcuaccccuuugacauuguaaauaccuauaacuaaucuaccacuuaaguuuuaaaccucacugucuuuccuuaagccacagccuaugucacucuacuucuuugacucuucugcucuacucuuaucccuggccacauuaagacauugaucuccccuuuucucucagucuuugugauuucacuucccuuuacuucaugaucaguuacaauauucugcugucauucauuagaacucuuaguucucuuggcuucgggauaaaaagcaaauuccuuaugucauacauacagaguacauccagauccuucauaguuggcuuuuucagcguuaacuggagaggcaccacagaggagugauugagagcaaucuugccccagugcgccuggauuccagucucagcucugucucuuagcuuugugaacuuggccaaguuaauuaauuuaccuaugucuuuguuucuuuuaucaguugaauggguuguuuuaaggauuaaacucuuuuuuuuuuagaagagccagcauaaagcacuuuuauuguaauaauaaaauuggaaacucauaugugauguuguggggagaggggcaacaauuucugucaccaguucacuacacaggacaucaaaggagugacaagggacugaagaaggaaaagccaggaaacguugagaucagcagagagagucaaguggcagaaaacaggagauguugaagcugcgaugacaagcaucauuugcuuaacauucaaggauuugucaugauagcugggcuuucauugggugguuaagucuacaaacaacaccuuuaauuuauacuuucaauuaaaguucuuaaaauuaaggaagugguggagcuuggaaaguuaugagauuacaaaauuucugaaaguccauuagaaaagccacaggauggggcagaggaaauaagccaggccaccaagaaggcuucagagguccccgcuggcccagggacagauaccuguagcauccaacaucgcagugaaaaugaucugcuuucaaaaggcagaggauuucaggggaggguagaguggaacugauggaggcaaaggcuccccauccccaccucaguuuuugguagggcuuuuaauuuaaccgaaggacaucuuucaacuuugagaauaauucagcccucaagagugcgucagaucugcuauggcuuugcagcgcaacagcaagaauguuuaguauauaauagauuaaaauuucauccaaaaaaaauuuaaaauaaagauucuuauaaccuccccccacaacacuaaauccuguucuaaaguuaaccagucacuuguucuguuaauauuugaccauagacuuacuuggaaacuagaucgaaaagacugaagcugaaucaucaccccaaagugaaaaugaaauaaacugaguaacuuaaggcuuauggcauauaguuuaaguaaaaugagaagaaagaggaagaggaaauggaggugccagaagcaaagcugagugacagaacgcauucagucaggguagauguuauacagguuguaguggaucuacauguggaaaagcuccauauggauuuaugugcaugugucuggaggcaccagauccuucuguggcagauguaagaacaggaagccaagggaggaggccauucuugccaucccagucuuagaagcuccauguugaagacaagaguggcaugaugcccuggugcccaguggcacugaaagcauagucuagagauacauucaguuuggcucugugacccacauucaucugggcaaccccuaccucccacucccgggucaccuucugcuugccuagcacacacuuaaagggcucauuucuguccuuugaagagucaaauuucuuuccaucuuaaagcaucccggcuuccggaagguauccaacuccuggggagaugaucuccaccuucgcucccaggacaucggcggaugccggugggcaggcaguguggacugagagggaccugucagugguucccaggcucugccucaucccugcuguccaucaucugcacacaugggcacccccgcacgccccguccugcacuaggaguaaauucuuagcacuuucccccuaaaucuggaauggagauggaguccucuuuaccaaauuaguuuucugaacauacugugcuguuugauagcaguguuccccuguguccccuuacuuccaacuacaauuuccugauagacccucaagauuaguuuacuugaccccucugugaagcuuuucuuaaccauccccucauaauugguuucuuaaaauaguucucuuuuuaccaguaguauuucuuacugauuuguuuauauguccucuucaacuccuacuagacuggaguucuuaucaacaggaacuggucuuacucauuuuuaaaaaucauaguagguuauuaacgaauggaaugagugaaugaaacuuuaaauggaaauuguuaaauguggcaccagaaugauuugauuugauuugauguuugugguuacuuuacuauucauguuuuccuuugcacuuuguuuuucauagacuucuaauguaaaagaaaugggauuaaaagaaaaaucuucugaaaguuauucuggaggaagaugaaccauuaccucuacuuuuaugauugaggucauaauugccaccuucacaugcauacauguuuacaaacaauucaucaguuuuauucauucccauuuuugaccuuuugauaccuuccauaagccaacauaauauuaaaaaaaauaacugaagccauuaaaggugaacuuuccuccacauggcugccaucucugcuuuaaaaacucuuacacauuuauuacugucaugauucaaagcuaagugcauugacgucuuuaaucccaacuccaugagaugcuccacuacuuugacuugauaccagugugucaugcuguuucucuuuuuauuucuuugcccguuccuuuuguuuugccuucaugggcaucuuuucuuccacuuguugauuaaacuauuaguguuccaccgaguucuguugucagccugcuacucuucacacucuaccugcuucugguuucagguauaauuuacauacaguaaugcccagauucccagaccagaccccuugucaagcuucagacauuugcaauuggaugucccacagguaccucagaaaucgcauguccaaaauugaacuuaacauucuucucucaaaauauuuuucuucuuugauuuucuguaucuugauagugucacugccuaccuuuuuaccugugcuagaaacaugaaaaucauucuugauuauuucaaucuuuuuauuuuuuuuccacauucaguucauuagauucucuuucuccuugcuuucacuccccugauucaaguccaagucaucucuuaccuauauuacugcaguaguuuccuaacugauuucucuaguucuaaccuggucucuccucaaauccauucuucacagaguggcaaaagugauuaaaauucuuucauuaaaaacuuggaaaaaugauugcaaugauauaaauggugcuuacaaauuaauaagaacaagauuaauaucuguuaaaaaaggggggagguggaaaacauaguuugcuuacagaaaugagaugaaaauggccaguugaccugaaaagaguucaaccccacuaauuguauaagaaauacagauuaaaguagcccauuuuugcguacugauugaauuuuaaaauaauaaccuacucuuggcaaaauuauauggggauucucauacacugcugguagugguacaaauugauguaaccuuggagggcaguuugguaauuuuaucaaaagcuuuaaaacucacacauucauugaccagcaguuccacaucugauaauuuguuuugaugaaauaaggaugugugcaaagauuuaugcauggaaguaugcaugcaaugauguauauuuaguggcaaaaauuauaaaccacuuaaaugcccaaaaauaggugauugguuaaauaaaacagccuaccuauguaucagaauacaaugcuuccuacaaaaaucauguuuuagaaguuuguuaaauggcaagagaaaauacuuuggguauauuaaaugacgaaaaguaagaucccaaagcaacaugugagaaguaugauuugugccacaaaguuacauuguaaauugcaucagauccuugacuuucuuauaaaaauuagccucacaccaauuaggaagaagcuuuauguaucuuccucuugaggccuucucccuguaauuuucagaauacuggauguuuacuuaucuugaaaggaucauuuuucuucuaagcuccaagcagagagagaacuggauucugaguccauuaaugagugcaugauugucauugcuucucaagguaacuuaauuucaagggcaaccacuagcuacuuaaaaacaccaugcaguuauuuugcuuguacuaucacuucugccuagaauguuccuccuuccacucccuugccuggcuuuccucagaaaccucugaaacucugacuccuaccuauuccuaucccuuguacccuucuuccauuagcugugcauuaauuaugcacauguauuuuauacauuaucugucuuguuuuacguaucacauuuacauuuuccccccaguuuuuguauccaguuucuacccuacuagacugaguucuuugaggacaggacuggaucuugucaaucuuuagauccuuagcaccuaauguaguagugccugaugcuguguauuugaccacaacggauugcuuaagaacauauucuccguacuucuggauaagaugucagacaguaaauuauaauccauucuuuuauaguaugcuaucuguauucagaauauuucagaauuucacuuuauaaacuuuauauuuuuaagguauuacuguauguuagaaaagucuuuacaauugcuuuauaauccuuuauuggggccuuaaucauuuuggauugguuugcaguucuucuuagauuuuuauugcaucaguggucauguuagcuuugagauaaauuccacauuuuacaagcuugaaauaauuuccuaauaguuauguaaauuuauucugaaccacaguagccucauuuccaugguaacuaaccaccuucagaagagaacuuucagauauucuagaaaagaccagaaauauccaugugaaauaaaaugaacuaaugauguaaaguuagaacucagauuuauguggaguacagaugcaugauauuggacccugaaaauguugcagauagaagagccguucaaagaccugaagauucugccuguuugcuguuuguacaucaggcaaaaugcaaccuaagaaaaacucagcuguauugugauuuuuguuacuaaaaugaccccaaugaggaagcuuugugggacaaauaagcaaaauucauggugcagaaauggauuuguggugccacuaagagauuaacauugugcuucacagaaggaauguggucucaugaaaggauauaugguuuuuggaagcauaucccugauuucgagccucuggcaaugugaucuugggcaaauuaauuuauuuacuugaaccucauucuuccuauuuguaaaguagggauaagaguccuucuuuguggugguguugugaggaauauccuugauacagugccugguacauuauaggcauucaguaaauguaccucagcuaauguucccagggcucagagaaucuuuccuuuguaagacuccuucacuugauucuguugucuuugauuucuuuuuugccuucuaaaggauucuguuuccuccuuagauuauuuaaauugacaucucagauaacuuucuguuugcuuuuguuccaugccaccagccauccaucagauggcaccauguuuuguggucuuugagccaagccagucacaccccauuccucaugcccagucuagcuucuuaggcuuucucaccuaagucugugcuugcugggcuccugccuaucuaggacaacaugacaaaauacuaguaaauauucuucauucuuuauuuaaagagcauaacaauugauaauacgaggacaaagucaugucccuuccagcccagaaguaagugaaaagauuugacuaucauuguuggcauuacucugcuucuuagguuaucugucuugaucucagaauuucaagcauuccuuaauaauuagcccacucugggucucuuauuuauuaauuuuaacuaucuuuucuuggauauauauucuuuuauuguauauauucaguuuuauugguggaaugucuuuuuuuuuuuuuugagacaaaaucucacuaugucgcccaggcuggagugcaguugcgcgaucucggcucacugcauccuccaccuccuggguucaagugauucuccugccucagccuccugaguagcugggauuacaggcacccgccaucaugcccggcuaauuuuuguaguuuugcuagagacggguuucaccauguuggccaggcuguucuugaauuccucaccucaagugauccacccaccccggccucccaaagugcugggauuacaggcaugagauuauacugcaccuggcaaauguuuuucauguaguauuuacuaccuuauuuuuauugaaccauauuucuucugccuuaaagggguaucaucaaaucuacaagcuuugguuaagagaaccaugacaggaagaaucuuaguaauuuuaauuauauugucaguaagcuucuuguauuaaauauauugaaucucuuaaacuucauuuaagaaauucccauucuccucuucaauuuuaguuagguuccccuuucuucauuaaagagaugauagaauuaggaacagcaggaaaaguggagcaguuuuauaauuuuuuuaaaugcccccuuucuugcuaaaaaucaaacuaaagagcuccaaagugggcaguggaaagauaauguccuagugaaaagaauaucuaaaacagguuucuucauuuuguauuucuucccccgcuaccuauuucuaccccuaacuguuaaggguguauugauggcacuuucauauaaacccaguuuacacacaggaauggggucuuaccccaucagguccccacaggagcauuuuauaucagagcagcacaguuacccucaguuuaucugaaaguuacaugcauugaauggugauuuaaauucugagaauaacugacaaaaagcuaaaugaaucuaaauuauucuacuuuuucccagucccuauuguaaugauaaccaagauuucuuuggucuuuuuuggccagagaagucucuuagguugaaaucauaucagugguuuucaaacuuguuuuuuuuuuuuuggccagggaacucaagcaaaaucauaauuggaagugagauauuuaaaauagauaaacauggaacuacucagauggaagcagggcaggguaggaauaguugccacacccagacccuccauuccuuguuuagauuuuuuucuuguugaugauuucaaauacagaguuuuguccaggggccguagcucaugccuguaaucucagcacuuugcaaggccgaggcgaguggaucacgaggucaagagauugagaccauccuggccaacauggugcaaccccgucucuaccaaaaauacaaaaauuagcugggcgugguggcaggugacuguaaucccagcuacucgagaggcugaggcaggagaaucgcuugaacccuggagguggagguugcagugagccgagauugcgccauugcacuccagccuggcgacagaguaagacucggucuaaaaaaaaaaaaaacaggguuucagugaccauguuaaaaguaacagcaaagauacuuuucaaacacuauuuauucuguaucuacugcaaauaggcagaaggcagaauccaguaucacuggagauacaaugacauauagggcacauucucaucuucaaggauacaguaggugauacagagaaguaguuagacauuucugucccaggaugauaaaaacuauaagauuacgugucaacuaugucuuugagacuuauucuuguccaggugauuucagugauucuugugcagaaaguagaaggaaaaaaaagauacgauauuuuuaacagauaaauuuauucuuugaauucuuaacaucacauuaugaauuagaaaugauaguacaucuaaacauuuuuaaaauauuuaagaaauuuuuaaauuacuacauaauauuuguacauauuugugggauacaugugauauuuugauacaugcauucaguauuuaaugauaaaaaucaggauauuugggauuucuaucaucucaaacauugaucauuuccuuuuguugggaacauuucaaaucuucuaguuauuuugaaauauauaguauguuauuguuaauuauagucaccuuauuguugcuaucaaacacagaaacuuauuucuucuaucaacuguagguuuguacccauuuaccaaccuucuucauccccucucaccuugaucucuugcccagcacacacaccuuucccagcuccuggaaccugugaaagaucuaauucaguaaugaucacagaccuaaauaguuuguaguuucaaagcagaauuuacauggacugaauuugacuugugaacuuugaaauccugagaaaugggucagaugguuguucugugccauuuucaaaaccaaaucauuuuguaagauccugcugucugccauccuuuuuaaaucauguuuuacauaguauuuuuuuaaaagaacuauuuuucagaauacagugcuuuucuccuuuuuaaaaaaucuuaaucauaguaauuucccaauaagaaagcaaaggugguaaagaauacuuuuuccuaaggaaaaaauauuuuauaauuguuuucaacauuuuuuuguguuagacauuuuucauaauaaaaagcugaaggaauuuuacagcaaauacccaccaccuucagucuucaguugacauuuuacuguaaugcuguaucaaauaucuaucauuauauuaaucaaucuaaauuuuuuguuacauuucagaguaaguugcagacauacccagauccuuaagcauucauaucauuagcuaagcuuuaauauuuuguuugcaguuuuuuucucuuucgagguaaaauuuauauacaguguaaugcacaaaucuuagaugugcuguuuauguguuccagcaaauacacauuacuauacaaccaaaacccauauuaaaauauaaaauauuaccaccacugcagaaaguuuccacauuccucuucucaguaaauccucugcuuacuaccccagagggucuauucuuuuguuuuuuauuccccacuauaaauuaguuuugucuguccuaaagcuucuuauaaaaguaaucauguugucuguguuuguuuguuuaaggcuucuuucacaaagcauaacguauuugagguccauccauguugcugcuuguauuagaaaccuguucuucuuuguuaaugaguaguauuucugaguaguguaugccaggccuuuucccagaguggucauaccaguucacauuccuaccaacaguguaugugaguucugguugcuccacauucugacccacauuuaguggugucagucauuuuaacuuuagucauccugguagguguauaguagcauuucuauaugguuuuaauaugcauuuuccugaugaguagugauguugaauacuuuacgauugcauauuggcuguucuggcaucuuccuuugugagguauuuucuaaacaguguugauuuccuggguagaugguacauguuauagacauauuaaaacuaauucuuaaaguguucugucaggaaacugucuacuuauugauaccugaaaauaguggacaauaaaaaaaauugauauaauuucaagccuguuuuacaugucuuuagaaauaguugauuuuagcuauuauuuauuugugaguuuguucucacacugcuaugaaggaauacccaagacucgguaauuuaugaaggaaagagguuuaauugacucacaguucugcagggcuagggaggccucgggaaacuuagaaucauaguggaaggggaagcaaacauguccuucuucacaugguggcaggaaggagaagugccaagcaaacccuuauaaaacuaucagaucucgugagaacucacuaucaugagaacagcauggaaguaaccacccccaugauucaguuaccucccacagggucucucccacaacauguggggauuauggaaacuguaagucaagaugagauuuggguggggacacagccaaaccauaucagcuucuauuuugauuauuuugggauuugaacauuuucuccauguaaccauuugaaauucucuugaagaagcaaaagaacaaucucaugugcugugaaauaccuguuauuuauaaauggauucuaaauauuuuuggccacauaaacuacugguucagaauaucugugccuuuaguaaauaauugaauuugccuauuguauuagucaggguuauccaaagaaacagagccaauaggaagcauaaguuuuccauauaaauaaauaaauacauaaauacauguaugugugguguuaugaaauauguauacauauauugguuuucauccccaguuccuggcgcauaucucccauagccuuuguuacagucuucucuuauguuggguauguuaggccucaggggcaggccuuaggaaacagaaucucucugaucuucuccugcccuccuuucaccugccccaaggcucuaaucuuccccagccuuucugaugguggguuuuaggacccuucccaaagaggggcccaccucauaugcuggaggaaagaauacugacaucaugaagcuuucauaaaaacucgggaggaguggguucagagagcuucuggauagcugaaaacauggacgcuccuagagggugguaccccagggaggacauggaagcucugcgccccuuucucccuaccucacccuacacauuuccucauuguaucaauguccuuuauauuaaaccagcaaauguuaagaaaguguuucucugaguucugugagccgcuccagcaaauuaauugaacccagagagggaguccugggaaccuccacuugaaacacauuggucagagguucuggaggacuaggcuuguaaccgguugggggugggaggaauucuggggagugagcccucaucaugugcaaucuaaugcugucugcagguagauaguguuggaauugaauuggagaauacccagcugguguccacugcuaggugugugggggggaaacucccacauaauuuggucacagaagcguucuucuguguugaugauugugguggugugagaguagaaaaaaaaugcagcuugagaggguguuuuugaaacuguggguguauguuuagagaaagagagaagagacuuuuauuauaaaguauugguucacgugauuauggaggcugagaagucccauguucugcuguuucuggagaccugagaaagccagcaguauaguuugaaggccugagagcuggagagucagugguuuaaauucugcugugagucugaaggccugagaaccaggagugcugaggguaggagaagaucagugucccaacuggaacaggcagaaaacaauuucagccuuuuuguuucucauuggacuggaugaugccaacacacauugagugccaucugcuguaacucaguccacagauccaaaugcuuuucucuucuggaaacacccucacagagaggcacagaaauagugaguaaccagauaucuaggcaugccauggcccagucaaguugacacauaaaauuuacugucacacauaguauacucgucuucaucuaauuacaaauaguuuaaaaaucuaauuacaaaaucuaaucacugcauuggcaaaacaccauuucuccccaaaacccuggagaaaucuucccaugcuuaugagguguaaauuauuugugaagcauuggcccuaccugaaaucugggucaaagggaacuacagaucuagagcauaucacaccaguguguuaaagugaaaaaauaauguaagcaaguuauauuggcgaaagucguuauugucagccccuuauucugggauuguaaugguugauuuccaaugauuacguaauauaauuauacuuuaaauguaaauaaugcuuuauauuauugagggucuaaagggauuuaauagauaaagugcacguuacaauaccugacuuacaucugauacugaacaaaauuuaguucucucuuguaaaacccuauguagagguauuguuauuaguccacugacugauaaagcuucugaaagccuccgaauuauauuuuccucuuuaaaccuuaucaaaaauaguuguuccauuuuaaaauacugcaagaguuaggguaguagaauuaugaggcauuuugacuugccaagaaauuuaauuauaguagaaauaauaucaagcaauuuuuauuuuauuuccaagguauaauuuauacugugucacauuuacauuauauggauauaccugacaaauuuuuaaaauaucuuucauauuaacaagaaaguauuuucacauauauuaggucuuauguccuuuuaaggaaaauugauuucccuaagauuacaaaacacauuuggaggcaaagcccagauuaaaagcucaggacuucugauuccuagucuaguauucuuuaaaaaaaaaaaaauuuguaauaguugguguauauauuuaucggguacaugagauauuuugacgcuggcauacaaugcuuaauaaucacaucaggguaaauggaguauccaucacccaagcauuuauccuuuguguuacaaacaguccaguuauucucucuuaauuauuuaaaaauguacaauaaauuauuguugacuguagucaccuuguuuugccaucaaauucuagaucuuauuaauucuaauuauauuuuugugcucauuaaccauuaccccccacccacuaccuuucccagccucugguaaccaucauucuacucucuaucuccaugaguucaguuguuuucauuuuuagcucccacaaauaagugagaacaucugaagcaugucuucugugccuggcuuauuucacuuaacauaacgaccuccaguuccauuaucugauaugagcguagcuaguccugcucacuuucaguuucucuuggugugaaauaucuuuuuccacccuuuuacuuucagucuaugugucuuuacaggugaguuuauugcaagcagcauauaguugaaugaaguuuuuaaaauucauuccaccaaucuauaucuuuuaaguggagcucuuaauccauuuacguucagcauuaacauugauaugugagguuuugauccuguuacauugugaauuguuuucuaguuguuuuauaaauuuguuguuucuucuucugucuuuuggcuugauggaauucuguuguguugccauuugauuccuuucuuuuucuuuuuuugugaguuuguuuuauaaagucuuuguguuuuuuuuuuuaacuuguguugucaugguggugaaugucaaccuuucauuaccacauuuaggucuccuuugagcauuucuuauagggcugguuugguggugauaaauuuucucagggaaagacuuuuucugggaaagaauuucuccauuuaugaaucuuaaucuugcuggauauaaaauucuuggcugauguuuggugguggugguggugauacugaugguggugguggugguuuuccuuacugcacuuugaaaaugccagcucauucucuucuggcuuauaaggauucugcugagaagucaacuguuagucugaugggguuuucuuuauagguaacuagaugcuuuuuuucuugcuaauuuuaaaauucuuucuuuuacuuugacuuuagacagucugauuauaauaugcuguggugcauauuccaaguccuuuuuggaauauauuuuccucaggaucucuaggccuccucuaugugaaugucuaacucucuugcuagacuugggaaguuuucaucaguuguuuccuuaaauagguuuucuaaacuuucugauuuuucuuuccccucaggaauacccguaauucacaaguccagucacuuuauguagucacaaacaucuugaagucuuuguucuuuuuuauucuuuuuaaguuuuugucugacuggauuauuucaaaagaccugccuuaaaguucugagauucuuucuucuguucaggcuugucuauuguugaagcuuucaaauguauuuuguaauuccuucaaugaauuguucaguucuagaauuuguuugaagauaucuaucucgauaaauuucucauugguauccuaaauagauguucugacuucuugguacugguuuucagauuucucuugcaaucucauugagcuucuuuaaaaucaguauuuuuaauucuuuaucuagaaguucaaggauuuauuuuugguuaggaccuauugcgggagaauuauuguguuccuuugaaugugucauaauauguugcuuuuucauacuuccuauaucuuuacauugguuucugugcaucuggaguaacagucacuacuucuuauuuuugaauuugcuuucauugaguggggagacuuuuuauugaagauaugucuauaauguugauuggauagggcguuuuggcuuuccuucuggguaugcgcaguggcuuuaaggauucugugugauuuccuuggcuacagauagccuuaguguuaaaucuguggauuuuucuguguguuagugugcaguuauugguggagucugugaugagguuuugcuggagacuggaaugccucauggguccuucagugguagugguggugggcuaaguaugucuaucauugugaccugguaugugguauaugcuggcacccauguugguaguuccagguaggcugauucuuuggccacuggguggcucucucaaaugccuguuguaguagagguagaccaugcaggugagcagacucuugaccuacugggaagccagggugguaugggcaaugggaauagcaguaguagugagaagcucuucucauucacaaguguugugcccuuguuuuaucaguuguugcaaugggcugugcaugucagccuccaggccaguagguggcacuugcagguaauagccagcuauauugucaacaguagguuuuaugccuaaccucuguuucugaggacaagugcuugcacaggugucccagaugguggauugaguugcagaauucucaggaaccuggaucccccuaaccuccacuucccucugcggaguaggggccaagcugaguggagcuggagcaggcaagcuuguacucaggccucccaauggugggugcaucuaccuuccuugacggggguggcagggcaguucucaggccccuggugaaauucuugggugagggaugacuguugcuaugccgaagucuuaacauggguauggaggggcagucccagcagccacagauguggcuuguguaaguaggacuuacuuccuucucaugccccaguccuggcagaguucccucccacuccuaacuguggcagcagaucagccuguucagucauggcaguguucugcaacucaguccagggccuuaggagauacaacccagcuuaaucccaagccuccauggcagcucuccuccugcucaggucccaagcagguagggggauaccccaguuucaguaucagcugcccauaccaguuucucaguucugguugcaggaguccagacucuugcuugagucccaguucuucaagccccagcccgaauuucugacaccaaagccuggcacugccacuuguucccaggaccauccacagcuuguuaagagcugggauugagaauggccucuuacuguagcugccuauaucugauggaauguaugggacgucccuggagcaguuccuuguccagucacuccccaggugagauccaggauucaggagggucaaggugcucuccuacagccuggauuguacaauuccccuguggaaacauggacugcagaaauacacucacucacccucuccccuacuggggauacauuccugauuuucagccaguccuggccacacggguuaccuguuuuccuucuucucagauguugaaguuuccuuuugcuuuucucuugaacucccaugcucccucuuggauaauauauuuaaagugugauugucuacacacaauuuuuguucuucuaaguggaugagauaugcuggaaaugcuucuacucagccaucuuggagagaaacuugaaauuucugaaguucuguagaucuuauccuaacucuguuuuauugaaaacuuuaacaauuccuacaucaauacuaauacuguuucccuuguugauauuuuguuggaaggaucccuucucauuguucuuuuaaaaaaaaaauuguuuuugaccaaaugugguggcucacaucuguaaucccagcauucugggaggcugagacaagaggaucgcuugaggucaggaguuugagaccagccuggccaauauagugaaaccccaucucuacuaaaaauacagaaauuagcuggcuugguagugcaugccuguaguuccagcuacuccugaggcugagacaggagaauugcuugaacucgggaggcagagguugcagugagccgagaucguccugcugcacuccagccugggagaaagagugagacucuuuuuuuuuuuuuuuuuuuuuuuuuacaauuuuuucuucuagauggccugcagauucagcuuguuaaauuugauaaaauuucuccugggauauuaaauggcauuucauugacuuuacagauucauuucaaaagaauugugauugauauauuuacagaauuaagucuuuguagccagguguguguguauauuauuauuaccauuuuuuugagacaggaucucacucuguugcccagacuggagugcaguguguggucaucgcucacugcagccuugacuuccugggcucaagcaauccuccugcuucagccuccuguguaacugggaccacuacgacacccagcuaauuuuuguauuuuuuuguagagauggcgaucucacuuuguuacccaggcuggucuugaaauccuggccucaagcauuccuucugccuuggccuuccaaaauucugggauuacagucaugagccaucacaccuguccucacuuuuauuuuuaauuaaauauuuuuaauagauaacauaugaagauguucuagaaaggauauauagugaaauauuacugcuaugucccagcccuccuccacagaagcaaccauuauuuuuuucuuauccuucuagagauauucuaugccuguucaagcaaagaaguguguaaaaauagcauaauagguguaacaagcaaucuuagagauugucaucaucaggagcagauccagcuuuuuugaggucugcagugaaaacuacuuuggaggccuuguuuaagacagugaguagcgaggugugguaauacacaccuguaauccuagcuauucaggaagcugaggcagaaggguugcuugagccccggaguuugaguucugccugggcaacuauagcaagauucugucucaaaaauuuuuuuaaaaagacagugaauaccaaacuauguacaaaaugaguaguuauuuagaacgagaaaagaaagcacaauaaacuaguuuuucaaagcugauaaacacuacaaacguuaccaaaacccagaaaaaacagcacuuuaaaaauauuaccuuauacacguauguguuguaauauuuguuuuugcugcauuuuguuucauugucuccucauaugucagugauuuuguaagucauuuucuaugaaaauagaaagcuaauuuggucuuuuccuccaguguuuaagauauagucauuugaauaugacuccacaccuuugugucucgguguuggguccuguuaguacagugggcagaaggaguauuccuggaagucuuccuauacugagacaguuuagguauacacaaaaguuuuggcgaaaaccacauaaauauaucccacuaaacccacuaaugguauauguagcucaauuuccucuugacuucucuuaaguacaaaaaugacuucagccacuccaucaugaccuggcauaagggcaagucaacauggaagcagcagcagucuugauggacugugguuaaaauagcuuacuauuuggugguuccuaaucuuuugcugcuucaguguucagggaauauccuuaugucuuuaugcaaaugugugaguguuucugauagaugaaucucuugaggugaaauugcuguaucaaagaguuuauacaauuuagauuuuuauagauauuacuaaaucacccuauaaaagauuguaucaauuuauaucaucaccaauauauauaagacugcccguuucucauacucuuguuauuugcauauuacuuacaugagugagguucaacaucuuuucucauauauuaggaaauucuguguauuuucauuuugugcacugucuauaucuuuuacucaguuuuuauuuguaauuuuuuucuuauuaauuuguuggaacuuguauauauuagggaaauuaguucuguuaucuguuuucccccuguucauugucuuuuuacuucaugauaguuuuuaauuauguauacuuuuaauuuuucuauguaguccucuugaauauacaaaaaccccaaaacaccaaacuguuguuuuuccuauucucuacuuucugcucaacgcagaaaaccucugugaucccagaauguggggguuauuuccccacacaccaagcaguacuucaguggacaccugcuguauguccuauaauucaguucaguucugacacuaccuaccuuucuauuuuucuaauagaaacaguacuacuuacuaaauaccgaguuuauuucauauguauauucuugccuccucaccauuuccauguagagauauggcacuggagagagugucauaucucacagguugagagcucaggaccaccagacuaccaucucucuucaggugguagucccaagucugggucuccagaacuucugacugacuagcuacagauugagguucccaugauccccuuguuggguuuuauuaauuugcuagaguggcucacagggcucagggaaaugcuuacuuaaauuuaaccguuuauuauaaaggauauuacaaaguguuaaacagcauagggcaagguacgugggaaggggcauggacuuuccauguccucucugggaaccacccuucaggaaccugcaugaguucagcuaccuagacgcucucccaaacccuguccuuauaaguuucuauggagguuucauuguguaggcaugauugauuacaucauuggccacuggugaucaauugaaccuugagcucaucuccccuucuggaguuuggggaauggagcugaaaauuccaacccucucauguuugauuccacuguuagguagcccucaucuggaggcuaucaaguaccccaucaagacuugucuuauuauaggacaaaaguugcuccuaucacccaggaaauuccaagagauuuaggggcucugugucaggaaaccaggaugaaguccaaaggcagauuucacaguaucacaagccaauauguuuaaauuuucuuuugugacuuccgaguuugugucauacuuaguccucccuccaagauuauauuuuuuaaaaaucucaugucuucuagugcuuuuauggcaguguuugguuuuaaucauuaaauuuuugauacguauggaauuuacuuugguguaagaaaugagauacaaauccaacauuauucuuuccaagugauuacaguuucuaggauuuuuuauugaguuauguaucuuuucccugauguaaugugucacuucaaucguaugagaauuuucauacauauuugcaucuauaguugugccuccauuuuuuuauuugaauagaaacagugcuacuuauuaaaaugccgagguuauuucauguguacauucuugucuccccaccauuuccaugucugaccacugcuacuacuguguccuaucauaacauuccauauaugcuuaaauccaagcaaaggguggauuuccaucuuuaaaaacuaagcaggcauuuuggacaacacauucuuggcaguggaacuuggacaacauuuaucaaacauauuagggaaaguucucacucuacauuauaaaaaggacaacuguauaucaaauguuacauaagugaaauaagauggaaacauuuuuaaaacugcuuaaacuauuuucuuaaagagacuuucuccacugccagagaucuugaauuaccuccuggucagucuuccagaagcaauucuuuauauaauugacgaacuuggcuuccacuuugggaagaaaaccagcuuuuucuguacuuccuugcuguuuugcuuuaaugucuucuacagaacuagguucucuugguguuuuaggaaguuuguuuguuuuuuuuucuccuguuuuuugaaggauucuugaucuugguguugaugguuuugaaucuuuuccauuuugguuugauuuuugugcauuuuuggcuggagugucucauacagauuucuucaguggagcuuauucuugucuccucuuccucuccacaacccggguaaccuugcuaccaccuccaggggcagaucacuuuccaaauguaccuaagaguuucauguccuccucuucuugaucuucuaagccucuucaccuuccuccccagcuccuaagugcuguuaccugauaugcacaggcccugaaccauacuucaacccaaaggccaugggugguguuauuucaaagaccccaagggaaaucauuggcuguucaaaucaucauguucaaaguugccacuauuacuuuauuuauuuuguuuuguuguuguuguuguuguuguuguugagacagagucucacucuguugcccaggcuggagugcaguggugugaucuuggcucacugcaaccuccaccuccuggguucaagcaauucucaugccucaaccugcugaguagcugggguuauaggugugcgucaccaugcccagcuaauuuuugaguuuuuguauuuuuaguagacuggguuuaauauguuggccaggcuggucucgaaccccugaccucaagugauccacccaccucggccucucagagugcugggauuacagaugugagucaucaugccuggccaguugccaguauuauuuuaauuggacugccuucguaauucauugucucugugucaacaaucugcaguucaucauuugcaccagccucuaagcugaccauucuuaaagauaacugaugcucauuuucaucauuauccaccuuaagaugguaauguuugucagccuuugguucacaaugaaaaacaugguccucaggccucaggggcucauguucauguccauugaaucuuccauggggugguggcacacacuuaggugggagagaaagcagauagaaaugaacaacuauugcuuaagagaacagccacacaggauggaaucaaaccaggcgauucuuuaauauuuuguuuccuuaauaaaauuacauauuuuucuuccuaaagguuuuauacuuuacuuguuagguacguaucuauuuuauuguuuuuguaguuaugaauuugguuuuuagauuuacauuuucugauuuuuuuuugauacguaagaaugugaaugacaacaaaaaacauguuaaucauuuauucugcuaguuuaccagagauuuauauuucauucuaauaguuuuucagcuuauucuuuuggcuuuuauuuuucuuuuaaaaauuauuuaaguaaugcaguaacauuauuaaagaaucaaaccguaucaacaaaguaaaccuccuccuuuauugccccuuccccauucccaccccuuuccucagaggaugacuguuauuaguuuaguguguaugcuuccaggugucuucaaaaagcauuuacauacauguacaucuacaaauaaauuuuuuucauuagcagauauuauaucaucuaguuugcucugcaaauugcuuuuugucauuacuguauuuaaauuucucucuguuuguaccuacaggacuauaaucaguauuuaaaugccccaaagcgauguuuaucaaacuuuaauguaccugcaaaccaccuggagaucuuuuaaaaugcugaaaccgauucagaggguuugggguggggaaacagagauucuguauuucuaauaagcucccagauguugccagugcuauugguccuauacuacacuuugauugggaaggcuguaacauaugcuuuagaccuauuguaguuuguguaauuauuauuccuguucaugaaaucauuggggucccuccccacuacagauaguacaguaaugcacauuggaauuucuccaggugagagagauuuucuugaauauucugaguagacagucauugucaugauguguguguaugugugugguaggggccggugguggauuucuccaacccuuuucccguauuuguauuuuguuucuuuuucuuauuuuuuuuuuuuuucuuauuuuuuuugagacagagucucacucugucgcccaggcuggagugcaguggugcaaucucagcucacugcaaccucugccucccauguucaagcgauucuccugccucagccucccaaguagcugggauuacaggcacccaccaccacgccccgcugauuauuauuauuauugguuuuuuuuuuuuuuuuugagacgaagucuuguugugucacccagguuggagugcaauggcacgauugaucucagcucauugcaacuuccacuuccuggguucaguccauucuccugucucagccuuccaaguagcugggauuacaggcacaugccaccacacucagguaauuuuuuguguuuuugguagagacaggguuucaccauguuggacaggguugucuugaacuccuaaccucaaguaaucuacccgccucagccucccaaagugcuggaauuacaggcauaagccaccacgcccagccucuuuuucuuauuuccuuaaauuagcuaggacgugcaguagaauguugaauagcuucaucaauagcuacucucugacaggaauaugaaauugguacagccuuugguaauauuuaccaaaauguaaaauacaaaaacaccuugacuuaguuauucccuuuaagaaucuauucuucuaaaacccuugcacaugcauacaaagauauguacaaggaugcauauuauagcauuuaccuguaguagaaaaaugaaaaguaaccuuaagugugcauuaauaggagaauaauuacauugggauauggucauaccauugaccuacuaugcuauauauguggcuacauguauacuaauaugcaguauuauuaagagagaaauacaaguugcagaaaauuaguuauugguugacucagucuguauuuuauuuuauuuuuuagagaugggggucuugcuaaguugcccaaauuggagugcagugguguaaucauaacucacagcagcuucgaacuccugggcucaagcagucuccugccuuugccuccugagugacugaaacuguaggcauguuccacaugccuggccaauuuuuuuuuuuuuuuuuuuuguagagauaggggucucacuauguugccuagacuccagucuguauuuuaaaaacaaguuaaguguguguguauaugugauguguuuuaaauacauagaaaaauguuuggagaguucacacaccaaaaauaugaauaguauuucucucuaaggaggguacugguguugacagguaguuugaagcuugauaaagaggaggcuuuuauguuuucuguguucuguacaccuuuuauacugaguacuuuucaccuucuuaacuuugaaaaugauaaaaaggaaaguagagagauggagaaaauaaagcaaacaauacugucaguuaacagaaaaauccaacuguagaacaguagggagaaucagagagcaggugaauucaaaccauccaguagucaauuuucuuaaauagucaacaagcaugguaaaaaaucaaaugguacaaaaacauaugugguacuguuacaguccugccaaugcaccacaguguagcaaucucuugugagauaucaccuggaguucagaguucuuugucucagugaugaagagaauuaaggggcguggacacaaagggugagguuggaacaaaaguuuaauaagugaaagaagacagcucuccacagcagagagaggacccagaagaggauugccguuuuuacaguugaaugcaaaggcuuuuuaaaagaaaccagugagggcugaacaucucauuuacguaaggugagaauuucugauagcucuacccaguccuccuaaugugcaugcaggcgguuagcuugaguuauuccauaucgcuuuguuccccuuacugcacaugugucaggagacgggauuuuccauugugggcaugucugggcaagucaccuguguagccuuucuuaucuguguggcuguggacaugucuuaggcaaaccucccugugcaaguucccuuaucugugccugcagcuugauuuuucagguuguucuguuugaaauaauuccacugaggacccacccuaacugccuaccuuaccgguuucuuccuuucuccucucucaguacugugauaccacccccauaccugcuauaguggcuucucucuaaaaacagaaaauagcaaguguugguaaggauauggagaaauuggaacccuuuugcacuuuugguacagcgaaaaguauaguugcugguaaaaaguaugguggcgccuuaaaaaaugaaaaacuagaauuaccauuugaacuaacaguuccucuucugggcauguuaccaaacugaacuucggucugcccacccagugcagcaaagcuaaacacugacauuuggauugcugcaaagagaaauggagauguuuauugcagggcaccaaacaaggagaaucggauagcucaugcuuaagaccugaacucuccaauggcuugcaagcaaggguuuauaaaggcagggggaaauuucaggaagguagaaguuauaggcaaaaucauaaggcaauacauggagguuauacauugguuuggccuaaaagggcgggagaucuugaagugggguuuacagguuguagguagauuuucugauuugcaguucauuaaggaagagaaguuuuguuuuaaaaucuggggaucagcagaaaagaauauuaguucuggcucaugggugugacuucucccaagucccucaggaagaacuuuaggacaaagauauucaguccucaguucccccuuaccugauguguacaugccaacagauccauuuggugggguccagguuucugaaaaacaacccagggacauguguccaucaaugauagacuggauuaagaaaauguggcacauauacaccauggaauacuaugcagccauaaaaaaggaugaguucauguccuuuguagggacauggaugaagcuggaaaccaucauucucagcaaacuaucgcaaggacaaaaaaccaaacacugcauguucucacucauaggugggaauugaacaaugagaacacuuggacacaggaaggggaacaucacacaccagggccugucaugggguggggggaggggggagggauagcauuaggagauauaccuaauguaaaugacgaguuaaugggugcagcacaccaacauggcacuuguauacauauguaacaaaccugcacguugugcacauguacccuagaauuuaagguauaauuaaaaaaaaaaaaaagauguugccuuuaguuucuauagggaaccaaacaucccacgacucuaacuuccuuggcuauuguuuuaagcugcuauuacccucuugcuuaucaaguuguucauuugcuucucagggccagcuaggugccuggaacuucucuugaaggaacucaagauuuuccuuuauuuccaugcugggggcgggggaggcccauaggccccucaagggguuccugcuccaucugagguccauguucaaaagaauugaaaguaggucucaaaaauauauuucuacacccacauucacagcugcauuauucacaauaacugaaacauggaaacaacccaaguguacgaugaugaaugaauggauguuagauguuguguauacauacaauauugagacaucaagcaaagauuaaguauguuuaacuuuguuaaagaaguggagccuauauuuaauaaagguuuuugugaauuuuucaaaauaaaaauugauauauagaauacaauuuuucaaaguuaagagcuuuagaccguaagacccaaaguuugaggaacauugcauuacaauuaaaucaugugaucacagagcuaacauguaaacaugagcacaaauguuggugcugaaauuucauguucaugaaaauuuuacaucaucauaaacauuuaaaagcaaaauuuaaaauucaugcagaaagucagacacucaagaguggacuuaggagaaacaaugauauaaaacauugaauucuuaagaaacuugagaauccuugaaaaaaauucuacuaauaugcauugagcaccuauuuugguuuaggccacugggauuucaauaguaaauagggcagucaagggcuagaaacaggaaagagugagggacugugugucaggaaaugcuucuuuaaggaaguuuuuuguuuuguuuuguauuuuugagauggagucucccucuggugcccaggcugaagugcaguggcacagucucggcucacugcaaccucugccucccaguugauucuccugccucagccucccaaguagcuggaauuacaggcaugcaccacaggguccagcuaauuuuuguauuuuuaguagagacgggggguggggggggggggucucaccauguuggcuagguuggucucgaacuccugaccuccagugauccaccugacuuggccucccaaagugcuaggauuacaggugugagccaccgcgcuggccgagaaauacuuuuaauuaguaucagauggaugaguaccuguuagcuaaauugagggcuaggguaaggaaaagacaaugagacuaggggcaggauugggaugaaaggagagaaauauaauuucauagucaaguggaaacauuguuauaauauuacuucaaacuuacaucauaaguuaaguuaugaugucaccuguuucucuuggagaagccuauucaccuucauuggaaugggaagcuuucucaagaaaugucagaggauucaaauauauucuugcuuuguuaguugagucaguaccaauaguacacuugugauuagacugucaaacaaaaucccugaagggauuucacacuguuaaaugcuugguuuuuauuuguuuuuauuuguuggguuuuuuuuuuuaaacggcauagauguaaauuugugaauuacagaaaagaagcaguuuuaacaugaaauggacaaaauugauuucuuucucugcuuacagagcuuaauaagaauuucaguccauaagccuuucaaaugaaacaauagaaacuccaacaauucagagcuaauguaaaugaaaacgguuaucuuccaaaucacagcauaauaaaguaaccuugaaucauugguguuggcccuauauuguuauuuauuugaauuaaauggcaauuuucagcauuauguaacagugauggaauuaagugauguuucuaguaaaagaauuuugcaaguauaauauauuuuaguauuaaauuccacuuguacauuuagcaauuaaaauuauuccugaaaugaugauggcauuugaagggauagggagcugucaaagaggauuugaagcuuaauuaucucuuugguaacaaaaugcauaaucuuccauuacaacacuuauuuucuuaugguaauugacucauuuguucucugguuaucaauuuaacuucccaaccacaaacaucugcucuuacaauuguguuuaauuggugugaauacuaucuacagaguaguuaaaauccagaaaacauuuuaagggcauuauuuuauaauucaugaaagggaaacuaaugauuaauugaacauugcuuaugaugauuuuuucuaauagucugugaaagucuguuuacuaaaaaugcauaccgaaauuaucugcuccccccuccuuuuuuuuuuuuuuuuuuuuuggaagaggcuuuugcuguguuuuccagaguaauuauuuacucugccuuagggggagccucaguucuugcaguucuuuagacucaaggaauauguuaaugucuuggaacaugguaccuuaguaguuaagaguauaggcuuugaagguagaaaaaaauuaguaugcuaucauuuauaaucuaaauaagaggauuggggacaaauuguggguguggguaugugcuuauaauuuucauaauggaauaauaaaucauaaauuuaccaguaggguaaaggaggaaauaggaugagagaaacaggguuagaagguagguagguuuguuugaauguaccuugucuuuauagauuuaaaaauuuacaaaguaguuccugaaacuggaaaguaaaaugaaacaggcgacuccaaagguguauccaguugguaauacagccacacaguaaguuacaauucuaaguauauggaauuauaauuccauguaaauuuaaaauuguaauuggacuauaauguaccuagugggauuuacucuaaggacacaacugcaaaaaaucuuugguuguuuucuuuuaucauauuguugguacagauguuuauucugagacuauggguguaggauaaaguaaaugaguaauuauguuagugucauugagaacagauuuuuggcuugagauacagauguaaaauuaagaagauucagcuaaaagcuacagucuuagacuuaauugaaaauaucaguaggaaaucaugaugaaguuuauauuuaaaaaauacaaaauugcugacuuuguccacaaaaagggucucagagcaaugaccauaaacugaaguccaauagagucaugugaaaaaggacucaggagcuuucacuguguucagguuuccuccauuggucaaauaugggauaguuuaagaaucaaaagaauaauaaccugagugaauugaaacaaaccaaauauaucuuaaacuaaaggcucuuaauacuuaaaugaaaaauccucagcaauuaccuuugggagaggauauuagaaaaccagcucacuguuuugaaaacguaagugaagggaaaaagucaagcauuuauucugccccuuuucgaaguacgguacuuuaggauaaccagauaauugugggguuauccuaauaauugaaggaauauaguaauaaguaauauaagggauguuucucuuuacagaaugagugauagaauaagaguauuacuauuuugcaccgccugaugggcaaugauaaccaaaggcuguuaacaucaccaaaagagagauagacacacaugaugaaccuccugauagaugcacauggaacugccuaugaaguagucucgggggaaaaaaaaaaaacuagccugacuccaaucaggguucuacauuuaacugugagcuuucagaaagaacauguuaaauaccacuauggcaauguggucagcaaaagacagauugcaggaaaaccuuauauuacaaaugacuugguuucuuaaacaaauuucaaacaaaagauaaagaggagucuguagauggaaaaaaaaaccuaagaaacaaauuaacaccagugaaugcaccuuguuugcccaauuugaauaaaguagaucauuuuuaagaacauagaggccaggcguaguggcucaugccuguaaaccuagcacuuugggaggcuaagguaggaggaucgcuugagcccaggaguuugagacuagccugggcaacauagugagaccuccucuguauuaaaaaaucaaaaaauuagcugggugugguggugcguuccuguagucucagcuacuugagcggcugaggcaggaggauuacuugagucugggaagucgaggcugcagugagccaugaucaugccacugcacuccagucugugcaacagagugagaacauuggccaguuagugaaaugugaauaccgacuggguaauaggugauauuaagaaacuauuauuauuauuauuauuauuauuauuauuauuauuauuauuacuugagacagagucuuguucugucgcccaggcugaagugccguggcacaauccuggcucacugcaaccuccaccuccuggguucaagcgauucuccggucucagccucccgaguaucugggacuacaggcaugagucaccacgccuggcuaauuuuuguauuuuuaauagagacggguuuuugccaaguuggccaggcuagucuugaacuccugaccucaggugaucaccugccucggccccacuaagugccaggauuacaggcgugagccaccaugcccggccaauaaauuauuuuagauaccagccugaugaugguaucaugguuauguuuagaaaugagaguucuuggcuuauagagguacucauuuauauaugaaauaguguaauacguggaguuugcuuucaaaauaauauguguguaggguagaggcugggaauggaauggauuaaggcauagaugaaucaguauugaccaugacuugauaauuguugaaucaacguaauagguacauaggauuuauucuauucucuuaaauaaaaaguuuuuuaaaagaauauagguuuuggagucagacugccuagguucaaaauccagaucugucacugacuaagccuugugcuauggaguuacuuagcgucucuguguauuaguguccuugccuauaaaauggaaauaauauaauauuaacugcauaauagaauuguucuaggaacuaaaugguuauaaguggaaagcgcuuaugaauguuagcuuugauguguucauuaucacacaucaaagauauacguuaaaguuauaaaucauuggcuaaagaucuuaguguacuuaggaauagucuaguugaauuccuuauuuaguaacccaggaguuugaaacccacauuuagcaaaauguccagugguagaaccagaacucaacuuuaugucucuugacuccuagucuuuacaacugcuucacaguaaaucacuucaaagaauauccaagagucaaaagacagaauuuuuacaaauuuaguuaaaugauauaauggcuuuuaauaguaauucaugagucaggcagcaucucaucuaaagaacagauaagcacuacacugggcaggcagaacaguuaguuuuuguagggaaacuugagcaggaacaaagaaacaguggauugguuaacauuaguugcuucagauuacuuucauuguaagggucaaagcagaggggacuuucuuauguuggcuaaaacugucccauuuggggauuugacacacacacucuccugauuucucagaaggucagauaaauaacuuagguuuaguuuggugauaugcaacuuuggcacgagugacugcauuuugguucagucuguuugguuugaucuguagaguagaagcucaauccauauuaguagucucccauaaauuuuauuuaacacaaguaagcuuaaguaaccuuguucuaaauagaaagacucacaguugcaaacaucuucaguuuuccuguaucuaaaauguauugcaguucaaaugaagacuccaaguucuuguuugucuguuugcuuugagaaggaacagacaaacuuaacauaagaugagucuaaauuuaucuggggaguggaacacuaaacaaacauguuagaaaaauuuugaggaaauaaaggaagaauauuuguuccaccauauauuauaacauauugcauaguuauaauaauuuuaugguucuggcccaggaauaggcagauggaugaaaccaauuaguguccugaaauaaacccccaagaguacguagauuuuaguauuaaaucuuucaaaucugucauucuuuuugggaugacugaucuugccagauauauguaaagcuggauacuuaguaagucuaguuuguuucguagaaauauuagaagaaaauacaagugaauguuguuauaguacagaagaagggaaagccuuuggaguaaaaauagugaaauacagaugcuaaaauggagagaacuuauaaauuuuaccauaugcaaacguaaaacuuuguuacaauagaugccuuaaguuaaagacagaagaggaaacaaauauuggcagcauguauagcuuacuguauuagucagggcccaguuaggagccagaaacuauacuaggcauuugaacagagcaaauuuaauauaaagaauuauuaauggccggucgcgguggcucaugccuguaaucccagcacuuugggaggccgaggcagguggaucaccugaggucaggaguucgagaccagccuggccaacauggugaaacccugucucuacuaaaaauacaaaaauuagccggacgugguggugcacgucuguaaucccggcuacuugagaggcugagguacaagaaucgcuugaaccugugaggcgaagauugcagugagccgagaucacgccauugcacuccagucugggcaauagagcgagacuccaucucaaaaaaaaaaaagaauuauuaacuauuaaaaucuacuuacuaaaaagggcaaaauaggacauuaaagaauacaaaaauaguaaauauagggauuagcuaugacuaccucuugagcugagggagagaauccaaaaaucaggaagacuguuguucagaccuuguugaagaaaguguagcugcugccaaaggacauagcuaugggccaaagcuggggcacaggaaauccccugcugggaggccucagagcuggugugcagaaaacaccugcuggggugcugugggcuggacagaugauaagccgaaaauugcccacugggaugacaugaguuggagcugguguacaggacccuauccaaugggaugcagugugucagagcuggugcacagaaagccccaugcuggaguaagcuagagaaacuuacaggagggugaucauuauugggucuuucacaaucagccucaccauaggagcaaaaagaagagcauccuccaaacugaaaauuaagcccaucacucugcuuugcugugcaacaaagcaccagcugacaaaaguccauauccacuacugcaaagaaggacagauuuggagcugagagccuugaaauaauaacucucauuauaccaaaagcucuuauauauagauaagaaaauuauaaacacucuaauuggaaaaacggcagcauauuuauauacauaauucacaaaagaauaaauacaaaaggcuugucauuguuugaaaggaucaagucaaauuugcuauuaauagauuucccugauuucaucuuguuguacagauuuauguuuucuggaucuuccaucacugugaauguauguuguuuccuaagauuauacaugauuucccuccuugggggagguucugcuugacugggguucuaucuccuuuuuguacuguuguucuucauuuaccuaaguuauguagcuaguuuagauuucucuucagggccugcucuagacagugcaauaggccaaaaaaguucuuuuuuaaaaaaggaaagggagauuggaaaggcauaaauaaaucugucucuacucacauacaagcaugauugucuauguagauaauccccaaacuguauuuacagaggcugauacagcuaaugagauaauuuaggauggccacaggauaaaagguuaauacacauaaaucaauuucauuccuacauacuagcagagaacaacuggaaauuuuaaaaaauuuaaaguaccacuuagaauagcaucaaaaguauuugaaauaccuagguauuuaucuaacagagcaugaaugagauuugcuuacugaaaucuguaaaacauuuaugaaagaaaucagacuuaaauagagagauaaaccuguguucagggaaaagaagacaauauuuuuaagacgucaaguugccacaaauucaacacaaucccaaucaaaaucccagcaggcugggcagauguuaggucaacuguaaauaaagcugcugucguugccauuguuguuguuauuucauagaacuagccugcaguggagcuugcugcuuugugauguagggaguuccugucauucacacuuuucaaauacagaucgcuaagacccuuugucaaggaugucauauaggaaauuauaucauuagguaggaugcuggacuagaucuacuucaacccuucuaauuaaaaauauuaugaucuauuauuuguaaguuagcaauuuacagcuguggggcauguggaaagggagcuacuggaauauucagacuuuuucaaauguacuuauccuuuccccgucacccuguaaaaccauugcauauaaugagggaucuuaguaauaggaguguguugcaugagugagcuguuuaaggacucuaaugugacguuuauuuuacuuuguuguuguuguucuuacuuaucaagcugacugaaaaggaaaguuuuaucaaucuuuuccacucuuugaauucuaauuauagcucuuaaaaaaugguauaaaucuuagggaaguauucuuuaauauuuauuuuuagacauuuuuaauuucuccaauauagucaacuuaguaaauaguuccaaauaaggaaacucagaaauuaucuuuaaaacaguuaguuguaccagcaaaucauuuuuuaaagauaauuguauuccuaacauguauuuuuuauuauauauuuauuuuaugcuuuugcaaaaauaugugaaagcuucaaauaaugaguaaaaauccuguggauuuuaugauuuaaaaauugguugaaauaugaauagcugccuaguucuauuuucauuaaugucuuaauuuccuuuuuauuuuaaagcucaaccugaauuccugaagcagccuacuaauauauaugcucacgaaucuauggauauuguauuugaaugugaagugacuggaaaaccaacuccaacugugaagugggucaaaaauggggauaugguuaucccaagugauuauuuuaagauuguaguaaguauuuuucaaagaaguguguuuauuucuguaaccuuuagauauuuuuaaauguagucaccgagagaucaguuaucuuauauauacuaguuuguguacugcaaaugaaauagaagaauucacauagaauguaauaccuucauuggcugaugagaaagcugagcccagaaauacuuugguagcuuauguaagaucacauagcaagucaguggcuuaccuaagccuagagucuagacucuuacuugaacacacuggcacucugaaacacagcugccaccauuuucuggcagaugauuagcacacaugugugugcguguauguguguccccaguugucuucacagcucucuguucaagaagcagaaaucuuuccacacuucuccuugaaguguggaaagaugauccuuuugaaaaacauaauauguaagaaugcaacugacuauacaaaacuuaaccuuaaaucguauaccgaugcccagacccuucaaaauaaggaugacccagugucggacaauugugguagcaauaguuauaaagauucuuuuuuaaaaaugcauuuaaaaagugucaaguguauuuaagaauacucagccauaauugcuuuuuacuauacuuuauauauaguaaaugauucuuagauauuaccuacuauuaucaucaauaucuaacauuuuaguaauagaauuauccagcuuuaguaauaaagauuaaugacauaccuugagaucuauacaugacauucauaaaaaugaucagaacuauaguuguuaaagacauaaugucucauuacaaauuugucauacaaguaaacauucuuagaaauauauuuucuauuuuugaaaugcaugaucuccuguugcaaaaaguaauuuacaaguauuuaacauuaaaaagcaaucuguuauaguuaaaauagccucuuaaaaucaauauuuggaaacuagaaaauuuuuaaaucauauuuauuauaccaauaacaguaguuaaaaauuuuuuuuguuuuuuaagacagggucucgcugugucacccuggcuggagugcagugguuugaucauagcucaccacagccucaaacuccugggcuuaagcgauccuccugccaaccugaguagcuggaacuacaggcacgcacuaccaugaccagccaauuuuguauuuuuuguagagaugggguuucacuguguugcucagucuggucuucagcgccugggcucaagugauacuccugccucggccucccaaagugcugggguuacaggugugagccacugcuccuggcccaguaguaauaguugacauucauauaguacuuuuucauuuaaggaaagcucacauggcuucauuuaauuuauuguagucuaaucuguuagaacuauugauauuauagauagucuuaggaaaaauaauaccuuaaauucacaaauuggacuuuaacuguggucaguugguauugcgugccagaucuuuuuccaggcaaagguguaguuugcaaacagugagaguaugacuuuccaugcguuaaguucuucaucgugaaugacaguauguacucuucuauucaguuaaauugguaccuugccaaugcuuuaguaugaaauugaguuaacaaguacuuggauaauauuuaauaauuggaucauaaaaacuuuacuuguuuuuuuccucuccaaaaagcauauuuuugagauuuugaucugguauuuaucaauuaaauuauguaauuuuauuuaugcuuuucuucuucagaaggaacauaaucuucaaguuuugggucuggugaaaucagaugaaggguucuaucagugcauugcugaaaaugauguuggaaaugcacaagcuggagcccaacugauaauccuugaacaugguaagaagggcugaaauagucagaugauagaggcugugugcuugaugaacaagcacccauccguccaaauaacucaugauugauaacccauuaguaaaggccaauauguggcauagcuaagagaaaaagaauagcagucuaaaucauuucuauuacauaaaauuaccuagaagcacaauuuuggauaauguugaaaagaaauuuuuacuaagaaaaggaaaacugaauauuauagucuuaauaaauuaauuuuuaaaagaauuuagucaucuuaaucucacaaauauauuucuguccuauaaagaaaaacuucuuuuuuuuccaauucuauacacuuuuauuaauacacuuacaaaaaauaacauucaaacacugagaaaacuaaauaacuuuggaagcagagcucauuguuuucugcuuacauauaagugacaauucugggcuguuggcacaaaauagucaacauucauaaaacccugacuacuauauaucaaacauaaguuaaaaucauaggcaguaguuuaucaaauccacguuucuuagaaaaacuuaguauuuauuuugcauugaaauuuuuaguuuuuccagaauacaauuaauuuaccuuuucugauuaccaccaaaaaaccaaguuuauuauuuaaaaauucagauaacaaugaaaaguauaaagaaaaaaauccauccuguaucucaaauuagggaacccacacuguaauuugagcagaguuuuaacauaaggaauuaacauugauauugggauuggaguaacaaagguuugacuaguaagaaguaaagagaacucuagacaauauaagaauggcaacuaucaggagcaacuacaaccccuaggucugagauagagcccucaggaagaggccccucuuuuuacggaugagauccagacccuguuggagaggguguaaccaugguuuacuggauggcagagaaguugaugugguguuuugcucucuaaacuugcucaaaaucuccuuucuugaggguuggggaaagcugcuuacagagagguaucucacuggaggcauucugcuacaaaaccacccaguggaucagguguaaggggaagcugcuggcuauaggaggcugccaggguaguacacuagaaccaggaaggaaacuccuuucuucuguacuguaucuccauugccuucuauugauaaaguuuaauacauaugccagcuggcaaaggaaaaguauauaaaggacauggcucuguuuuugcagcauaggcaaugaaaucagaauuuggagcugagaggcaguaaauugauaacugguacacacuucaaauccuaccaccuggguacacuguguaugguuuuauaauuuccuguuuuguugcaacagcaugcuguguauaucuuucugugucaacaguugaucugcaucaauauuguuucuuauuaaauaauauguauauauauauauauacacuguuuuauauaacagauuuuauauugguuaacauuuagauugucaccuguuuuuuccuauuacaaacaaggauguauugaacuuuuuaugugauuauuuucuuauacuaaauuacuagaaguugaauuauuggauaacaguucuguguuaaauugauaaggguaccuguugggugcauuauucauuuguuuuagcaacugaaacauuuuucauuuugagcauuucucaaaaauacaugaaaaagaugccacuuuagacaucugaucuuuuauucaagucaaauacaaucagguauuggugugccuccaggaagaauuucucugaugauuguaguuuggccagggaagcuaauuggcaaagauggcaccuacucuggcuuuucacuaacauggcauauauguaggauuuuugugugcuauuuuuugaaaaauauacuugagagugcuguuacagaaaagcauaaaauauuagaacugcuuuuuucuucuuagguuuguauauacccuccccuguuuauuggaaaugauuuuaguagaagcaugccauuuuuccaucuuggugaaaugccugaguacaauuacuaaauaaggcacuagcagaauuagugagguagauaggcuuauuucuuuuuacuuguggcagugacuuuucuuaguaaaccucguagcuauuugggguauauuuauuuacauggaacuaagcaaaggcacuucauuauauuuguguuugagauuacuguuacaaaucuaacucuaacaguagaaaugguuaaguaugccaggaaguuccuaaacuaauccuaauugggcuuuccucugaaaauauuuggauaguguuaaaauuguagucauaguguauuugcuucucucuuuuugagaauagcguuuuaugagcugaugaaauuuuuuagugacguuauugggcauguauuaaagaugcauagauuauaagaaggagaguaagugucauguuauuaauuguguuuucuauuuugcuguuuuaauuugcaagauaaauauuuauacaggaaagcuaaaagaaggaauacaguaacuuacuagaucugagcucuucuuuuuuagaguuuacaauauaauaagggauguaagagauauauaaaacuugaauaccaguccagaugcauaaauaaagcagcauacaguucagaagagaggaauucugucugugugaucagggaauuuuuucauguaagguguccccuuuguaauaggccuugaauuauaagauuucuagauguuaauucaaaggaagaccuggaucaauauggaaauaaaauagaagaccuguuccuguaguaagguagccuuuaacagcagaauaggaucagagugcaugauuauaaauaauaaaaacaaugccauguguaaugaguaugaugauaaagucagguuuagaggaagacagagugcaagcugguugaaggaaaauuguuaugaggccauugugagaugauaaauacuuacacuagagaaaucgguggaaaaggauccuacuaaggagauuguguuagucuguucuugcauugcuauaaagaaauacgugaggcuagguaauuuauaaagaaaagagguuuaguuggcucccaguuccacaggcuguacaggaagcauggugcuggcaucugcuuggcuccuggggaggccucaggaagcuuccaaucaugguggaaggcaagaggggagcaggcaucucacauggcaggaccaggaucaggagagugaggugggggggugccacacacuuuuaaacaaccagaucuugugagaacucacuaucucaaggacagcaccaagccaugagggaucuucccccaugacccaaacaccuccccagguuccaccuccaacacuggggauuaccuuuucacaugagauuugggcagggacaaauauccagacuaugucagagguguuagugauuuaucugauugagacuuuaucaacugauugaacauuaaacauuguuauagagaagccagagauacuuccaagguuuacccaaguucuggguaacuagguguauuaguccauuuucacacugcuguuaaagacauaccugaaacagggcaauuuacaaaagagauuuaaugggacuugcccuuccacauggcuggggaggucucacaaucauggcagaaggcaaggaggagcgagucacaucuuauauggauggcagcaggcaaagagagagcuugugcagggaaacucccauuuuccaagccaucagaucucaugagacucauucacuaucacgagaacagcacaggaaagacccaccccuauaauucaaucaucucccacugggugauuccacugggagguggaaugggaauugugggaguuacaauucaagauaagauuuggguggggacacauccaaaccauaucacuagaagaauggugacaccuuuacaaaaacagaaaaagagggcagaucaaaguggaaggagauuuccacuucuguuuaggauauaaagaggugcauaaagaaaaucccauucucaccacauaaagagcuuaguaaucuacaacgucacagguucucuugagcccagcagagagcugagcaugcaaagcaaauauauuaguucauuuucacacugcugauaaagacauaccugagacuggguaauuuauaaagaaaaagagguuuaauggacucacaguuccacauggcuggggaggccucacaaucauggcagaaggcaaaaggcacauguuacaugguggcagacaagagagaaugggagucaagugaaaggggaaaccccucaugaaaucaucaugucgugagauuuacucacuaccacaagaaccguauggggagaaccacccccaugauuuaauuaucuaccaguaggucccuuccacaacacgugggaauuaugggagcuacaauucaaggugagguuuggguggggacacagccaaaccauaacagcaaccaaauaaccuaaauuccaaaaaggacaacccuccccacacaacccccucaaaggcauagaucauaugcauuguuucacuuuuggcagaacacaagagaaagagacggcuacuguaaaagugaguaagaggaaaacuccuagaguuuuaacuaaaaggccuuuaacugcaaggccaacuauggccuaauuuggaaugucugggggccucagacagaaugggaguuuacacuuucuugcaaacacuuuuccuuggggcuccacagaguacucccaauuaagaggaggcaaaagcaggagacuacagaaagccaucucugugguguagggaugaaggaagugaugaucugcagcugcagagagagaaugaugcagagaggccuuugugccugggagacaggacaaaggccuucccauuuacucagacccuucuccuuuaagccucaaaccagugggggaggggcagaaaaccuucugauuucauacguuucugaagggagauuagaagucaaaccccugugcugcuuagaggaggaacccuccuguccccaggaugcaggcagagacucauugaugccggggaaaggguagaagagaaaacccuuuacuucugaaagaggcgcagaaaucauuuuaggccucaggauucuacacugauaccaaggagaggucuuuuacuacuaggggaagaguaggaaacuucuaccuaagaccgauacaaauacaaggcagauuuugacugccacaggaagaagagccagagggccuaccuaagacugaggcuggaccagaacaauggagaauccuagcugccucaaccaugaacuuucuacuguuugggaaaggucaagagcacagagggauauccugugguauugguaugcuggagugguugaaaacucagaggaaaggaaaaaaaaagagagagaaacucucuggcuccuaagcacaggacaaugguagucucccaguagaggaauuugaaaccuauaguauacuuaagguaacuauaacaauaaaauccauuccaagcucaauuccugacuagauuaacuaaacucuuucacacuaaugacaugacagaaaaauaagcauaccauuuuucagguguaaauaauacuuacuguuguucagcauaccguguucagcauucaagcaaaaauuaauagacuuuaauaagcccaucuauugagagagaaacuaaucauuagaacuaauuucagccuuugugacuucuaugcaauagaaagauguucuuagaaaauauaccauucaaauuucauucuuuauauaccuuuuuuaaaauuaauuaauuaauuaauuuuuuugagacggaguuucacucuugucgcccaggcuguaguacaguggcgcgaucucagcucacugcagccuccgccucccggguucaagcaauucuccugccucagccucccgaguagcugggauuacaggugcgugccaccaugccuggcuaacuuuuguauuuuuaguagagacaggguuucauauauaccuuuauuuuuaaaauuacuugagguauacuccuacagacuacaagaugagucaaaccaagaacucaaaaacaacacacacucuuaacaucugauccagcaguugcacuucuuuguauuuaccugaaugaguugaaaaguuauguccacacaaaaccccucaaauguguuuguagcaucuuuauuccuaauuaccaagauguccuucaguaggugaaagaauaaauaaaccguuguacaucuagacaguggaauauuauucauuaccaaaaagaaaugaccuaccaggccaggugccguggcuuacgccuguacucccagcacuuugggagguggaggugggcagaucacuugagggcaggaguucgagaccagcuuggccaacuuggcaaaaccccgugucuacuaaaaauacaaaaauuagcugggcguaguggugcaugccuguaaucccagcuacucaggaggaugaagcaugugaaucacuugaacccgggaggcgaagguugcagugagccaagauugcaccacugcacuccagccugggugacagagugagacucugucucaaaagaaaaaaagaaagaaaagaaaaagaaaaaagaaaugagcugucaaaccauaaugcacuugaggaauuauaaaugcaaauuaccaagugaaagaagccaauuugaaagggcuaaaaaccgugugauuccaacuacaugacauucuagaaaaggcaaaacuauggaguuaguaaaaaaauuagugguugccaggguuugggaggagagagcgaugaauaagcagaacacagauguuuauggcagugaaaccacucuguaugauacuauaggggaggauacgugucauaaauuuguccaagcccauagaauuugcaacaucaagagugaacacuaauauaaacuauggacuuugggugauaaugaugucucaauacagguuauucaauuguaauaaauguaccacuuuagugggggauguugauaaugggggaaacuaugcauguguagggcagaggaaauuuugguaccuuaugcucaguuuugcaaugaaccuaaaacugcucuacacacuuauuaggauaguuaaaauccaaaauacugacaacaccaucaaacucucacaaggauguagagcaacaggaacucuuauucauuguugcugggaaugcaaaaugguacagccauuuucgaagauaguuuggcaguuucuuacaaaauuaaacauuuuuaucauaaaauuuagcaguugugcuccuugauguuuacccagaugaguugaaaauuuaugcuaacacaaaauuuacacacaaauguuuagaagaauuuuacucauuauugccaaaacuuggaagcaaccaaaauauccuuugguaucugaauggauaaacaaagugugauacaucuauacaauggaacgucauucauugaacagagcaucuaagaugggacaauaucagaggcuauaacauaaguaaauuauaaguaaaugggagucucacagggaaaacagaacaaggacagggagaaacaaauguuugaauagauaauggccaagaauuuuaaaaaaugaauuagaucaaaccacacaaccaaaaagaagcucagacaacccccaagcaaacuaaauaccaugaugaugauaauaauaauaauaaaaagaaaauaugccuguacacaucauagucaaacuucuggaaaccaaacaugaaaauaucuugaaggcaauuggaaauuuaaaaagaagaaagacacauuacauacagaggaacaaagauaagaauugcagcagacuuuuugccagaaaaaaaaaaaaaugugagcuagaagacacugagcaguaguuuuuaguuuaaaaaaaaauaauuaaggggccaugguaaucuucacuguauuguuccaauuuuaguauuaguguaugugcugcccaagugagcacagagcaacuuuuuaaguccuuaaaaaaaaaggcaaccaaaaaaaaggcaaccaaaacuauacccagcaaaaauaucuuucaaaaauuaaagugaaauaaagaccuuuucagaacagaaacugagaauuuguugcugacauacccaugcuacaagaaaugugaaaggagaaaaacaaagugggcuagaguguuuuuaaaguaaauauaaaaauauauuuuuaagauuaauugcuuuaagagauaauugacugucuagacaggcccacaaaauuuuuuucuucuuuuuuuuucacucuaaauaguuuauuuccaccuucacaaacucaugcaccucuggccauuaugcaaggcaccaugaauuaaauagucauaucaguauauauuugucuuacaugauucaagauaaagugaauuuuaaaagcaaaugggugccaaugauggggaggugaggggaauagggcaggcagcaauaggguaacacgcaacaaaauuuucuguaaagggcuagauaguaaauauuuuaggcuuaaugggucagucucugucacagcuacuuaacucuaccauucuagcgcaaaagccaccauauagaucaaacaaccuuggcugcuccggugaaacuuuguuuacaaaaacaaguagcagguccuaauaugcuuacucuggucuaacacagaaauaguugauaacaugaaauuuagaagugugacagaaugguauauguaguguaguccgauguguaggguagaauugaaaauaaacuauuguaagauuauuacugcacacaacaauacugugugucgaagaugcucagauacuuucaauauuauuuuuaaacaagacucaugaagauaacaacuauuacaaaauauuuccuuuuucaauaauucacuccauuauuuuucuaguuaagcucagauagugaucacagagauauguuaguaaacuaucuguaguuuguaguucucccuuuaacaguuccuuuuuggagugacuagggcacauuuccuccucauuauucauacaccaagucugacuuucuucacuuauccuuauauucuucauucuccugcucccuguuugccuuuuuuuccucccacuccuucccccuuuuuauuuaaaaaauuuuaagugaaacagacauccacugaugagaaauaacuuagaaucacaaacuaucacggcugaaagauacguaucauguaguacagugguuggcaaacuuucuguuaagggccaaagaauagauacuucaggcuuuaccugacauuuggucucuguuuacauugcucaccucugcuauuauaaguuugaaaaccaccacagacagaauacagacaaucuguaacaaauauguguagcuguguuccuguaaaacuuuauauacaaaagcaggaaguacacuggauuuggccugugggcacaguuugcgaaucucaaucuaguccaucuucccuugaauauccuuacaucaguguuucccaaauugugcccuuuaagauguauuaaugggucuacuaaaaagcaaauaaaaugaacaaaaaggaugcuccacaguccaacagauuuugggacugcuauauauaaacauuauauucuacguuggaaauucgcaaugcuaaugaacacaaauggaaagaggcucaaggugggccaguuuucaucauuucuccuucaggcugcccaagcgucugccuuucuccuaccaaauccagacauaucagugaagucugucagaauuugcuauauuuacuucuugcaagauaacccaauucuccugugaaaggaauuguuuguagacucuuaacuucugucugucauguuuuuggcagaaagucaucaauguuauaucugguggcuuuucuaaauuuuaccacugauuaaaaggugaguuuaguauuuaaaaaaaaaaagacuuuacuaauuauauaaaaguaauacaugauuauuuuagaacacugagaaaaauaucacugcccaaagauaaccaguguuaacauuuugguauggaaaugucuaaauguguauauacacuuuuuaaaauuaaauucagauuauuugguauauauuguuuuguaucuuguuuuucuacuuguuguuauauccugagaucuuccugauaucauuacagggguucaaaggcaugguuuuuaauggccaaaaaacuuuuccaucauaagguuguacuauaauuauuuuaacuacuuccucuauuuugggacauuuaagucauuuccuauucuucuguucuuuaucccugucuguuuuuccuuuuucaauuacuaaugcucauauuaguagucuuuguccaaaucucugauucuuuccuuaggaaaaauuccuaaaagaacaauuaaugguucgagucaguaauuuauguaauugucaaaaugguuuuaguaaaugauguaacaauuuacauuuuuacuaagagugaagaaaggauacaaaccuaaucacacauuagccaacuauuaaaaaguaauguucauuuaaaaauacaaaauuuaggcugggugcaguggcucaccccuguaaucccagcugggagcugaggcaagaggauuacuugagcccaaaacuucaagacuugccugggcaacauagugagaccccauccucacaaaaaguuaaaaaaaaaaaauuggccaagugugguggcacacaccuuuggucccagguacuaaagaggcugagaugggaggauugcuugagccugagaggucgaggcuucaaugagcugugauugcaccacugcacucuagccugggcaacagagcaagaccaccacccuacccaugcaaaaauaaacuucauuauuaggcaaaaaugacaucuuacccauugaauuuuauaucuuugauugugaaguggaauauuugucauauguuuagaaauacaguuacuccuugguauacaugggagauugguuccaggacccacacauauaugcccagaucugugcauauucaaguacuguagucaccucuguaagaccugaguacaugaaaacuaggcugccuguauagucggguuuugcauccugcaaauaccguauuuuuuguugcguuuguuugaaaauaaaaaucaccauguaaguggaaccaugcaguucaaaaccggcuuguugaaggauccacuguagucugucuuugcucuucugugaguuguauucuucuguuaguuauugaaaaacgaaaucaaucucuugugauggugcuuaucuucaaaaccuucuuuaaaaauaauguugaaaguauuugacugugcaucuuugauaguuuuauuucuguagggagaguuuucugauucccaccugaaguguguggcuauauauacuggccauaggccagcuggcuagugcugggcugcaagaagcugcguuggagcguccacaguaggccugugguauacuuaacaugacuauuagguuaauuaucagcuuuaaacauuaaaugaaacuuaauaauuauaguuaaaauauauaaaacauuuuugcauaucacuggaaaacagaauuucugagcaaauugugaaguagaauuugacuuuuguuccuagcaugcuuucuuaaucaaaacauuuaaaauacaacuuuuaauauuuaacuucacuuuuaugcauuuucgguaacagcagcucuugauuuuagaagaucuuguaucuuuuaaaaauauuuaacugaacauaaaacaggauuauuuuuauuugcugccauuucagauuaacauugccugucauuuuaugcuaaaauccuuuguuuuuuauaauuaucuauuaaauuacauuuucaaaaaaaagcauuggcagguacauuguuauuauuauuuaaauuauuacuggucaauuaagaguaguaggaauuaagguaaaaugucuguaucuuuuguccauuaacuuuuuauuggccuuucuuccugucaguugaauuuaaaaauagauugcgaaauuaucaugugagacuggaaugugaaaacauagaaauacacuuucuuuuucuguccuuucauaccacgucugauaauugccaaauuuuaguucuaguaaaggaagaaggauucaugaaaagggaguaacaucaacuuguuuuuaguaaaggaaacuuacacuuuaccagcuccuuaaaugacugcugggauguuauggccauaguagauaagaauacacacugagcaucccccacccuuuuuuugacagaaauguuuguaaaaaauuccaaauaguaucugagguuagcauugaauaauagaaguucuggaauaagugacuaauggccuggcaugauuaaaaguuggcuagauagcaggaaauuguuacucauuaguggaauauuuuaauuucaaagcacuaggauguacaguaguugguguugauguuaauuaaaggauaaguucuaaucaguuauuuugcuuuuuuguaacgguaauuauaacuuuagggagaguuuuauucaagguaacugguguaauuugacuucuuaaucaugaaauucaugucuaggaacuuucuaaagacugaauauguaucugcugucacugcuuggguucuaguucaugucugcuguuaaugacuggauuacauauuguaauucugugauuuuuuauuuucuauaaaauaaaggaauuaaauuuaaugaucucuuaggucccauaucacuccaaauacucuguuaaaugcaguuguuuuacaaacauaugcauuuaauguaaaaugugcuucagaacgcuuuuuccguauagguauugaaauagauauguuguuugcagacagauugaggcauuuccaguuaaugauuuuauguaaccugucauaacucguauaaugaaacaaaccuugugcuaaaagucugacauauuggauuaaugucccagucccacuguggaugaggugauuaaccucucuaugcaucaguuuuguuaccuauaacucuaaacagucaucucugcacagcacaccuuugaggggcaaauggaauaauauauguaaagcauuuuguaaauuguuaaguacucuguaacuuuaggauaauaguaauuggaaagaacauagaaagacagaguaucgaugagaauucaauagucagcauuaaaggagauuaaaagugaagauaaaagcuuaacuuuaugaagcaaaguuugaagguuuuuucaaaauagacaacagaaaucuuuaggauaauaguaacuuuaggauaauaguaacuuuaggauaauaguaauuggaaagaacauagaaagacagaguaucgaugagaauucaauagucagcauuaaaggagauuaaaagugaagauaaaagcuuaacuuuaugaagcaaaguuugaagguuuuuucaaaauagacaacagaaauccauauaauauucaguuagaucauuuaaauuugcaaaauuagaaaaucuucuuuauaugaccagauuguaaggcaucuguaaugaucugguuaaaacuaaacuugcacuaaaauauuuuaaagcaaauguaacacauguucauugucaagaauaagaauacauaauugacugaaauaaaaguaaauuuacuuuuuaacccuucucuuaauauuacuuucuagagauaacccucauuaacaaacauucuguguauuugugcauucagaaauaaauuguugagcaaaauucuauauggcauauacaauuguguauucauugugcuaaguggugaggaugaaacagcuaacaagcagacaugauucucugccuucauagugcuuauugucuguuaguagagacagacaauaagcaaguaaaugaauaauuauaccuuuuauugucuacuuaaauaaaaguacuacucugauaaagaauuauugggguagaguggaaguuauuuuaaauagguuagacacagagggccuuucugaagugauauuuaaguugagaccugaggguuagaaggagccuaugcguguguguuuuacacuuacacauacauauacacauauucauguauaaacuuuuuauuugcagaagugaaaucauauuuuucugugacuuuugaaaacagugucuuauggacaugguaguccuuauauuacagguuuaucuuuuucauuuuuuuuaaacugaucuauacuucucagacuagaguaugaggaaacauaguuuugaguucuugaaacauuguaaauuuuuuugagaugcaguuuaagaauaauuuaaaauucacacacccuuucaucaaacaauccuauuuauaauaauuuaucuuacagauauaguuacuaaguauuuaaagauucauauguuagacuagcauaaaucucuaaguaaccuaauugauccaaccaauaagggacuaguuaaauacagaauagaguggaauacuaggaagcuguuaauaagauguauggaaaaauauccaauuuauauuauuaauaaaaacaaguugcagaaaaguauguauacucugauuucauuuauggaaaagagaaggaaagauauaaaugucuguguccuuguauguguaagaaaguuuugcaagucuacacagaaaucuauuaaugaugguuauagcugaggaaugggauuggaaaaaccugaagaugaggaggaaggcaaaaauaauacauuugaaauuuuuggaaagccaaauaaaaacaucaauuagaaauuaaacuuggaauauuuaaaucuauaccuggugauuucuaccuuguucaagguaguuauaaacuuuuugaguuuuuauuucuugaaacaaaaugcuauaggagaaaaaauaguuuaauaaaaguauuuggcaacagucugcaaauguuaguuaauauagcauuuuuuuccuagaagaugaaucaugucauauaaaugcugaggugguuaaguauaauuuauuaaaauuuuaaaaacuaauuuguuuuguuaaccaaguacuuaauauguugaguacaugugcuguguaaauagagauucacaguuaucuagcagauacccuauuauauaggcuauuaggggagauaauguaaaauuauagagucuagcuagaauagaccuuagagagcugaguauuuaauuuagcugagcuggaaacucaguuaagugacuugccauaaaauaacuaguuggcaucagagucaggacugauaucuugguuuucaauuucaaaauucacuguaucacuuuagcaaguuuaauguuuucaagacaaaaauuuauguucuuuuuuccgcuuauguucucuuaauuucaaguucagucuuuuaagucaguauaaauaaguguuauuacuuacugacaagguuggucagauguaucauuuugcuaggaugaccauacaucuagugugccuaagacaaucccccagcauaauuaccaaaaagugucuccuuucacuuuuaguaguaucugguuguggacaacauauuccauggucaccccaauuguugcuaauuuauugaaucugaaagauucuacacagugccaggguaaagauuuuggauuaugaaucuaaauaauuauaaugcaagcugugcugaaugccaaagcgcuacucuaauucuaaacuggaagaaauaauuucugcuagguuugacaggcaagggaggcugauugaagaacguggcaugugagccgagccuagaaggauggaugggauuauagauuagucagguuacaugaagaugggaagagguguauaugcaagaaggcucaaagugcauuuggagaauagccagcaucucgguuuaccaguguugagagaaguaugaguacaggaauauacaucugggaaggugugcagagaccagauuauuuaauaccaagucaaaggguuggaauuuguugagcaguuggaggacuccagcaguuuucaguuauguagcacuuuaagaggauuaauuuauuagagauguguugaguggcuuuagagaggaaaauauggaaucuguccuaccauuuagaaggauuuuguaccaaaucagaugugauguuuaaggcccuggacuaguuuauggcaauggagagagagaggcuuucuuuuuauucccuaauggcuuuguauuaguucauuugcauugcuauaaaagaauaccuaaggauggguaauuuauaaagaaaagagauuuauuuggcuccugguucugcaggcuguacaagaagcauggcaccaucaucugcuuccaaugagggcuucaggaagauuuuuaaucauggcagaaggcaaaaugggagcaggcaugucacauggugagagaggaggagguuccaggcucuuuuaaacaaccaguucucaaggaaacuaaccgaguaagaaccuacucagugcaagaaagacaucaggccauuccugaggguucuguccccaugacacaaacacucuccacuaggcugacccuccaaauuggagaucaaauuucaacaugagguuuggaggggacaaacauccagacgauaucaggcuuauacaugguacauauuuauuacauguuggauagauguuucuacaaaagaagauggcacaagauuuaugauuuauuggauacuuaggauaagagagaagaaaacauuagaguuuuacacuaauuaaaaguagagggauuuucuguauaaguguaaggauaugaucuuuguucuacuuagcuuaaggagguuugucuccauuaauuuugaguuaugcuauaaugaaugcuguuuuuagauagcuuugaagagguagacauauaauuaaaguaugaauaauuuguuugauguugaacaucaauuucaucuuugccaaaggucauggacuuuaagaccagaauuucugagguccacauaauaauuuaaugacucaaugauaauuuuugguguuaaauaaaaguccugcagaugaccuuucuggacacaaaguugaauuuagaauuaucaaagagcaagcuugaauuugaauuugaugcuauuauuuuguuauaaagaaagaaucuauuaugcagugcuaaaacaccagaaggaagauaguaugucugaauaucuuuuaauugguaguuauauuuaaaagaugcuaaauuauacaauaaugucauaguuggcaaaauaucauuugagucugaaagauaucacugacaaucuggcugcuuauagacuagcuuucauauaguuuccaugcugcgucuguguguuuuucauuuuagguuauaguguuguuggcaaugagaauaucucccaauugaugcaugcuuaagagacuaccagaaauaaaaaguauaauauaauuugauaugcauuuagagaaauguuuuucuuuaguauuaacauuuuaaauguuacuacugccucauaacugcuguaauaguguuuuaauauuuuagcuguaugaguauuucucauaaaaaccuuuauuuaccaccagaauuauugccugaguuuccccuuauauagcauguaucugaacauuguagaccccaaaugauaaaauaaauuaagagacuuuuuggcuagauucugguuuggugaugauuuuuuccuaauuuuagaguuccucuucauuuuacacucuuuuacaaauuugaguaguuguaguuuauuauagaauaguuuuguuaaaaaucucaauuagggacuacuuuucaaaauaaucucaggaaauaaaaacugcuugaauuuggacuucugcaucuuaaaaaaugcuaauacuauuucucugucaacuacauccuagaaaauugguuuaugauuagaugucauguaaaucacuaagcucauugaaagucaguuuuucuuuuuuauuggacugaauggguaaugagcagaaauaccuuucugcuuuuugucuuccuccuuuccucugggaugugggaaucacauugaggagacagcauuugguuuaggaugaaaggagagaaggcuaucuuuuuucugggcccacugcugugguaggugcgucauuaacaucugucacaccuuuuuuaaugagugcuuuugaugucaggaaaaagucagaugacuuccuuaaaauuaaaacaucucucuugcacgcaagaaugggaggaguauuuuguguucauuuuauuuuauaacuuccuccaauuguuuauauaagucauuuguugaaaucagcaguucacugcaagggcugcuuaucagaaccuacacauauuuaaaacuccccaguaguguguuccuaucagauuaguacuucucugccuuugagacuugguuccuuagaggagaaacuccagugucugugagauuauucacaugcacuuuauucccuugccagugaaauuguuugaauacucaaaacauguagccuuggcuauuuuugugaguuuauguucacauugcauuuuggcccuaaugagucuccuagcuauucaucaaccaugcucauggacauuucagguauuagaguagcuuugaauaauuucauuuugaaguguguuauucucucaccaccagggagacuacaaaccaaauucagaagcaccaacuucaguuaagcugagacugcuggcaaauccuauuagguuucccuagucuacuuccucucccuucucuguaugucaauauuugaaaccuucuugccucucaagccuauaauucucuuacuucggcagaugaucccacauuucccauucauuggaauuuaagaucuuuuuacgaucucaugcguggucaguuuuuuuggugacaguucuauggguguuaaguuugcugcauauuauaguuuguaaauaucuauuggauuaaacuuaauuguguucuuaaaauucauuaaacgcuuaccuaauuuuugucuaccuuaucugucaguuucuaagaaaauauguuucuaagaggccaggcaacgguggcucacaccuguaaucccagcacuuugggaggccaaagugggcagaucgcuugagcucgggaguuugagaccagccugggcaguauguugaaaccucaucucuauaaaaauacaaaaauuagccgggugugguagcacguuccuguagucccagcugcuggggaggcugaggcaggggaaucacuugaaccugggagguggaguuugcagugagcugagauugugccacugcauuccagccugggugacagagcgagacuccaucucaaaaagaaaaaaauauacuucuaagaaaguaugauuggagauuuguucaauguuuuauuuauauuauugcuuuauauauucagaagcuauguuguuaaugcauuaggaauuaugacuuaccuuccuggucaauuacuccauuucaucaaaucuaagguaccaugcauuaugagauacaaccugauugcagagauguuaaaauauggaaaaggaucaagaaaacaugguauuuguuuuaucagcaggaaacauuuguguuguccuaguuaauucuuguugcuuucaacuuuguuuugucugauacugacauuauuauaccuaccuuuuuuuuuuuuuuuuugagacagaaucucauucugucacccaggcuggagugcaguggcgcaauuucggcucacugcagccucuuccuccuguguucaagauauucuccugccucagccucccaaguagcuaggauuacaggcacccacuaccaugccuggcuaauuuuuguauuuuuaguagacacaggguuuuacaauguuggucaggcuggucucgaacuccugaccucaagugacccaccugccucagccucccuaaguacugggauuacaggugugaacccccaugccuguccaugcuuuuauaauagcauugacugaaauauauuuucuauucuuucauuuucaaacuuuugguguucuuuuguuuuaggguuaucaacuguagaccacuuuauacuuacuguccuuaggaguucugccaucuugauuuuuucuuucuauuuaucaaauggcugccuuuaaaaauucaacguauuuagccauuuuuuuuucuagcagcacucaggauucaucaugauaccuuuucccucaccaaacaauuaaaaagaacuucauccuuucacugcccuguuucucauauacuguacauuguccuaaacuauauucucugggcuauaauuucuacuuucuuggauucaucguucuuuauuucacuugauuauauuuuaugauaaauuucucagaguaugugagaaguaaauauucaaaacuuuguaugucugaaaauauauuauuugcccuuauauacaguuucaucaucuuuuagccuaauguuaggaauucaguuucucauucauuucuugauuuuagaugacuuaguuuauucucugaaagcuuuugguuuuuuuuuuuauuugaauuuaaagaauaaaaccgccaguuucauauuguccagauugagugguuucuuuaaagacuuguaucuguuuagguccagaaaaaucuuaugauguaucuguuugauuauuguucuugcuacuuauucuguuagcuccucuuagauuuuugcuuuucaugccaucugcugcucuuaaguguuguauccugggaaaguccuuagaauuacuuucuaguccacuaauuuccucuuuuuucuuuuugaguucaaugugcuuuucugucuauauuguuaagaaacuuuaucuuaggauuauauuagauuuauagaaaaauuaugaagauaauacagauaguucucauauauccuacaccauuuuccccuauauuuaacaucuuaauaugauaaauuugucacaaauaaccaacauugauacauuuuuuacuuacaaaaguucaaacuuuauucagauacuguuagcuuuucuuuuucuguuccaggauccuaucuaggaugccauuauuacauuuagucauuguguuucauuagauucuucuuggcugugacaguuucucagacuuauccuuguuuuugaucaacuuaucaguuuugaggagcauuggugagguauuuuguagaauauugcucaauuagaauuugccugauauuuucuuaagaguagacugggauauggguuuuugagaggaagaccacagagauaaaauacuguucucaucacaucacauugagggcacaugcucucaacgugacuuaucacuauagaugccaucccugaucacauagcuaagguaguguuuaucagauuucuccaccauaaaguuacuuuuuuuuauccuuuccauacucuauacuuuggaaaaaagucauuauacacugucuacauuuaaggauuggagaguuaugcucuaccuccuugugggcuaaguauuuacauagacuauuuuguauucuacacagaauuguccauccuuccccauuuacucauuuauucaaucauuugcuaauauuuucuuaaggauuguuacaacauagaugucugaguuuucugguaaugucuuugucugguuuugguauuaggauaauguuggcuuucuugguauauuugugcugcuauaacaaaauaccuuagacugggugauuuauaaaggacggaaauuuauuucucacaguucuggagguugggagucuaagaucaaggugccaacagguuuggugucugguaagagccuguuuaccacacucuguaagagucuaaguccuuguuuccaagauggugccuuauugcuccacccuauauuggggaggaacacugugucuuccguggcaaaagggggaccuucaaccucaaaaccuuuuauaggggugcuaaucugauguaugagacagagcccucaugaccuaaucaccucccaaaggccacaccucuuaauacugcuacacugaggauuaaguuucagcaugaauuuuggagggaacacugucauucagaucauagcacuggcuuuauagaaugaggaaauguucccucuguuucuguuuucucgaaaagauuguagagcuugguauuauuuauccuuuuacgguuugguagaauucaccagugaaacuaucuaggccuagugcauucuuuuuuuugaagaucuuuaauuauugauuaaguuuguuuaauagacauagggcuauucagguauucagguuaucuguuuauccuuguaugaauuuuuguaauuugugucuuuuaagaaauugguuggcccagaguggucgcuuacaccuauaaucacagcacuuugggaggccgaggugggcagaucaccugagcuuaggaguuuaagaccagccugggcaacauagcaaacuccugucucuaccaaaaauaaaaagaaauuaagagagagagggagagggggagggggagagggagaaggagcaggaaagggaaggggaaaggaaagggaaaagggaaagggagucucuagagagagagagagagaggacugaaagggaagggaaaugggaaagggagucucuagagagagagaguggaaugaaagggaagggaaaagggaaagggagucuuuuucaucuaagcgggcauagaguuguuuauaguauucccuuaucuuuuuuuuuuuuuuuuuuuuuugagacagggucucacucugucacccaggcuggagggacugaagugcagugucaugaucggggcucacggcagccucgacuuccugggcucaggugauccuccugccucagccccucaaguagcuggguccacaggugugugccaccaugcccggcuaauuuuuguauuuuugguagagacaguuucgccauguugcccaggcuggucucaaacuccugagcucaagugaucugcuggucuuggccucccaaaauuuuggguuuauaggcaugaaccagcgggccuggccuuccuuuauccuuuuaaugcccaugaaaugaguaguguuagccccucuuucauaucugauauuaguaauuuguggcuucucuuucuuuuucccuuggugccuggcuacagguuuaacagucuguugaucuuuauaaauaacuaacuuuuaauuucauuuuauuuucucuauuuuucuguuuucaauuucauuuauuucugcucuaauuuuuauuauuccccuucuucugcuugcuuuaggcuuaauuuucucuucuuucucuaguuucccaagguauaaucuaaguuucacuuauuuucauucaguucaaaagauuuucuguuuuuacaucuagcucccucuuuggcccaugaguuauuuagauauauuuauuuccaaauauuuggaguuuuccagcuauauuuuuguuacuuauuucuaauuuaacgcuacugucugaaaacauacuuuguaugauuucuguuuauuuaaaugcguuaaaguauauuuuaugucccagauguugucuaucuuggugaauuuccaugcaagcuuaagaauaaugugcguuuugucauuguuggauggaauaugcuauaaaugucuauuagaucaauugauauagaugacuguucagaucaucuauauacuuaguaauuuuuuuuccuucuugauuuaucaauuacugacagaaggguauuuaaacucuccaguuauuacagugaauuuugccuauccucuugcaguucugucaguuuugccuuauauauucuggcacucuuuuguugggugcauacauguuuaggauuguuaugucuucuuggaaaauugacagcuuuaucauuauguaauaccuuccuuuuucucugauaaucuuccuuguucugaagucugcuuugucuaguauuaauauagcuaauuaauauaucaauauaacaauguaauaaagguauuccaucuuucuuuugauuaauuauagcaagcuauaucauucuuuuuuuuuuuuuuuuuuuuuuugagacggaguuuugcucuuguugcugcgcagccuggagugcaauggugcaaucucagcucaccacaaccuccaacuccuggguucaagcgauucuccugccucagccucccgaguagcugggauuacaggcaugcgccaccacaccuggcuauuuuuguguuuuuaguagagacaggguuucuccauguuggucaggcuggucucgaacuccugaccucaggugauccaccugccucagccucccaaauugcugggauuacaggcaugagccacugugccuggccucccuuuacuuuuuuuguaacuuuuagucauguggcuuuuuaaugaaaggguauuuaaacuauaaucacuaauacaugaagaucuucaaaaaauuauauaauagagauccuccuauucagaauuuugaaguccuuguuuuaaucuguaacaaagagcuguuuugaacucagcugagccuccuuggauggggcauaagaggagcaucuguuaucugcuuucaauccauugccccuuugucccuuuacaaguuaccuuacccagaauugccugugcucaugauucuuucguucuagcuaucuuuguuuucuaccuccuccucucugacuuacuuucuucuccugcuaauauuuucccccauuuuaaaaaauuacaguaaaauguacauagcccuaaaauuaacuaucuuaacuauuguguguauuuccuuggcauuaagugcauucauucuguugugcagcuaucacugcuauccaucucaagaacucuucaucuugcaaaacugaaacucugugcccauucaacaaagacuccacauccuucccucuucccuuuuaccuucuauuucuaugaucaggacuauucuagccuuauauaaguagaaaucauacaguauuuaucuguuugugacuggcuuauuucacuuaccauaauauccucaagguacauccauauuguaacauauguuagcauuuccuuccuuuuuaauucugaauaauauuuuguuacaucuauauaccacauuuugauuaucuguucauccaucauuagacauuuggauuguuuccacauuucagauauucugaauauggauguacaaagaucucuuugagacccugcuuucaauucucuaguguauacucagaguggaauugcuggaucauaugauaauucuauuguuacuuuugagaggaacuuuuauacuguuuucacaguggcuguaccauuuuacaugcccaccacugaugcagaagaguuccagguuuucaguaucaucaccaaaacuuauuacuuucauuuuucgggguguuuuuuauaguggcuauccuaguggguguaaaguaauuaucccuuuacuuuuacucugaaucuuuauauuuaaagugaauuuucuuguagacagcacauaguuugucuuguuuuuuaauuuacucugauaaucccugucacuuaauagguauauuuaggccaguuacauuuaaagugauuguugcuguaaccagauuaauaucuaccauguuuccaacuguuuucuuucuguucauugcauugguuauugguuucuuuucucccucuuuuucugccuucgucaguuuugaguacuuuauauaaucuuaucuccucucucaaaauuuugauuauacuuauuuuaaaaauuuuuagugguugcccucaguuuuacaguauacguuuuuaacuaaccuagguucuuaagacaacacuauacugcuucauuuguacuauagguauuuuauaagaguauucccaauucuucccucccaucccuuguaauagugcugucauuuauuucacuuacccauaugcuguagcuacccaguauauuguuacuacuauugcuuuaaacaaaucauuaccuuuuaggucaacuaagaauaagaaaaauaaaagauuuuauuuuaccuuugcuuuuuccuucuccagcacucuuucuuucuuuguaaauccaaguuucugaccuauaucauuuuccuucugcuugaagaacuucuuuuaacauuucuugcagggcaaauuaucugcugauugauucuccuuauuuuuguuugucugagaaaguuuuuauuucucauuaaccuuugaagugcaauuuugcuggauauagaauguaagguugguggguuuuuuuuucagcacuuugaauauuucacuacacuuaacauggcuuuugacaugcucuccacuguaauucuuaucauuauuccucuggagguagggugguuuuuuuuauucugccgucuuucaagauuuucgcuuugucuuugguuuucugcaguuuggguaugaugugcuuagguguagauuuuuaaaauauuuauugugcuugguauccucucagcuucuuggaucugugguuagguguuugucauuaauuuuggaaaauucucgcuuuauucucucuucucugauauuccaauuagauguacauuccacuuuuugauaaugccccaugauuuuggauauucuguuuuuuucauucuuuuuucucuuugcauuuuaguguaggaaguuucuacuggcuguccucaauugacccauucuuuccacacccacguugaaucuacugaugagcccaucaaaggcaugcuucauuuuuucuuuguagaauuccuuuugauucuuuuuuuacaguucugucucugugcuuacuagucucuucuugcauguucccuacuuauuuucauuacagcccuuagcauucuagucauaguuauuugaaauacccuggugauaauuccaacaucuuugucuuuuucugaugguuguuuuguuucuucagacugggguuuuucuuguuuggggcaugaaaauauuauaauuucuuguugaaagcuuggugucuuguaugcaguaauaagaacugagauaaauaggccuuuagugugaggauuuauguuaauccagcuagaaguuggguuguguguuuaauguuuguuguagcuauagguuaucagagacuugaagcuucuuuagcguacuugauuuuuugucucuacucuugacuucggaacuucccuaaguauuacuccucagagggagccuuuuucuugcaguucuuucagcuaauaguuguuuccgcuauuauucuugagcacuguuuguauaauguuaagaugugagggagaaggacaugcuaugaucuuugauuaagucucagguuuucagggggcuugucuuaugguugugaccuucacaaguguuucuccaguaguacagcuuucuucccccuguucccuauucccuuucccaucuguaguguucccaaucuauuuccugaagccccuguccucucuugacuauggguugucguauucucuucuaacccccacuuaggucaaacaggaaagcugaagaaaauuggaggaacaaggaauuucuuuccucuagcugggauaagcuuucacaauuaauucucuggaacagguucugggcauguuucaugaugguuacucuuccucucccccugccagagacaggagggaaucuuuuggaauccucgugaugacaaccugguaaaauuccuggagggaauguccacagaaauguagucaccccuaagacuguggcccccaggauuuuuucauucucacaauaguccacacucaaccucuagcaauuuguaagauuaccuuuuaaguguuccuaccaguuuaugucucccauggcuucugcuucauguaagcaaaucuugguugcuguaugucucugaaugcaccugucucuacaguuugggguggggauuugcccugcaaucucauuucucuagugaguccaggaaagucauucauuuucaauuuuccagcuuuuucuuguaagaaugaaaaugaugacuuucaagcuauuuacaugccaccauugaaacuggacaucucuccuggcuauauuuuuaauuuucaacaucuguaauuuuuuuuuuguuuuuuuuugagucagagccuuacucuguagcccaagcuggagugcaguggugcgaucucggcucacugcaaccccugccucccaggcucaagugauucucaugccucagccucuugaguagcugggcuacaggcaugugccacuacguccagcuaauuuuuuguauuuuaguagagaugagguuucaccauguugcccaggguggucuugaacuccugagcucaagcaaucugcccaccccagccucccaaagugcugggauuacaggcaugagccaccacaccuggccuguaaacuuuuuuuuauaacagcuuauucuuguuuuaugguauucuaauauugauaucucuugaaguuuucuccuguuuccuuauuugcuguuuccuuuauuauuucucuuguugaauuuuaugccucucuuucauuguguuaauuguuaauucuagauuguuuagcuuucuauacauauuugccuuugauuaucccuauauuagguuguugauagguuguugaccuaucacaaguuuauucauaaaaguuugucauaagcacucuuuuuggggaaggagguuuaagguuuugucccaagaaaaaaagcuaggguagcguguggcucaauaggagcagaagcagcaguauuucuggcucagacuauccaaaaauaguuuguuuuuguuguuguuguuguuuuguuuuguuuuuuuaauuacucauguauuuucucauguccuuuacucuauggaauaucucuggucuugcuuaucugcucauuugaaaacuuuuuuccucugccagauuuagcuguagauuuucucuauuuuuuuguuuucaccaaaccacuuucuaucguuuaagaauucuucaacauuuuaauuuuaagaauggcauuuucuuuuuucuuuuucguguguguguguaugugugugugugcguguguguguguguguguuuagagagacaggguuucacuuuguugcccagacuggaguguggugaagugaucauagcucauugcagcuuugaacuccugggcucaagcaacaauccccccaucucagcuuccugagcaggugggacuacaggugcacaccaccacacccagugacaucccuuguuauacaaguaguuguuucuguaauuuuaagagauuuugguuggaaaggaagguagacaaguauggcucaauccagcuugauccaaucacauucacuuucaauuaaugaauagauuuguuacuauuaguagugguaaguuaauauuaauugagcauuuaguuuaugccaggaaacaugauaaauccuuuaacuauauuuuaaucauuacuuaaacacaguaaaguagauauuguuacuauuuguauauauguuuaagaaaauggaaacuuaaaaacauuaaauaaucuacacagcaccacacagcuaauauaucuguuggagcuaggauaugaacccaaauucuaucccagcaaacucaauuaaccucaguuccucacucaccugaaacuuccucccucaaguugauuugcuaauaagaugccucccuucuaccaggccaaauccuguguaucauucaaggcccagcuuuaaaugccaccucagcagcagugcucugggcaauauuccagcagaaagaaaacucuuaacuuuuaauuuaacuuuacauuuauuugaccucuugucuagcacuuucuacuuuauauguaauacagucauuugaugcauaguuucgucccuacugcacaaugagaucacuaggaaaagugucaauguccuugugucacuuauuuuuacaauucccagcauuccccagcauguaccauuuuaauaaauauuauuaauaaguaauuauauuuauucaguuuaacuucuuuaauuuauaaaugcauccuuauuggcucauuauaaauauuugcauggauuuuauuuaaauaugauuaaaggaucuugagcauauuuguuuuaaaccugucuuugggauuaauauuuaugaauauccaggaaauggcaaauaguuuuagaacuaauuagauagaggcuucucauuauacuuacgucaauaaagauaucugaauauguaugaaaauuucaaggagauucaggauauuugggagccauuugcauacuaacuaaacauuuugauuuuuccuucuggaaguuaaauaaaauggauuacaauauggaaggugauucccaaauuaaaaguaggcaucaaauaaaucauugcuuuugucacauaaaccuugaaggaaaauagcauaucugucaagucuuaaaauucaugucagaauuucacaaagcaauugauuauaagcuaucuuucuuuuaaauaguacguagcaaagaaguuugugccauuucaaauaagugacaugucagacauggagucccugagauuuauuagcaagaccauuuuguucuguuucagaaaauuacagaauuuuggaauuacaaauuuuaccuguacagugguuaucuuuacaguaauccuuaccauuuucuagugauaggguauucuuucucacaagacaucccauucuaguguuuaguagaacuuuauuuuuuuuaaaaacuguuccuuauuuuaaacuaaaaucugccuguuuucuaaagcuucuuuuuuaccuauacuuugaacuuacagaaucuauaaaaaucuuaagauuggcuaggugugaugacucaugccuguaaucccagcacuuugggaggcaggggcacauggaucacuugagcccaggaguucgagaccaaccugggcaauauggugaaaugccgucucuacaaaaaacacaaaaauuagugggacaucguggcacgcgccuguagucccagcugcucaggaggcugaggugggaggaucacccgagcccaggaggucaaggcugcagugagcugugauugcaccacugcacuccagccugggugaaagagugagacccugucucaaaauuaaaauaaaauaaaauaaaaauaaaaacaaaaaaccuuaagauuuucaugcuaacucccaugacagcaguugucaagcauaaugggauagggcauagggaguggggauauaguucuuucucugagucuccugagagcagauguuuauaaacuagauugugacaggauaaguggaugcuaauucugaaucaucaccaauguguaguauuauuccucugcuuuaguuuucuuuuauucauuaucauuauauuuuaaauuuggaaaaaguuaugaauuguauuagcuugggaagggaagaauaaauaugucuuuucuuauacuucucauuuaugagcuucaugaaauaugacuaaucuguugagagacaccauugggaacaaccuguguacagccugaacucauuguaucugccauguauuuuucaguggcuccuuuacaugacagauuacucucaggagcaaauaauaugcagcucuucucacauuuuguuaguguuuuuauuuuuaauaaagugcuaugauuaauagccuaguguuauuguuguuuccccauugaguguaaaugcuucauuugaaugucuuuaaucugaaggaacaguuguuuuauuggacucuuguuauuuuucugugcuucucaagguuuuuugauugcuuucuuugagcucuuugcaauggaggaaaugaacucuaucagaaucauggaguaggacuccguagagaaauuuugaggaugaauacugagauacuugaacauucauacauacauuuuuaugauaauuucagaaugguagacacaccauuagcaauucugauugacucuccaguggcaauuauaaaaguagcuuggccgggcacgguggcucacgccuguaauuccagcacuuugggaggccgaggcagguggaucaucugaggucaggaguucaagaccagccuggccaacauggugaaauccuguuucuacuaaaaaacaaacaaaaaaaagcacaaaaauuagcugggcguggguggcaggcgccucccagcuacucaggaggcugaggcaggaaaaucacaugaacccaggaggcggagguugcagggagccgagaucgcaccauugcacuccagccugggcaacaagagcgaaacucugucuaaaaaaacgaaaaaaaguagccuaugucuggccuacugguauugugaugacauugccauauagauccuaucugaagugccaugugcuuucaauaagucuuucuguuguuguuguuguuugcaaaucagaguuaaaguauaagacaagacaagagguggacacaaaaggacuauugaaaaguugagaaauugugaacugagcuuuuacaagaauauggugcccacuuaccaagaggacagcucuucuuguuauuuuugcccuugaaguggugauacccuuuagccuagucauuucugcauuuacucccaggagccuggcugugauuagaaguguuuccuguagccauagaccaauuuuccuuuuguucaagaauccagaaggcaaguugggccucauuggcaccaaccaucaaggacuucauuagcccuaaccaggggccaacuaaauugucaaauuggaaaugaaggacuuuacaugaauucaaagccacugauaagagagcuugaaggcuuaucuugugaaacugaguguugaaugcauaacuuuuauuugagaaagcaaauaacuuggguggaacuucuacaaauuagagcaaaauaauuuaggauuuauuuggagguuuaauagcuuguuagguguagccuugaauauguagcauaacauaugcauuuauauuauauacuuagaaacauucuggucuuuuugguuaauaagaguauuacuuuuacuggcucuuagauuguuucagaggaauuagagcugucuaguuuuguauaaucaagucuuuauuuucauguaaacuaaguaaguucuguuuagaaagucagccccagaagguuuauuuacgcacuauauaagcucauguuuuaagauucuccauauccccaaaauuaacauuuuuguuuguaaguguucuguuaguuuuuagucauugaagaagcauuuauugaauguauaguaauauuacuuucuacaaagaaaacgaaugucauaacauaaaaauacauaaacauuuuuuacaaugaccagagcuuagaaauacuuuaaauacagcauuuuuuaaaauuacagugguacuucuuugaaagagguugucugauaauuauuguaauaucuuaaaagcacuuggaccuuacuucuggccaugaccgaauaacuaguacuggacuaggccucuugcuguaaacagcuagaaaauuagacaaaauauauggaauacauguuuguagacauuugaaaacaugcagaaccaugaucccuaagacuaaggaaaacaaaugggaugagccccauaauugcccucccagcuuuccgcuuggagccacuuuucuguagcauaagaugccccauuuaugaacaggcagaagggagcagacagcccagcagucucagugagacugagaucagaguuuagguguagaaaaguagguggggccgggcguguuggcucacgccuguaaucccagcacuuugggaggccgaggcgggcggaucaggaggucaagagaucaagaccauccuggccaacauggugaaaccccgucucuacuaaaaauacaaaaauuagccaggcgugguggcacaugcguguauucccagcuacucgggaggcugaggcaggagaaucacuugaaccagggagucagagguugcagugagccgagaucgcgccacugcacuccagccuagcgacagagcaagacuccaucucaaaagaaaaagacaauaaaaguagguggaauuugugcagcaggcuacuggagagaagagaaauaugcagagaagaagcccaaggaagcuauauaggguuccccuugagucuuuugggucucacauuacauuuagucuccuucaguuugugauaguucuucagucuuuccuucucugccauacccuugacacuuuugaaaaguauuggucagguauuuuguccaguguucucaguauggauuugucugauacuuuuuugugauuacauugagguuauggauuuuuuuuggaggaauaccacagaagugauguacccuuuucaauacauucguaucgggguacaugauaucagcauguccuguuauuugguaacguuaacacugaucaugugguuaaggugguuuuugccagucuucuugcagucaucucugagcccagagccucucugauuuauuuaguuucuccugaguguaaaucuccuauugccaagggugagggauuuggagauuuaaagcucuucuuacaggagcuuucaaauaauuccuccaucccccauaucauccuuuccuccugaagugcugcugauuccugaaggucaguuggcuugaggcucaccugucugucccuuuggagguacuuagauugacucuuucccgugaaauaauuuacuuuucuucuauccaccuucuucuuucauauauuauagauuaggauuacaauccaaaauaucucucaguuuuaucagaaauggaguuuguguuccuauuucuuguccuguuuguuguuuggguguauuuaugaagugguggacccagaaauguauucgaccuuccaugcuaaaacugaagcuaaaaauagcuuuuucagaagacaguauuuggcaucauuucucaggcauucaaauacaaacuuuugacucagcauuuccacuucuagcaauuugucuuacagaaauauuuacacauggacccaaagauaacauguauaggaaaguuuauagaagcauugcugauaguagcaaaaaaaaaguaauggaaacagcccaaaaaaaaaggaaaaacaagggaaugauuaaauaaauggugguauaucuauauuguagaauacuauucagcaauuagaaauaaugagguuugucuuuauguacuguuaugggaaccuccuaaagacauuacaucauauagcaguuuguaaagcaacauguuugguaucauuucauucccauauuuauguguauauaaaagugugucauugaaaugaaaaauauuugaaagaauaugcgccaaacuauuaauagcaguguuuuggaggucaucaaaagggaaccauaaucuuuguauacuucuuaaacuuuguauacuucuguaccauauguauuauuuuuauaacaagcauauugcauuuugauuuuucaauaaaaagaugaaauagacuaccuacagcaguaguugagcaaccacuggagguuuucaggcaugggcucuuuuuguuguuguuguuguugguugaauuugaaugucauuccugcauuggucauuuauuggauuucucuguagcauuuauuuauuuucauuuuuccguaaguuauuaggguacaggugguauuugguuacauaaguucuuuaguggugaucugugagauuuugguucacccaucaccugaacaguauacaaugcaccauauuuguagucuuuugucccucgccucccucccaccauucuccccaaguccccaaaguccauaucauucuuaaugccuuugcguccucauagcuuagcucccacaugucggugagaacauuugauguuugguuuuccauuccugaguuacuucacuuugaauaauagccuccagucucauccaggucacugcaaaugcuguuaaugcauuccuuucuguggcugaguaguauuccaucguauaaauauaccacaguuucuuuauccacucauugaguaaugggcauuuggguugguuccacgauuuuacaguugcgaauugugcugcuauaaacgugcacaugaaaguaucuuuuucauauaaugacuuauuuuccucuggguagauacccaguagugggauugcuggaucaaaugguaguucuacuuuuaauucuucaagaaaucuccauacuguuuuccauagugguuguauuaguuuacauucccaucagcaguauagaaguguucccuguucaccgcauccaugacaacaucuacuguuuuuugauuuuuugauuauggccauucuugcaggaguaaggugguagcgcauugugguuuugauuugcauuucccugaucauuagugauguugagcauuuuuucguauguuggccauuuguguaucuucauuugagaauugucuguucauauccuuagcccacuuuuugaugggauuuuguuuucuuacuguuuuguuuaaauuuuuugucgauucuggauguuaguccuuugucagcuuguuaguccuuugucagauugugaagcuuuucucccacucuguggguugucuguuuacucugcugacuguuacuuuugcuguguaaaagcucuuuaguuuaauuaagucccaacuauuuauuuuuguuuuuauugcauuugcauuuggguucuuggucaugaaauccuugccuaagccaaugucuagaaggguuuuuccauguuaucuucuagaauuuuuauagugucaggucuuagauuuaaguccuuaauccauuuugaguugauuuucauauaaggugagaguugaggauccaguuucauucuccuacauguggcuagccaauuaucccagcaccauuuguugaaaaggguguccuuuccccacuucacguuuuuguuugcuuugucaaagaucaguuggcuguuaaguauuuggguuuguuuccagguucucuauucuguuccauuggucugugugccuauuuuuuuagcaguaccaugcuguuuuggugacuauggccuuauaguauaguuugaaaucagguagugugaugccuccagauuuguucuuuuugcuuagucuugcuuuggcuaugugggcuuuuuuguuuguuuguuucauaugaauuuuagaauuguuuuuucuaauuucguaaagaaugaugguggcauuuugaauggggauugcauugaauuuguagauugcuuuuggcacuaugaucauuuucacaauauugauucuaugcauccaugagcaugggaugcauuuccauuuguuuguguugucugugauuucuuucagcaguguuuugcaguuuuccuuguagaggucuuucaccucccugauuagguaaauuccaaaguauuuugaguuuugcagcuauuauaaaagggguugaguucuugauuugauucucugcuugguugcuguugauguauagaagagcuauugauuuauguacauuaaucuuguauccagaaacuuugcugaauucuuuuaucaguucuaggagcuuucuggaggagucuuuaggguuuucagcguaaacuaucauaucaucagcaaacagugacaguuugacuuccucuuuaccgauuuggaugcccuuuauuucuuucucuugucugauuucucuggcuaggacuuuccaguacuguguugaaaagaaguggugagagugggcauucuugucguguuccuauuuucagagggaaugcuuucaacuuuuccccauucaguauuauauuggcuguggguuagucacagauggcuuuuauuacauugaaguaugucccuuguaugcugauuugcugcuaacaauuuuaaucauaaagggauacuggauuuugucaaaugcuuucucugcaucuauugagaagaucacaugauuuuuguuuuuaauucuguuuaugugguuuaucacauuuaauucacuugcguauguuaaaccaucucugcaucccuaguaugaaacacacuugaucaugguggauuaucuuuuugauaaauuguuggauuugguuagcuaguauuuuguuacggauuuuagcaucuaugcuaaucaaggauauuggucuguaguuuucuuuuuugguuauguccuuuccuggcuuugguauuaggcugaugcuggcuucauagaaugaauuagggaggguucccuuuuucucaauauuguggaauagugucaaaaggauugguaccaauucuucuuugaaugucugauagaauucuacugugaaaucugucuuguccuggacauuuuuuuuguugguaauuuuuuuuuaauuauacuuuaaguuuuaggguacauguguacaaugugcaggcuaguuacauauguauacaugugccauacuggugcacuguacccacuaacucgucaucuagcauuagguauaucucccagugcuaucccuccccccuccccacaccccacaacaguccccagagugugauguuccccuuccuguguccauguguucucauuguucaauucccaccuaugagugagaauaugcaguguuugguuuuuuguucuugugauaguuuacugagaaugaugauuucuaauuucauccgugucccuacaaaagacaugaacucaucauuuuuuauggcugcauaguauuccaugguguauaugugccacauuuucuuaauccagucuaucauuguuggacauuuggguugguuccaagucuuugcuauugugaauagugccgcaauaaacauacaugugcaugugucuuuauagcggcaugauuuauacuccuuuggguauauacccaguaaugggauggcugggucaaaugguauuucuagaucuagaucccugaggaauagccacacugacuuccacaaugguugaacuagauuacagucccaccaacaguguaaaagucuuccccuuucuccacauccucuccagcaccuguuguuuccugacuuuuuaaugauugccauucuaacuggugugagaugauaucucauugugguuuugauuugcauugcucugauggccagugauggugagcauuuuuucauguguuuuuuggcugcauaaaugucuucuuuugagaagugucuguucauguccuucgcccacuuuuugaugggguuguuuuuuucuuguaaauuuguuugaauucauuguagauucuggauauuagcccuuugucagaugaguagauugagaaaauuuucucccauucuguagguugccuguucacucugaugguaguuucuuuugcugugcagaagcucuuuaguuuaauuagaucccauuugucaauuuuggcuuuuguugccauugcuuuugguguuuuagacaugaaguccuugcccaugccuguguccugaaugguaaugccuagguuuucuucuaggguuuuuaugguuucaggucuaacauuuaagucuuuaauccaucuugaacugauuuuuguauaagguguaaggaagggauccaguuucagcuuucuacauauggcuagccaguuuucccagcacuauuuauuaaauagggaauccuuuccccauugcuuguuuuucucagguuugucaaagaucagauaguuguagauaugcaguguuauuucugagggcucuguucuguuccauugaucuauaucucuguuuugguaccaguaccaugcuguuuugguuacuguagccuuguaguauaguuugaagucagguagugugaugccuccagcuuuguucuuuuggcuuaggauugacuuggcgaugcgggcucuuuuuugguuccauaugaacuuuaaaguaguuuuuuccaauucugugaagaaagucauugguagcuugauggggauggcauugaaucuauaaauugccuugggcaguauggccauuuucacgauauugauucuuccuauccaugagcauggaauguucuuccauuuguuuguauccucuucuauuucauugagcagugguuuguaguucuccuugaagagguccuucacgucccuuguaaguuggauuccuaaguauuuuauucucuuugaagcaauugugaaugggaguucacucaugauuuggcucucuguuuguuauugguguauaagaaugcuugugauuuuuguacauugauuuuguauccugagacuuugcugaaguugcuuaucagcuuaaggagauuuuggguugagacaaugggguuuucuagauauacaaucaugucaucugcaaacagggacaaauugacuuccucuuuuccugauugaauacccuuuauuuccuucuccugccuaauugcccuggccagaacuuccaacacuauguugaauaggaguggugagagagggcaucccugucuugugccaguuuucaaagggaaugcuuccaguuuuugcccauucaguaugauaguggcuguggguuugucauagauagcuuuuauuauuuuagauacgucccaucaauaccuaauuuauugagaguuuuuagcaugaacggcuguugaauuuugucaaaggccuuuucugcaucuguugagguaaucaugugguuuuugucuuugguucuguuuauaugcuggauuacauuuauugauuugcguauauugaaccagccuugcaucccagggaugaagcccacuugaucaugguggauaagcuuuuugaugugcugcuggauucgguuugccaguauuuuauugaggauuuuugcaucaauguucaucaaggauauuggucuaaaauucucuuuuuugguugugucucugcccagcuuugguaucaggaugaugcuggccucauaaaaugaguuagggaggauucccucuuuuuguauugauuggaauaguuucagaaggaaugguaccaguuccuccuuguaccucugguagaauucggcugugauuccaucugguccuggacucuuuuugguugguaagcuauugauuauugccacaauuucagcuccuguuauuggucuauucagagauucaacuucuuccugguuuagucuugggagaguguaugugucgaggaauuuauccauuucuuguagauuuucuaguuuauuugcauagaggugauuguaguauucccugaugguaguuuguauuucugugggaucgguggugauauccccuuuaucauuuuuuauugugucuauuugauucuucucucuuuuuuuauuagucuugcuagcagucuaucaauuuuguugauccuuucaaaaaaccagcuccuggauucauuaauuuuuugaaggguuuuuuguaucucuaucuccuucaguucugcucugauuuuaguuauuucuugccuucugcuagcuuuugaauguguuugcucuugcuucucuaguucuuuuaauugugauguuagggugucaauuuuggaucuuuccugcuuucucuugugggcauuuagugcuauaaauuucccucuacacacugcuuugaaugcgucccagagauucugguauguugugucuuuguucucguugguuucaaagaacaucuuuauuucugccuucauuucguuauguacccagcagucauucaagagcagguuguucaguuuccauguaguugagcggcuuugagugagauucuuaauccugaguucuaguuugauugcacuguggucugagagauaguuuguuauaauuucuguucuuuuacauuugcugaggagagcuuuacuucccaguauguggucaauuuuguaauaggugugguguggugcugaaaaaaauguauauucuguugauuugggguggagaguucuguagaugucuauuaggucugcuuggugcagagcugaguucaauuccuggguaugcuuguugacuuucugucucguugaucugucuaauguugacagugggguguuaaagucucccauuauuaaugugugggagucuaagucucuuuguaggucacucaggacuugcuuuaugaaucugggugcuccuguauugggugcauauauauuuaggauaguuagcucuucuuguugaauugaucucuuuaccauuauguaauggccuucuuugucucuuuugaucuuuguugguuuaaagucuguuuuaucagagacuaggauugcaaccccugccuuuuuuuguuuuccauuugcuugguagaucuuccuccauccuuuuauuuugagccuaugugugucucugcacgugagauggguuuccugaauacagcacacugaugggucuugacucuuuauccaauuugccagucugugucuuguaauuggagcauuuaguccauuuacauuuaaaguuaauauuguuaugugugaauuugauccugucaguaugagguuagcugguuauuuugcucguuaguugaugcaguuucuuccuagucucgauggucuuuacauuuuggcaugguuuugcagcagcugguaccgguuguuccuuuccauguuuagugcuuccuucaggagcucuuuuagggcaggccuuguggugacaaaaucucucagcauuugcuugucuguaaaggauuuuauuucuccuucacuuaugaaguuuaguuuggcuggauaugaaauucuggguugaaaauucuuuucuuuaagaauguugaauauuggcccccacucucuucuggcuuguauguagaguuucugccgagagauccacuguuagucugaugggcuuccuuuuauggguaaccugaccuuucucucuggcugcccuuaacauuuuuuccuucauuucaacuuuggugaaucugacaauuaugugucuuggaguugcucuucucgaggaguaucuuuguggcauucucuguauuuccugaaucugaauguuggccugccuugcuagauuggggaaguucuccuggauaauauccugcagaguguuuuccaacuugguuccauucucccugucauuuucagguacaccaaucagacguagauuuggucuuuucacauagucccauauuucuuggaggauuuguucguuucuuuuuauucuuuuuucucuaaacuucccuucucgcuucauuuccuucauuucaucuucaucgcugauacccuuucuuccaguugauugcaucagcuccugaggcuucugcauucuucacguaguucucgagccuugcuuucagcuccaucagcuccuuuaagcacuucucuguauugguuauuauaguuauacauucgucuaaauuuuuuucaaaguuuucaacuucuuugccuuugguuugaauuuccuccuguagcuuggaguaguuugaucgucugaagccuucuucucucaacucaucaaagucauucucuauccagcuuuguuccauugcuggugaggaacuggguuccuuuggaggaggagaggcgcucugcuuuuuagaguuuccaguuuuucugcucuguuuuuuccccaucuuugugguuuuaucuacuuuuggucuuugaugauggugauguacagauggauuuuugguguggauguccuuucuguuuguuaguuuuccuucuaacagacaggacccucagcugcaggucuguuggaguuugcuagagguccacuccagacccuguuugccuggguaucagcagcagugucugcagaacagcgguuuuucgugaaccacgaaugcugcugucugauuguuccucuggaaguuuugucucagaggaguacccggccgugugaagugucagucugccccuacuggagggugccucccaguuaggcugcucaggggucaggggucagggacccacuugaggaggcagucugcccguucucagaucuccagcugcgugcugggagaaccacugcucucugcaaagcugucagacagggacauuuaagucugcagagguuacugcugucuuuuuguuugucugugcccugcccccagagguggagccuacagaggcagacaggccuccuugagcuguggugggcuccacccaguucaagcuuccgggcugcuuuguuuaccuaagcaagccugggcaauggcuggcgccccuccccaagccuugcugcugccuugcaguuuggucucagacugcugugcuagcaaacggcgagacucugugggcgugggacccucugagccaggugcgggauauaaucuccuggugcgccguuuuuuaagcccgucagaaaagcgcaguauucaggugggagugacccaauuuuccaggugccgucugucaccccuuucuuugacuaggaaagggaacucccugaccccuugcgcuuccugagugaggcaaugccucacccugcuucggcucgcgcacggugcgcugcacccacugaccugcgcccacugucuggcacucccuagugagaugaacccgguaccucagauggaaaugcagaaaucacccaucuucugcgucgcucacgcuggaagcuguagaccggagcuguuccuauucggccaucuucacuccucccccuguugguaauuuuuuuuuuuuuuuuuuuuuuuuuuuuuuugagacagagucuugcucugucucccaggcuggagugcaguggcgcaaucuuggcucacugcaagcuccaucuccuggguucaugccauucuccugccucagccucccgaauagcugggacuacaggcacccaccaucacacccagcuaauuuuuuguauuuuuaguagagacgggguuucaccguguuagccaggauggucucaaucuccugaccucgugauccgcccgccucagccucccaaaguccugggauuacaggugugagccaccgugccuggcgguaauuuuuaaauuaccauuucaaucucgcugcuuguuauugaucuauuuagaguaucuaauuccugauuaaagcuaggaggguuguacuuuuccaggaauuuauccaucccuucuagguuuucuaguuuaugugcauaaagguguucauaguagucuugaaugaucuuuuguauuucaguggugucaguuuuaauuauuccuguuucauuucuuaaugagauuuuuuggauuuucucuuuucuugguuaauuuugcuuauggucuguugguuuuauuuaucuuuucgaagaaccauaaauaaauuguucuuugauguaaaccaaaauaaauuuuaauuuaucuuuuguauuuuuuuguuuguuucaguuucauuuaguucugcucugaucuugguacuuuccuugcuuccaccggguuuggguuugguuuguccuuauuucucuaguuccuugaggugugaccuuagaaugucaguuugugcucuuucagucucugauguaggcguuuagggcuaugaacuuuccuuuuagcacucccuuugcuguaucccagaggucuuguuagauugugucauuauugucauucaguuugaagaauuuuaaaauuuccaucuugauuucgcuuuugaaccaaagcagguuuugaaccugcucuuucaggagcagguuauuuaauuuccauguauuugcauggcuuugaagguuccuuuugaaguugauuuccaguuuuauuccacuguggucugagagagugcuugauauaauuucaguuuucuuagauuuauugaggcucacuuuauggccuaucauggagaaaguuccaugcccuguugaauagaauguguauucugugguuguuggaugaaauguucuguauauaucuguuaaguccauuuguuccaagguauaguuuaaaucuauuguuucuuuguugacuuucugucuugaugacccaucuagugcugucaguggaguauugaagucccccacuauuauuuuguugcugucuaucacauuucuuaggucuguuaguaauuguuuuauaaauuugggagcuccaguguuaggugcauauauguuuaggauugugauauuuuccuguuagacaaggccuuuuaccauuauauaaugucccucuuugucucuuuuaacugcuguugcuuuaaaguuuguuuugucugauauaagaauagcuaccccugcucgcuuuugguguccauuugcaugcaaugccuuuuuccaccccuuuaaguucauaugaguccuuaugugucaggugagucuccugaaggcagcagauuguugguuggugaguucuuauccauuccgcaguuguguaucuuuuaaguggagcauuuaggccauuuacauucaguguucauauugagaugugagguaccauuacaugcaucgugcuauuuguugccaguguaccuugguuuuuuguuuuuuguuuuugcuuuuuaacuuguacuuuuguuuuauagaucuugugugauuuaugcuuuaaagacguucugcuuugauguguuuccaggauuugauucaagauguagagcuccuuuuagcggucucguagagguggcuuggguaguggugaguucuuucagcauuugcuugucuggaaaagacuguaucuuuccuucauaugugaugcuuaguuucacuggauacaaaauucuuggcugauaauuguuauguuugaggaggcugaagauagggccccaaucccuucuagcuucuaggguuucugcugagaaaucuucuguuaaucugauagguuuuccuuuguagguuaccuggugcuucugucucacagcucuuaagauucuuuccuuagucuuaacuguagauaaguuaagcacacugaugacagugugcuuaggugaugaucuuuuugcaaugaauuucccagguguuuuuugugcuucuuguauuuggaugucuaggucucuaguaaggccaaagaaguuucccucgaacauuuuccaaauauguuuuccaaacuuucagauuucucuucuuccucaggaacaccaauuauucuuagguuugguuguuuaacauaaucccagacuuccuggaggcuuuguucauauuuucuuauucuuuuuucuuugucuuuguuggauuggguuaauuggaagaccuugucuuugagcucucaauuucuuucuucuacuuguucgauucuauugcugagacuuuccagagcauuuugcauuucuauaaguguguccaauguuuccagaauuuuuuguuuuuucuuuaugcuaucuccuugaauauuucucucuucacuucuuguaucauuuuuuggauuuccuugcauugagcuucaccuuucucuggugccucccugauuaacuuaauuaaccuccugcauucuuuuucagguaaauagggauuucuucuugguuuggauccacugcuggugaacuaguaugauuuuuugggggggguguuaaagagccuaguuuugucguauuaccagaguugguuuucugguuccaucucauuuggguagguucugucagagggaacaucuagagcugaagguuguuguucagguacuuuggucccaugggguguucccuugauguagucucucccccuuuuccuauggauguggcuuccugagagccaggcugcagugauuguuaccucuuuucugggucuagccacccagcaagucuauccagcuccaggcugguacuggggguugucugcacagaguccugugaugugaaccgucuauggguuucucagcugcggauaccagcaccuguuccaguggagguggcaggggggugaaauggacucugugagaguucuuagcuuuggugguuuaaugcucuauuuuugugcugguugcccuccugccgggaguuuguacuuuccagagagcaucagcugugguaguauagagaggaaccagaggugcgcgggguccuagaacuuccaagauuauauacccuugucuucagcuaccagagugaguaggaaaggaccaucaggagggggcggggcuagauggugucugagcucagacucuccuugggcgcgucucccugcggcugcuguggaggaugggggugaguuaauggaguuguguaccuaggagcauuauggcugccucugcugagucaugcagguugucagggaagugguggaaagccgcagucacaggccucacccagcucccacgcaaaccaaagggccagucucauucucacugugccccaucuaacagccccgagucugccagcaguuggggagccaggcuugagaacuugccccaggcugccugccucccagcugugaaagaaaagggcuugauucuuccccagccuguggagucugcacaccugauucgcacccuuucccgaguucuggccaggaggguucuccccagcuucaaauuguuacaaaguucagcuggagauuuccuucucccugugguguuuuuccccacacuccuccgguugcccucccaaaggaucccuguggugccaguuaggaauggccugccuggggaccuagugagcucccggggccuuucucgcugcuuccucuaccccuguauuuugcuuggcucgcuaaauugacucagcuccagguaaggucggaaacuucucccucaaacaaccuucaguuucuccaguggggauguguguucaggagaggagaaucucccuuucccacuuccacaguuggggcacuuggggcacucacaguauuuggggugucucccagguccugcaugagcaauccacugccuucagaauccacuuccuguggguccucucgggauuucugguuuguucuugcagucaaucuggagcuuaaauucacagugcgagccuccgcacacugcucuguccguccaagucggagcugcagucuaguccugccucucccgucugccauggugauccaaagaaugccugcaugggcucuuuuaaagcggcucucugcuagacaguaucucaggaagcauuuaauucagggauggauccccagacuggauuacuguuuggggaaauagggauuucaugaucaaauaagaaugagaaaugcuagguuaacaaacagaagaggugcuaggagucauuaacauacuaauaugcauggcaaaucucuacaaucucccaaauuugauuguuguucucuuuuuuauuuuacgguauauguguuaacauuucccaaaaguaauauucuguggaaguauacuuuuguucacacuguuacuauguuuggaguaauaagcaccauguaaaucugacuccguucugaauaaugaauucugaauaauguuagagugaacauuccugggaaauaacaauuuaguagauuccuaaugaagggccagagagaaagaauauuucccaugauacuuuccuaccuuucaaaugagcuuagaaauuuuuaaagaaauuucaaaacuauuuucaaagaaagguuaugaaaaaggaacaaaauuuggauuccaaaaagaaaauguaaauguaccuacucacagcuguaguuggugugagugggcgucaaauuaggauaacuggggaucugcuuaaccaagggugcaacaugccuagugcagaauuuaaugaucuccaccuucagaaacuuucaaauacauguauugguuaaacuaauaauuauagacuguuacuaagugacacuuuaucagucacaaaucuaauguauugaaacuggaaccgucaaccacagcauagcuagauuuugaaaguuaauucucagaaauauuaggagcagcucugaugacuuacucaauauaaagccgggucaggccgggcgcaguggcucauaccuguaaucccagcacuuugggaggccaagacaggcacaucacuugaggucaggaguucgagaccagccugaccaacauggugaaaccccgucucugcuaaaaauacaaaaauuagccggguaugguggcgcaugccuauaaucccagcuacccgggaggcugacgcaggagaauugcuugaacccaggaggcagaggcugcagugagccgagaucacaccacugcacuccagccugggcaacagacuccaucucaaaaacaaacaaacaaaaaagccagaucaggagaaacgucaucauucuuuaggaacuuccacggaacaauucaauuucugcuacuuacaacccugugcaggcccuuagguuucagcgacugggccagugugaagcugcugccaagcauuugagcagcaggucagagcggacagcaaugcucacauuugaaaauguaauaccuuuucucaaauagauuucccaguggccuuuggcuugauucagauuuacaugguguuuacauacuguucuaaacauaguagcaguaugaacaaagguauaaaagcuguaaaguuccuucuuguuaaguaaccaagcaaaucaagagcacauccuguuuaggaaauaagccuagaaagcgaggaugggaccagucuggaggacuuugaacacuguccugagauguuuagacuuauucuggaggcuguuugguacaguuacaaugggugaacuuuaugguauguaaaucauacuucaguaaagcuguugaaagaaagacuggauaguugaaacuauuaaacauccuuuuuuuuccuaguguaaaacagcaauaguuacacaguccuaggacauuucuuuugcucaaaacaccugagcuuaaaaucugucugaagucuucauaaaauuaaaguguccagaaauuaucaaagacuuuuauaaaugccaaccagucaucaagggcccaaagcaaacaugaaaaauacagaucuguaggccacauguaguaaaaaccuuuguuucuuagagucaggcugguugcuuucccuucugccaccagaguaguuaucucauugcgcucuuaauuuacauuucccuaaugacuaaugaugucauuuucaugugcuuauucuauguuuucuuugaugaaaugacuauucaaagcuauugccuuuuuuuuuuuaacuuugguuguuuucuuaaugaguuguaagaguucauuauguauuuuggguauaaguuuuuuuuuuuuuuaucagauacaugauuuggaaauauugucugccagucuguugcuuuucauuuacuuaguuuuggguuguuuuuuguuguuguuguuguuuuuguuuuguuuuuuucuggguuuuuuuuagugcagaaguauuuguuuuuaauagaauccaauuuaucagggcauacuuucuuuuaugucuugugcguuugauguaacguauaaaaauucuuugcuaacucaagacaugaagucuucuagaaguuuaguucuuagauuaagacuaugagauauuuuguuaauuuuuauauaugaugugaguucauuacuuugcauguggauauauuguugucccagcaccaguuguugaaaagacuguucuucccacauugaaauuucuugacaccuuggccaaaaaucaauugaccacaaauauaaggguuuauuucuggacacugaauuaucucauugaucgaugugccuauucauaugucuugauuacuguagcuuuacaguaaauuuugaaauuaguaaauuuugaaguacaguaaauuuugaaauccuccaacuuuuuuuguucuuuuugauaauugauuuggcuauucuaggucuuuugcauuucuucuagcauuuugcauuucuucuagcauguuaauaguugccuuauuaacaacuuugaguuguucaauucaugaacauggacuaucuauuuauuuagaucuucuuuaauuucucucugcaauguguuguaauuuuuucuuuguaccagucuuacacuucuuuuagguuuauuccugaguaucuuaaaauuuaucccuagauauuuuuguuaaauuuauuucuaaguauuuuaauucuuuuugaugcuauugugaguggaauuugugaauggaauugauuucuuaauuucauuuuuggauuguuccuaaaauauagaacuacaguugguuuucauauccuccgaccuugcuagccuuauuuauuaguuuuaguuguuuuuuuuuuuuucaguagauucaugaggguuuucugcauagauaauuaugucauucacacaugaaaauaguguuauuucuuccuuucccaucaguauuuccuuuuucucuuuuucuugccauuuugcacuugcuaggacuuuuaguacuaaggaaugagaaacuaauauccuugucuuguuucuaaucuuagggaaaaagcauuuaaucuuucaccauuacauacagugcucacuguaggcuuuucagguugaggaauuuuacuucuuuuccuaguuuguugagaguuuuuaucaugaauggguguuucauuuugucaaaugcuuuuucugugucuagugagauaacuagugguuuuucuuuuuucucuuaaugugauguguuuaauugauuuuggaacauuaaacugucuugaauuccuaugauaaauucuacuuggucauggcauauaauuuuuuaauguguuaccaaauguggcuugcuaacauuuugguaaggaguuuuauacuaugaucauaagggauacuggucuguugcuuucuuuucaugugucguguuucuuucuuuucuuugucgggcuuugauaacagaguaauacugaacgcacaggaaugaguugggacauguuucuccuucucuauuuccugaaaaaguuugugaaggauuaguauuauuucucuuuucaaauauuugauaacauccagcaguaaagccauuuggacuuagaauuuucuuuguauaggaagauuuuuacuuacuaauucaguuucucuauuauaggucguucagacuucauguuuuuucuugauagauuuggcaguuuauguucuucuaagaauuuuuccccuuccucuaauaugucugauugguuggcaauuuuuuuucccaaaauauuccauuaaagcuuuuuuaguuaucuguaggguugguaguauuguacuauugucccuucuuguauucuugauuugaguaacuugugucuucucuuaguuuccuagucuucuaccugagauagaagcuuagguaauucauuugagaccucucuucuuucugauguagguaaagcacuacauuucccuuaaagcaccacucuagcugcauccuguaauuuuuaauacauuguguuuuuauuuuuauaguguuaaaaaauuguguuuuugaggcagagucucacaaucacccaggcuggacugcagugguacaauuaugacccacugcagccucaaccuccugcauucaagugauccuccugccucagcuucucaaguagcugggacuacaggugcacaccagcaugccuggauaauucuuuguauuuuuuguagagauggggucucacuauguugcccaggcuggucuuaaauuucugggcucaagugauccaccacuucagccucccaaagugcuggguuuauauaggcauaagccaccaugccuggccuguuaaaaaaauuuuuuuaaauuuuucuuaugauuucuucuuugacccuaggauuguuuaagagcauguuuaauuuucaaauauuugggguuuucucagauuucuuuuuaauucugucauuuuuugcuuucauauuuuggggcuuuuuuguuagauauguaugcauuuauaauuauuauauucaaagaagaaauaacauaauucaauaauaauugcagauuucaauauucugucaaaaacugcuaaaacuauuagacaaaguuaggaaggauauaaaauaguuaaauaacgcugucaaccagcuugaccuaacugacauuaugaaucuucauaaucuucuuuauaagaaucugcagauacagauuuuuuucaggcacacauggaacaaccuccaggauagaccacaugcuaggacacaaaacaagucucaauacauuuuaaaagaccaaaauaauauauaguguguucucugaccacaacagaauuaaauuagauauccacaguaagccugcuguuugucuggggccugcuuccucuugcuauaaaaguaguaaacaggucacaugugguggcuccugccuguaaucccagcacuuuugagaggccgaaguggguggauugcaugagcucaggaguucaagaccagccugggcaacauggugaaaccccaucucuacuaaaaguacaaaaaauuagccaggcguggaugugcaugccugugguccuagcugcucagggaggcugaggugagccugagaggcggaggcugcagugagccaugauugugccacugcacuccagccugggugauagagcaagacccugaauaugcaggcauccauccuggccccuccguauugccuucaugggacuuugggggcaugggaaacugaccaaaacaaacgagaaacucuagcugccuccacugccaugaguaauaaaguucuuugucucugaugcagcacuuguaccaucugccagcacccaugaaucaguaauaagcuaacuuguuagcuuaucaauaagguaaacucucagauccugcuuaguuccugacaguuucuuuaguucuuagaauauauuuaaauagccacuuugaagucuuuguuaaauccaguaucugaggacauuccaagaaagacauuuuguaaugacugccuuuguaaugacugccuuuuuuaccccuugauuaugagucacacuuuauuucuuugcaugucucuucacuuuuguugaauauuggauauuuuggauaauaaauuguagcaacuguggauucugacucuuccucccacccccuagcaguuuuucuuguuuuguuuguuuaauaacuugccuguacuaaaucugugauuucugccucucccagggugugcaaccacagauguuuuuguugaguauuuaguuuugauuaucuuuuuauuugcauuuucuaaaagucucuguuuagauuuugcccugugucuguauagauuagugcugaaccaaagauuagucagcaguuaugcucaaauaccucaagccaauaagccuaccacuuugagcugaugggucuuugugugguuuggggagugcauucaaaaucuggauuauuuuuuaguuugcccagccuuugcuuucuaccgggcucucucaguugucuugugaacacacacacacagguuucaucugccgggggugugugaguggcuugggccugcugcagucccuaggguacauacacauggccuucagucaaccuaggauaugugcagagguuaccaagccuucucaccacuuucucaccucauggaauaccuuguuccauggcuagucuaccauccauugcuugccucaaugagauacaaccucaggccagcagagcacuggcccuuccuauucacuugccaccaggauugcuccucuaauugacaacacuccauaucaaaugagcucuucuggcaacagcagcaaagccacugguuuguagggccugcgcuagccugguugaacaaucacucuagcagagcuagagggggaugccucagacacuguuugugugugaagucugguaauuuucaugaacagaugcuucucagcuuguuauaugucuuuggucaguuuccaguuuuugacaguuuuuuuccgcuuuauaguugcuuugggggaagaggauuugucagucucaaaccaucaugccaggagucuaaagucccaaucuacaucaucuugccauugaugcuaguguaacuuaacugccuguuugauacucugugauaacauaaguugcuuucucuuaccugcucagcuaggauauggaacagcagcaauagaaucaaccuggggaaagcugauagagaacacuggggccacagugggcauggauuuuucccaugguuaauuaggaaugauuuacaaugaucaggcauuuuuuauacuuuuauucccuguauaacuaauaaaacauuugcuuuacaaaugguauaucauuauauaaauguuauuuauauacacuuugugucaaccaaagagauuaaaauauugccuuuuguaaugagauucuagaaacauugucuucaucguacucauguucucccugaauuuccuuccauuuauuaauucaauaaauguacacuugguuaucuaaaguauacagaggcauguugagugauucccagaugaaauugauacauauuuuguccuuaaggagcuuauagauucguggaaguaauacaauguaaacaugaaaaauggaaauagggugugcuggaugccguuaaagaguuauagaucugugcuauggaaguucaguaggguaacugaguuuucccuaucuaagugauucuguuaucacucauuacucccaucaccucguccucccugcuugcauucccuccccagcugcuuuccuacugaaauccuuauguuguuacucauucaagcuagucauaguaaauaacauguacgcagagcuuccacaugcacuuuucuuguuugguauuugucugguucauaucagcuugggguuuagguagggagcauuauuauuccuaauuuacagauaaggaaacugacaucagagugauuuacccaaccucgcauauuagaagagucaaguuuugaacauaagucuuuguacucgaaguccugggcucuuuccgguaugcucugcugccucucacacagcaaacuuucucuccucucuagccaguagauaguugggaagaauuaaguuuggugaguugggucagaauuggaggcagcuuaguguguuucuagauggacaugcaaaugaggcugcaaagcaagacuguucaggcuacuuuuugaaucauuucccaauaaggguuuuuaaugacuuuuaauuuuacaauaaucggagauccauauuuucauuugcaucucauuuauuccauagguguugaauugugacuuuaaacacagcauauucaaaaccaaauucauaaucucccccucaaucuguugucuucucuguuaaugacaccucaggcuccacagucuccuaagcuaguaacuuggaagucuuugacuccuuccuaaccuuuaucucagcaucuaauccuaucguuuccagccuaccucauaggguuauugugugaguaaacugacaaaauauauaaagacaaacucugaaagcugugaaugagagguauuuauuuccucuaaggcagugcaucuguugauguguacaguacuacaaggccucagcaaccauucagaguuaauguuuuguaguguugacacuugcuuuagugaagcauguacuuaacgucggggcuaaaacugcauuaucuuacauucuuauaacaaucugcacucuuaaaagcacuaccaagggaggagaaaaaaaaagggagcaugagagagaacaaggcucucuuuugugauuugcacaagaacuggaagucaaguuuucagacucugcuuggcuauauccagaggucuuuuaaacugaaaaccaaaguugauuuuauuaauaccacuccaccacucauucucugugaccuagggcaagugauuuagcaaugucagucucuacauauaaguuagagauaaugauuguaccuauuuuauagagcugcuguaaggauugaaugaucuauauagagagccagagugccauauguaagguauucaagaagugguagcuauuggauuacucuucucccuuuccaccuaucuagagauuuuagguugguccuccuuugccauuucccugagauagauaauuuauuucacguggcguauuuauuuagacugcaucacauuacacucucgcaguucacagacauuuccaggagguuguugcuccaccacuucauucaaaacuagguucacgguuuucauguuuuccucucuacaucucuccuacuaauuucccuuuuaauguucgaacaugauucugaugaagucuuucaguuaaaaauugugagauuaaacuuguacucucuaacuccgaagugaaagagauuuuagguucaauauuaggaauaaaauucuacuaucaggacuguuguuuuuguuuuucaucaguagcaugggcugccuuggaaguuaugaaguuacccauggcuaccgcuauacaaaaguggcuuuugacuagcagcuuugccucgccacugcuuccuuucucccauccaguccuugaggucugcaagcuguuucaguauacaucgcagugaagaguguaacaaacagauuagcuaccugacuugcaauuuuuuggcuuuggaauuuuugguucaggauuuuauacuguccuagcuaaaugaauugacaaaacagcaagguauaacuuacaaugaagaaguuuaucaaccuucccccgcaggauuaccaaauacagaggugcaggguuuaauauuagacuaaaguugaagauguggcccucaauucuccugcaaaggagcucugcagugaagucacaauagccaugagccucucaguguaacuagggucauccauacuauuccauauguuaaaguagaagaaaauagugaagucuugucauuugcaagacuuuuaugcaaaguuugacagauguugcaugcugcuuucaggauuaagaaaauuacaugggcacugcugugccuucugugagaaguuuuauucucagcugucacccuccuugucccuugcccauaaccauuauaguggccagaaagucugcuugcucuacagugauguguuuugaauagugcccauuaguuuucaguaguuacccuggccugcauguuagccuucaguuuaauggccuuuuuuauguucauucauuuuauuuuauuucccaucgugguuuuguuuauuucuuuuuuguuuuuuguuuuuucuguucucuuuuuuaaaaccgucgugguuugcccuucauauuccccaauguuugcacaugacaagauguugccaucccaacauuaccucccacuucacugaccagugccacuacugaccaucuagcaccagccacaacgggaccacugccuucagcuccucgggaugucguggccucccuggucucuacccgcuucaucaaauugacguggcggacaccugcaucagauccucacggagacaaccuuaccuacucuguguucuacaccaaggaagggauugcuagguaagugccugugugucugcagccaguuggcugccucuuggucacggcagccuugucaugcucacccuggcucuugguaucuguaccaauuuuuaguccagaaaauaagaucacugagaugcaccuucccuaauuuuaggucauuaaauaaacucccaaacagacuaaaguccugguagucucuccuuuucugggaugacuuagggagaggguagauacagcuauugagguggacguauuuaaauguaagaaggagugcccuuuuuucauaagauucagucaguauaaauucuagagauuaagguagacuuaauuuauuaaaguaaacuuaaaugaauauuugccacacccuuauguggugugggcugcggagcuccagggguucuccuugauggaauaagaguaguuagugaugacuuuuccuaaaauagcauuuucauuacauuccucuucauuuccacccccucaggagcucacauugcucauaggggaagaucuauaauguccaggcugcuuugugccacaggcuggcuucacuuuaucuguccaacuugcuuuuccuuuuuccccaauguaacugacuuucuagugaaaccagucuaaucacuauagccuuuuuuuccaguguguccucuucagucacuucuugccccuuucucagcugaagguaaauucaguuaauccuucuuggcccagguuaagccccaugaagcucucaaagaucuuuacccaccuuuucagcacauagagcauuucccuuguacguguauuuguaucccuaauauuggcacuugauuaugguaauaugugauauuuuacuaccuuaagcuguuauucuucaauuauguucuauguauuugugcuguuuucccaaccagauuauaaacucuuuggaaggaaccaugccacaugcugacuguucacacauugccgaguaguaaauuccuucacugugcucuuccaaccagaauaagaaagcuaagauacguguuuuaguaggagcccuaauacaucagcuaaagcuuguauuuccauuagcaugcuuauaguugauguacauuguaguuaauaccagacuggcaaguuuagcaagugcaggacccuuucuuuaauacucucaagaagucuaaguggcauaauuuaacaccaacagaugggaguuaccugaaugcuauacuguguguuuugaguuuuacaaggguagagaaacauaguucuauacauaaaaaaagguaagacauuccuaccaaacagcaaguuucaauaucaccauuaaaauaucuucaauagacuuugaaaucucauugaaaaucucauaagcuuucacagaaggaagaaaccauuuaguaauucugcguaauaagcuuuauuucugcaguagguuuuuugcucuuauugugcguucuaccagaaaugcauuuuccucacaugaguuacaucuggcuucuuaucuaucaucuuuagaugacaucuccucaggccuucccugaauaccaacccaaacuuagccccucggugacugucacacagugggguaucagagccagccuguucccaagcuaauuguuaaaugcucgggaaauuuugcaaaccuaaugacaugacuuggcagcuugaaauugggcauggugggaguguuuacagugacaaaugcugcaaaccagagccaauuguuaaacauucaccagaacaccacugcugucacaucacccuauuuuuugguaugugugugguauuuuuuuguuuguuucgcuuuuaguuuggguuuuuuuuuuuuuuuuuuuuuuuuuuuuugagagcacuuacuacucucugaaauuuucucuuuuauuagcuuauuuauucugucugucuuguucaauaaaauucuccagcaccuggaacagagccuggcauuuaguaacacucaguaaauauuuauuaaguuaauacauuaauuucaauucguggagaaauaauagauaauucaaguaaucauguugagauugauuauccauuuggugggaaaaauaaaaguuaugucucugucuuaaauuauagauggauuaagagauaaauauuuuuaaaaucuauaaauauauuagaagaaaauauagaaaugauuuuuaucauuuggagaacaggaaagggcuuuuaaagggagauagcaaauccagaagccauaacaggaaagaguaacaaaguuacaaauuauaaauaaaagauaucccaagagacaaauaauacaagcagaugauucauaguacuggaaagcccauuagaguuaaaaaaagguuuucaccaucucaggcgaucuuggaagcaaaaugauggggguuuuuuuguuuguuuuuauuuuguuuuguuuuguuuuguuuuggagacaaaggucucgcugggucacccaggcuggagugcaguggcacuauauuggcucacugcagccuccgcuucccagguuccagcgauucuccugccucagccucccaaguagcuggaauuacaggugccugccaccaugccuggguaauuuuuguauuuuuaguagagaugggguuucaccguguuagccaggcugguaucggacuccugaccucaggcgauccacuucagccucccaaagugcuggaauuacaggcaugagccacugugccuggccaaguuaucauuuuucaucuauaaagcuggcaaaaauuuuaaguugauaauauccaguguucaaugaguugacagcuaggaggaaaaccacucuagguuauugguggcaguauaaauuagaauagucuagggaaggugauuuggcagaauuuuaaaauauuuuaaauauacauagccuuccaucacacuucuagguaacuguccuauagacauacagauauauguaugcauugggcccucauacaaacacguuuauuuauagcauuguuugcaagauuauaaaaggagacuauguaaauauccacugauagaagaaugggcaccuaauauacaaucgugcaucacauaacaacgcuucagucagacagacugcguauacaauggugaucccauaagauuauaccacugucuuuuuacuguaccuuuucuguguuuagacacauagacacuugccauuguguucgcauugccuacagcguucaguacaguaacaugcugugcagguucguagccuagaagcaauaggcuaucccauacagccuaggugugugggauauacaccuagcuauaccaucgagguuugcauaagugcauucugugauguucacacgaugaaaucacgugaugcauuugucagaacauaucccuguuguuaagcagugcaugacuguauguauacccguaaguaugguggcagcaguuuuuuuuaaaugaccugucuguauauuuugauguguauguaaaugccuaaagcagugauccucaaccagggacaguuuugcccccucaucccucgggauauuuggcaaugccugguacagcgucaguaaguaccaguagagguacuuacugacaucuaguggauagaggccagggaugcugaugaacauccugccaugcacaggacagucccacaacaaagaauuauccugcccaaugucucaguagugccaagguugagaaacccuggcauggagacugucuggugagauaugcgucaauaugugccacagucagcucucagggcaggacagguuuugacaaaagagaauugagacuuauuuuuuuuuaacuguguguacuuuuauauuuaaauguuuucaaugagacacacuuauuuaaauuuuaugauagauuguggguuggaguaagcaggaaugauuaguaaauuaauuuguaguuggaagagauacagaaguugaguuggcaggggcaggugggcaugacuaguguauguaaaggaagaggaagugcaagguaaggccaucuguguguaugcugugagaaggaugcaaaggcaagaaagcuggccaaacuggcccagagcuuuuggcagaaauuaguaagagauuagaauaaaguggacguuuggagccagaugcuggaaugccagugagaauuuggacauaaucagauaagaagggaccauuuuugacuguuaagaaaguuguacacugugauuuuauuaaacaguacuuugggaacacuacccaagauuaaaggagagaaaaaauagagucagggagacaaaauuggguaguaauuauguuagccuagauacgugcuagucgucggcuuggaugaagaugaaagcagcgacuugaaguggauaggacaaauuugggaaauauuuaaaaggaagauuuugggagaccauaauaguuuuuuguugcuucauuacuuuaugauuucugaauagaggcaaugaaggagaaguuaauuuuuuuaagucguaagacuauauccuggcuaauuguuacauaaacaaaacuuucuuauuaaucuuaucggcuuaaauuuucucaucuaaaaaacaaaaguaauauauuuacuucacagacgugugguaagaauucaaugugagaauguaugccacuaccugcauuuacaaauucacccacuuccugcauuugaaaauucagccaccagguggcaccauaugccuuggucaugagcuguaauucuuauggguaccugaguugccagagauuucagaggguccuuccucucugccuuuucagcuaugaaaauuucaucuuucuuaaaaaagcaguacuuuucuauauuaaccauuaagugggaaguggaaaguaagguauuucugcuauucauagcacuuuaaaguuggauugaagccuuagagaucuguuagucuagucaagggguuagcaaaccauggacccugugccaaauuggagcaauuauuuauuuuuauggccccggagcuaagaauaguuuuuacauuuuuaaauaguuacauuugaaauguuacauagguaacuauauaauauccuccauuuugccucuuggccuauaaauauuuacuaccaggcccuuuaagaaaaaguuugcccacccugucucauuuuuucguuuaauacauaaagaaagugaggcccagaaagcauuagugacuuuuccucacaagcuaguagcauugccagaacuagaauugcaucuccuaacuuccagcccagugcuuucuuucuauaaagugugcccuuuucuuucccuuuugauucuuagcuuucacauucuaaccugagucccacuguaaccccacacacuuaagagaauuguuguuucaaaugcuccuugaaucuuaucccaaaaccaagggugguuuuucugcacaguaacuuguuucugggaccucagaccaauagugucagaucaccuaugacugauuuuuuuuaaugguaaugcuucuauagaaauuugauguggguauuaguaaccuucacuuauuucucccauuuuuucccuuucacauagaagcaaacaaaaaauauauauaugauauuaguauacaagauuuacauaucagaaggcagauuuucguuuauucauucaauguauguuugggaugcagcuucccuguaugagcauucugcuacgugcuucugucguacacgaacaugaaugagacagucuuuuacuucaguuugaaguaaaauagucccccuccugugucuuucuagaagaaaacuuguuucaacuuuccuguguggggugaacaaaagagaccugaucuguacucucucagagagccuuuaguuuaguguaaaauacaauacaguugacuccccagaacuuaaccacuaguagccuacuguugacuggaagccuugccaauaacaucaacagucuguuaguacauauuuuuauguuauauguauuauauacgguauucuugcaguaaaguaagcuagagaaaaaauguuauuaaaaaaaucauaagggaccagguguggugguucaugccuauagucucagcacuuugggaggcugaggcggguggaucgccugaggccaggaguuugagaccagccuggccaacauggcaaaacuuugucucuacuaaaaauacaaaaauuagccgggcgugguggugugcaccuguagucccagcuacguacuggaggccagggcacaagaaucccuuggacccaggagguggaggcuucagugagccaagaucacaccagagcacuccagccugggugacagagugagacccugucucaaaacaaacaaacaaaaaaaucuuaagagaaacuauuuauuguacauuaagugaaaguagaugauccuaaaggucuucaccuucagguugaguagacugaaaaggaggaagaagaagaaaagggguuggucuuauugucucaggaguagcagaggcagaagagguggaggaaauggaagcagggcaggaaaggcaggcgcacucgguguaacuucuguugaaaaauauccgcuuauacguggaccuacacaguucaaaccugucuuguucaagcaucagcuguacuucccuuuaagacagggaucauccaugaucagaccaagugucagaaaccuuaaauuguaagaaaucaguugauccuuccuuauaaauccugugauugagagauuuagccgaagagaaaauaguauuagguaucucaaguaucucugaaaaauaauuuuuguuacuacaguauucuuuuccaggggaccuagcugauuauagagaaaaaauccucuguaaauauuguguggguacuauuguuggauuuuuuaauuaaaauaaaguaacuuaaaagaacuauagaaaauuaccaaaaagcacuucucugcagugcaaaugcucacaaucagacaaauuggcauauggucauguagaccuacacaaauuuuaaucugcaauuugaaggcaaauuaucaguauuuuaaaguaagaauuuuaauucaauaaauuagaauaauuucuucaauggaguaguuugaggcucuuuaauuacuuucucaagacagguauagcuguuuccucacaugaaugacaguuccuaaaagccaacuguuugucuaaaacaaauuccuucacaauauuuguugaaaacucuugauuaugcagucugguuuucauucuagugaguacaguagacugagcauguuuguggaccuguguuggucacacagaccccaagacagaaccuggaagccaccuuuaguaaagaaccuagauaacugguuuuaagcuuucaucucaugauauuaaauacuagaccgcuggauuugaguuguuugugauaaaguuugucaaacauuucauaucauuucauaucagcuucaaaaucaaugaaguguuaauuuuaagaaauuauaaaaaucaguauuguaaucaguuuauuuuauagacuggguuacacuuaggauuuauuuaaauguuuuauguuuuuauuuccaauuuuaaaagaugauaaccucuagcauucuuuuuauugagagucucuuagccaaaauauacacagcauucuuugauauuuucugugaaauaucauuaggucauaccaauauccaccuuccaucaauuucccuaaaacucagugauuucuaaagccuagaaaguugaugacuagcugccccauuugaaauggcauugagaagagcccugugucuucucugaaaggaaguugugauuauggucagcgauaucaguaacauuucagcaagaacaucacugauuugucagauacguaugcccuugcucuuuugccaguccccaucuucuuugcacuguccuacccccaaaagcuucauuguuugagagcuaauuugacuuacacugauagauuuuuauguggaguggaaaaugaaacuguacauucuggaaguauuccuaauuaaugcuaucucucuccaaauccuuugucuaaagggaacguguugagaauaccagucacccaggagagaugcaaguaaccauucaaaaccuaaugccagcgaccguguacaucuuuagaguuauggcucaaaauaagcauggcucaggagagaguucagcuccacugcgaguagaaacacaaccugaggguaagucuuccaccugucugucagcacccccuagagguagaccucucugaaguucuaccuuuguuuagccuugcacaccauaggggagcagaagauaacaguuccuuacuuucgggguccuuaucaauuaggggaggcaaaauuaauuuacaucaaaaaacagcaaguagggcuggguguaguggcucaugccuguaauccaagcacuuugggaggccgaggcaagcagaucaccugaggucagguuuuuuagaccagccuggccaacauggugaaaccccaucucuacuaaaaauacaaaaauuagccggguaugguagugggugccuguaaucccagcuacucgggagaauagcugaggcaggagaaucaccugaacccaagagguggagguugcagugagcugagauugcaccacuguacuccagucugggugacagagugagacucugucucaaaaaaaaaaaaaaaaaaaaaaaaaaaaacaacagcaaauaguauaagacaauauacuucuguuggugcuuuucuacguguucauauuuuacugacccuuuaagacuuagcucagaugccuucuagaaucuuuccucugauucuaauauuguuaucuccacagucuaagauauuuaucacguuuuuccuucaguuaugauuaugaacuuaccuugcugauuuuguagcaaagacagagccuuugucauccuuacauuucccacagugucuaauguaaugccuugcacaugaagaagguauuuaauaauuguucuuaacuggauugucugucuuuaggcauaccaugcucuuuagaaucuccuugaggcuuuauuuuggaccuguggucuuucgugcuaaauaggguuacuucuaauuacauuucuaagauuuucagugacgugagugucaaucagguuuauuuauauuauaaauguguuguauaucuuaaguuuggauuguaaacuaacuauaggaccgaaauuacaagcagccagaucuuaauaaaugcuuuuccuacuugaggcuuuugucuagacuuuugcuuucuuuuaacacaaauuacuguuuuuccucaguguauucuuuuuuuuuuuuuugaggcggagucucgcucugucgcccaggcuggagugcaguggcacagucucugcucacugcaagcucugccuccuggguucacgccauucucuugccucagccuccugaguagcugggacuacaggugccugccaccaugccuagcuaauuuuuuuuuuuuuguauuuuuaguagagacgggguuucacuguguuagcuaggauggucucaaucuccugaccucgugauccgcccgccucggccucgcaaagugcugggauuacaagcaugagccaucgcacccggccaccucaguguauucuucagucuaauuuuauuauuaacagcauuaguuuuucuguauuaaaaaccuccaguaauaauaaaauauuuuacuuuggguagagaguauuuuagauauauuuguagaggcuacugaccaggcagcugaacagaauaaaugacuuuaccaguggaacuauagaaauaauuuaagaacuuuaccugacggguagaauaagugaagaagcuguagaacuucacuuucuaaugcuauggcauaucauucaccugucaaauauuuauugaguauccccuauacuggguaaugugcaagauacuggagaugcaaggaugaacaagcuuggucuucuucccuuaaagaaggagcaggcaagguaggagaccuuucaucauuucagugacagagauugaagauaagaaucaaacccaggcaagaacaagagggccaucacagagucaggggguugauuuaagggaagaguguguucucauuacaggcagaauguugaauuuuacaguuaccuauguucagacaagagcaggaauacucuauuagguuucaagcucaguuacccuucaucagcuuucauauagaggcaucauucaugagagauacuaggauacagaauagagaaaacuuacuguaaaagauagaaaagucaaggcaggauccuagggaaagaugagaccugaggcuggccuugaggcauuugacuuagagcaagcauuuugugggaaggaauuugcaugacccaaaucccagaaauagaaucuaacagugcacaugcaagguaagucaugacaaaaaugaaggaaaugcaaggguccuauccugaggcugugaaccuucugaaacugcaugaaaauaaauauuugugucuguacauauucacauuucccuuggaaaggaucuguaguuuucauugucauuucagagcucauacaucagauuguugagaaccacugcgagggucauugucaaauuuagagaugaaagaaaaggggugaagaagaguggauuuauugagugcccaccaugugucagccacuguguuaggcagucaggauguaaagaugaguaagacuugacuucuguccacaaggagcuuacggucugguaccauagacaacagugugauguguuaucaccuuaaggaaaauaggcagcauaaccauuuauucaaggaguuuggcuaaaagaaaauaguuguaagaauguagguagaaaaggcaacagguucuggugaggguauuuuagggauggagaagagacuauaacauguuuuggcaaaagagaagcaguuucugaagagagauuuggauuucaucuggagguguucagcuugugugggggaggcauaaauguuggaaccagcccuuggaaaauauuuuacauauuuaguuucacaaaccaacuuaacauuuuuuccauuuauuaugccacuguacagcugaaaugaaagaauucauuagcaccuuuuuuaggaucauauuugccuacacuuggccaaugaauauauugaaaaugauuucaagagaauuuagggacuguuuuguuuuucuucuccuuuaauaaguuagaggaaaguuuuccauagcagcagaagugugacaaaucccaccugucaggcugcacaaaauaugcccuuaacugaagugaauaacgugauucauaacuaaagcaaacaacuguuagaguaaccauauucagauuucucuacuuugauagcaaaauuaaucuuaagcuguggugcuguuauucaggaaagccaguguguuuuacauuuuguuagcuuuuuuucccuucccaguuuuuaaaucuaaugaaugucuauuacagaaacacuagugccagagaaauuguuuucaaauauagaaugucuaccaaaguguaggcauagacagccacacaggauuuguguauaaauuggaacuggaaccugucagucagacaaaaauaauacaguaaaaggguaggugugugagccauuguaggagauagagccagcuagacacuuaagcagucagccagugauccagucuuccagucacauacauccuaucguggguauuguaguaaucuccuuacgggucuucuugagcccacguuuuagaaucagcaaguacucgacuccuggguccaccgcuagcuaacuuucccaucacuugggaaagauuguuaacuucauaaccucaccuguaaaugagggugauaauauucaucucacuugguuuagugcaaagauuauaugagaaaauacaugucaaguauuuagugcuugacugacuguaaccauucaauaaaugguagcuguuuuacaauuauuauuauuuuaucuagucuuguucuuuuacuguuuuucuuccaugcauguguucacauguccuuucuaaacacagaucugaucauaucaugcuccugcucauaauuuuucaguagucaccuaacaccuacuagagaaaaugugagcuucaauagcaggacauuagaggguucuucacuaucugacuagucauuguuuucaacauucucucucccauauccacucuguuucaaccaagcugaaccacuuaacacugucuuuuuguauauucucccuauugaccccauugacuggaaugauuuuccccuugguaucugaggaaaguguucauuuugcuugacuccaagaauucuucaucaaagggguuucccucccaaaccccucccaaagcagaauugugugcucucaucuuucuguuuuuguuauaaccguuaccuaaaucuguuagcacuuacgacauuuuuuguaacuguuuauaugucugacuuuccugcuagacugggaguucuuugugggcaggauucuauucaucacuguaucccuaguggcuaccacaaugcccggcaaaagaaggaucucuuucuguggugguugccuuuuaugucuuguguaggcccacugcaaaacugggauuuuauaaaucacaaggaaaguuuuucaguguaauuucugguuuugauuugaaucauaaaaaggaaaauguguuuauauauuauucuaaaaccacuucaaucaaauccauuguuuucuuagcuucuauuauuuuaaaaacguggccaauaugacaguauugccaagaaugguuauugaggaguguagcauuucauuuauaucuugcuuucucgaacuuuucuuucuaguucagcucccuggcccagcaccuaaccuucgugcauaugcagcuucgccuaccuccaucacuguuacgugggaaacaccagugucuggcaauggggaaauucagaauuauaaauuguacuacauggaaaaggggacugauaaagaacagguaugaagugaagcaacuuuucaaaccauugauuggaauaguagaguugaaauauauuuccaaaacucaguaguugcuugacuggaaaugugagggggaaaaagaaacauaggaaaugaaaaguugacagauucuauuucuuuguaccaagauuuauuguguaguuuuuaccagcaguggucagugaacaucaagcaguauuucuaaguaaauugucaauuuaugauucaucugcuuugacuauugaagaaccuuauguagaagggauaaaaucuguuucauguagaauauagaauuuguguagcuaauucuuuaauuuucaacuuuucuuuuggcuugagugcauauguauaaaguguuuuauuuuauucaaggauguugauguuucaagucacucuuacaccauuaauggguugaaaaaauauacagaguauaguuuccgagugguggccuacaauaaacaugguccuggaguuuccacaccagauguugcuguucgaacauugucagauggugagucuuucuuccucuggaacgauauaccacacuuggugccccuagugguuuaguuguaagaucaugagcuuugaugucuagaagauucaguucaaaucccaauuuuaccucuuucugguaauaugacuuuagucaagucugaacaucuuuuuucacguguaaaauguagauaauaccaacuucauugaguugcuguaaagauucagugagaaagcauagagcauaaagugccucuuacuggauaggcucucagcguuuguguuuuuagcagaagcuuuuguguaaguaaauacuauugcuuguucauaacacagaccauuccagggcuuuuggaagacuagccuuauucuacuuagcaaugauauuugcaugccaaauuagucuuucuaguuccuccguauuugugacuguuuuaucucucaccugugacugaauuucuaaauuaaguuauauauauauauacacccauauauauguauauacacccaugaccuagagcaguguuuuucgaacuacagcuugccaaagagauuaaguaggucaaaaccagcauuuaaaaaaaauauauuuuuagaauagaacagaaaagauuagaguucauugcacuuaguaaggguauauguuguuucaugaaacucagcuaaaucuuauguuuuagaaaaaugucuuuuuaaaaaaacguauuuauguguauaccgcucuuacguaaacacacaugcuuuagaagguaaaguuugacucccuuaagaaaagagucaaacuuaacaucaccaauaaaagaacagacugacaucacgugcccccuuaugugauacauggaggaagacacaauauuacuucuguuauaucaguaccaaaaauauuuaacuugaaucugaucaugaugaaacaaucagacaaauccaaauugagggaagcucugcaaaaaaaauuuuuauuuuaacugacuuggauucuuaaaauauauuaguuuugugaaagaaaaaaaagguugaggaaucauucuagaaucuagauuaaagaagaguaaagacacaugaaauaaaauauguaugaucuuuggauccugcaucuggagauaaaaaaacagccauaaaggacacuauugguauaauuacuuaauauuagauacauaugguauuaggcaauaguaaauauuagauauguuauuagcuauauuagauaauauuuuuguguuaaaauuucugaaugugauuguuguauuguguacuuuguuggagaauguccuuguucauaggagauacauggcgauauacacugaagaauuuuggagugaaguaugaugacugcagucaucucucagaugauucagaaacaauauguagauagauaaaucuguauacauauacauaauaguaagauaaauaaaacaguuguugcagaauauuaguaauugugaauuugaaaagaacagccauucauuguacuauucuugccacuguuuuccaugggcuugacaguuuucaggauuaaaaaguugggaggcuuggugcaguggcucaugccuguaaucccagcacuuugggaggccaagucgggcaacuuacuugagcccaagaguucaagaccagccuggacaacaugacaaaacgccaucucuacuuaaaaaauaauaauaauagcugggcauuaguggcacacaccuuuaauccuaguacucaggaggcugaggugggagggucaccugagcccggggaggucaaggcuucagugagcugugauuacaccacugcacuccagccuggaugacagagugagaagcugucucaaaaaaaaaaaaaaaaaaaaguugggaaaaagaaacaaauaaauuacaggcgguuauaccuuagcuagugaacuacauaagccaguuaggcaagauacuggggaaaaguuaagggaaaaaaauguuuacuguaggcuguuaaaucuacacacgagccaaauuuuaacugcauuaaguguguuggcauguugacuacaguaccugugggaacugaacacaucucagcaugguggcuaggggcagcacuuuggaauaacgcaaaucuugguuccgaugccaggugaaacaaauaucuuggacaaguuaacuucccugaaccucuucuauaguuuucugaucuacaaaauaggaaugagaauagaaacuccguccugagauuauuauaaggaauaagugucugccauguaaugaccaugcagcaaaucuuugcuaugauguugauaaugaagacaaugaugacagauauguuggauaccucugcaaccucagucacuucuuaacauggagaugacuggaaucauuaauguaauuuuuucaaaacacaugugccuggguccuacuccagacuaccugaaucucugaguuuaggcuugaggcacuuugcuaggcacaaguuacagaaaggagcaagacacauucucuugucuuccagaagcuauagcacagugggcacuuaguuguauaccuggucaccaaauguuagagacagaaaaagagaaguuuccacggguggauuaggagagaagggcuaaagucagcaauuuguaagugcagagaaaacaaauccgguuuacuuugcuugcucucaccaauaugaagggagauacuagagaaugugugggccacacacugagauaacucuggauuauguucuaaagugaggaacuaaaguuacguggcuguuuaaccaacagucccaaacuucucacaucuaaaugaguauuuucugguaucugguugccucaggaaaccagaugguucacuuuaccaguugucauugcuuaaauaucuuugcuguacuugggaacugccuucaaaaccagcuuagaaacuccacaagaaagccaggcuuacugauguauguacaucucauuuugauccaucaugucauuacccaguucagucacuugccauauuccuuagaccugguuccagaaaaaccuaugguugucugccaagauaaagauagaccagggccaggcacgguggcucaugccuguaaucccagcacuuugagaggccgaggcagauggaucaccugaggucaggaguucaagaccagccuggccaacauggugaaaccccgucucuacuaaaaauacaaaaauuagccgggcgugguagcaggcuucuguaauccuggcuacucaggaggcugaggcaggagaaucgcuugaacccaggaggcagagguugcugugagccgacaucacgccauugugcuccagccugggcaacaagggugaaacuuagucucaaaacaaaacaaaacaaaacaaaaagauaaaccaucaccaauaauacucaaaagaauacauuuaagguucugaguacauauggggucuagaaaaguugagagucuuuagaagaguucagagcuacuguacauccuugaaauaaauaucugacuucccaaagguacagccuggcuuggguguaggugcuuucccauaugaaagugucuuauguuaaaaauugaaccaggcauggcuauaugucauccacauaguauugucaacaugagggcauuggcagcuaguuuagaucuggucacguaaucaguguuugagaugugcauuuguuuaaaguccagccaagaugaucacaugaugggugauguaugggugauuaaaaaaaaaauuuuuuuuuuuuuuuuguuucucuaguucccagugcugcuccucagaaucuguccuuggaagugagaaauucaaagguaaaacuguaugaugcugcuguucauuuuuacugguauacuguugcgccucagaggggcuuauagaaagggagauucuguaggaaagcaucaaaauaaaugaauggcgaugugguaauaaucugcauuuaaaaauaccaaaccuauaaauuagaacguaagugaaaaaaaucacaagcaaagaaguaaaaagacauagauauuacacuugcauuaaagcugggcuuaaaaacccacucauuuauucuccuuaauuuugcuuccuuccucugacaccaaaacugcuuuaacauuucugcaauuaaauugcucuuuuucuguaaaacauuacauucuagauguuaacuguucagaaccuuagugguacggcagaaggaaauaaguuguuuauaacaugguuccuuagugcugugagaugagccaugugaaucaaaggcagaccucugucagauugguuguaucuccucaaacuguccuuccuauagccaaguuugcuguguucuuaggggccauguuugccucucagaggcccagagcccuucuggacuacgcagacaacuaagauaaucaguccuuucaggaaguacuguagagagccaaaugcaguggcucacgccuguagucccagcugcucggaggcugaggugagaggaucacuuaagcccgggaguugaagguugcagugagccaugauuaugcuacuacacuauagccugggugacagagugagaccccgacucuaaaaaaacaagaaaguacuauagggcuccuuuuuuuuuuuaagaggcaaccagcuguuaauuaguuguccccuuuuuaaagaguuuuauauggaaauugucuaauuucagcucuucugcacuggacacgggaaagaaucuuuauaccuaauaauaguuaguucccuaauccaugugcuucuggccuucuuauacuuuccuucugaaaacuuuucugagacuuuuauccaacaucaucuuucuggcaaaacaaccaggagaucagggguccagaguguacuacucgaauauauaaucuucccauuugaucauugaggguuuuagaauuuaaagguauuuuugagugauuauuaaauaacuuuguaaaacucugaguaccuugcugccucuauguuuuuucucuuuaaacaguaaaaucaggauaaaaauauuuaaaacaggaccaagcuuuugauauauucagccuuuuuucuauaauucugucuugugcagaguauuaugauucacuggcagccaccugcuccagccacacaaaaugggcagauuacuggcuacaagauucgcuaccgaaaggccucccgaaagagugaugucacugagaccuugguaagcgggacacagcugucucagcugauugaagguaagcuaccgugcacaaaggcaaaagguacacugugucuuucucagauauugaauuaugcuagucuaaugacugcucugaacugucgacuuauacaaacaaauuuaaaaugguucagaaaauuuuuaaugguucaauccacuucugacuugauagagauuaauggaaaacacucuuaaagguucugcuauuucugaguggugagaucgaguuugauuuuuccuuucuuguguuuucugcauucuccauguuuucauuuuugaguguauuuauugcuuuuuuguaaucuuaaaaaugauuaaagaaaguuauauaagcauagaaauuaccccacucaguauaguugguaacugaggucuacaaagugguuuuuguaacaccgaccaccacucguguguacguggccugaaacaguauuugugaauagcugcaucauugcaauaaucauacaugcgacuauggacacgauaaaguuuuagaaaauacuaucaggcaaagcuccuucuauauaguuuucccuucauaugcaacagaauaaguggcauaccugguaaaaauggauccacauguguaucuaauaugguuucacccuggagaucacagagaauccucccgucuuccucaaggaggggaaguagaguuggcuaagcaaggggaagguucuuuugcaggagaaacaugggaaccagauugagugcuuucacccugugaauguugagaucaugccuacgaagaauugagacagaugccccaagcuguccuuguuccauuggguuuucauagaugcuuaauauggcugcagaaucgacuguagucugagcagaccccauccugccgacuccuuuauuaguuuagcagugccaagacucuguccugcucaguuauacaugccucagcuucagcaccaucacccuaccucuguccuaggaguaaacucacaugggcugggccuguuggaguauugccucagcugcaucggcuuaguuuugucacucaauagagcccaucuguuuugcaagcaaacagaugaauuugagacuaguacauuuacaaccaaaaggugugaguuaucuguagcuguaacaguauagucacagggcauguuuaaucucgggacaaaagcucugacucggguaauuuuuuugcuaggaaacuccaaagcguguugguagauaagaacuauaagaaugugagauauugucauuauuuucuaagcccaagaauuaauuucaucacccuuuggaaacuuuaacuuucuuuauauuuuaucucuccuggguagacauugaaaggauuacagaagcuuggcaucacccacuuuccugugaccccagggacaggguucuugagagaaccaagaucuggggucaaaaagugucacguuuuccagccaggugcaguggcugaugccuauaaucccagcacuuugggaggcugaggcaguuggaucaccugaggucaggaguucaagaccagccuggccaacauggugaaaccccgucucuacuaaaaauacaaaaauuagcugggugugguggcacccaccuaugaucccagcuacuugagaggcuguggcaugagaaucucuugaaccggggaggcagaggccgcagugaacugagaucaugccacugcacuccagccuggacaacagaguaagacucugucucaaaaaaaguauaauguuuuuacuuguuuauggguauaaguuucuaaaaauugagagagccauugauagugaaaaacugugcucuaguaaucagcaagcuucucacuccucaccucacaaaugggauugacuuccuucagaauaggagaaggugaauguuugucuccaggggcaugucuuucagucuuccagcuucuucacaagaaccccacaucucuuagcugcaguccauaucaugacugcaguagauggugcugagaaauaucacuaagggagcauuggccacagauguucucaaagucauuuucagcugagcgugguggcucacgccuguaaucccagcacuuugagaggcugagacaggcggauuccuugagcccaagaguuugagaccagccugagcaacauggucaaacugugucucuacaaaaaauacaaaaacuuuaauggauaagcagaggcugaaaaaaaaaaaguauaaaaauuagccaggugugguggugcucaccuguggucccagcuacuugggaggcugaggugggaggaucauuugaacccaggaaguggagguugaagugagccgugauugugccacugcacucuagccugggcaacagagagagacucugucuccaaaaaaaaaaaaaaaaaaaaaguuucauauuuuacucuacauucagauaaauaacauuugccauuuguaaggcuuuucauuuugaauauuuaguuguauuuauuauauacuaggcaucauucuuguugcuguuaaaaaaaaaaaaaaagaguauaguccuugcccaugaggagauuauucauuuucucaaugaaacauuugauguguaagcaaaauagaauuuuuaugguaaaaauggcuuuauauuaagaaaauucuuacauuuuaaaaucauaucuggauuuauucauuuaauagauuucauugaacuuuuguuggcauguucuggcacugaguauacaacguugaacaaaaauggagaugcuugcacucuuaaagcauuaacuugaagccugauaaguauuagggagcaguauggaucaccaagauccuuuaccaacaacacauuauaugauuaaauuugaagcagaaguaauuauuguuauagcacuaaacagaucuugccauaucuuuaugauauguauuguauaccuuaguuguagucuauaaacucuauaggguacuuagagggagaggaacucagccucuuugcauaguaccucauuuuugcuugcucucucuuacaucccagugguccccaaaggacagggaaugauugguuggauucuuucaagaucuucauugaguaguguuugcuaguaauccagauuaucgucugucaacaaacacucuaguacuuucugguucauuguguggggagacaaggagauaaauugacuugggcccaggcauuuugcuccugccuuuugucuugcuccuugcuuuguggggcacacagaugucaggaugggccuaccaacucuucuccccuaccacgggacaggauuagcuaaccaaaccagggcuuuucucauguccuggccaaguuauguucucaguacuguugcccugguuuguagaauagacuuuucuaugugcauguuuguugcguuugauacauugguaagucauguacuuuauuagcugguaguaaauuaaaaguugcauaacagaaagguuugggucauuuuccacuuuuacuuacuauauaauauaugagcaauugguuguuaaggaauagauuuugagaccguauuuggugcuuaaaauuuuucugccaugauuaugagguggcucagagaacagagguaacucaauaggaguuacaucuuugcauucuuuccuagguuuuagugccuucuaagaccagauaccuuuguuccuuuuuuauaacucuuucauuguucuuggccucuuuuggccuuagcuuucuuuguaacacaauaaagggauugcauuaaaugaucucugaggugccuucaagcucuuaaacaaaagucuguaaucuccugggagcuucagucauuucuguuuuccucuuagauugugugggcuucagucuuugcuuuauuuggagauggaagcuacucuauguuguauuugcauuuugccuacacuguauuaacuuaaacugaaacuuugccaagcuauauacugaguuggugacugagauguuugccuuaaugagggauuauuaaucuuuuguuuuuccaaagcucuuguuucaguugucuucuuugucauuuggucucaggucuugaucgggggacugaguauaauuuccgaguggcugcucuaacaaucaaugguacaggcccggcaacugacuggcugucugcugaaacuuuugaaagugaccuagaugguaagaauaacaauuggcaagacuggaacacaauagauacuagcuguagucaaaugagucaaacuggaaagccacagacuugggguggauauggcucaagucugugaacuuuagugcaucacgcugcuguuguuccuguauugcaucgaggcugcuggaauggauuuuuugcagugccuuguagagaacuguccuuucaagcagaacuagagcaaauaaaaauguguaugugcuauaaguuggauuuuuuuuuuaaucaaggccauuaaguagauggaugaucuaaaauuuaaggcugagccacauaaaucaugccuuuauuucaacugcaguuucccuuuucuuuuaguccuggacaccuugcccuuuuucucacauguuuauucagugaguacucccaaauggguguguauagguagcaccuuuaucagugauaggugcuggacuugggaggcaaaagaccugaguucuuguucugagucucauuuuacuaauuuuuuuuuuuuuuugaaaagggaucucacacugucacccagucuggagugcagucaugguucacugcagccucgaccucccaugcuuaagcacgauccucccaccucagccuccugagcagcugggaccacgggugugugccaacacacuuagcuauuuuuuuuuagagacagggucucacuauguugcccaagcuggucuugaacuccugggcucaggugauucuuucuccuuggccuugcaaagugcugggacaacagacaugagccaccauaccuggccucaguuuacuaauuuuuaaauuaagguaguaacuuaugcccugaaaacaguguaugugaaagagcauguaaauuuccuccuuuguaagccucuuagucucucaccaauugaaucaacuguggcuccaaacuuucauguuuucugacuuaccauacuacuuaggggaguaaauaauuggugcuauugcuauaaugugaugcuuaaacaccuguuaacaacaggcuucccacuacucaguuuaugccuuucucauuccaccugguagaguuugggaauggaugugggaccaagagagaugguaacuauugaaaggcaauuuauuuuucuccauuggggcagaagagguucuuguaucucuuuguuuucucuuccaaauuaauauugcagugucuuguauuuaaagcuguucaggucuuuuuuuuuuuuuuuucuuagaaugcaguaaaaucaugggcuguauuucacuauacauacagauucuuuuugaacucuugggcauaauguaaaaaacuuagccccaaacagugugguaggaagcuaaacaccauuccccaaggauggugagauauuuuaaaggacaguauaucucaucuugcuuuuccacuuuuccuucccagaaacucguguuccugaagugccuagcucucuucacguacgcccgcucguuacuagcaucguagugagcuggacuccuccagagaaucagaacauuguggucagagguuacgccauugguuauggcauuggcagcccucaugcccagaccaucaaaguggacuauaaacagcgcuauuacaccauugaaaaucuggguauguuugcuaaguagagaaaguuaauugugugggagauuccuuucuuuuuaaccuuuuauguaauauuuuuauuuuuacaagaaaauugcgaaaauaguacaaguaauuucugcauguuauucaccugaauuccccaaauguuaacauuuaaccacauuuacagcuauauuuugcagaaugccccucaauuuagacuuggcuuaauauuucuucauuacauucagguuuugcauuuuuggaaggaauaggguagaaguguuggguuucugucagugcaucauaucaggaggcacauuacagccuauauugauaaugauguuaacuuuaaucaguuggcuaaaacgguaucugccacauuuuccugcuauaaaauuguuauuuuuuuccuugguaauuaaaaguaucuuguggaugagauacuuugagucuuuauaaacaucuuguuucccauuacacuuucacucccuaguuucagcaucuguaguaacaguuauuagaaugguguuuccccaguggugauuuucuaauuccauauuuccucuacacguguuaacauccugugauaaggaagaacuuucuuucaccccuaugaagagaauggccaaugggaaucucuuuauaacugguuccuguguccauuugacaucuuccaucuuucuuugagcacuuucuuccuuuuugacaacauaguaagauguuccuggcucaucuaguauuucacuagccucggcccuggaaccagccauuucucuaaggaacccugauuuauuuuaugaaaaaugauuuuggaaaccaauaucugggcacuauaucuauucauuguaacuaggguagaaaauccuaaggaaucuacaaaagggccacaagauacaaagugaauauacaaaaacaguaaaaugauuuuggaaaccaauaucuggucacuauaucuguucguuguaacugggguagaaaauccuaaggaaucuacaaaaaggucacuaaaacuauaagugaauuuagcaaggccacaagauacaaagugaauauacaaaaacaguuguaucuccauauacuaauaauaagcaguuggaaauuggaauuaaaauaacaauaccacguagaauagcaucaaaaaauaugaaguacauaggagcagacuuauaaaauguguguaauaucugugcacugaaaauagaaaauuguuacugagagaaauuaaagaauacuuaagauaccauguucacugguuggaagccgugauauuacuaaggugacaauucuccccagugcaguccaagaaaagucacaauaggcuuuuuuguagaaauugauaagcugauucuaauaauuuuuaugaaaaaucaaaggaacuagaauagacaauuuuuuuaaagaauaaaauuagaagacccauacuagcugauuucaugucuucuuauaauugagacauaguggugguauuguaaaggaagauguuauacaucaauggaacagaauagaguccagaaauagauccauauguauauagucaguugguuuuuagaaaagcugcuuagauaauuuaguggggagaagacagucuuuuuaacaaaaguugugggaauaccuggauauccauaugagaaagaaaaggaacuuuaacccuugucuuacgcuauaugcaaaaacagaccuaaaugcaaaugacccaaugacuuugggacaacaauucuagaagaaaguguaggaaaaaaucuuuaugacuuugggauaggcaaggaccucuuagguuguaaaacagcacaaaucauaaaauuuaaaaauugauaaauuggauuucaucaaaauuuuaaaacuucuacuuuuagaaacauaccaauaaaaugaaaaggcaagccacagacuuggagaaaauacccaccauuuaaauaucugacaaagaauuugaguccaaaauauauaaaaacucuuacaacucaauaauaagaagguaacccaauaaaaagugggcaggagauuugaacagacacuauaccaaagaaaauauaugaguggacaauaaccauaugaaaagaugcucggcaacauuaaucaucagaaaaugcaaauuaaacccacaaugaaaugcuauugcacacccgcuagaauugcuaaauguuaguagacuggcaauaacaaauaucaacaaggauacagaacuggaaugcucauacuagcugguaggaauguuugacaguacaaccacuuuggaaaacaguuuagagguuucuuguaaaguuauaacccaguaaucccacacguagauaauuaaaagaaauaaaaauacaugucuguguaaaagcuuauauacaauguucauaguaacuuuaugaacaaggggaaauaacaaauuuucaucaacagguaagugguaaaucgugauauauccauggaguacuacucagcaauuaauaggcuaucaagacacaacagaaauuaaucucauaaacaugcugaccaaagacgucaaacacuguuauauuuugugaauuacaaaauaggcagaauuuaucuauagugacaaagcaagaucagugguugccuggaaccagggguguuaggaaucaacuacaagggcaccagggagcuucucggaguauuggaaauguucuauaucuugauuuuggugguuaugaugcaagguauauauauuugucaaaacuguaaauguacaguuaaauggauacauuuuauuauaugcuaauuauaccucauaguugacuuuuuuuuuuuuuuuuuuuuugagacagcaucucacucuguugcccaggcuggagggcaguggcgcgaucucagcucacugcaaccuccaccuccuggguucaaaugauucuccugccucaaccuccugaguagcugggauuacaggcuugcgccaccaugcccagcuaauuuuuguauuuuugguagagaugggguuucaccauguugccccaggcuggucucaaacuccugaccucagaugaucuacccaccucagccuuccaaagugcugggauuacaggcgugagccacugcacccggccucauuguugauuuuaaaagcaaaagaauuugagaaauauuuauauuuuauaauaaauaauuuauuuuguuagguauaauuacuuuuccaaauuggauuaucguuauagaucuuuuuugaaacacuuguuucuaaaauuaaaaucugcccugaccaaauuuucauucagaucguuucuuuguaaacaucuuuucuaagaacaacuucaagugccuaacagaagaguuauauucauccuuucuguuaaaaaauaagcugggauuuaaauauucaaaaaaaaaguaaccuuuagcuuuuuccuuacaaggaagaaacaguacaguuaaccuaggaaauguaucccccacgugaacaucuuuuaagacaauuguuagcaaaaggaaagcuuugcugguagaauaaaaaugucuggccaggcacaguggcucacaccucuaaucccagcacuuugggaggcuaaggcaggaggaucgcuugagcccagacguucaagaccaacuugggcaacauauugcgaccucaucucuacaaaaaauuuaaaaaauuagcuaggcaugguggugugugcuucuagucccagcuacucgggaggcugagauaggaggaucgcuugaucccuagaggucaaggcugcagugaguccugauuauaccacuguacuccagcugggugacagagcaagacuuugucugaaaagaaaaaaaaaaaaugucccuguagugaccagcuucauacuguuuccuuuaugcaacuacugaugugaaacuccuuugcaguauugacaggacaugguccuugaucuucaggugcuuucagucuaacagaacaaaaagaaaacacaagaaacagugaagugaguugaagugaauuuuguucagagaagggagaacgcuauagcaagacacaguagagcagucagggaagaaaccccugagcuugaaagauagaaucaaaauagcguuugaaauagagagaugagaggagugcugcaugugcagaagagaguaagcagauagaauuuauuagaaaauggagugcacauugcagaguagcaaaaaaauuaaugcagcauaaaguaaaauaagcuugagcuauaauuauugaccuagauagaucuaagaugccuaugauguugaguaaaagaagcaagugagagguggagaaaugcaguuagcaauucaucuauucaucauccuggaacucuccccugaccuucagauccauauaaacaucugccuacuggguaucagcaccuggauauaucucauauuccaucuggcccaaaauuaaaguuaaugccuucucccucaaaccuguugaucaaucagcaaauauuuaauaaacacuuacaaugucccagacacugugcuagagauagagcagagaaugagacagacguucucacaauuauuagaaauaauacaauucaaaaauaauugaaauuguucacggugcugagggagagaaaugggcuguguaacuagagaggcuaguccaguguggaaugagcccuuugagaugaauaggcgcuuaccuagguaaacaggaagagugggaugugaccccagcauagggagcagcugcaagcgagaaggcccuguguuggagagaacacagugcucagugaacugauaaguggccgguaaugauggagcacagagaacuaggcaaagaguggugggagaagacaaguaguagauucaacaaaacuugauuguuugucuggaggggaugagggaaaaggaggucuuaauaacucccagguuucuggcuugagcagcaggguuggugguagugucguuuacuaaaccaggggacacuggagccgaucugaagcuggaggcagggugggaagggaaagauuugagacacccaagaggaaaugccaaacagacaauugaacauaaaggucuggugcucauaagaaagauccagacuagagaucuguauuuguaauugaugacacauacaugcuaaucaaagcuaaggaaaugaaugaaagugcauagggugagagcgaagagugggaauagaagaggaccuagaaucaagccuugcacauguguauuaugguugcucuugccccuuuucccaaucucagugaaugacacugcuaucuacuguguugcccaaagcacuuuuuccuugccagucacgaaguaagucuuacugauuccauuuguuguuaguucugacacaggaagaccaggugccucuauuuguugcccucuaguggcaaucuagggagugggugggccgccaagaaaagcagcuguuuuaagcuuuugagccacaugaggcauggcucaugaggcaugauggcuaggugagguuuggccauuucuggauuuggaggccacuuggagagucaaggacauugagcacuuaacugacuuaacaguuuaucuccuucuucucuaccuugucuguucccaucgcuguccuuccaggaaugaaagggguuuguuuaauuccaagcuccaucuauagacuucagcacauuaaaucuuaucucuucauucucagccaagcccuacaccauacccugaacaucacuaaaccauaggagagaccaagagagaauucaaacacagcccaccuccucuacugagacuaaauccgggaaguuggucccagccaguuuuucuguacuguguguacuuccaucuccauaucucccuacaaccugaaauaaucccccauaaaaauuuuuaaaguugucuuucuugaauucuucugugguuaagauuaugcacagccacccuugaauuuuuaaaauucuguagugagcauuuuuuuaauguguguuucuuuuuuuucagaucccagcucucacuaugugauuacccugaaagcauuuaauaacgugggugaaggcaucccccuguaugagagugcugugaccaggccucacacagguaagguauccuaucuuuccuagucuccagcacuuuuccuagcagcuuaggcagaauauuggcaugaggccuaucccauagguguuagggaagaaaaagcauauggcaguuucgggugcugacuucaaaugggaaagugggcuuucagcauggaaaguucuguuaauuuguuuugcuuuuuuuuuuggaagauucuaauucugccacguaagccauucuguguagauauauacacguuuuuaaucuguuaggauguggaaagcagaguuuuuagauaauuaaaagugauuuuccgucuuuugggcaugugaguugaaacuaaagugagucaaaaacaaaaaauguagguuacugacgguggcaauaaaugcaugcgauucgugaacccaacaucauuugguuacuagccaccugaguugguuaggaaaguguuuuucuaugugccuuuuguaagcuugaguauaaggucagagguacuauccauuugaucaguuauacauuuauuacaaacgagaccaaauauucauuguuuuucuuugaauuaucuacuuaaaauaucucuaaaggccgggugcagugguucaugccuguaaucccagcaguuugggaggccaaggcaggcagaccccgaggucaggagaucgagaccauccuggcuaacacagugaaacccuaucucuacuaaaaauacaaaaaauuagccaggcguggugcugggcgccuguagucccagcaacucggaaggcugaggaaggagaauggcaugaacucaggaagcagagcuugcaaugagccaagaucgugccacugcacuccaggcuaggcgacagagagagauugucucaaaaaacaaaacaaacaaaaaucucuaaaauaaaguaauauacaugucauguaaauuuuucuauagauauauaagacaucuaauuuagaucugaaagagaaaguuuauugaauauguuagaguuauaaauuuuuuuucuuuuuuuuauuauacuuuaaguuuuaggguacaugugcacaacaugcagguuuguuacauauguauacaugugccauguuggugugcugcacccauuaacucuucauuuaacauuagguauaucuccuaaugcuaucccucccccuccccccaccccacaacaggcccuggugugugauguuccccuuccuguguccauguguucucauuguucagcucccaccuaugagugagaacaugcgguguuugguuuuuuguccuugcgauaguuugcugagaaugaugguuuccagcuucauccaugucccuacaaaggacaugaacucaucauuuuuuauggcugcauagcauuccaugguguauaugugccacauuuucuuaauccagucuaucauuauuggacauuuggguugguuccaagucuuugcuuagaguuauaaauuuuuuaaaagggcacuggaaaccaaagaauuuauuuucggaaauguucuuuuucauuuauuuccaaaaauuuugauucuuuauuguccagugauaucugcuggauauguugcauaauugugcagauuugguaacauucuuaaggaaggcuuaccuuuccugaaggaagaguacauccuugaguuccuuuugcuuuauuugggugugagcuaugucacucuacugccauuagacccagaacaucagggggccuaauauucucuguccuuuuuuuuaagcuucuauuuaagacuacuacauguuugguaguucuguucugucuucuauaugcuuacaguuuauaauuucuuuuagaaauagcuuuaguauuacaaaaaggagcaaaaauuaagugaaaaaguauuuaaauaaguggucugcuacuuucuaaaaucaggcuauaauaguaaaaaacaaauuugacauuacuuccuuuuauguggcuuaaaaauauagccuacuagcuagaaauacacaagaaaauguuccuaagucauguaaucuagauauguuuucuaaggguugcuacauauaagaaaaaaaauuucuacaagaauucuaaugacuucuacaccugaaggugcauuuucuguaacuaauugguauguguccugccaaacuuugaacaaagcucuugguuauauaauguaugcuacuccucuguuauuuuuaguccucauugcacaggaaauacacaaauggagacuauuacuuuagcuuagcaauuauucauaaacaagguccaugccauuccacauuuugaguaauaagggcuagucaccaugacuaugugagaaacccauuguaaacugugaacuuaaaucaguauguguaaacuuagaaaaccuaagcaugaauugggaaagcccguauggauucugcuguauugcccugggcccauggugcauggugcuuuugugcucauucuggccucagagaaggugucuguuguauauggcacaggacagcuccaugaguauagacuuuccaucaaauaaguacuguacaguacucugauuucuaaaguuugugaaguuuguuacuuggaacugugauaaccauggcauuuccguuaacugaugggaauucaucacuggguuguucucugacucuguggaagaaacuaugguagauaguccagcauggugucagcuuaccuuuccugaaggaagaguacacccuugaguuccuuuugcuuuauuugggugucagcuaugucacuguacugccauuagacccaggacaucaggaggucugaacuugacccuuuguggguaucagauaccgucaauacccauggcugacauucaagacucagguuugaguguuggacccuuacaugaauagugauaugcacagauaacucuugucccaaaaauucagccacauucacugaaaucucaaaccaugagguuuguauugcuuguuuagaaauuguaccccugauucuaaaagcaguuuuugucuucgugagccuuuuugguuuugggguuuuuuuguuuucugagacagagucuugcucugucacccaggcuggaguacaguggugcaaucucagcucaccgcagccuccaucucccagauucaagcgauucucaugccucagccucccgaguagcugggaccccaggcaccugccaccaugcccagcuaauuuuuguauuuuuaguagagacagguuucaccauauuggcuaggcuggucuugaacuccugaccucaggugaucugcccgccucugccucccauagugcugggauuacaggcaugagccacugcaccuggccucaugaggcuuuuugaacaggaaguagaauuuucaaguuauuuuaagaaaauucaagcacgaauacauuaauauaaucacuggauuauaacauuuuaauaugccuauagaaugcaguagagaauauaguuuauuacugcuucucuuaacauuuuucuguaauuuuuuccugaaagaacacaaguggaaauagucuuuuaaaugaauggugguuaucuauuaacucugaauuuucuuucuuuuucuccauuucucaccuuucauuccauuauauuacccugcauuucccuuuuauuuuauuuuuguuuacauuaaaaugccacuucccuuuuuaaauuauuuucugcucagacacuucugaaguugauuuauuuguuauuaaugcuccauacacuccagugccagaucccacucccaugaugccaccagugggaguucaggcuuccauucugagucaugacaccaucaggauuacgugggcagacaacucgcugcccaagcaccagaagauuacagacucccgauacuacaccguccgauggaaaaccaacaucccagcaaacaccaaguacaagguacugacacauuugcccuggcugaaaaaagcuaaucauugauacuuucuaauuuuaaagucucaauucauguuuuuuucagaaugcaaaugcaaccacuuugaguuauuuggugacugguuuaaagccgaauacacucuaugaauucucugugauggugaccaaaggucgaagaucaaguacauggaguaugacagcccaugggaccaccuuugaauuagguauguguugucagaagccaugucacauggcugcuuuuacuucccaaggaaagaauugagugccugaauugacauauuuacaaaacacagugagcaacuacauuuggaauucaguguuugcuauuucagcugacaaguuguguguuuuuaauuacugaacaagaacauuagcaaauaacaggauacuacagggaaaacaugauaaauuacaaagcacuggguagauguaagggauuauugccauuaauccugcuuuacugguaaacugagauagaaaagaugaagugaccugcccuugaccaggcaguuccaaugccaugcuugcuuggagccugaacacuuugcugggugaccccaaagcugccucugcaguuugcuugcaagcaaauuagcgucuuauaaaaucuuccacugaaauaauccuuaaggucuuuguaaguggacacgagagggaaaagaugacuaagcaaauuaaagagagaacaggcuaucuggguuugagauucuguuugguuuuugcugacuuuuagacaugccuuucugcuacccccugggcuuuccuagucuagggauaugcauaaccauuucaaaucucugucuauuuuggccuccuauuucucuccuauaugaauaauggaguuauaaauucuccacaaacugggcuuggccucagugucuuuuugucuucugcacaguucacuggacuuuguacagagagaaggguuggauuugaagaguuagaaauacaguacaucaaaguuuaaauagaccuugaguuugcuuucuuugccaaccauuuuaagaaaauguuuuuacuucaauccuaacccauuagauaacaaaugagauuguguuuucccuuaggauauuugcauuucaccaggcuuccuuacauuuuauacuaagagaauucuaguauuuuaggaagaguugaguaaauuuaaggauguacuuaauuugcucauuuuccuacuaguguguuaaaaguuuucagcuaucacauggaaacacaggaaacguauuguccuguugcauaaacgaacagcuucacuuuagagcuguaaccucaauaguuggcaguauguuugcagaauaaacucauagugaaaaauauuaaucuguaaaucaucuauucuuugaagaaauagggcuuuuaaaaguuauauuuggggcugggagugguggcuugcaccuguaaucccagugcuuugggaggccauggugggcggaucaccugaggccaagaguucgagaccagccuggccaacauggcgaaaccccaucucuacuaaaaauacaaaaauuagcuggaugugguggugcgcaccuguaaucccagcuacucgguaggcuaaggcacgagaaucacuugaacccaggaggcagagguugcaaugagcagagauugugccacugcacuccagccugggugacagagcuagacuccaucucaaaaaaaaaaaaaaaaaaacagcuauauuugguuuggagagccaacuauaaaugagagagaaaacuguuuuacaauuuacaguauucuaacaaaauaauccagugugacagggaagaagucaucuuggacgaauuacauaacuucucuaauuuuuugguguccugauccauaaagcagagauagugauaacuaccuuucaaauuuucuacaaauacuaagugagauacuauguguacguuaccugguauacgguagguacuugguacaaaugccacuugacuuuccuaccuaauuauccuguuuaucccugacucccagccaagaugccaauucuguaucuucauaguaugguauuuccucuuugguacucugaauauucuucuuuugauuggaacuuuugauagacaaacugugauuucuuugaagccagaagcuuuaucuuuuuugccuugugcccuuuauuuugccuuacaaguggaaaagguugaagaaauagugaacuaauuugaaauggacagaaauuauuaaaaauuuuguuauuuuguaguuccgacuucuccacccaaggaugugacuguugugaguaaagaggggaaaccuaagaccauaauugugaauuggcagccucccuccgaagccaauggcaaaauuacagguaaaaugcaaucaagugugcauuucuuugugcgcucuuccugccugacaggaguauuccaggagaguaccauguugcugggagaagugggagucugaaggcuggcuuggucauuuuaugguaaggugugagucaugaugguccuugaaauuggggugaggcugugcuggucgcccauagcggcauaaaauggguugccuguuggugguucugacugcagucggggaugggaggcacuagacagccuuuggcuauagugggacuuuguagacauuuauuuuccuuaggaaagcugcucuucucugucuccgccuagauggacagcuucagaauuauauacccccucccugguucuguagaguaauacccaauaaacagagauucugcucuuguacccugaagccacaaaaaaaaaaaaaaaaaaagcccauuagauauuuaauuccuuuucacugccccccgagaccugcuacuucaaguaccugugcucuuauaauuagaguuaaaagugaacuugccuaggucuuuguagggaccuggaauuuuuuccuuguacuuucagaggaaaaccuuccacaguagaggggacacucugccuuccucagccuuaucagggauggaagccugaugggguucagcugcucuuacuuccuuuggcgccucuggcccauguaggugugugcugaggaacugggguuugcccugaaguuccucuguaugaauagguggccuaaggaaauggaaaguguuucuuagcacuguccugcuucuugcuuucaguaggaaucucuuucuguacauccuggucuuuaugucauuuuuuuagguuuugacuuugccucuuuugugaaagaaugaaucaugacuugacuuggauuacauuuuacuuugucuuuuaaaaccggcaacagcgcagugcccuuuugcugugggucagauagauucaugguugugaugcuucccuucucaauguggggauuaagugcccccugguggaaguaucaggugacaguucacuguggcucugcccaggaguuccuaggagaucacaucgguaagagcuaaaacagccugucaggcaauuccugguuuucaaaacugaauuauuuuaauuguagacccuugaggguacauuauucaaauauuaugcuauaauauucauaugauauaauagguacuuauugauuuacugaaggcaaaaggaaaagcaggagugagauuucuuuucccauuaauuccuuuggacagguuacaucauauauuacaguacagaugugaaugcagagauacaugacuggguuauugagccuguugugggaaacagacugacucaccagauacaagaguuaacucuugacacaccauacuacuucaaaauccaggcacggaacucaaagggcaugggacccaugucugaagcuguccaauucagaacaccuaaagguaaugcuccccaagcugaggguuuuguugugugucucuuuaguggggcuaugcugacacuaucacuugagcauauagagucuguggauaguauaugaagucuuaaugaugagcuugugagccaugaugugaagauuuaucccagaaugauuccucaccuacucauugaccaaaucagugcucccuggguuaccagccuaaacauaucauauaaaagaggacacugguuccaggcuauuuggggcagaucaauugcagugaucuaaaaguuuuuacuggucagaucagauaugauucuuuugguucccauauagagaaagaguaguguguucuugugauggauaguucaacucaggcaggcuauuaaccugaaagacuuauuuguggacguuacagagaaaaagagacuaaaaagagccuuuuaaauaaaacccuagauaagaaaaugaagauaaagcacugaaccaaguaagccuagccuaauaaaauuuaacuggggacugaaucuaaggaauuauggaagcccuguaugaauuuaauuucuguuaguacuaaagucaaguuucaguuuguuuggaaguuuguggggguuuuaguuuuuuuccuuuaaaaaguucugccugucccaucuucaaagcuugugauccuugcucuuguuuuuucuuccccugugcuuggccuguuagcggacuccucugauaaaaugccuaaugaucaagguaaaugaguagauggccucucuuuucuuuccuuucuuuugugaccuauuauuagcuuuugguuuuuguuucuuuuuuuuuuuuuuuuccugaaaaaucagcaccauguguuaaaagccacacaguuauuggccaaaguagaguugaguccauguucugaaaagcuggggaauuuauguagaagcuaacuaggcuggcagaagaaaacugaaccaguaaacugguccugcagcuguaggagauucgucuuaaguguggaucagaucauccuuugugcugagauauugaaguucugugacaacgauaagcauuuaagucaugauuagaccgaucauaccaauuguucauguuugcagcaguuguucauauuugaucauaccaauuguuuauauuuguagcaucuagaauuuuauuagugucuuuaaguggaaaguuguaucacauucagugaauacccuauuuuccucuucccacaaagaauccacaaauuuaccuuacucaauguugugauucugugugacuaaauuacugcuuuguuuauucuguuaccauaaacuuaauucagagcucuuuuuucauuucuccccuuaaauauaucugaucauauuaaaagaggaucaaaacuauuugaaauaaaaacuuaggccacguacgguggcucaggccuguaaucccagcacuuugggaggccaaggugggaggaucacuugagcccaagaguucaagacuagccugggcaacaaagugagacccccucucuacaaaaaauaggaaaaaaaaguuagcugggcaugguggugcgcaccuauaaucccagcuacuccggaggcugaggugggaggaugguuugagccugggagguggaggcugcagugagucgugaucacaccacugcacuccugccuaggugacagagugagacccugucucaaaaaaaaaguaaauaaauaauaauaauagugauaauugaaauggggaccuagcaaacaggggccuccaugucaccauucuugaaaccaucugucaauagucuuuacacuguaacugccaugguggagggauagcuauauuuugugauuuuuaucucuaggaagucagcuaaugcuaguauguuuuccauacugagaaugaacauuaaaaguaaauuuaauuauugcucucuugguuuaagaguaguuguuagaauugcaaguuauuuggaucuuggcuaauggcaaggaagagucagaacuugagguaucaaguuuuccagaacacuuuggaaauguguuugcauucagugagucuuuugcacuacauuggagaaacugcaaacauacuuucuguugugugaaagugcaggaauauaaaaauacccauaauauauauaugcacagaauauaaaugggcucauuguuuucucacuugauuccauagccagagugcaauucuuagcugccugacaccucugguauuuaaaauucuuuacucauugauauuuuuggugcucaguucauccuuggaauuucuuguucauaguuuacauucaagagaaacaauguugggaaauacaggaauauaaaccauccaguuuguuagcaauguguguucuuugacaauuagguacauaauccaaugcucuggauaguuuggcuuaaauguagccuagcugucaacuaaguacacuuaaaccugaagagccuugcaggugcuaagccaucuccaccagcuagacuuugucauagugaaaagcauaugaggaacaacuggacucuuaaucuauggugugugucacuugggagaaaugauggcaucagaaguaaggagauaaaguaauauguguggacaauggaaaaagggccagggacugugaguaaauucuagaauaugcccuuuuggauauccaggaacuccuguuaccuucuuuugguagguuuucaguuucuggaagcauagcauuguuuuagucacuggauuuauucuguuagaugaacugcauacacaaacuucagauuuuaauguuuucauuucauugaauauauguaucuccugauaauuuauggaaguacuugacauuagcucuaauguuuugcagaaacaccuaguuuauacauuucuaguaaggcuuuauuuguagaaauaacucucauuuauaaguguuuuuugaagcuucaugcucucugccucuuuaaagagaagauuauacucuuucgugaagauuuuuuaugcuuguaauaggagugguuaacauuuauggaacaucuacuaugugucagucaguauuaaaaauauuuuaugguauuaaauuuccauuuaauccucacaacagcuuugugaaguggauaccauuauuaucccuguguuacaaugagaaaacugaggcccaaaaagaauaaauaacuugcccaaagucaaacaguuguauaugauggagguaauaugcaagugcagucugucuauuaaacaaugugcuauauuaaccucauaguuaacuucauaaaacagcuuuuacuuugcaauucuuucagaccucuuuuucaggagaaguaugauauugcuuucuggguauaaaccuuagauugacaccuuugcuuuauuggaaaaagguccucguauuugcuuuucccaagcagcuuuuccuauaaaugugaagagcaaaauucaaggccaaguauaagaauuuuuuaaaaaacugauauuugcacuuucugaggccuccuucuggggugguccuaggccugaggucagcagccucacuuaguauguucccugaugauggauuaggagacagugucuuuuugagcaacuaggaggaagacuguuuuuuucagccucuggaauguuuaggugacugagcaggaacugagaaccugauuugaacuuccauuuaccuuccugcuccugcuuagcuuaggguaacuuuauauucagaaggacaacuuuguaauuugagaaaagaaucuaaacaauacuaacaccugcuaggucagguauuaguauccacauagccaggucccuuggaagaguauaguucuuuaauguagacauuaaccuaauuaguccccuugguugcuuuucuaggagaagcuacuuuugcuguaaguccucugagcaguccuuugggaacuguuuccuaagcuagagaaauagcaccuacugucccagcuucuaaacagcagugacagucagcucacagccgugagacaagcgugucagucuuucagaugccucauuacauagaaagcuauaccuuaguuugcuuuccacacauagacuauagauucccaugauuuaugugcuacuuuauuuucucauggacagaauagacuaaaaauuguguuuuuuguuuaaaacacucccuagcuaugaaguggacugucacgccaaauguguggggucauuauugacaugauuucuucuccuuuagccucagggucuggagggaaaggaagccggcugccagaccuaggauccgacuacaaaccuccaaugagcgguaaagccuuucccauggcguuuuuugcuuacuauggacaugaagcacuuuugcuuaaauuuuugaaauguccuuuauagcuugugugugguggguuguagcauauuagccuguuuucuuuuauugcuagauuuaaguguuugccaaaucacuccaagcccaugugucguaggacccauaaaucaaauuguuuccccaguuauccaacuuaagauuaauuccuaaacaauuuguucauccuguugccuacugccucuagaaaagaguuagaguuucgcuuucaaaaauaaacccucuagugggauuagccaccauccaaaccaagccaaacaaaugcuuuuagaaucauuaaguucuuccagugcuacuacauacugcaguguuuuuaguuuagcaauucuagaaaauucuuccacucuccuagccauccugagagcuggugccuucuaauuuaaugaugacacccccgucuuuacagagcuucaccauauauaagcuacuuucacacaugaagucacaauugauucuuacaacauggugaagcagggagaacagauaccguuauucccguuuaauacauucagaaacuaaguggagaaguaacgugccuggggccacgugcuaauuguggcaguccuaggaccaaaacccagggcuucucauuucugauugugcuuuucccacugucacauucagccuaaaaaagcagugggugcuguaccagacgugggaaccuagaguggaaaguguccacagaaguaguuacuaggaaugacccuuacugucucuucacauguggaagagagagacauaugagagaaacgccuguccccuaguaacucauagucuaauuguaggaauacgaugaugucuuaaucuccagcuaucuauuuaaaucaaaaguggaacugcccagacuuuaaugaaaucagccuuaaaagaaccagacaaacuuaacauccuuccagaaauaauugugcuccagguucuaggacucuguuuaugaguuucuucuucuccauguguaugugacauuuauauuguguccacaguauaauuuuuaaggcugugaggaagguaauuacuccuuugucuuucuuucauucauguauucacucaugcaugcauguuuuuuuguuguuuugguuuugguuuuuuuuuuuuuuugagauggaaucucgcucugucacccaggcuggagugcaguggcaugaucucaguucacugcagccuccaccucccggguucaagggagucuccugccucagccucucgaguagcugggauuacaagcgccugccaccacgcccagcuaauuuuuguguuuuuaguagagacgggguuucaccauguuggccagacuagucuugaucuccugaucucaggugauccgcccaccucggccucccaaagugcugggauuacaggcgugagccaccacgcccggggcccgcgugcacguuuuuaaagaugcaggcucuaugugacaagcugugggagcaagaggaguuaauaacaaacuaccugauaaagggaaagcuuccuagaagaggugccgucuaacccggaucuucaaggaugcuagaagauugcuaaaugucaagaaagggauuggacauuccaggaagcaauaucagcaugugcagaggcauggcaauauauuaauaaaacagccugcucucuccaggagucacacugcauagagaaaggauagagauugaguugaaaaugcagguuggaaucagccugucaaaaacucaaguaccagugcuaagaaauaugagcuuuauccuacaaauaacaugugaaauaucugacaccacugguacacuaugacauccaucuuuuauuaucaacuguuauuacucugauagcagugaagaauaaguugggggcuaagaguauaaagucaggcaagagggguuagggagcuguuacaggccaggcguggugguaugcacguguaaucccagcuacucagaaggcugaagcagaagaaucacuugaacccgggaggcagagguugcagugagccgaggucacaccacugcacuccagccugggcagcagagugagguuccgucucaaaaaaaaaaaaaggaagcuguuauaguaguccagaugaggcauaaagaaauggcauauauauugucccugguaggacuguucuuuggcagcucacucuugcuguaucuuagaagaaaacuuuuguccagcucauucgcaagaggucagaugcgaguaaaugagaauuugucagugaaaugcaggaaagaaccaccuccaccucugccugccucccauacuucagcuccccagccucuaauuugcaaugccugcccugccaaguacccaacccuguaguucagcacugcuauuaauaacaguguuauggaaagcccuacucuaauaugaacaguaugguccauuuuaguggccccaguaccauggucuuucccaaauauaaaaacauuauuuuauugaaggucaguauguacaguuuaaguugucugucugcuuaccuuuuucucauaaaugaaagauaaaaaugauugaaccaaauguagaauaggcucuuaaucccuucuaaaucagccccagauuuagcacuguacuuagauguagucuguaaaaucaaagaagcaaaguuggagggucaguuaauccggcguuguggaagggauucccacaaugaguguaaguuuggauuagaacauaaauuugggccgggcgcaguggcucaugccuguaaucccagcacuuugggaggcugagguaggcagaucacgaggucaggagaucgagaccauccuggcaaacacugugaaaccccgucucuacuaaaaauacaaaaaaaaauuagccgggcaugguggcgggcgccuguagucccagcuacucgggaggcuaaggcaggagaauggcaugaaccagaggggcggagcuugcagugagcggagauugugccacuguacuccagccuggacgacagagcgagacucaaaaaaaaaaaaaacacauaaauuuauaagccagguuguuaggagaaccacuucaggagauuuuuuccccccuagacggagucuugcucugucgcccaggcuggagugcauggcgcgaucuccgcucacugcaagcuccgccucccagguucgcgccauucugcugccucagccuccugaguagcugggacuacaggcaccgccaccaugcccggcuaauuuuuuugaauuuuuuauuagagacgagguuucaccauguuagccaggauggucucgaucuccugaccucgugauccacccgccucggccucccaaagugcugggauuaacaggcgugagccacugcgccaagccaagagauuuuuuuuuaaaacacacauuccaggccauacuuugaugguaggaacuucuuccacaacaucccacgcuggcaggaugccucuuaaguacuuccaauaacuaaagaugcauuucuuggcaaggcagcucaucccauuauuguacaccucugauuguuagaaaauuaagagagagaguagcuagaaggaaagagauuagauauccauggugguuagacauguguggugggauuugccacauuuuauaauaugagcauacauaaauaaugaguagggaggcaaagaaacauguuucaagaaauggaagacaguaagacuuagagcuaaauuacaaagccuagagcucauccuuucagcaauggggaaauaauaauaggaaaaggaaaagaaaaucugaauuuccuucuucaggguccuaaaugguccagccucugcagcuuuuccagccuuaucccuuuuuuccuccucacuuccuuccuucugacuugcaucucucugcuuaaacaacacuggcugcauuucucuuccuugagaagagcuuguuccugccucaggguccuuucccuuguaugauggaaucuuucuuacucagaucugaacucaaaugccaucuucucagagaagcuuuuucuaaccauucaaucuaaauuggcuacccagacacucuguaucauaaccccucauuuucuuuuuuucacaccguuaguuauuaacuaauaauuucauauuuaucguuuaucccauucccccgccaaacguucacaucuuuguuguucaccauugcaccuuaguaccuagaacaaugacugacacauaguaaccauucaguauuugucaaauuaagccauacuucagaccuacuguuucuugaaguugaacaagagaauuaacucugcguaggcuguguauuuauaaaaacagacuuuacuuuucaugcaauuuuuauaaucucagauaucugccuguuggggaaaacuucugcuuuguaugaaugaacauuuuuaaaugguuuugaaaaccagaaaacuaaaugacuuauaaguggugcuuuacaaaaugaguuuauauaucacaugagacaccagagagccaagacucuuuaucugucuaaguauaucucaaccuuugaaagcucuugaauguucaguacaauuugagaagcuuuaauuaaguacuaucuuugagcaggcucuguccugagcacuguucauaggacagacucuuagcugucuaggagcucaucaucuagagaagagagccauguucacgcggcacuuuuauauaagucagagcaaugaguguuaucaagaaguucacgugagauauuaaugguucuguagcuugauaguaugcauguuuuaaauucucuaacccuaacacauguaccauuucucucucugcaggcaguaacagcccucaugggagccccaccucuccucuggacaguaauaugcugcuggucauaauuguuucuguuggcgucaucaccaucguggugguugugauuaucgcugucuuuuguacccgucguaccaccucucaccagaaaaaguaagaagccccagaugcaccccuuagauuuuuggcaucuuaucuuuugcuuccaugugacuucuguauauggagugguacacaaaguuaagacauaaaaauacaugaaaaggaauuuaagauauuuuaaaagaaaaugggaagugguuccucuuaucagucaguguccuggcagaaaagagcuggcacauuuaaaaggauuucaaaagagguaauuuacaaagucauaggugggguuagggcaaacuaggcagggauauucagaggcuagcagcuaugauaagacaccaucauccuugggccugaaagggcaagaggagagagcuguuuucagaaaucugaagcaguaggagagggcuuccugacaaaagcaaagugggugcuagaggcaugcagccauugccagccuccucccagcgggcaguggcaggaaaagaaacaccuccuacccuccagccucuugccagugucuaguauuagcuauacccagcuggaagccaggaaacccagcaggauugccaaguaauaguuaauuuagcucaaccucuggggucagagggccaacuagagaauagauguggugagaaaaguagaaagugucuggcauugcuggucacccccuuuggagcaccaucuguacaugcccacagugaacccgaugcccaggagucuguggacauucuuacaggcugugucacagcacaaaugccagcccaguuggaagaagaccauaggccugucauucuaaaucuaaguuuaagaauauuuuuaaagaauugcuaccaaguguagaguuggggguggggguaggauugcuuuaaugaacaggaaaggaucauugauaaucaauuuaucaguuucucagagcggcugaauggcugcuagccuugaacuccucugggauuuugaggguuguggcuaauggucuaagugcagauagcaagggggcucaguuauguagugcuugcuaauaccauacaguccuacacuugaaagaauccuugauccuaaauuacauucaacucagauaucugguuagcaaaauagauagaaaaaaaaaaggagauuccugaguuauuccuaauagcaguaccauaaugugcauaauaaaaugacuuuaguugcaauaucuugaaagaucauaagauggggguguugcuccgcuagagaaagagaaauucauguuuaugugauuauccaugcagacuugaucugcccaaggcaagaaugcauguauuuaauaaucauaaauuuguucauuuucacuguacaggguaaguacaggccacccuguaacugcuacugguaaugacuuuaugucauuuuuuguaaguuaugugauauuuuaaaucucucuuucuuuugcccaaaugaaauagcuuuccauagcuuguacuguaucacuuuuccaagaaaaauggaggcuucuuuuauaauccuucugaccacugccucuuauagcucuuccuuuuuuuuuuuuuuuuuuucuuuugagacggugucucucucuguugcccaggcuggaaugcaguggcacauucuuggcucacugcaaccucugccuccuggauucaagcgauucuccugccucaggcucccaaguagcugggauuacaggcacccaccaccaugccuggcuaauuuuuguauuuuuuaaguagagaugggguuucaccauguuggccaggcuggucucgaauucccgaccucaaaugauccgcccgccucggcuucccaaagugcugggauuagaggcaugagccacugcgcccggcccugucuacuuuuaauaguggaaaacuauuauuuuuaaagccucaaagacuacauuuuuuuuucuacucuagaacuuuucuucaagccucuuuauuuggcauuuaauauuuaucuaucuaugaacuugauuuuauaucaguuuuagaaauauugggaucuuuauuuuucuguuauugaaauaauuugaaaaccaaaaugacagaauuccuuagugcuuuggaagacuucaaauucaaaguaaauuuuuuuuuagacaggauuuuggucugucacccaggcugaagugcaguggaacaaucucaucucacugcaaccuccaccucccggguucaagugauucuccugccucagccucccaaguagcugggauuacaggcaugugccaccaugcccggcuaauuuuuguauuuuuaguagagacaggguuucaccauguuggccaggcuggugucaaacuccugaccucaagugaucugcccaccucagccugccaaauaagguacucagucuucagauugaaaguaagaagaugaguugauaauaggcucuauucucuguauuggcacguccuacagauuugggucccuuuguugaaaaucaucauaucagaucuucaugggguuuuccccucccccacuuccccaguuaucugcuuugcaaguauuccauugacuguugaaaaauauaagcgagcuuuucuuacuacuuuucuuccuacuuuucuuccucuguaauaccugagguucauuuagaugguagcuguuuacagagucuuacaaccucaaaguugauagagcauuuagagaaucuaaacccucguugguucucagcacauucccccuuagccccugacuggcaacagguaagcugggcuucuccuucaugaagaaggcagaagcugucagauaagaacaaccucagcacaccaccaucaaaucugacaccuuucuacacugguaaucaucguuuccuccucccuccuaaguguacuuccccuguuugaagcccguucuacccuuuacccccugaaucucauugucuuccauuuuucuaagaccuuuuaccugcuguuauuccucucuccagcauagcugaccucuuacucguuauuggccgccucuucaguauuuaagugugcucuaacuucuuccagcuuaaggaauaauuauaauuauaaccucacccccacccccacccccuguaugguccuuuucaccggcugcuuacuaaccuuucuucuccaccacagaauuccuugauaacuugcuuauacucuuaugucuguucacugccuacccaugcaucagcccuuucuaaucuuuauucugccccuaccacuucaccagaauugcuuuuguggaggucaccagcgaccuguguauugcuaaagccaaagaacauuuuucaguucucaucuuagucucucagcaacauuucacacagucaaccauuccuuccuucuggaaacauuuucuucuuuuguauccaugacagcauguuuuguuuuguuuuuuguuuuuuuucauagguccuccugucuaccuagccaucaaauacagacauuccucagggccugggccuggacuuacucucuucuccuucuguguucuccccaagugaucucaucugcucccguggcuucagcauuccagcuacuuuuguauuucugucuccagccaaggccucccuccucugaguaucagacuugcacacacaguugccucuucuacauuuccucuugaaugucucagagacauuucaaauucagcauguccagagcagaauucaucaucuuuucaggcaaacccgcuucugcuccuuuauucccaauauuaaguggcuuaaaucagaaaccuuagcaucauccuguacuccucuuucuucuuuacucccaccucacccuacauccauuuauuuaccaagaccugucaugucugccuccugaauaacuuucaaaucugccucuugccucuacucccacugucccaugccaucaguuauggcugagauugcaguagcauccuagcuggucuccucuucuauccccaaccccacagagcuauucuucacaucacagcugguauaaaguuuuaacucaaaaguguucuccuuacucucuugcuuaaaaccauuuaaugguuucucauuacucacaaagggaaguucacacucuuagcauugcccuaaaagcucuuuaugaucuggucccugacuaccuuucuaguauuauuucacaucauucucugcaggguucacuauguccccaccacucaggauuucuuaaaauccuucuaauauaccaccagggcauugcacucugcuuuaggguuuugacauaagcugauuucaccaccuggaaugcacuuucuguucccuuuaggucuuagcuuaaaugucacuuccuccucuagguuuuuccuguucagcuuaaguccaacuguuaagaaguuacucuaacacuugacauuucaguaagcucagaacauuuuaaaauaauaguucaacgucuguauuccucacuuuaucaaaaauucugagggcacagcagucuagcacagggucuggcauauacuggguacccaguauguccucauuagggguaaguaagagagugaauggagaagcuaaaacacagagaaguagacauuguuguccccauucuugacuccaccuaguugguaguccuaguuuggcagucuucgaaguuguuccggccagguacaguggcucacgccuguaaucccagcacuuugggaggccaaggcggcagaucaccugaguucaggaauucgagaacagccuggccaacauggugaaacccugucucuacuaaaaacacaaaaauuagcuggguguggugguggacgccuguaaucccagcuacucaggaagcugaggcaggagaaucucuugaacccaggaggccagguugcaaugagccgauaucucgccauuacacuguagcuugggcgacgagcaaaacuccaucucaaaaaaaaaaaacaaaaaaaguuuuugccucccuccuuuauaagccacagacuuucccucuacuccauuguuauguuucuacauugcucuaauuagaaacuuguggaugaaccuucugguuaugagauuauauaaugaaaaaugcuaucuuaaucuuuuaacagucaaaaaaaguagucacaaggcaggauucaaacauaaagacccugguaaguaucucuaaauauguguggacaaaauagagauacauuuacucuccccaggagcaaacuuguuguuguuguuguuguuguugggggcaggagguauguuuuuaguuuuugcuuuuuuugcuugaaacaucucucagaaaggaaguuuuaaucacucaagccuuuugacaaauacguucaaaugaguuacuuuuuaaaagcuccucugaacuucgugccuaggaaacgagcugccugcaaaucagugaauggcucucauaaguacaaagggaauuccaaagaugugaaaccuccagaucucuggauccaucaugagagacuggagcugaaacccauugauaagucuccagacccaaaccccaucaugacugauacuccaauuccucgcaacucucaagauaucacaccaguugacaacuccauggacagcaauauccaucaaaggcgaaauucauacagagguaccauuuuaagugcagguuuuuucucaaauguuaggaaacuauuuucauuuaaaucuuuuuuuuuuucccugaguuugccuucauuuggcaauuccuauaugagaucagauuuagagaaauguguaugauaagauuugggaacauaugaugaagaauaccuagcuucuuaugggagagagauucuguagccauacgagacaaucuugcagaucuuuuaggucucucaucaggcuucagcagcgugauauucaaggauuugaggcuagcuagcccaugucugugcauuucauucugugucuucagcuggcuuccagcuugcauugugguauucagaacauucuuggucuggaggcucuuauagacacccugugaaguauggugggcagcauugugacauccacauugauucagcaggaacucuuguaaugcucuaaugaucauuuuccucuuuauuucacuucuuacagaaaugucuuguccccauuaugcuguuugugaauucugaauccccuacuagaaauguuucacuguugaggcugcucaguggcauagggcacaugcugguaacuaaccuccacguuuaacaucuagggcaugagucagaggacagcaugucuacacuggcuggaaggcgaggaaugagaccaaaaaugaugaugcccuuugacucccagccaccccagcguaaguagaagcaucucuuuuccucagugcuaccaaucuguucagucauguaggggaacaacuaugaaugaucuuuuugacuucacuugauucuaacacaaagauaaucuaccaaagcuuugacaccuugaaggaggaaguaccaaacacuugccauauuuugcaacaaacauuauucuugaggcuagcgucguuauguuuaugguaaauaagcugaaaagccaaugucuccagauucccaggaauaggggaguaacuagucucccuaaaagugcaucauaucucuaugggagagaugggaaagcuucccuccuccagacuagagcuaaggauggucugauguuacaaguuuucauuacgcugccugacaccagugcugaugagcaccugugaaauuuauuuuuuuaauuaauagauuugaaggccaagcaagauggcccacaccuauaauccuagaguuuugggagaccaaagugggaggauugcuggaggccaggaguucuagaccagccugggcaauguagugggaccccaucucuaccaaaaaaaauaaaauuaaaaauuagccagguauggugguacaugucuauaaucccagcuacucagguggcugaggcaugagaaucacuugaaccugggaagcagagguugcagugagccaaaaucgugcuguugcacuccagccugggugacagagugagacucugucucaaaaaaaauaaaaaaaauaaagccaggcaucguggcacacaaccuguagucccagcuacccaagaggcugaggcuacccaggaggcugagauggaaggauuacuugaacccagcguuuaagguugcauugagcuaugauuuugcaccauugcacuccagcuugggcaacagagccaagagccagucucuaaauuaauuaauuaaaauaauaaaauuuaaaaauaaaauuaguagacuuuauauuuuagaauagcuuuagguuuuacuguguggaauuuuuuuuuuuuuuuuuuuuuuuuuuuugagacagagucagagucuugcugugucgccaaggcuggagugcagugucacgaucucagcucacugcagccuccaccucccggguucaagcaauucuccugccucggccucccaagcagcugggauuacaggugcucgccaccacaccuggcuaguuuuuuguagacacgggguuucaccauauuggccaggcuggucucaaacuccugaccucagaugauccacccaacucggccucccaaagugcugggauuacaggccugagccaccaccacccgcccagccggaauuuuuuaaacaacauuuuucauucuugauucgugccucacuuugauaagcauaaagguuucugagccucuuuuaauaauaguugaaauucaaaauaaauaucaugauuaaaccagaaagcagugggacaaaccgauucuuucaaacuacuauguccucucucgucacuguuuucaaggaagugaagccuuucagacuagcuagcacaguggggcuugcaguugagggaauucucagccaucugucaacaaacgaugcgauuuaauagccaugaauaucauacaugcaacgagguacaccaugacaucgugcacuuggaaaaguuccucaaauccccaaccucuugguggaagcuucaagcacguggaugucugcacacgcauucccucucccacaaacacuguacacaaacauguaagauacuggauuacaaaaaccaucuuugaaagaguaauacccuauuuguuaacagguaauuucagcucaaaguagcuuaugcuugugguccuugauggaaagaaaagccuggacuuggaaaugcaggggaaaaccaugguuucccucuuacaagaggugcccuggaugggguucccagguuuaaagauacaaaugcccaagaagaguaaauuaauccaucccaguugcuucugauugaucaagaagaugcuagcacuauacucuuauuuguuuguuuuguauaagacuugaguuccuaccugaacuggcuuauuuugaaaacuuguaaaauuuuacuaucuuuauuucuagauguauuacuuuuaaauauguuaaguaaaaaagauauguuguccaguugauaucauucuucuuuuuuugauguuggggaaggaguuugcaccaauauacaauauuauuuaauuugugccuuaacaguuggguggguaaguggaaucuuuuaaaaaccugcaaccauaagauccacuuguggucuuuagguuuucagauacuguuuuuaaaacccgcauggcuacaguucuguuucacaagcugguauucccugagcucugggcccuggaaugcugcaggagccauauacccacuccccaccuucccuggucuuaaaugacugagcagugccaggaaggguuugcuggugcugggacauggcuccauccagggccaugcacugaagcaacaaguucagagucagcuaacagcugcugauuuccuacuauauccuaggcaggcacauucacacugcuuuauuuuuuuuuauuuacuuaccuagaaagacuggaaaugccuuauaaaagggaaaaagucaauuuuguuuuucccuugugagaguccuaaaaugcuuucaaauuguacuuuccuagguaaaaaucagguuuauucccccuaccccagccugaauucuggaaaacacugagucugaagcaccuacuucuaaaaacuaccugucuuccccuagaguugcugacuccccaguuaccucaagagcccuccucagacagcuuuccucuguuguuuuauucccgggcacaaccuggagccucugguccccaagagcagcaccugagggaaagccccuuuuuuguuccucaggccuugagaagggaaggaagggucagcagugcucaagggucccagucaugccaccugcuugcuugcauguggccaggacaagggauagcuggaaaguaaaggcacccauuuuguugaccaggauuucuuuucaccagaguaauguugaauagccccacaaagacuuuagggagauccuuggggacagaagacauuucaauaggccacuaaguguuaauuaaguaguauuauuaaguucaugaagccuuuguuuggagaaaaaaagauucccaguauuguuagucagcuuuggccuauuugccuguuugguggggguagagcugguuaucuugaucuuaaacgugccauuucuacaaccacuccaagggaguuccucagaaaaguuuauucucagacucugggcuucuaauuuuaucuguuuccaucucagauggauaaugaagccucauagaaaguaguacauggaaucucugucuucauagaaaguaguaugugaaaucuguguggaaauuucagauucuuuagcuaaacgcaguuaauugaauccuuagccagugugggaaggaaagagccauuuauucucuuacaugcagauggguaugucugaguccccagacuggaagcaguaaaagauggugccaucagccagugguucaugcuuuuaguacuagaugggaccaucagaguucaauuccauuugcauuuauuuuaagacaugaaagccgauuaaacagcuacuuauuuauuuggccuaaauacccauuaaaugcuucauucagcaguuuuaacaaaggcagaaugaauuaggaauguacucgaaaaagaagggacuucuuucuauccuuuuagcaggacaaaauagaaaauuuauguguuggcuuauggauuuauauuuugugacauauucaaauagauacuuguaauaacucauguaauccauguuuauuauaguagaauuggaaaauacagauaagccaaaagaaaaauauuauuuuaauccugaccacucuucccugcaagauaauaacuguuaacauuuuaguguauauuccuuuuuuucuauauauauguagacauaugcaaaagaguaucuucauuuuuaaaaaacaacguaaaaaucaauggcuaauugaccagaucuagccagcugccaccaaaaaaccaagggaguguuuggauuguaugggaggugggaagggggugacuuugcucuuaaacugugauuuguguguguuugugcaagcauguuaagcauuucucugucuuguguucauucacagcugugauuagugcccaucccauccauucccucgauaacccucaccaucauuuccacuccagcagccucgcuucuccagcucgcagucaucucuaccacccgggcagcccauggcccauuggcacauccaugucccuuucagacagggccaauuccacaggugagagaugaggaucaagcccagauggaaaccauuccaaaagagucggcaagcagaaauggggaaggacuugcccuacuuagaagagggauuuggaauuuuucuguuuuauuuaacuuagcauaacauuucugugacugacucaaauuuguuucuguaaaauucaccccauauuucuacuuaaguuuuaaacauucagugcaagguuuucuuuuaguaaaaacaguaucucuaaucacauaagcaucccuuguuccauaaacuugcacuuuaacucagucuuuuuuccaauuucuuucuuuuaauccucuaguuugaaaggaaaacucauccugggugauuucagacacuagugguugccuuugccuggcagucacuguaacauuggguagguccaaagguuaacuguuacauacagguuacuuccaccguggaccaaagugcaaacaacauccaaggagcaguggggccaccagccacgaggaguuguguguauuguaaaccacagggugccugauguaaaccucaggauuauuaaaauuaggaagcgaugcacaggaauagauccucucugaagaaacagaaaauuaccucugaaguguauuuaaagaaauacguugcuagacaaacauguccccaguuuggaaaucuuaggaaaccgcauuaucaaacaguuuuaaggaggaaagaaauagugaaggugugaggacaguaagcggcauaaauauucuucauuaauugaaaauuaauuuucauccucaguuuuaaacggcaagccuaguaacuucccauauauucaacauauuauuuuuccaccauuugaaacuugccuauuaauaguuauuauguuacugauagaacugaguuuugcuggucuggggaauaagggaauuucaagugaguuccauuuuaaaagaaccucaaaacuuuaugcuggaaauuuggguuuccaguaauauccccauucuuuuaaguuuuuuguuuuucuuugguuucuuuguuuguuuuugagacagagccucagucuguugcccaggcuggagugcaguggugcgaucucggcucacuguaaccuccaccuccuggguucaagcgauucuccugccucagccucccaaguagcugggauuacaggcacacaccaccacacccagcugauuuuuguauucuuaguagagacaggguuuccccauguuggccaggcuggucucaaacuccugaccucaagugauccgccugcauuggccucccaaagugcugaaauuacaggcgugagcuaccgcgcccgguccccauucuuucaaguuuucaucaaucauaaacauacccaaaacaucaaaugaagcuuuauuaaggggugccuaauaauuuccaacauuagcuacucccaaagcuauuaccugauuuggagaaugcugcuugaacucacaucuaaauuuggccuuccaggcugagcaguguggcucaugccuguaauucuagcacuuuggguggcugaggcaggaggaucgcuugagcccaugaguuugugaccagccugggcaacaaggcaagaucccgucucuacuaaauauuaaauauauauauauauauauguaaaaauuuggccuuucuacuaucucccuccaaaucccaauuuggaguucugcauuuaggaaagacgguuuccaagauggacaguuacuccagccagcugcauggagagccaaagucugccuuacagacauagucucaaauagaacagaggaccagaaagcagccuccacaccugcucuuagaaaggagguuuugugcccaacccuguuucuccaucuuuaaggccaaggaaucucacaugcuaggaugugguccugccugaguggauggcaggcaccuuccaaucaaaucagccccuuccuccuuccuccuggguuuggggauuggagagaagcauggcagcuccuacccagcccucucccuugugaucuaguauugguaagcauucccugcucuacggaccuaggcagaaagugaagagagggggaaagaauaauuugcauuacugagagaggccaugcuuugaugacuaguuggauaauagaagguaaaacuaaagugauagacuuacugaagacugauuugaaauauagagcaaguauccagaaaugaucaaaguucuuuuucacgauuguacuuugcuaagcuccugugucucuggagcucagaguguugccacagcuugguauauaugggcuaagcagggccagucucugcucuaaggagcauucacuaugucaccaccacuugacauuggaaaagcacuuuccucuuguccaaucacuuggccagugugaacucugugugucuuaacucuuuaagaggcaagucagucaggaaguagcccccuugccaaagcaggaauuuuacuuacagcauggauucuaagcaggccagugauuuugcacacugucagggagcacccuucaugauaaaagcaacgugccuggggcccccggaguugugcaaggcagcccuggucugugguagcaggccugggugcugacucauguaggcaaccccauuuuccuuuuucaccuuuugcgccaucucuuuggcccucagaagcuuauauauccaguuacagaccguugaggcagucaggagaggccgguuugcccagagcugaccuaacauaucugucaguacaggcugacauggccuggacaugagucuacuguucucucuccuccucccugcuacccuuccuagccagcuccuacccugcccagcuucucccuggcccaggaucacagagggggaccaccagcucccccgccguggggauggcuagcuugagcaagccuaagaagauccucagcacaccccuuuaaggggugaggagugaccuaagccugguagggccaacauaguuaggcacacuugggaggguguacgagucccucauccauggacccaagaucagaggugccacucgugacugguguggccugacuucucagagcccaagggcacagauucacugcuacuucagcaacaaaggcagggaaauguguuggauuucugcagauugcucaugcuuuacaguauccccaucugcggggauacauuccaagacccucccccuccccccgcaguggaggccugaagucgcauauaguacugaacccuuuauaucuguuuucuccaucugauaaccgagacagcuacuaagugacucaagggcagguaguguacgcagucuggauaggcuggacuaagggaugaggcacauccccaguggaauggcguaagauuucaucaugcuacucagaacggugcaaaauguaaaacuuaugaauuauuuauuucuggaauuuuucauuuaaauuuuuggacagcaguuggccacagauaauugaaaucauugaaagcaaaagcauggauaagggggacuacuguacuuguuaagguugaggacuccagaagucagaagaggccuucaggccaccugguacaguccauugcccugagcuguguccccaucccucuccucacagguggggaagcuggucaccagcucaugcuguuggaagggucuuccuuauguggucuccccgggccuuggugcugcuucugccccacagggugggggcaagugguagucuggguguggaaagguguguggugguccagagcauguguguggaagucggaaggcagggauucagauuccacccugcuaguucuuaacugugcaaaugggcaauuugcuuaaccucccagugccuucugaguuacuuugaggaucuagugaacuaaugaauguaaagcagcuggcauagugcuuggcuuaaaguaagcacccaguaauuuacaaagaaaagaaucuuaauagauagauauucaagcaccguguucagcacuuuucauacaucucauucaauccucaaagaauuauguguuauucucccucuuuuguagaugaagaaacugagacucagagauauucagugacuuugucaaauucacccagcuaguacacaaagauuggaguccaggucugucugacuccagaguccgugcuuuucuacccugcugugcugccuuccagaacaacucugccccuucuuauauuuugagauuguuaucauguucuuccugagccuucccuucuccaggcuaaucuacccccauuuccuucucugaaucaaaaaugcccuucauuuggugugaucugaaagcugugugcagaccucugggcugcucuguuuguuguccaauucucacuugagcuauggguuuuuugcugugaugaggccaugcacagucccuggaggcacgaaggccuguggcauuggccucuccugcagugaccgccaggccuugucagcagagcuggcuacugucagguacccggccagccuuggugguuagccaugguugucuaugaaaggccacugucuaagauuccagugagugaaguuuuuaauuuucuuuuauacuuauuuauaucuuaauaucuuagucaucucaggaaccuuuacaagugcuucauaauaaauaaugaggagaacuuuaaaucuacaaaauugugaccacuuagcugugaggugaaaaacuggaauagcugguugaguacaaaauuguucgagacuccauucuuaucccuggcaguggugcuaauccauguucucuuggacuagcacugaucgcaagugcuauugagcugguuuagggaaccccuagaaguagccaaacugugggacugucacauauuuaauggcaaaagaaaugcuaacauuuagacuuuccugcuguagaauccguucgaaauacccccagcacugacaccaugccagccucuucgucucaaacaugcugcacugaucaccaggacccugaaggugcuaccagcuccucuuacuuggccagcucccaagaggaagauucaggccagagucuucccacugcccauguucgcccuucccacccauugaagagcuucgccgugccagcaaucccgccuccaggaccucccaccuaugauccugcauugccaagcacaccauuacugucccagcaaggugagugaggauggcagcacaccuggagggagcacaccuggagugacccuuuggcucaagcuugggacaaagccaccccuucuuugaaguauagcaaagcaaauauccuccaagccuaucuuagcaauucuguuagcguagcagugugccauugccccgcccaggaaguuuauggccuccccuuuucugggaacacuuacaaaccggagaauaauuugcugggaaccaagggcugaccuuuugaauuguguuuuaugugcagcaccuuuggugguaaguccaauggcaugggaauggauagcagaucuagucugcccagaccccuggaaucaccucacuucguaaggucccugcaaacuagagaagggaucagggaggccaaggcuuggacucauaggguggugaaagcagaaguaaccucagaauagggaaaggaauccugugaagggaaagucauuuacccaaauccacacagcucaguaacaguccccugaccucaaaggcaugcuugcuuucugcucuuccaaauuguuaccuauucauuugcuuuagaauaagccagugguuuucaaaauuucuggucucaguaucccuuuauagcuuaaaagcuauugagcaccuaaaagagcuuuucuucauauggguuauaucuaucaauauuuaccauauuaaaauuaaaacuaagaaauuuuuaaaguauuuuauucauuuaaaaaagcaaguaucuaucauguuaagauaaguagcauauuuuuaugaaaaacaacuauuuuccuuuuuuuuuuuuuauuugggauggagucucgcucugucacccaggcuggaguacaguggggcaaucucggcucacugcaagcuccgacucccggguucacgccauucuccugccuuagccucccaagcagcugggacuacaggugcccaccaccaugcgcagcuaauuuuuuguguauuuaguagagacgggguuucaccacauuagccaggauggucuugaucuccugaccucgugauccgcccaccucggccucccaaagugcugggaauauaggcgugagccacugcgcccagccgaaaagcaacuauuuucaaaacaaaaauauagugagaagagucguuuuauuuuuugcagaucucuuuaaugucuggcuuaauagaagacagcuggauuuuccuaucugcuucugcauucaaucuguugcaauaugguguuuugguugaaauauaagaagaaaaucuggccuaacagauauguaauuggaaaagggaagaguauuuuuauaaccuuuucagauaauuguggauauucuuuuuugauacuacagcaaaacucagcaaguuguaguuuuuuaaagguuuguuuguaaagugaaaucugaaaccuuaucuaugaaauauucauacuucauuccauugaaauucauucaucugucuugcauuuaaugcaugauacuaaaauaucacacaucggucauuuagaaaauauugguccacuacauuaugcaaauucugcaaauagugauacauuucauuauccaguaucuaaaaacauauucauuaauaucaucaaaauguguaaguauuaaguucucaagaccaugguggcggaugcaaguuuuccaaaauccugauuuuuacuuaaaacuuaaauuuuaucauuggcaagaaacacuauccauuguguuccuugaauugacaggcucacuuuguucauuuucuaaaagaugucucaagaaccaguuugucugucuuugaacuaacagugauauuccaugauaaaaacauucaacucaaaacucaaaacuaucacaaguaccuuuauuuaagacagcuguuggccgggcgcgguggcucacgcuuguaaucccagcacuucgggaggccgaggcggguagaucaccugaggucaggaguucaagaccagccuggccaccauggugaaaccccgccucuacuaaaaauacaaaaaguuagccgggugugguagcagacaccuguaaucccagcuacucgggaggcugaggcuggagaaucacuugaacccgggagguggagguugcagugagcagagguugcuccacugcacuccagccugggcaacaaggagagacuccgucucaaaaaaaaagacagcugucauacuuugcacacagcugaaguacuuuaugcauacuuuccauuuugucacauacaguaaggucaagauuuaguaaaauaaaaaauauguauuccuuuauuaaggaugguucuuagugaaacuggcuuuuuuaaacugcacgugcgugucagugaauggcuuuacaguuuggcaccacugccuuaauuugugcuaaggcuccagcagcucacccacuauugccuuuguauccucagugcaaaggcaaacacaguggaaaggcaaauaaugucuuacuauaaagagagcuuuggccuuccagauauccugcaaggguuuguggacuaccacacuuugagaaccacuggacuaggauauugguuuucuagagacaguggaauauuuucucuggccucaugaaugcccugcuaucucccuccuucccucuuauuccaguaacuuuucagagcaguaucccugcacugggucuguaugucucucucaccccgaagcagcacuuggaccuuagggccuucaugaggucuaggggaggcaggcuuggccacauaucugauggugcccuuuccccucagcucugaaccaucacauucacucagugaagacagccuccaucgggacucuaggaaggagccggccuccuaugccagugguuguucccagugccccugaagugcaggagaccacaaggauguuggaagacuccgagaguguaaguucguggggccaucaguccagccagauugccugggaacaugccccagggccugagacugcuggucaagcugauaaucugugcauaccaggcccgccacccagaacuaugaagcagauacacucauucauucaguagauacaguguugagcaucucuucugagccgggaacugugcugaggacuuggugugcuuucuuucccauauccacucuuuuuuuuuuuugagacagaaucuugcucugucucccaggcuggaauacaguggcaugaucucggcucacuacaacgucugcguccuggguucaagggauucuccugccucagccuccugaguagcuggaacuacaggcacccaucaccaugccuggcuauuguuuuguauuuuuaauagagaugggguuucacuauguuggccaggcuggucuugaacucccuaccucaggugauccaccugccucagccucccaaagugcugggauaacaggcgugagccaccacgcucggcccccauauccacucuugaacaucuuaaauuagcuuuucacacuagcccagcuaauggccccuucccccacauccugccugccuuuuaguucugucccuucugucauuguucuuuucuugguuugaaccauccauacauucccucaguucuacucugugaccuuuccugagcaagaugcuggaggagaaagugccugagugguuguucucgaaacaaaaaucaccagggucuuucuuugaucuuucacucucaaacuccaguaaaaauguuuugccucugaauuuccagguacaggauucucuaagcggaaagcuuggggcccagagauccagggacauaccaacugugcugacuggggcagagaccuagaaggggcaagcagugggccuucuggccugugaagucauugugacccuggggaguauguguugggagaaaggcauugugcauuaucaggaaacgggauccuagugaccuugggucuauccugcuacuuuccacucuucugagccacccugcguguuaguagccaguuuucuggggccauuugacuacugaccacaugaggcuuuggccucucucugggcucuccuuucugagcugcucccuggauccagcccaguaacaguguuuucuuuuccauagagcuaugaaccagaugagcugaccaaagagauggcccaccuggaaggacuaaugaaggaccuaaacgcuaucacaacagcaugacgaccuucaccaggaccugacuucaaaccugagucuggaagucuuggaacuuacccuugaaaacaaggaauuguacagaguacgagaggacagcacuugagaacacagaaugagccagcagacuggccagcgccucuguguagggcuggcuccaggcauggccaccugccuuccccuggucagccuggaagaagccugugucgaggcagcuucccuuugccugcugauauucugcaggacugggcaccaugggccaaaauuuuguguccagggaagaggcgagaagugcaaccugcauuucacuuuguggucaggccgugucuuugugcugugacugcaucaccuuuauggaguguagacauuggcauuuauguacaauuuuauuugugucuuauuuuauuuuaccuucaaaaacaaaaacgccauccaaaaccaaggaaguccuugguguucuccacaagugguugacauuugacugcuuguuccaauuauguauggaaagucuuugacagugugggucguuccugggguuggcuuguuuuuugguuucauuuuuauuuuuuaauucugagucauugcauccucuaccagcuguuaauccaucacucugagggggaggaaauguugcauugcuguuuguaagcuuuuuuuauuauuuuuuuauuauaauuauuaaaggccugacucuuuccucucaucacugugagauuacagaucuauuugaauugaaugaaauguaacauugaaaagacuuguuuguugcuuucugugcaguuucaguauuggggcggguggggggcuggggguugguaauaggaaauggaggggcugcugagguccugugaauguuucugucauuguacuuucuuccagaagccugcagagaauggaagcaucuucuuuauuguccuuuccuggcauguccauccuuauugucacuacguugcaacuggaguuugauuuggaucugguuuuaaaauucuucugugcaauagauggguuugaggauuuagcggcccugaugucuuggucauagccugguaagaauguccaugcugaggagccagauguuguauuucuaacugccugagucacacagaauaggguaagagccugaccccauucuguaaaucagaaagcaaggauggagacccuuuccugcugcuauuauuggcucucuuugaggaaguuggagguuaaggaaggaacuuguuuguuuccguauacgacuccuucuucucucuaguucagucuucagccaguccagcgcucucuuccacacuucagagccccuucagagaaagcauuagcaggaaugagacaaggcagagcugcagugcccccugaggcuuccacacaucuuucugaauauuauuuuucaaguaacaagggcagggacagcggaaacagcugcccaccccccccaucccagcagcucagcuaagcccugaugagaaugaagccacaggaguugucugaggugaacccagccgcucagccacacauggaagccauugccuuugcacauaguucuuggguucuuuuuccuaaaaagguaaggagcugaggugugugguuuuuuaauauuaagaauauauaauggaaaacacacgacugacgcucaggcaucuuccccuacuccccaacagauccccagaagacagcguggaaggcaguguagacaguaaaucgggcuucaguucuauagccaagaagagaucagcugcugaaaccaccaguggguaccccaggccaccugccuuugaacuuggggauuugccauguuugaucuugucacauacuugcuuuuuuacaagaugaacucuuuguauuuaugauuuggggggcaaugaaaggugcaaugcaggaacugcugcugccgagcucgcuggucacaugggggugccaggcgggauucuggaaaaccagugcacuuaaacugauccugaagagagcugucccagcacucuggccaccaggagggccagauuccccagaaacuaccuuuugcccaaagaacaugcucaguauuuggggcauuuccucccacaaacccugacugcuucuguuaccucagggccuugguaccuggauacugccacagaauuggggcgggugggggaggggccuauuuuuaaauaaaauaacuguucaaaguuggggguuuuuuaaaaaauuaagaaaaaggaaagcuauucuguauugcaccuuuucacaauuuaauacauuuucuuacauuuuccugugauuuucgaaacuaaaccauuguguguccuguaguguccugguugagcugccgcucagcagcuuccucggggggauuuggaacaccugugucugucgccgcacugccugugggaggggcccagagggcugcugggacuggcgucuguacacacuuguuuggccuuuucuguaguugaugcuguaaacucuauggcuuuuuaaaaacgauuucauguuuuuauuuaguauuggaaauccaauacacuuuuuuaauccaaucaaacucuggucuggucaaagaguuauuuuccuuuguccuuaaaaaaaaaaaauaacaacaacuuuggggcccccugcuucccagccucuaacugacuucacgguugccuucacaacuguaaagccaguagucuaugaggagacucagggaaggguggcaggugagccaggaggcugcaggagguguuuggaccguccaccaguaccaaa

SEQ ID NO: 21459 - RNA, 42002 nt, Homo sapiens
uuguauaaaaagauuuauugaaauuuaucaaugacaaacagacauaaaacucaaaguuuggcucuucugaggggcaggagaaaaacuggugcagauguucuuuuauacagaugaaacauggguucagaaauuacacgucacuucuaaagcaaccagaagagggacacgaaagcaaaccuguacauucacuaggaauuugcagucauuucagauuuccacuagguaagaaaauacaauuuugcguuaguuuuuccgugcucggguguaugaaaaaaaaaacccagccgacaugcagcaacgucuccagcgcuuagguccguaaaaauguucuaagcacagaaguacauguggaagaauucucucaucauuuuuuguaaaacaaagcguucuaauauuuuacagaacaagauaggacaguuuuuuuuuucuuuuaaagaaguugaaguuugaagguguguuucuucuaauuuuaauuaccaaauccauuuuccuuguaacuuaacacaacaagccugcgguuuucagcucucuggcucauaagcucaagaguaacaucagaguccucuuuguagagcgaagcccaccaccaucugugaagggggaaaagggaugagagauggggaauguccccagaccagugccaaaauacgccuuuagguugcuauuuacaaaccagggcguuggaugccucuagcaggccugagaaaagcagguaucaucaugugaaccaaagcaaaagauauggcuggugcucagccccuccugggcauugaguaaccaaacugagaccagccacagccuuccaaccaacccaagagacuugggaaauaccaggaaacguaagagaacuccaaaccauccucuuugagagucaggaacaaaugcucacuuaguguguacuuagcuaucgcauuuacagggacaaaaaccggacacaaagaaaaaguaggggaaaaaaauaaagaguggcaguaaaaauaguauuuuauuccacccccacccgccaucccuccccccgcaacccccaguacacucuuccccucucguucccacagcaacguuacaaucagaaaaaaauaaguuucagggggcaggauuggaggggggggggagaggggauauggguaaaaacagucaaaucacaauaggaauuuuucaaaauagguuauuccacuuagucaucaucuucucccucaucuucagguucucguuuucgcuucugaccccuuucuucuucuggaaaaguaagaaagcggcauuuagauuaguuauuaaucccaccucuuuaacucaacccacccagugagaagucaggggacccaugacuagcaagcugugccauccuuggaaaccgaggcaagacaucugcacagcuggaaggggaaucugaggccucugacaggaguguccugcccacugccaggggccucugagucuaagcaaucuaaggccaaagugaaagggccaggcugcuaccagcugagaguaaaaaggcugccauaccaccaagcucuucuucaucuuccucgucaucuaccucuccaucguuauaaccuucuucauccuccuaggagaaaggacagacaccagaacauuagaaaugcccugccuugggacaugcugaggaagccacacagagcacaaaaaggccggggucacccccagccucucagagcccccaccaagacuugacaucucgggaggaauguaaagcagagguucuuaauuuauuucagaucaaggacucauugggaaaucugcagaaagcuuugaacuccuucuccagaaaauguccguaucauuuauaauauuugcaagcaguuucaggggguuauggauuccaggacccagguuaagaacucugaucugaagucccuguaaggcaggcagcucuccagucugcacauucucugaggagaacaaguucccgagcagacucccugacgugcaaaguaggccauccuuucuugcaucuguccucaaucuaguuuuggcuucaagagaagaccccaguuuaagcaaauccagauucugugggcaaguucaacgucaccugacccagccccuucccuagcuugcaaacuuggaccaccuggaaggguuggggaagauaaauucaagacccccugaggacaucauucccaaccggcuugagauucagcaagguguaugacuuucuuucucaacacagggcccuugcuuuccucugcuccugaaaguauaugcaaguugaaucucugcuuguuaaaccugguuccugaaguuuaaaagaacuuggugacagacuucuuuuuugucaagggaaacauucuuuuaaaaugucaccaaagaguucccucaucagucuguuugcuaagguucugguuuuuuuuugcauguauaagcucuccuuuacugaaagcuggaaauaugcagauggucagugagauuauuuaaaaaacaaaaaacaaaaaacaaaauccacaacccucccccauccccacccccccaaaccucacaugcagcacuccugugacaggaagaggaagauguaacagcuauuagccaauacaacuuacugcccuguucuaggggaaccuguuuuacuaagacuuuauuuuuaaaauacaauauucuuuagagaugagccuaagagucuagaccuagggagaaggcaaagccagcagcacaacuaaacagaaaccaagcucaucuggccagcuuuuuuuuuuuuuuuuaacugagucucgcucuauugcccaggcuggaaugcagcggugccaucucggcucacugcaaccucugccucccagguucaagcgauucgcgugccccagccuccuguguagcuggaauuauaggcauccaucaacaugccuggcuaauuuuuauauuuuuaguagagauggagucucgccauguugccuaggcuggucucgaucuccugaccucaagugauccgcccgccucggccucccaaagugcuaggauuacaggcgugagccaccgcgccuggccuccgcgauucuauugucauuggccugugucucucaagccugggccggcuggcuggaacuggaagacacuaucugagugaguccguguggcaagcggaugugucugcauccuccauugagggagacaggaaacugcggggggaguugggaggggacacaggcgccuuguccaugcuauugucacuuuaaaacucucuaguucuaacuuuugcaauuagcaagaguugauuuagaauucugagcaagucauagaaaaugacucugcuacagagagacucagaacacacaaacacaaaacccaacacagugccaggaaccuggaggagggugugaacgccuacaauaagcagucagacacuuaccccuugucagacacuguccuuaagcauuuuacuuacacuucacuuuauccucuuaacaacccugugagaaagcuaucaugaucccuauuuuacagaugaagaaauaggcucagaaaggucagguaaauugucuggggacacacagcuugcgagugguagagcugggacucacccccucacagaucuuguuaaaaaacugggaaccagccaaucucuuuaggaaaauggccaacuccuggugcucuauuuccauagugucacucucugauuugggauccagcaguguuauccugcuaccuaucaguucaaggcagacuuugguuuucccuagcacaguuuaagugcucaaugaauaucuuaauuagcauaugaaagcaaaaagcagaaaauggggccaugcauucuguacuucuucacauagaaacaacggccaggcuuaccccagcagguucagucccugccucuaaaauccucuuccccucuucuaauccagccuccccagagcuuacugcaagucuugucuccccagaaacagcccagugaaaggcucugaaauggacucacuucacuacccaucggggagcgacuuuccuaaccagggcuccggggcugccaagacugaucacagaggcagucagugggacugccucaaaggggcagacgguggcccugcccagcccagccuccuuaccuccuccucuccacucacguccuccucuucaccuuccuccuccucauccucguccuccucgucuuccacuaccugagcaucuucaucauacuccuccucugugcaaucgaaauggggaacggaaacagaacuaguggugagcuggcuccgccccccacacagcacaggccccuuguagcgucuucaguguggggcucaugacccucccacacccaccuaaguccaaagauggaacacacuaacucucaugaaaacagugcugacauaauuaaacacauccugaaguugugccaaagauaagccccccucacaaguguuaugcaugugaaaggccccuucuggaggccucucacaccgagaccaccaggaaauugucagagcacagcaacagguuccagggcccgggaaagcggcaagaucaaaucaaacuccucagguuaaaggugagagaucugaggcacagagagaacugacuuguucaaggucacgcaucgagucacuaguugagcugggccuaggggaccuggucccgggacugccaguuuuggcuccuuucugccauaucacaagauccccaccaaggcaaacauggucucugaguaucuugcaaaacacucccaauugaacaaagaaaaccaaaauccuguaucugaauuaauuaaucaggcaagugucuccauucucaacuuuaucuggccacgaagaugcaugggaaagcugcacugugcugguggcaagggagaaggggagggaacaggacucccuucuuuucccuccuuccuuccuguaggccucgacuacacaccacacugccagggaacccaacaaguggccugcaguccuccacuucugagcaccuggggcuccugagcaccugagccugugccccuagguguggggcuguaggcugcaaccaccagggggccccacaaccccucuagcucuggaccuccucuccacuacugaauaccuagaugggaaagagggguccucaggccacacacucuucucucucuauccccucccucccucccugggagagugucuaagugcgggucacacuacagaaagacuguagaaucccacucccugggggcuuuggaaaagggacaaaaauugaaguggggauucaguuggaugguuuuaaaggaguuauuaugcaguuggagaaucucaggauauuuccaugagcaugggacucaugcuuuguucuuuuagggaagucaaccaaugagacagauuagggacuauggaaaacaaagcagacagcccuacuccccuccauagcuuuggaaggugguagcuaccagacagacagccagccuucaguagcugggugggggccucccaacacccagcccacccaccucugcaaagccaaggacgagccccaaggccucagcugggccccugcagcccugggccgcacccugucacccaccauccucauccuccuccucaucauccaggcccuccacguagcccucagcauccgagucaggggccuccuugucgucccggucauagccgucgagauaugugaguugcgggaggagcuugaacacauuuucucgguagucguucagguugguuaccucgcaauugaaaaggucuaagcucuugagguuuucuaacuuuuucugcaagcggaaaaaugaagccaacaguaagugauuugugggaggaagguggaggaacagcccuagcaaacaggcaaggaugccaugagauagcaugcgcagaccaugacuuccaggugauaaggaagcuuggauuuggcucugcuuagccacaguguuugcccagacauaucaccugcaguuugugggccucggcgucuccaucuggaaaaugggggguuggacuggaggaucuuugaagccuuauccaauguuaacacuuuuauucugcaauuacagcuucugucuuaacagugauugacuugaaauuagccuggggcuuucuuggugcaugagccaagagguuuacugccucucccugagacuaaggagccagagggaaaccaaaagucaacuugaacuaacaaacuaacuccuucugcaucugauaaugaugaugauaagggcgguuaacauggcacuucauguacugagucacuuuaucucacaaccccuguaagguagaaauaauuauuaguuaauuucacauauguggaaauggagggcacaggauuugguaauucaucaggcagcccaacuucagaccugugcucuuacucuuugaauauugccugucaaaaaaggacaagagaaaaagcaauggaggaccccaauucuguccaugguauuugacacgaugugcucugucaaagcuuuacaccagacggguucuagccaauguuaucccuguuugaugguagaggaaacugaggcccaggaagugaagggucauacugcuugcaaguaacugagcuacauuuugacuucccaccucacccaccuuugaggcaccagguacaaaaaaaucccaucccaggcugaguccccauuccaaagguggccaggucuaacaagggagugaaaccauugcuccuuggagucaaugucgggagcuagguugcucucucuaugaccuugcaguugagaccugggucauucucagcagaagccaagggcagggaggaagucuugacaguggucugugugggcaagcccagcaccugcuaccaaaagcagcuucccgccccaggacgguaaggcaacacacacugacaagcaggggcggagaaagcacugagacacgugugaucugggcagggggcaguggagagugugaacaugaacgugccugagugccugaccccuaauggugacugaaucacaauguuuuacaaggauuuuauauacucaauccccauaccucacccauauacagaacuucaaagacuuuuuccuuuuguaaugacauuauaaaaucaagacuuccagacagaucaaaauaguuuggcuuuuuccuaggagaccagugaaaggccugaaaagaaguucugugggaagcacauucuacuaguuggccccaaugccaucgauggacagguaaagagcuuggaaaagaaaugccaguguccucuucugccacacuggccaccagcaagucccgugagcauccauggagagcaaggagugccuuuugggacagaaacccugaaaacuccagcccaaucugagggauacccaaccuccccuauaaacccagaagggaaauuuggcaaacguggccaauuguccuccuggccuuucccugauuuuaagaugccugaggugcugcugcugcugcuuuuuuuuuuuuuuuuuuuuuuuuggagacagagucucacucugucacccaggcuggagugcagugacgcgaucucagcucauugcaaccucugccuuccagguucaagagauucuccugccucggccucccgaguggcugggacuacaggcgugugccaccacgccgggcuaauuuuuguauuuuuaguacagauggggugucaccauguuggccaggcuggucucaaacucuugaccucaggugauccaccugccuugcccucucaaagugcugggauuaaaggugugagauaccacgcccggccuuaugaggugacucuuauauguauauucacaacagguguauuuacuucaugugguaguauuuccuauuccaaaagaguuguuuucagugacacaucuuacagcugauuuccuuaaaaucaaaggaauacagcgaaucagauccugguaauuauagaaaguguuguucugaacaugaccugccccuuucuggcugguaaaucagugaagcuuaggggaugucuaucucuacaaggaugagcagaggagccagaaaugcuacccaggccccugagagccuguucacuaucgcaacaaggacuggugaccaggggucacucuucuccacaccacguugaggaaggccugccugcacgaggcucucacaccacacggcucucagucauuccaggguucuaugucaggacugacucauuucucacaguucaggggccagcgacccaaggagaaaacuggaguccaccuccagggccaguuuaauucuuggauugcuccucccuucccaaaaaggggcaacaagccaugcccugaaccugaagacauuacagcucagguuuccaaagcugagcagaaacugaguggaaaagcaggagaccagaaauugaaacuaggguucuacgcuacccguacaauagcugcccauucugucugugaccuuggucaagguauuuaacuucucugggccucaguuucucuauggacucagcagaaacaauagcucaauucuaucucauagcacaucaugagagucaaaaaaauuaagugggaaaaggacaaaugcaaaaguaguauuugcugaugccaauuccucccaccuccuaccccugcagggaggggaggguccgaaugacuuaccaguggcucuauugugcugaggucuuuaauuuuguugccacuuaaauuuagaugcgugagguucggacacuuuucugccaauacuuccaggcccccugagacucuguuaucgcuuaguucaagcuaaauaaggcagggaaagaaaaagcagaaacagcuuuuaaaaugaaggcuaccggcucagagcugcccggcuuuccccagacgggcaagaagggaaagcagucucaggcaauugucuggcauguuggugcaagcacccggcuuucccuucaauuacucuuucuaaacauagguaauaacccuucccacuccccacccccgccucccagcacacacagacuccacucuauuuaccuucuuaaguuuguuuaacuuugguaaguuugcgauugaggugaggccuacguugauuguacuuaagaauuccaguucuucaaauucaucugugaggccuucgaguuugccuucauucgaccgacuguuguccaggacaaguucuuucaccugaaagaaggcccgaccgugugagcggggcugaggaauggggcugaagcagggggaggguguuagaggacuccucagagaacagggagacagacgcaggaagcagucagucacuccgucacuucuucuagcuuuccggaucacugugcugccaacgaccacaggauggauuugcccacccugacuuuucugccuuuucaacaucugggugagaggaggccuguggugagccgagcugcagaaccagggggccacuccagacaggggccuuggcuguaccgcagaagacaaacccaguaagcccugcugccucugcaagguugguggucucauuccaacccugcucucgcauucucccaaaacccacaugcaccagccacagcauuguuagggacuucugggccuugccccgccaccccaaugcccccacaagacccccacaugcccaguugcuuucacccacuccugccaucacagcagagccugccgcuguagcuggcauucacauggcaguacccauguggccuguccugaggcaggcgcagcagaccaggggcuccuccagcucucccaccucuagcccagcacuguccaacagaacuuccuucaaggacggaaacggucuguacuguucaagacaggggccacuagucacauguggccacggagugcggccagugagacuaaggaauagagcuuuuaauucuauuuaauuucaauuaauuuaaguguaaacagacacagguaacuacuauauuggauagcacagcucuagacuuugcucuucacgguccagcauagacguggaaggagaauggaaacccacaaacuuaggaugggcccauaaugaaaugcugagaucugucucaaagucugugcuuggaggcaccucuguggcccugucuuuuuccccacucagcucccuuacccacaauuuggguccuaaauccuuuauuucuaaugagguagaaagaacgaauaaaaagccacccucucacaggguuguuaagagguagacuuagcugaaggugaaacugcagguucuaaugaagaagguagaaagacaggccgaggaaaaguaaccaggucgcaggcaugaaaugacccugggaguaagcaaaggagacccgguguguggcccuccaggcagcuggcccagaguucuccuuccugccccagagcagccagcuucugggaaacccggccucucuggacuggaagacaccuuaaaugugaucccugcccacaccugguaucucaaagagucccuucagcccaggacacagcagcccaagcucccugcaggugccaggaaacacuuaccaaugucaacuggauuuguugccucccucccuggaacuuccaugcacaggcccugauuucucaccaaugggucacauggcacaagccuuccuucucaacagcaguccagcauuguucaaaggguugcuccugccccucagggccuuuucuucucuuggauaagcagccaggcuuucuaaccugucccuguccagggcugcuccugcuccuuugagcaggccaacaugccuagcuucuucuuucugggcccagaaugacuaggugccccucuuacucaggcaucucugggccaaguagagauaugggggaaaggagguggaaacagaguccacaugaggccugcuaugccccuccucagcccccucuugccagugggcagagcaggggagcacugggguacacaucuggaucucagaguccugcagggcccugcaacugcccugccuucauucuucacugguggguggaggcaugccacuccgcccgggacagcagcaauuuguggguuucaucuagcacagcccacagagcaggagaaccagggagcgcagcccucuccuggagcuaaggagcucucagccuaggaaauggucaccaaagcccaccuuccuguugggucugggagggggaggcucaguccuuucccacccccucagucccugagauccagauguccaggucaagccaccuucucaaggucauggcaagagugccugggaauaaauccugugaggccuucugcccuagggcaggaaagcaucgcagagccaggaagccaggccuuagggggccagugcagauggagggagaguaacuguguugggggaggggagccaucuccuucguuugcaguaaacacuggagucacguggcccacagucuucuuuaguaauugguuuccuuggaaggccugggaauucuugaagcuccaccaaagcaaggcaaauaugagaagagauuccagucuacccucaaagacugcagacaugcgguuuuucuagacgggucaauggcuucuccuuacugccguuggccgaggagaggagggccucagagagcagugcuggggagcccagggaauucguccaggaagucggucuccuuccuggagaggaacagugcugccugccaccccugcccacagcccaaggggcugcugcugggguaggcugccuaggaaugcuacagauagacauagguuucggagcccugacgaggccagucccuggcuccuaccacaacaccaaaacugguggcugcuccucuggaggacaauacucaagcaaucacuauuaaugcuuugauuaaaaauaaucgucauaucuuucucaagcacucgcuaggcacacucuaggugcuucauacacagucucguuuaauccccauaaccacuccuugggguguguucucuccguuuuaaaggcacguccgaacugcuuauccuaaaaucccaaaagaaggucacaggagggugggugucuacugcacucagguggcuaguguuagccacaagaugaggaggggccccuguuggcuucuugggacucuccccagacccccaagucaauucuacaaguucuuggcugugcuggggcucagaacacaauacccaaauguaaggggcuuuggcgugcuggguacuuugaacuaaaggagauuggaaggccucagaagcaagcucugugaauuucucuugcccuccugucucucacccucucuccccagaagucacagaauccagaacuucucuuccccaaggcgggucacagaaacuagaauuccucucucccaaagcaaagccgagaaagguuacucucuccugucccuucucccuugaagacccucaugccagggaaguccugccccauaucuaggaggaaggaaugcuacacagagaggccacaaagaaucugaacagacaggccuugcuggguucccucucagccuacaccccuuuguccagucccauuucuucauggcugucuauucuucaucaaaccuaaguauaaaaauaggcaguuucccugggucuuugguucuucuucucugaagguucucaugucacuuacaacuuugauuaaauaaauuuguuacgcucuucuuuuguuagccuuucuuuuguuauaaguguuggccaugacucuuacgacggguaaggaaagggaucacaccuucccgccccuacagcuguaacuguuucuuuucagcuccucuucuaacuguuccaccagccaggugggcaccaccccuagaggucucugcucugguuacacauccuuagcaaccaaagcacagagccuaacccugcccuggcucagaugacgcugcaggagggggcaaggauacagagaggggccugggacccugcucuuccccaaauagcaagagguugcuuccacucccuugggaaauccccaucguuuuaaagguggugucuucagaauccccacuguuucugcauuuccucccugguugguuucagcaccaugcagggugagaucacagaggggaaggaggggacagggcuuagaccugagguugcugauaccaccaaaaagcccaaaccacaugggggaaagacccacugcuuugucaugagaugaagaggggucccagugagagcagcaggugagcugugaaguaucugaaaugcaccaaacaggacaaaacaaaaaugucagcccaacagcugccugugaaagacaucccauucccuucccugccugccuccaugagggccacacuuuccuagugcucuaguuucaaagccuagacccaccccugaacucuugcuacaauaccaacccauuuccucuguacuugguucuaacccuuccaugcaaagagaacaucccuuuuccacccaggguguguucugcuuuaaaaagaaaaaaaaaaaaccaaggcccacuuccccugccaaguccugggugugagugaagcgcaaaguuaaaauuaaacugaaaauuuguacuuuuguagacuuuuucccaauuccacugaccauuuaaaaauauccaaaugugguuacccuaccuaguggaacugaaauuacucugcuuguaucagaagcuuuuccaacaccccaaagagaaaccuacacaggacccaaugcuucauuccucaagugaacaccuaaaaggagcccucauauucauaagagaggucagugaggaggcaaugaagguucccaagaugucagauugcuggggguccuguacuuccugaaaaacuuguccccaaagcaaagaccugucagucauuuuucaccaaugggaccugaaaauuccaugauaaacacaaauacguuauuacucuaaggaacaauuuguuguuuaaaacugaaaucuugucuuuacagaucucucaaauuuggccuuuccccucuguucccaacguugcagcacuggucacugucaccucgagucacuucaagccugcuuuugccuccacaccaggucucuaugacugugaggauggaaguggucaagaggcagccuggauuacugggaacaggccucgaccuagagggcucgacccaacuggcuccaugaucucagcucucucccccaggccucaggcuucugccucuguagaaaggggaugaugagaucuguuuaaccuauaaagaguaaacuccagccuggaaaacauuccuggcuucucacugccuugggaaaaauucaaguuccuacacaugaccuccaagguucuccauucuuggagcucccuccucuuuauccaaccucagcacccccaaucucucacucuuacccuacaaauccaguuccccuucccaggaagccuucuccaacccagcucugugcauccuggggcaccaagggcagcugcugcaugaaucauuuacucguguauuaagcauccgauccuccuagaggucagggacuguccuccguaaucagccuaccagggagcggagaccagagcaacugcuuaacaaauguccuguuuauugcgccagguauaacauuaggugcugggaauauagaggugagucaaacugucaugaaacguauucaacaguaugacgaauaaauguugaaugaacccuaucuuuuauaaacaccagugguuuuuuggagucuuucuugugcccaagacaagcauaagccccugagaggcaggucagcugugcacacucccccugaccugaaugacccagugcucugcaugcaggucuccagcccucuccacauggggcacaccugcgacacuguuggcugaggagacacggaagaaacaguaagccaaggucgggguccuugccagcaagaggugugguggccggcugggaggagacagccaccaguaaacaacuccaguccagugugccagguagcaggacuggggccgggccagggugcauucuucaaaugccucuaccagauagaacaggcaugcuaaaggcagaugagggggacccagaaggaccaacggaggagauacacuauaucaaaagccaggacuggcuuagagggcccagcauaaaaugaaaaacacggagccccuugcuuaaaaauuaagaauuccaagacagugacagcagcgcauuaaaccaagugcgugcugcacgggucacaugccugugaagcuggcccugauuaaaguggacaguuugggccugaaacagagcccuuugaaggacaggaccagagagaaggaagcuuagaguaagaacugcuccuucuuuuucuaguacuuccugaggcaacaaggaaagguggacagaaggcaggcucucgaguccgagagaacuggcucaaguucaauuuuucuucuuuuuagcccagcuuaccuuucugagcuuccguuuccuuuagugacuauaauguccaucaccuaggguuggauuaaauaagaauguacuuggagcauccccagcuuggaaaaagccacuugccuuccccuuuuuccauggcuaucuuuacuguugcguacagucaaggcacaagaauggaaacgaagggcagguuagcagauuugagucaacuaagcugucuguacggcuuccuuauaguaaauacgaggccucuuaaccuguuggggaaccaggaauggugugcuuaaaaccgaccccuuuggauuuuuacauccacaccuuguuuuguuuuucacacuaacccugaccacccuugauuuucuuuuccuucacggagcaagaauucaauacauauuuguagcuuugguuucaaccuugucagucccugacuaauuugguuuucagguuccagucuuugcacacaagagaagacucauaucaaauugacccuguguuuuuuggugcucguggguuuuaaauaggucagcuuuuaaaugggccauccccuguugcagaucccauuucagcuagaaggccaaacugucugagacaccaagguuuuagacuggggugauagaugcuugugauuuuguuguuuuaaccauaaaaucgaugguuuugcugaacagccaguguggcaaaaccugcagaaaucagucagguuccauguuggggaaaagugaaagcucugacagaaaaguuagacauuuugaaagcuagaagggccuuagggaucuccuaggccaguggcuuucuacauuuuacaccguggcucaguacacacguuuuuguguguguauaggcauacacaacugaaaacaaaacuuaacacuugcaauuacuuucuuauguuacuuagaacaaaauauguguaacgugaccuacagucugcaaaacucugguguaggucaguucucuuuuuucagaggaagaagcaagguccaaaguuggggccagagucacugugagcugggcgauucguuucccugcagcacacaccaccaccaggcaucagaacucacauccccaguggaagaccauggaauuaacagaucacucguguagcuuucaaguuucugcuaacaggaggcuauucugcagccucaacaguaguagacccagaucuccacaccucuagaagaucuuuuaaaaccuuaacuaggggcagaguccccuauuacuuuaaaacaaacaaaaaaucuccccaagaaaaaagcauccacgucucugauuuuuuuuguuguuuguuuccuacaauagagcucugaaggcaggcggggagcacauggcccggggaagucggugacgccauccuuauuauuuuagggagccaaggaacacaagcugaggcgcgcugcagcgguaauuaagcugucugccagggccccggcucauaggcuaagccgccggcgcggggagggcccgcauuaacauaaacccugugacuugcuccugcaccgccuggaaccggcuuccucugucuccucccgcgggugugagagggacuuggguuucugcuucaccaaagcagaggagcugguuccaccgcagauguuccuccagccagaaacacagacucagggcaguacuccgcaggcugggguggcugcaggaccugaguuuugggcuugccaaaugggccuguuuagcuggugaauccuagcugggccccucccugauauuguuccuuugcuuccucccccuuaaaccuccuuccuaccuuccagcugguauagacuccacaucaaggaccugucaguucuaccucccgcaggaagccuucccugacugcccagccucuagcccaggccugucugguuuaagagcguguauagcucuuaaaaguguucacagaggagcaggaacuguuuuggggucugaagaagggaaggagggguuuugggucuagcuuugcugggggaugggagcugcaguguggaaaaggggagaugaagguuuuagaacuggcaggguacacgacccagugaaaaucuuacagacucaacucuuuuuauuuugagacaguuucguucuugucaccuaagcuggcgugcaguggcgugaucucggcucacugcaaccucugccacccagauucaagcgauucucuugccucagcuucucaaguagcuggaauuacaggcgcccaccaccacgucuggcugauuuuguauuuucaggagagacaggguuucaccauguuggucaggcuggucuucaacuccugaccucaugugauccaccugccuccgccucccaaagugcugggauuacaggcgcccaccaucacaccuggcuaauuuuguauguucaguagagacgggguuucaccauguuggccaggcuggucuugaacuccugaccucaugugauccaccugucuccaccucccaaaguguugggauuacaggcaugagccaccacacccagccgcagacucgacucuuucuacaugguuguuccccuccuaccuucaguggaugcuggaagacugaagagguaggugcuggaggacugaagagguaggcacuggaagcagagucccagcagguggugugugaacaguaaccagggaagagaaggaaaaggggccaagaugcaccaagguguagugcacagaaugcuugucaggcacucugaugaccugggcuuugguccgccuugccgcuaacuugcugugugaccuucgggaagucacuaccacucucugggcuucuccuaguccucuaguccauacacuggacaauagagccugagugcagaaauaaggucccucuaguuucaaaauucucucgguacauacacuuugagccugagugcccaccccacauucaaacucagucacuguuccggaaagaacguggccaauuucaugggucaaggggcccaggauucaucacugagggaugccaggaaggaaaucugggacauggggcaguuacccuggguaauaagugaaaugggaaacucaaucaucuaaucucuuaaaacauaucagcacccccaaaauaaguacaacuauaucaauuuguaaaauuaauuacaacaaguuuuuaaaaaccacacaucaggauauaaaaacaccccccagaggccccgggugcuggguucugaaugugggaguccagcauugucccaucugaugucuauccucucacaggucauugaguggccuccaagaugccuggggugggaggagaggagagaccaggaucacccaucacuacucagauccaugagcugacaauucagugauucaaaacacaaaccacagccguucuuggugaucuuauuacagaaccacagcacugcacccaugcaacagaaaagccacagagaaugaagaccaaggccuagagagcaaagaggguaaauccugcucaaucuuccuaaaacgcugcuuugaucacaucacaucaugucucauuacuccccuguccaaaagcuuuuaauggccacagggaucaagugcaaauccagaguacgauucccagacccccacccaucagugcucccuggcaaaaccccugugcuuccucccaucucagcccucugcuagccucccugaugugcagcaaaaauaaugacaucacuuggcauugcauguuacgguuuacaaagugcuucuccccucauagacaauggaaauuuuaccccuucugucccucccaggcaaccugccccuguccaccagggcccugaaugcugcugaaggccagucauucuuccuccuaucucucccccaacacagccuugcuaaggucugaggucucagugucacccuagugcccuccccagaggggcuggcuuucaguaaaugcuugcugaauggccaaacaggcuaggggaggggugggguguggguggggaauggcucuggagaauaaucuagauuacagaaggcuaacccuuuauucacuuucugaggcaaagcuccccacuaaaaccacucuuagaaaaaucaacugucccagcugacagauacgguuaauucuggcugcugaaaucagauugggagauugaagcccagcuuggcugggaccgcuuguggacugcgggagcugucugcuuaggaaaucccacuggagucuucagggagcagcccaggguuucugccuuggaguccgggauggaccccgaguggaggaacugucagcaaaauagaaguuaauucauuucuccaguguuacuauucagagacccaggagcuggcaauucaaaguuucugccuauuccagcccccagcauaacccaucuaagaaaacaugccaaucagacucagaggccaggacgcaucccacagccgugguguaagcgucugccccauuuucagauagcuuuuaaaaaaugcuucaaagaacuaaaggaccccaucaaugccacuuuuggggaacuacuguaucuaauccaacuucccuagcaauugaugaagcuggguggaaacuaacucugugacucacccaaggcuacacaguuaccccacuguagaaucgaaccuuaggccauucucucaagacuccaaacuuagggcccacacccucaaagucacaggacucuccauccuccuugaagcaagaggaaagaaagguggaaaauaaaauuagcuguuaggaagagcccagaccugagcucagccccugcucuccccaccaccaccuuccacacauccaugcagagcugcaaguggagaagaggcagggaaagcuaaauggccucacagaagaaaccucgaccuuggccuccuucccugccaccucuaugcaaaaugacagcagcaucagcaaugacagaagcagagcaaacgccgccucggcacugaagcccuguuguccaaccaccaaugggaaaucgcugauuugggcagaaaugggaaccaaucaugcagaagaaccuaaggcuggggcugaaaguuuuuucuauccaaggccacaaaacaaauuagccaggggcuacacauaagaagcaauuuaacauuaguuauuucucccuuagacaagugugaaaugugcagcuuccuuaaaucugugaauuacacauguauggcaaaaauuauuagugaaggaagugcaagaaaugcuagcaguauauguuaacuccauauuucuaauuggaaggaggauuaauaaaagaaauggaaugagggaaagcaaggaaacuauggggaacugaggggcugcuggaaggaaggggagagggagagacagacacagacagagaaagacacgaugagggaagaaaggaguuggaggcuuggcagguauugcugaacuuccagaguuccauccucuucaucuggguuuggugguagaaccuuaccuacacuuguuguuuuuuaaaaagagugcagguugaguucauuguuguucacaagucuauggcugcuuuaaucucaaaaugcuaaaaaacaaaaacaaaccccaaaccaaaaaacuaugaagagagucagggaggguccacaugacucgagacaauguaaaaaggaacuuaaugauuuuagucuucaucagaggcucaugaaggaggcuucuaccauggcagccaacacagaugagccaucgaaggcugugcugauaggaacacgugggauggaccagggcuccuuggucagggucccaaaacacucugcacugacaggacuagaccugaaauuccaaaauuuaaagaacaaauuugaggaaggcaaccaggguaggaaggcaucugaaaacugggauacuagaagaacaauugaaggaacuagugauguuuaggcuugaggguaggggagaccaugaucacuaucucucuccacuuauuugaaggaaugucauguacguuuauuguguuuuccagugguucaagaacuaagaucagagugcaggaaucauaaagagacagcuuucuccccaguguacuuuguaagaaggucucuagaucauuauggcugucucacaaaauaaugggcugcucugaaaacuugggagcuuccugucccuguaugaaucacaaggcuguuaagugaccgugggcaaagagcuucauacauaaagagugcuggaugcuuauuagaugaauuaauaauauuguaugauaaagcccugcaaagagagcucugagucuuuuccccucuuaaaaugcuaugauuugauucuuucuucuuaagcauuacuugcuuuaggaugcaggcccgauacaaucauucaacaguccguacagaguauuuacuacaugccaugccagguacuaugcuagguguuaaagauaccgugguaaacaaaacuaggugccugucucacagaucuacauucuagcaggggagccaaagaauaaaccaauaaauguauacacauguauauaauguguaugaaugcugcaaagaaaaaaaaaaaaggacagaaaggcaccgggcgcgguggcucacgccuguaaucccagcacuuugggaggccgaggcuggcggaucaugaggucaggagaucaagaccauucuggcuaacacggugaaaccccgacucuacuaaaaauacaaaaaauuagccaggugugguggcgggcaccuguagucccagcuacuccggaggcugaggcaggagaauggcgugaaccagggaggcggagcuugcagugagccgagaucccgccacugcgcuccagccugggcgacacagcgagacuccgucucaaaaaaaaaaaaaagaaagaaaagaaaaggacagaaaagcaauagugacaagggacacuacuuuagagaggguaaccaggaaggccuauccaaagugagcuuucagcagagacguaaggccaagucaacaacuaggagggccuuccagacagaaagaaggaaaagccagggcaaagauccugaguggguggcaugcuuggccuuauuggggaacagcuaggaagccagguggguacgagagaauuuguggaagggaagaaaggagguggcagcaugagauugggguggagagaaggcugcuguagguuacacaccuuuacccacaggggacauuccacaugcaacuggugguaggauaguggguuucacaggcaaugcaagaagaauugcuuagaccacaggaaaguaguuaagaccugagaucuggccauaagccuaagaguuaccuugcucugccuuaaaggaagaagaagaagaaaaaaaaaaaaaaaagcaaaggaaaaaagugaaggagaagaagcuuuaaucaggauugugcuugccccauguuuccagguagaaaugggccuaaucuacaccccggacaucuccuaugggagaauguuuugauuauggggguuuggacacaugagaaguagucggaagaucugguuugguuucaggcuuuacugcuuacaaacuguguggcuuuggacaagacuucacugagauucaguuucuucaccuguaaaaugggacgagucccuaccaaucccaccugucuccaugggacccaaugagaucauggguaagccaggcuguccuagagguuacuaugauaaauuuuauaagcauguuucuuacccaagacuuugcaccccagaaagcagaggugagguauuaugcaacugauucccccacacugccuugcacuuagcuuucaauaaauguuugcagaacugaaaagcauuaaaaauaacccggaaaauguucugccauuuuuuuccuuccuauuaaacuguagcacuuugccagaaugcuccagaacagucucucuucacuguaauccuucacuuuggaggaagaaccaacugagucacaccagaggugugugcucagaggauaaacucugaggaauggggacaggaacaaggccugacuccucuggggaaggcuccuugcucucugugcccccaaccuuucucaaacauccugagagggccaggccaggcuaccaacggaagggacugcagauuacccuagcacaaggucaggaucuccuggaaaaguccaugaaagccugagaaauacaauauucacaacauuccacuucagacuaaggagucucaaucugguccaacugccucaccauacggauagggaggcuaacacacaggucaguggacucgcugguucaaggucaccucuuuuuuuuucuccuuuucaauuuuuugacuaacacauucauucucaugguuuuaaaaccaaaauauauaagauauacaguuaacucucccuccuaucuuauccucugucugcccagucaacuauaccaccugcuaagcaucucucuagaauguucacacacauacaagcaaauucagaaucuuauuucuucucucuuuuauuaaaaaccuagcauauuauacuaaucauugccuugccuuuuuuucauggaguuuguguaagaguacauaaaaacccucuucguuucuucuuugcaacuacauagugugucaucauuuuucuuaaccagucucuuauugaugaguaucuggguugcuuccaaucuuuuguguaauaaauaauuuugcaauaucaauaagcuugggcaugucaguuugcauucaccuagcuuacggauaagagcuggaaucagaucccauuucugaccuacaggguggcagucauacagccucagaguccuauuaucuuauuuauuuauuugagacggaauuuuguucuucucgcccaggcuggcgggcagugacgccaucucggcucagcgcaacuuccaccucccagguucaagugauucuccugccucagccucccaaguagcugggauuacagguaugugccaucaugcccggcuaauuuuuuauauuuuugguagagacgggguuucaccauguuggucaggcuggucucgaacuccugaccucaggugauccacccaccuuggccucccaaagugcugggauuacagacgugagccauugugcccagcccagaguccuacuaucuaaugucuaaguuacuuaaccuccauucauucaauacacgcuccucagaacuacuaaaucccaggcacuacaccaggugcugaggguacaaugauaaaggugucuuugacuucugcucccaaaguguccagccuggaagggacaaacagaagggaacauuccgacacacaagggccgcucagugugccccggaagccaucugaccuuuguaggccaaucucugucaggaaauggguggccuuaccuacaccucagggguguuuuaaaagguaaaaaagauaaugcuugccaaguaccuagcaagcaaggaccacacaaagcucauggcagauacucaauaagggguaagccuccucuugucccagaaugggucuuagugauggcagcagcaagguguuccaggcaaaggcacugcauugccaugccuguuccacaaugagcaauucucuuuucuuagaggagucuggaauacacugcuacuuauuuuuuaaagcagcaccuaagccccuaauuaugucuuagccuacuuuuauuggaaagccauuugccucucucccacauuccagacccucuucaauaucucugaggcaccuggguaugcuucucaccugcgugcacaagcccugguguuugauggagugucagagccacagaggaaacccacacacauuucuuaagacccuggcacagaaaggcacaggcaggcacauggaaagucgcuuuuacuaggauaccccugaaaguauuaaauaauaaauagaaaaaaaauaggacaaaaaucauuaaaucucacacauauuguuugguuuuaugugcucuauuucacaaacuuuuuuuuuuuuuuuuuuuuuugagacggagucuugcucuguugccaggcuggagugcaguggcacaaucucggcucacuacaaccuccgccucccagguucaagggauucuccugccucagccuccugaguagcugggauuacaggcgugcaccaccaagcccaguuaauuuuuguauuuuuaguagacaugggguuucacuguguuggccaggauggucuugaucuccugacuucaugauccacccaccucggccucccaaaguccugggauuacaggcaugagccacugcgcccggcccacaauaaaacauuuuuaaaaaucagaacuuuuggcauaaucuauuucgcuuucccaggaaaagaaauguagcagauuuuauaacagagaagagaaaguaaagucaagucaagagucuaagguauuuccauauuaucaucaaaguugccgggagaagguugggggucaaagcuaagauuccagguuggaugaccugguuuuguauccaagcacagcuccucaguacuaccugaccuuagguugguuacuuaaccuuucugagccuugguucccucauuggcagagugagcauaauuccauucauccagcagcauuucuguauagauuaaagaauaaauauggugccuggcacauuggcaugaacaaacaguuaaaaacaaacaaaacacauuuuuaaaaagauauuacuuuuucuauuuaguacaaaaaugaaaaucuagugucuucccuuguuuucugagucucgcucuguggccaggcuggaguguaguggcacaaucucgguucacugcaaccucugauucuccugccucagccuccugaguagcugggauuacaggcgcccaccaccacgcccaauuaauuuuuguauuuuuguagagaugggguuucaccauguuggccaggauggucucgaucuccuggccucgugauccaccugccucgaccucccaacgugcugagauuguaggcgugagccgcugcacgcggcugugucugccuuugagaagcuucaagaaaaacagugggcaugaaauuauccagcccucauaauacugggaaacuauuuuccuaacaggcuaauuaauaaagucuuacuucagccagaagcuccuuucaaauugauguaggauuccugcuuuuagaugaaauuauuggccaauuauagcucagucugguccuugggagagguggggucugcugcuguauuugugaccucugauuuaacugugggcuucucucucccuaaaauaaacccugggggcccugugaguccugccucaccaucucuggucagaggcaucaguagggucucuccagcccccauucaaaagcaucuaacccccuaaaccagguccagauggaauccagaaaguacaaauggggguccuccaggaaacacugcuauuucagaaacaccaauggaaauuccacucugacagugacggcagcuggugguacaaaauugggcggugucuccgccuaggcaggaaaaacaccagcuccaggcagucagccguugccuuaccuggagggcugaucaaccgucacaaauguguuuaaaauuucuacccccuccccacacccagccaugagaaaauaaauguauuauuguuaauaaaugcaauuuggaagucuaaaucuuucaaagggcugagucuugaagauaauaaaacacauucugggaugaaaaggcagagggcuggagcccaaggcuggugugagcagagcaguggccggcuauuauacuuguccuucuuggguuuaauuucaucuuucccaugaaucaucccaugaauucacaccuuaagcucacugggccuuagcuuguuuauugggaagaggacuucuagagguacuucuagaucagauauccuaaguuccagcucauggggucagaaguccaguguaaggcacuugagugcucaaaugccaccuccucagagaggccuuccuggaccacccaucuccuuuaacgcagccuuaugggucuucauggcacucaucacaccagcagccaugccuuugcuugaaggcuuacuacugacugucucccccagcggaacagaagccccacaagagcagcauaggugaugugucugucuaguuccuagaacagaacccaguacagagucggcauucaucaauguguguggaaugaaugaaugaaugauuagccaagccaagggucaaccagaaagacagggauuccaaucuuacaccuucauuugcuaucugggcaccucuggguaagccacauaaccccuccacaguauuguguauuugcagaaaccacccccauaacucugguuaacaucagacaguaguggccaagugcugcucaccaucagggacauuuguggcaguaauaagccuccuggggcuaauaagccauuggucgauacaagucugguuucugguacagugggugccucucagaccaagaugcacaucuugcuggagucuauggccacuggucaaucucagaggcacauucucacucccauauccaacccugccacuccugaugaugaacaccggccgcugaaacugaaggaagacuccugagugccuacacaugccaacugccugcccugaaugaaguacccuucuggcuuuaagagggcagucagcguuccauuuccgcucccacuacucccaccccaaagagcaacccuggagggcucuccucuagaagccuucccagacucacagaccacaccuaaaugcaaagacacaccaguacuuuuaaccaagacacagaaaggcaugucugcaacagagccauaaacuagacaagggcuaaaaagaacagaacugcucauuauggcuucaggccaaccucugcagauaggcuucaucaggccuaccagagacagcugaaagcuucacaaaguacaggccugcccagucuucagagaccacaaccaggguacacccaaaucuucauggggaaaggaagacgugcagaaguggaaggaacgccuggguggcugugaaggccaguuucugacccuccauauggaacagcccccugugccagaacagacaggcuacucccacuggcagccaggcaagaggcuggagaaccacaucugccaucgucacagagcucuucuauguccccagcugcaggagagucacacugggcucuguacaccgucaaugcugcccucuggcaggggguauggacauauaaaggagcacugaccagacagagagaaagccacagaugcacaccuaagugagugcuauuggacuuggcugagaggcgaacgcugcugcgugcccuggaaguccccaggacuuuuaccuuuaugucaccuagguggacacaguuugcucccuuucuuccagugaguugaggagggcuucccagaaaaggggaccucucaggagcuguaugaaugaaagauaaaggacugggagaggcuggcccagacuucugcagccagaggggaguuuaaaggcaagaaggcuagggucacggagcaacugcuaugggaaaggugagccagcgcgacagcccccaccccagaagaggcccggggcaaggggaugccugcagcuuggcugguauuccucccgccccaccuccacagaaaacgggggggggggagucucuccuuugcccagagccucccugccccuccccuccgcuucacagcuccaggcgaggccuccuccuggggcaggccgagacagcucuucucagacuugcucccaccccagcaagcaccuucuggagaggggcugacuccaccccacccccaccgcugaccaaacagcucauucaagcccugacggguagaaucuaaccuucaggguccgucuacaacccauaccuggcauaaacgauauuucuuuccgugcuaacaacaagcucugggaagcagguuauucaccguuucacagauguggcaacugaggcucagugaggugaccugccaacauccucaggcucagcaguucucaagcacuacugcccacuguaccugacugccugggucugcgccugggcccccgcccuuuuacaaaagguccacggccucucaagagcuggacaugaaggaugggccaaguccagucuugaucgguaaugcccacuugacacucccaggagcagcauccugagauacacguaaaugaaaaauuccaagugugaugagcagaacgugguugugugaacaaucccauggugguggggauguggggggcaggucaaggagcggaucccugaaccccagcagauuaaauccugcauccuucuuuccuauuuccugguuucucugcuccauuuuccucuaguuuccacuuaguuacuucuuccuaccugcugugaagcucugcacccugcuccauggggugguucccaacugugcuuuagaguccccuuuagagcuuucuaaaaauacacggacuggggcaccacccucagagacugauucaguucaggcagagccuggguauugcuucagaugcuccccuggcaguucugauccacagcugggguugaaaucggcuuuacuaaccacacaccuucuucccugcaguguaugugcuaugcuccaucacuccagcuccaccacaggagccaggcaccaccauccacuauaaccacucucuucucuccuacccagcccaggaugcaaggacuggauucaagaaauuaaauuugcuacaaaaauacuuacauagcauuuauacaacuccuugucucauucccgaugcugggcacacaggccauaucaguggacuccccucacccguccauucaguuacaccacuuaggccugcccaugaagccaauggcuaaggugacaguugguuacauaaauugaagaugagucccuccuccagaugcauggucccugaagaaaucugaaaguaauuccucuaaauugagaaugacaggcccuugccuccacccuaucacccccugcacacgcacaugcauacacacguaguucucacgaauucuacaggaggcagcagaauccagaaacccagcacugggcacugcuggcugcagaguuccagcacaacuuugcugaaaucucucagcaaacacacucugcgggccucucucuuucaagcuucacugugcaccucugucucugcccuuccagcccacacauccugccucuuacuuguuccccacuccaagauaacuaggagaaagccaccuucccacccacccugagucuauggcugauggaauccuuaucguagcuacuuccuggccucucaggacaugggcagagagaacccggggguuuaccucugugggaccccaggggugacuggaggggacuuugguggaucuguccacacagccuaaacaaagagcaccaagcugacacacggcaguggagccuugauucaccaaggaucucgggcaagcuagcuuauuguauuaaagggagacugugaauguccccuaccccuacucaucacacacuagagcuggagagaucuuaacaagcagugucuaggaagguaugagcguuucuuuuacagagugaacuuuaguaacugaauuuaaaauaaaacgagcaauuaauuagaacaguagucucuuauguggacugcccaagccaauccacugggaugcaagaauuucaggacuuuuuagauguuuaaauguauccuuuuuaauuuauauuuuuggcguuacauuuuauaauguccauauuuauagguaguguaugugaauaauccauaacugcaagguagacauacuggggcucagguucaaauuguuuacugauaagggaugugauaaugagaaaaacaugaugaccagcgaccuaagaagugugcaucacccacccagagcaacuccaucagaaagucacaccagcgggcgugggggugcgggugugaaggugugcgcuucguuucaguggcuucgugcuugauguaccaaccgguaggugaugaaagugacaagaagguauaaguaccacagauccuucacuccaucaguacuucuagaaugcuuaccaugugccaggcacaguguggagcucugaagaccacaaugaugagcaaaagcaagucccucaaaucgugcagugcacccauuaggcaaggggacagagaugcuaauuaaacacucauaaucuggaauauguaguuacaaacugaagcacucugagggaaaaguucuguaagaguuuucuggcaaaagaacuagaucuaaaccugacggaggaggcuggagaugguaaagaugacuagaugcuaacuggauacaguggcaaucucaguguggcacagguuugcaggaaugagaggcagccagggaggcccagagagaguggggcaagggaacagaugacgggaaguggccagaccaugcagcaccuuguuggucuuauuaaagauuugggacuuuauccuaggaacaauggugaauuuuaaguauggggugacauuacauguguguuuugauaagaucauucuaguugaaggucacagcauggcuucaagaagacuagacuaugauacagggagaucaguggcaagcaacagagcauguuuuaaacagacaagacuugugaugaugauggauggaaagaggaucaugagugugugugugugggcaguggugggcaagggacagaggacauggguucccuuuggacuuaagaguagggcacuuuuggagcacccagguggagacaucaggugggucucaagcuuacucaagcaguaaacuucaaaccucagagagcagcacgcaguaccugcagcugucagugaggaaggacaaauuuccaacuggagagaauacaggauaagaaugcccagcgcccaaguuugacuaagucaauacuucauggcuaaacaggagagcaacaggacaccagaaacugagcagugacuagagccguagaagauauaccagagaaagggagagcaucuaucauaaagucaagaaugcugaaucccagccgggcgcaguggcucacgccuguaaucccagcacuuugggaggccgaggcaggcagaucacuugaggucaggaguucgagaucagccuagccaacauggugaaaccccuucucuacuaaaaauaaaaaaguuauccgggcguggugguggacaccuguaaucccagcuacucgggaggcugaggcacgagaaucgcuugaacccaggaggucgagguugcagugagcugagaucaagccacugcgcacuccaacaugggccacagagugagacucugucugggaaaaaaaaaaaaaaaaaagaaugcugaaucccgccacugagacaucaugcaagauaagaaaugaaggcuguugggauucuuggcacuauuuaggaagcaaaccagacuucacgugguggaguaagagaggugacaggauggagaagauagacaauucagaaaguuuagggaguagggagaagagugggaugggcaguaacuacagcgcaacacgggaucaauuagagucuuugcuuuaagaugggagaagcauccccagcuggagaagaauccaaaggacaggaguggcuaggugcccaggaggaacaagggaacugagggagggauggacaagacaagaagaccacugaacugggagggauuaaggcagguucagccucacaacuacuuaagaaaccaggagguuuccauuuucugugaagaggacguccuggccgggagggaagggguggaggccugaaauagcugcugagggcaguaagaaaaagaguugcccagaagagggacgagucacuuacccucaguagaaacuaccuagaguccaaugucaggacuguagugaauuccuagugggaaaaaguaacuccugguaacuuugaaucucuagcuucuaaaccuccuuucccauugaaagaaaaugguuacuuuuguauguaaugugucugcggauaauguaaguuggguuuuuuugagaccgaguuucgcucguugcccaggcuggaaugcaguggcacgauaucggcucacacugcaaccuccgucucccagguucaagcgauucuccugccucagccuccagaguagcuggaauuacaggcaccugccacgacacccggcugauuuuuuuuuuuguauuuuuaguagagacaaggccagccuguucuugaacuccuggccucaggugcucugccugucuuggccucccaaagugcuggaaguacaggcgugagccacugcgccuggcccuaaguuguuuuuuuuuuuuuuaagugaaugccagguaugguauucuagcuaugguguucuaacggcaacaacagcuaacauuucuugagagcuuacugugugccagacagugcggcaggcacuauuacaaccucauuuugcggagacaaaaagggaaggugcccugagaggggcgugcccaagugccacaguuggaaguggcggaagcaggacauacccccacgcagucuaugugggggaaaccaggugcacuguccucucuccacaaucuucccugacccagcaugcaaagugugcaaugcacugaaggauggggcccugggugacaagaguguggagaaggggcugggggaacauggcugauggggggccacuggcaccaggaacguuggaaggcacccgucugggguaggagccuaggauugaguccuuaugcugagaagguuggaggggagagaagcaagacauaaggagagcagcuggagaagaugggaugggcugguuuaaaacagaagucaugauugacccucaguggagaggccucacaaagguaccaagggcauccucucauucccccaaacaaaacuacaaguauugaguauaaagaaaccuuaauauucaucuuuuaauggcuuucaaacauuaacaaauaaugaaacuaauuuguagguccaagccagucaguuuucuuuuuaaugaauaaaaguguuuuacauguagugagggaggagcauggugucgguuuuucacaaaacacaggaaugcguguacauaccagggaguggaguaaaauguauuucucacuacuaggagcagaaaguucgaaagccacugaucuaauucaacacucccauuuuagaauuucagaauggagaaaacagaggcucaaagaagccaaacaacuuguccaacuuacuuaauagcaaagccgagaagagcauccaagucuuuaauaguucucugguaauuuccucaccaaaccagaaucuccaaauguaaauaccucugggaaaaacagugcugacuuuaauccacauuagaguaaauaacaguggaguaguaaguaagcugaucuuuuagaucugcugccuggagcaaguuuugguaaaggaaacaguagcugaaugaauucagggggcagcuguggagcuaaaacaaaauaaaucugagggaaagcacuggguugcaggguguggcccagcaggcccaggacagggcuuggugugguagaauaaagggacuuuuaucuuccuuagagucuguauaucaucaggacaacuaguucuagacaaggaggcugcuuccaugucugagaagguggcucagggccauggugcuuugcucaucuaguuucaacaaauuuuauuaaaugagaaguucugaauaacagaugccuucacaaaucucugucccugccagacuccaucucuuuaaugaaaacaucauuguuggguauuuaucauuuguuguauaauucuauuucaaagcuauagaagauucagagucagguccauguuucucuacuugaaggcaguggugcugggggacugggagaggguaguuccuaggagaccagagaacuagcuagaguaagggauggacugccaaaacaaagaggagggaugcugguggcaaacauuucuaaaggaaugccucucuagacaccagagcuaugagccuccucuuaaacuaaguuagaauucaggccagacaauugggccacguucauugggccagggcccaaucaccaacaagcucccggcuccuuuccuaagugacugcaccaaaauagcaaaggcaugagaugucuaaagaguauccuacacaauuuccaggaaguuuuuuuuuuuuuuuuuuugagacggagucucgcuuugucccccaggccggagugcaguggcacgaucucugcucacugcaaguucugccucccggguucacggcauucuccugccucagccucccgaauagcugggaccacaggcacccgccaccaugcccggcuaauuuuuuguauuuuuacuagagacgggguuucaccguguuagccaggauggucuugaucuccugaccucgugauccacccgccucggccucccaaagugcugggauuacaggcgugagccacugcacccagccuccaggaaguuuuuuauuucaaugugauguaauuaauuuggacccaagcucugggauggacagcucugaaagcucaagcagaugucuuuccaaugguauugaagaagggggccaggcacgcuggcucacaccuguaaucccagcgcuuugggaugccaaggugggcagaucacuugaguccaggaguuugagaccagccugggcaacacggcaaaaccccgucucuacaaaaauuauaaaauaaauaaauaaaaaaggaaacaagucucauacugcuauggggaaagaaaaaaaaaaagaaagauggccaacuguguaagucuagaguaagccaccuugagaggcugguggugcagcagcagcaggaaagagggaauuggggcuguggugugcugucauaacacaggcugcuguuauggggacuaggauuuguccccuugaauuuaucuccuccuccccuugaccuggccaauuuuauaaccauuccuuccguucauuagcucaggcacaagacgcuagagggaaaaacuucugaaacucaaagccacuaugcugcugguucauuccccaggaaacacgcaugguagaaaagcagcaggccaaaaacuagagauuccaggauuaucugucauuuucaaagaucugggcucugaaaggcugaugugagccacugggugcacagcugccccgccuuugguucaagccucaaagcucuaaccguugcaacccaaagcucuuucuaucucugagaugacaucuagaaccuaagagugaccauucaacuacaagauacacagaaggcuuugacauguucugaguacacaacgaagaauuucagcuggcuauacagaacucuagacgagaagugcuucauacuaaaccaguaacaaggauaauuucucuuccuauggagguuccuggguugaggcugauuuccacuaggcaccaauuacuuacagggcacagaacacauaaaaggacuuaaaaagacccugagaguaccacccaaauauauggcuugccauuugcuuaaacaaagcaaaacacuagaucccuggggcccacccuccaaucuacugaaccaccuuuucagcaaaccucuucugcaaagggggcagauaguaaacuuuaucaagagccaaaauuaagaacacuacauagggacuuuuauaacaagagaaaaaucuaacacauuuccacaauucuuuuauugauaaaguucagaauauauugaguacaauuuuuuuuuuguaacgagaucuguuaacgagacaaguggauuucuuauuuuuugggagaauaacauuucaagucauugggauucaaagaguguuccauaccaucaaauugacugcaacguuuauauguacaaauaauucuuagcucaugacuguacaaaaauugggagcucaguuauaguuuggugauugcugugguacuccugugauugggguggagcccaggaaucugcauuuuacaugccucucacgugauucugguaaugggccauggacccaauggacuauccaauccucggaaucucuguccaccaaaggggccugugguuuugcagugcgagaacccggcugugccaccuaccaguugcucaaccucuccaaaaaucagaugauucauccucacaacagggguggcauugcacugcuuggccuacccuuaaagaguugcugggaugauuaagugagaugauccaugaggugcuaugagcauacuaugucccagauacuaaagacaugccaguuauguugaguuuuuuuggcugcagaugcagacugccugagcagcuccugcuugucuucuccuuacucaaaaugugucccccagcaccuugaaggccagauccacuucaaccuaacccacugugaugugcuaaagcaaacucagugcaaggcuucauaaaaugauaauccacagccccugguccugaaccuccuggcccucuaauaucuccaaccaggaugcuauccacucuucauuucagcgucuucaauaauagaaaacucauucucuuucuacgguggcaccacuccaaagcuggagaagaaaaagcucuuccuuacaguaucuuaagaaaaaaaggguguuucaaaggaggcaguagaguguagagguugaguaugcagacuggcugaguuugaauccugguucugccacucacuggucacaugauaaccccuguaugccucaauuuccauaugcacaaugacgaugauaauaauaauaccuaccucauagugcuguuguggggacuaaauuaguugauacauguaauccacuuaagaaaugugccagacacagcgugguugcuauguaagcacuagcuaauauuguuauuauccuaaaccauggaggagcucaaaguaaugccuggaagcacccugauaugucuccgagacuaaaacugucauauagacagcauauacugagggccauaucaaaccaauuuugucaucauuuacugauuaaauaggauuauuccguuuuacaggugaagaaacaaagcuucaaaaagguagguuaagcucaccagcccaaggucacaagggcagguaaacguauccuaccuccuuguggcaggaggaauucaaacccaggucuguguaauuccuaagcccaucuucaucauggagccccucagacucgaaacuacuaucagcagcagaacucaacugacuaugaccacaggggaacucaggcucaauuuucugccugcgaguuccugguuggcuugcauaaacuguaguuaauaucaugcuacuugaacccaauuaggcaguaagucagccuggaaaacaucaugcgauguauuccaaaggucaaaguaaaagcuggcuuccaaggcagccucugcuggacacugccaugaaaguuaguuucugcacagauaccagaguucagcucgugaggugcuuaaccagcaccuauaucggcuuuuuaaaauucucagagaugccagcaucggaggacccgacgcgacgaauugccuggcuccuaagucaacauccggagaaaggcgguuuacuuuuuucaaaagcaaaccuucaucccucucuuucgcuuuaggaucucauuacuauuguagcugccuucucccaggcaaaaauaaaagggggaaggagcagguuuagaccgaggaggaggguuccccuagccugcagggcgcugcaacauccaccugaaacacggagcucgaccuaccuucccggagagcccagcccgggagggcguuuccccaacggaucgacaacucuucccucccggggaacaggcugcuguccuuggcuucagucagggccacuagagucgcgugcgcgacaccccucacccccgccaaaagaaccucauguuuaauguuccccuuacucuaucacuuccgccgaaagagcaaacaccagagcgaucgguuaguccuuaaggccacauuuaacuacgucugagcgccugcaggaggaacggcgaaaccccggagaggaggcgggggaggcagggagcgcgugggggggggcauuugcacagaggaucgucguccucccggcgccgcggccgccgugacucuccagcacagccucaggccguuggcgcggggcggaaacccccaucggggcucauagcacaacuggggguccccaaagccggcucccccugccuccuccgcgcgggaggccgucggggugauggcgcaagacuccgcuccccccgccccccacagcgacaacagccacggugacaaaauggcagcccggcgcccggcagucgugccacaggcgcgcagggcccuggaggcggcuccugccccccaguaacgccucggcgcccuucgggcucagccccgagugggccuagccguuaaaaaaaauaaauaaauaaaaauaaauaaauaaaacaccuggaacucaaaaccagccuagaaagccacaaggccggccccgcgcguacugcacccccgccgcccgccugccagcgccccgcgccacauggagcccggagcccgcauuccgagcccugcgccccgcgccggggaggaggggcggggcgugcggcgcgagccccgggaaacauggcugcucguccuauuucggcgucgcggcauggccaccagcucccggagcccaguugggagaggugccgaagguggguguguggggggcccaggggcagcgcggcggggaggggcgcagggggcgcgcuccgggagccauuugucuuaagaacguuuaaaaaaauacaguuccuccucccccaacccuuuugucccucuuucgcuagcuuucucccccucccccgcaaaugugcagaaagugcccccuccuccgccacccgcgccccaccccgccuccaggcagggggcaggcgugugggccgcgaggcugggaggcgagggggcgaagcgugagaaaucgcucccaguacggcgcggugcgcuccccuccccaacacacacacacacucguggaaguuuaaagagccgguucgacccgcuuuccugcuugcucccggggggccggcagcgucggucggguucgccaggccagccgcgcccccgcacccacccgcggcgaccccggccccgcgcuuggcgcccuucccccuccgcgcagggggcuuccggaaaguacgcgggaagaccgcggccccggcccccucccccaucaccacacccagcccccaaacgcuaggcgccgggucccggccgggacgaaagcggccggagagaggcaaaccgcccgcaaauagugcgcggaaacuccggccuccaccggcggcgcccccuccucucccgcggccgcccccuccccgcccugcgcgccauaaggcacucgcacgucuccaguccacagcugcguuaaggcggggaggggguagacaaaaaggaucuuguuuucaaaagucucacucagguuugggggaggaacuagggaaaagaggaagcgaggccugccuucgccgggauucggguuuaacgggcuagaggggcgacaggccagcgcacggugcugcccaaacucccaacuccauggagcucgggccaccgagacugggggcguccucccgccagcgcguccccgguccccccaaggggccaagaggggagcuggccagggucuccgccccagagccgccaacucgccgaaaacacucagguuugaaagcgagagggaggcagaaauaaaaaccagcguucgagucacccacccucaccuucccccuccucagggguaagcuuucgcucgagccucgcgauucccacccguguaaguuuccuccggccgugcucccgccgcugcccaaucaauaacggcggcuagcgggcaaacucccauccuagagcugcguguuugccaugcccgcauaaacguggacccagccaguacccaccacgggcgccagcuccgggcagcucgcguccugacaaaguuucccgugcccauuuauuaagcaggcgccgaauggcugccgacaagcccagcacugagaaagacgggccggggguucgagcuggggggcaccagggcccaaaggcuggcaucuuggggaagccggaaggagcuggggcgagggggcaccgggacguagccuuugggcaacuugcaccagcgaucgcuggaggcagggagacgcggggauuaucugugccuuagcacguucgaaaaucccucccccuccuucuaauuuauccucccuucggaaggaaaggaagaaacaucagcaucuggcccgaaggugggguggaaagagugagggagaaagaggaggagaggaagggaggcagagaaagggagggagggagagaaagggcgcguucacgaacacuacaaaguuacaaauauggcucccccgucucucgccucaucacugcaaagaaaugaagacgcacuuuaaacuccagccauucccaacuccgcugcagcccccuccccacgcgcucuccccgggggccucggcccacauuuaucagaaacuaaaccggacucgcgaagccccaaacuuauugugugugcgagcgagcgagcgagagaaagggaggggggaggcgcgggaggggggcggaaggggggauacauuuauaaaauguaaaacccccuuuuuuuguuguuaaauccaggaggcagccccucuccuccuccucccucguuaaucuuccccccagacggagucacgggagcagcgaucuccgagggugauuucgccucauucucuccgacccaaacgcgugcgcccgccggcccccgaugggugcacacucgcacgcacacucucgcacccacacucgcacacgcgggagcacacgcacagguagucacacaccaagggcagcggcggcggcagccggaacaugcucggauggcauugcaaccccccagccuugccaauucgcuugcaguccgacccccaaacccgcaccucccgggcgcccccccccaaaaaaagugccuccccccagcgcgcacacacacacacacacacaaaguaggagaauggaccgacagagauauuuuuggcaaaugcucacaucagagggcguccuguuccgcagcucuaaaugaauccgucugcccaucuccaucucucgcgcucucucucugcagaggcucccgcgccggcggaauucaaucaauaaaccccgaacccacggccgcgcguuuuaggacuuugaaggcucaaccagcuccgcucgguucucgagcccccagcacccgcggcgcacacuaaccugaucgccg

SEQ ID NO: 21460 - RNA, 3212 nt, Homo sapiens
cccccacagucuggagacuccagcacaguagacaguuggggggacagaaaggacacacagcuguaccauucacagcuacagcucuagggccugccagggcccggaguggccugggaggcucagcagcuagacccuggggauuugugugcuaggagagcuucagccccucagggagcagccaggggucgggggugggggguccccaucuugcccagcugcccauuuuccugugcugauggcauuaacaagaaccauccccaacucugggcugcuucucccaucaaucuuuucagucauuuuuuacaaauuuuuuacuuuuuucucuccuaaaauuucugaacauacaguacaaguaugagcugccuugcaggagaggcagucuugcagccccagcuucauccagacacaugaugccuauguuccucugggaugacagagaaaggggaaggaaaugggaggcacuccagcaugaggagcaggaauucacacacgggccuccaaaugcccaacugucccagugccugagguguccccugacucagcugagagaguucaacaggucccuaggcccagcuccuacauggaggggcaaauccaggcuuccccuaggcugggaagagcucaugguuggauccucuugcgguauagguaggcauugcucaccugguucauaaugaccaagcuggugaggacagggcauaauacagccagguaccaggcugcaccagugacagaggcagugaaccagagugagcacaugcccagcaagaggcuggcacuacccagcagguagcccaccagcccagaaguagcaugguauagcuugagcuucgccaggggccaucggggcagcagcuugggguagagcagccccaccccaccugagcacugcagcccugcccacagcacagccagcagcccugccugcccaugccgcguaaccaggugggcuuugccaagcugcucuuuguggaggaugacaaggccgaggcccagcagugcacacagcagggccagcagcugcagcacccaguggcagcgugcucggccuuuccgugagagggagugcagcagcgaacucucaggagaaaacaccaguagugccucggucaucaggaaggagaacugaggaaacaggggaugggaagcucaagugagggugcugccccagaagaggagaagagggcuuuauguaacccuuagcugccagugagucugggcugauuccccuuuuucuuucucuccccacugacaagacuauccauuugguggggcaagaguggaaaaccccaucugggaugauauaugugcccugaauaaucuccacacuuccuccuaggugccagucugaaaugucaucugucguauguuaccaagcaaacacaggguuugagauguggcaguuauaaaugauucacaagcuuuguuucccuaacguggggcuggauacaauuucuuggcaagagcuggccacaugggugcacuguuucagggaaaguuaggugcaucaccagaaauuaaaguaaaaagggacagagguacauccaaaugcaaugucucagcuuucugccuagaggugggugaagccucauugugcuuagacaaaucuuacccauuugaccuggguccugggucuucauuacucugauucaagucucuuuuuuuuuuuuuuuuuuuuuuuggagauagucucucucugucacccaggcuggagugcaguggccugaucucggcucacugcaaucuccgccuuccggguucaagcaauucuccugccucaggcuccugaguaacugggauuacaggcaccugccaccacacccagcuaauuuuugguuuuuugggggguuuuuuuguuuuuggguuuuuuuuuuuuuuugggacagagccucgcucugucgccuagguuagagguuagagugcaguggcgcaaucuuggcucacugcaaccuccgucuccuggguucaugcgauucuccugccucagccucccgaguagcugggacuacaggcgcgugccaccaugcccggcuaauuuuuuguauuuuuaguagagacgggguuucaccauguuggccaagauggucucgaucuccugaccucaggugaugugcccgccucggccucuaagugcugggauuacaggcaugagccaccgugcccagccucaagucugaaauauauaccaugggcaggaguaguuggagcaugcaacucuuccaaacagauauuaaauguggacaaagauucagaggcugccagggccaccaaccaugcccaugcucccaccccuaagaacugcccaggcccacuacuuacagccaaagacauaagcaccgggugccaggagaacaggccuggaaugagaagaggaggccucauggggcugaggcaagaagaaaccagccauaccaauccuuaaggguugaggaauaccagcagcccaucacccaaggaggugcugccaaacugugagccccuucuugcucugcaacaagcugaccccacaccuauccucucuuccuggccucuuccuggaucagaggccaugcuuugccacuccucuggcaguccucccuccuucccuuacaccuccugagaggcagccaaauggagcacccagagaaggaaagacaaaccaggaauucugugugcccuggccauaccuaccugcuccaccucacucaucgcuccagcacagaauucccucaaccagccaggccuguucccggaagucccacugcccuuccuccccaggaacaguggcccuucccuucccagaagucagcuaugaauucuacuuacuggagccaggccuggcaagcacagccacaaagaugguaaagcccagggccacaaggugggcggcagcgccagaagcaguacgcagagcucgguagaugugugacucggucuccgcagaaagggccaucgucagccgugcuagugguuguagccugaaagcauaguagcgugggccaggaucucaggugcccacuguucacuccucacuggagaaaaggcugcaaggcaggaaugccacccucuuccaauaaguuaugguaggaaagaacaguaccaagaccagcaccaggaauggucacaacaugccagucgacggccggcggccugucaacguguacccaugucugaacugguaccaaucgcuggcccgccuuccagguaggaggcgcaaagccauguaagacuac

SEQ ID NO: 21461 - RNA, 3318 nt, Homo sapiens
ggaucuacaaaucauuuuauugaaauugaacaaauaacacaacagucuuccuaagcuaggggccauccuccccaagccauuucccacauuauagaagcacagagcuugcacaguacuuaaaaaaaaagucaccucuauauagaaaucagacucugccacgacaucaucauggacuauuuacaaaccuucacauuauaaguauuccuuuuaugguuuuucccuccuuucuuucccuacccagggguucuagugcuuucccuugacugauccugaagggguggggguuacuguaagggagggggugguaggcuacucauaacuacuggcaccagccuuaggguguugucccuuaccacaagguggugaacaguccccucccaauuggagggguggaggauuuggugcaaagccauggagauuagacagaauagguggguuggaguaacuccccauaggcacaagcauccgcagccuguccugaccccagccugcacucucucaacuccucaacuggggguucgggguuggggggcaacaguuaguugcaguagggggaucagcccagcccuggguagagggagaagcccccacccaguccccacuccuaucaauagccagcaaacuguccauccaucugaaggcgggaacaaauggcagguaggucggaagaaucaggcuggcacugcccccagccucuguccaacacaggaggaaucgagguagcaaacggcugaaaugcucugacuagggguuaaaagggaagugaaggaaaggaaguuccuacuuguauacagugcccacagccuaggggcuggaagaaagcauaccuugcuuguaaagugcuguagccucuagcagggcuaggccccaggcaaacuuggaagaaagcagaccaggcaaggaaccagguaacgggcauuccugacugguauaugcccugcugugcugcuugcagggguggcuugggagaguggggugcuaacucugccauuagccuucaccacccaccaaccaccucuuguccacacacaaaccaacacccaaccaauacugugggaccgacccgcucacagcugaagguuaugggccaacagaguuuauucaggguuguggccccagccugggcuccucaauggaagccacaccuugauugagccugggaguuucuugccggggcagggggugcuucugucugccaccucccagggucacaccucauagaggaucacagggaaauccacguggaugcgggggugauccagcuucacgaugcccugccauggaaacagaggcuaguaagggucagcucagggccucuacuucaggaagcuuccuuguuccucccagauccccccgcaaaagcccccaccaugacaacagaucccaucuggguccaccuccacacgcuuaguguaggcucugugaccgcugcccagccccucaccugaggaaucagauucuuaugcacucgccucagcuuggcccgcuucugcccguucuuggugacgauugucuccucauagaacucgugagccagauccccauccucaucauagaacauagagcuguguagagggagaaggaaacaggcugggcuggagccccacaccugggcauggcaaaugucacaggucacggggaagucuguggucuucccaaccccaagugggaagaaaagaggauaauaugccuggagaauccuuuuuuuaaaaaaaauuuuucgagacagaaucucacucuguugcccaggcuggaggugcaguggcgcgaucucagcuugcugcaaccucugccuccuggguucaagcaauucuccugccucagccucccaaguagcugggacuacagacaugcaccaccacacccugcuaauuuuuuguauuuuaguagagacgggguuuugccauguugcucuggcuggucucgaacuccugaacucaggcaauccacucgucuucaucucccaaaguguuaggauuacaggcgugagccacggugccuggccugccuggagaauccuuugccugggguuuggggucuacuagaagaaagugggaagugaggugaugggugggcagugcuacuaugucagacccccaagaagagagcccacaccagagcacaccauccaggcagccaccaaggccaguucucauccuugauuuguucagcaagggcagccauucuaauaucaggacuuugccuucacccaggacuucuagagugggcagggugguggccugggcauguuggucucacuccagaagaugcugcuggcccagugucaaagacugaaauagcagaagccuaagcuaggaagaagcacaaaggaaugaaggcugcgucuccccugaccccacaccccagguggcuggugaauugccacuguugggucuuccuggugucuacagccaaaucucuagcacagggagcgcccaucuccaggagcccacuagagccaagccaaucugguacucuugugcgggccucugggagacugggcuggggguuggguggguaggucagcgcucuggaucuggagaacauaacugggugagggucuuuuuuccucagccucacccccaauacugaggccuaucccugcuuucccagccacuacgcucaaagguucagccccacuacugucaggaaaagcagccuaaacagaggguuauuauccccuuggaauaacugggggggaaagggaggcuaggacccuucaguaugcaggcugagccggaagggaugaaaggaagagaucuuauggaggucuuauggaggcccuagcuuagcuuuaccgugcggaagguccgaccagugacaagccucaggcccacucuucccuagggagacuuucagaguggccaggccgccaggagaccacugcccggcuuucuccacccccagcuccaaugaggcucaaaauaugggggucguccuggcuuggcuguagugggguacagcgguggaaguucccccguggcgcgggacgccuggccgcccgccuguuccccccgccaggguggaacccaugcccuuacccgcggcgcgugaauacgaaggggggcacagcucggccccgaggccgcaccaaagcuugcucagcuccugcugccucugagccgccgccuccggccgccgaggcgaagggccacaggccccgagcuuuggacccgcuggcgcccaugucagggccgccggcgcauggcgggccccguggccgcucugcucacaccgcaguccgcacuaccauaaccugccccagccgcugaucgcaggugccgccgccgccgccuuccgcaggcucggcugucucca

SEQ ID NO: 21462 - RNA, 22151 nt, Homo sapiens
guccauucaggucccugcaccgcacuccgcucggaccccaggccgccggugcugucgcuacucaagugagucccgcggugccccucccgccgcgccgcccgucgggcauggacucgggccgggacuuccugacccugcacggugagugccuggcccgcgcgagcgggagacccugcagggguggaccccuggaaagcuguuccgggcccuggacagggagcccccagcuccuucggccgccuccacaccaccccgggcccgccucucugccccuucuccggacugggaaaaucucagcccgcggcucccugggugggacugccgggcacgacccugggcguuuccaggcuuguccgagaucuagcccggggggugggugggcgggcgguacgggucuaaagacuucccuccgccucgcggacccccuuguccuggucaugaaagucugggcuccacgaucccgcucgcacggaggggcggcgaaggaaggaaacagcauccaagaacgaccaaaauucuccuugccccauccgggccgccccagaggcuccccaaagccugggcgugccuggaccgcgucaggccgcgcggguguggcggagcaggggcuaagcggguggggagaggaggugugcaagguuaaccguggucgggccgugcagccuuaacugcccagcgcagaauagucagcgaugcucaggcugaaagaagcagcacgauccccucaucugcgacccuccucgggggacagggccaggucucagccggagcugccugcuccauccuuuguccagcggagcuuuguuuccuccaauaugagccagcucuuugcccuuucgcugucccuccagcagcgaggggagccugggcucccgaaggcagaucuggaggccuucugggaggcgggagguuggggaggguaacuuugggcgccucuuugcuccaggacaggcacucacucacucuuggugggggcuugcccuccugcccucccaggucacuugccaucucagcaaacccugcuccuuucauaccaaucacugcuuuacuguauaucccucucuuuuuuaguacccuugggguuggaggcuuuaguggccaccacccauccaucuaaacuguucauggacauaauagaugggaaagagaagggcagaguccucuagccuuccacuagagucccccuggaauuuagagggacuuagagauguucccaucagccagccuccagucuaucucguguucugcaguuggcacagaccugguccuccuggcccagagagaccuugcucugugcccagagcuguugcuuuuacaccaauagccuaggcuccuuaaagccaccuugucuagaugagucauggagucccugccccuuccagugcucccucuucuuucuucaggccagaggugucuuucgugcgccugccagacuagcaagaagggaggcugggcagcugagaggacacaguggacaucucugcuuucucucugacacagcgucauuccuuggcuccuguuggaacaggcuucauccucagugucugugccuuuguccaguuucucuccugaggcagccuugauaucuuuuccauggaggaagacacauggaggcucagucaggaccucccaguccuguggcauaggcuuggcugcccuggcccaccccauuugagaccagccucccaaaugccuaacucaguccagccuuuccugaaggguugacaugaacacugugaccccaagcuguuuucccugaaggcccugccacuucuagcucaucacccaaaauuaccucaacugccuucuguccacacugcaaaccagauggggaaauaagaaccugucaaggagaauuguuggugggagggggugaucacugugcccugugcuguuccagguugucuacacuugcauuggagagucugcauccguuucacagugugggugccccagcacuggaugugcugcaggaccacacucucuggccuagggcuccacacucucuggaaggagcccagagggacuccuucuguuggccuggggagcuaugcggcucaccuagaugugacaugucccuucuguccucaccccagaugcaugcagaaguaauguaguuuacuggcauagauucugaaagcaaaguaccugaguucaagucuuggcuuucucaucucagaugaaucccuugacuucccugugugucaguuuccucaucuguaaaaugggggauaauaccaucuaccucauaggguugcuacgaagauugaaugagauaauaucuacacagcaguuagaacagugccugguacccagugaguacuauguuccugcaggaggcccccuccccaaauuucuaugcccuaugaguugccaucuguaguucuuugggagaugaugggggcaucauaagguaguuccuagucauggaaaauagggccagaacuagauucaagagcgagccagccagcucuuucuagugccucugaagcccucagacugaugcgacagcauccauccuccuuccuucaccuuacuucuuccacucuuuauucuggcuaugccuggacuggcuucucuagcaggucccccgaugugccccaaaggacauuaccucccagggcccuccccucacugaacaccccccacauacacacuaacuuuuccuacacccaaucccuuuugcccccaccccugcaagaggugccguuuguaaaaacagaaaauagaggggccucaucuuggccccaguagaccugggcuccaguccuagcuuugguucuacuuacugugggucugagaaucauccaugggauagcaguacauauuucacaguggguguugugaacauaaacgccaaugggcauagaaauucuagguugccccaaaaaccaguccuccaagagaugaugauuccagagcucuuagcaaguugggguggccagcuccucacucaccuguguuccaaagcagucugccccugggcuuccaggcccaugcuacacaggcacacacugauccacaccaaucuuaacuuuuugugccacagaccacuuuggcagucaggugaagccuguagaccccuucucaggauuauguuuuuauuuauuuauuuguuuauuuauuuaugagacagaaucucacugucacccaggcuggagugcaguuugcgccaucucggcuuaccgaaaccuccaccucccggguucaagggauugucuugccucagccucccaaguagcugggauuacaggugccggccgccacgcccggcuaauuuuuguauuuuuagcagagacggggugucuccauguuggccaggcuggucucgaacuccugaccuuaagugauccuccuaccuuggccucccaaagugcugggauuacaggugugagccacugcgcccggccaggaucauguuuuuaaauacagaaaauaaaauacauaagaauucaaaggaagccaauuauuuugagauguuauucuaucuacagguucuugaggggucuuuggucugguuaagaaccccugcgcaguuucuccauaacacaggcucccuuugcacucugcuuccccucuccaaagaauagcuuuuccguguucauauuucagcucaucuaccuuguccaucuacucaccuugcucaugauuuauucucucugauaugaccuuaggcaaguuacucugcgcuucaguuucuuguuauuacugcugugcuugucugugccaauaacuggcuuugccagugacucacugucaaugcuggugacuggagcugcagugaagcgaacugggggaacuauucagaggcugagaguaagagucaggccucugggugguguccugacauuggcacacaguaggggcucaauaaauaauuacugggugaaugaaagggaaguugugauguacaugaaaggacccacuguucccgagcauauuggcagcaaaguuuugugcaaaguuacagucguucucauguauuuaugaaagccacccuggguuaaugggcuuauuuuaagaucagaauuuuuucaagaauuucguuugcauccgucaccuuggggauuaucacuuugguggucaaaccgagagaagcaaacaggcccaccugagguucacaaaugaggcaacagcaagcugagucgcaaugaauuaguugagcaauugaaguaaaauacuuggggggggcucggugucuggcccaggcuccauccccggucccgccugaucucgccccacucagguccccgcuagacugccauccaccucccacugggacuccccucagcuuuucuccccagacucagcccuucgguucugcgccagccucaaagguggcguuagaauucgccgcuccggcuccuuggucagaccccgcccacacugccucccggacccuggcuccgcccccgcaccgccuccaaagccgagggaccgccccucccugccuggacaccgcccuuccagugcgggauccucccaggcucgccuccugggcccuggccccgcccccgggcugcuuccuggguauggcucugccuccacgucgccucuggagcagaggcucccggccugagcuccgccucugagccuggccccuccuucgccccgcugccuuggcucuggccccgcccccaggcuucgacacagauuugcuuccuggguuauggauuugucccacuccgccuccgcggggcccggcaccuccucggccccgccuccuggguucuggauccacccccauccccacccacgccucgacaccacucucgccccaucuccaggggucguuagucccaccccucuuggauggcccagccuuuuggggucugacucugcccuccuuagcccagauuuucuucucgucccgccuccuguauucugacuccccccacucauuuacuuugccucgguuucgcucucgccucaccuucagggggcauaggucccgccgcucguggacuagcuccgccuccuagcgucugacuacccccucagcccagauuucccucucgucccgccccuccgaagugcgccccuccucucgaacucuagcuccucccucccauuccuggacuccgccccugcuccccuccaagggcgacaguuccgccccccggaccagagcagaggguguugugagcauaaaacacuggaggcggcacugccccggacccggcuccgcgcaggcaggggcacuguggagggccaugcagugccuggggauccggagccggagccgcuccagggagcucuaccugcaggagcggagccuuaagguggcggcgcucaauggacggaggcuggguaaggggcgcagagcacuccgagaucugcgggggaaugggaaggcagcuggagcaggacgccgaccacuugucccuuaacgcggggccauuugccuuggagccuuuaauuggacauguuuaguacuucugugaguguguggcccacuguggggcaguguuugcagugguagcacgucggggugaguacuagggugauuaguuaccccuucucauuauuuaacucagcccuuccaacgcuccccaucccuugucacccgacgccuuccuguuuacaaauuucugaggcaccguguauguggccuggucuguguaaccaaugaggugaucugcaagaguuugugcuucaauaugauccugugcaaaagugugccuguaugugaugggugugacaguggugaucuaguaugggacccagugccgacugaguaguucugucaugccuggggucugugguggggccacuguacaguguguaaugauggugaugguguguaauguugugaaacaaagugugugacauuguggcacugagguggcugcuuguaacccagugugacagcgugugaucuguugugauacuguucaacugagugugacuguauaaccaaugugacagugggugaccuagggugacugagugguucugucauuccauuaugguguguguguuauauggauuuucugauguucuuacucuguggcaguaugucccuucacaguggcugcguaaaguuucauaccgcugacccuguggguaagcuaccugcuucugaguccugacuccaccaugcaacuuccuugagccucaguuuccucuuguguaaaacaggaauaaugacagugccuuccucagaggguuauugagagaauuaagugcaugugcuaagaacaguaucuuauuuaaauauuaacuauuauuaugggagccucuaucaucaucaucaugaugcucuggcacuauauguuguguggcuaugcaugacuaagugugacacugugcaacucccugugacaguguguaauuuuggggggcagugugucauuguguguggcucauugucucuuugagguugugugagugguggucuagugugugacuguguauuuguguggccauaucuguguagcuguguaucgcugugggucccaggcccagugugucuuuauuaugcaucacccuugguauaggaacaggacuccuggcaccucccucagcuucccacuggcaccugcaacacccuguaugccccaccacauggccaccucacugugcacagcuagccugggcaggcugcaaggucaacccagggucagcucaaagucuccucgccacgacccucccacaggaggagaagcucuuagauugaugcaaaaguaaucacaguuuuugcuauugaaaguuuuugcuauuacuuucaauagcaaaaaccgugauuacuuuugcaccaaacuaauauuaugacuggguugaguagggcugggugaggggugccacagacuuucugggugcuaagggagcaagggugguggggcaggaaguccagaagcuuugggaacagaagggccccaaaugaggcuaagagaugagggcaccugcccagguuuccuaaugguccagagggcuguggcuaucaccuuucuggaauuaucacccuggaacugauguccaccuuuuagaaaccauuguuggcagcuggggguuuaucucugccugacuguagauagggccacagccuggcuccaggacaggaugagcaugucaucucuucaugguguuuuccagaacaggaggguggugcucaacuucuacuuccuggcucccagcuccauucccauacaugcuguuggcaguggcuugcccugauguaugcccagcuugugggguggggugcuggcagaggguaaggagaugucccucucagcuuuagagggacaucagccuuagaagggauaguggaauuccccgccggaggccggagguggcccuguccucuggcagccugggaacucccuucugccuccucuugucucaggcuccucagacacagccaguaguugggaauauucuaucagagcccccuucuuuuccacugggacuccccuugggcuaagagggagcugcucacgcuaaggcacaacagcucaucaaguggguggacagaccugggagaaagguggaggaaggucacaucagacugucaccccugaggaggcccagggaugccuccccuacacuguucuuagcccagugcugaugggggaacaaaagcagagagagggaagggaguugccuaaagcuauaggggguggauguuagcacugaccucuauccugauuggaagcaggagacuggggaaggauaaagagugugugagcaacugaagccuggggaagugguccagaggguucugugagcccugaagauaugugggacaggcuggcugggggaggggguauggauaaaaugggagaggccaucuguuguuggggaucugggcucagaaaagaaaaggccuguggcuucaugagggcuuccccacauaggcuuaggcucaagacccucagacuagacccuugaagucccugaggcugccacugugcuggagcagcaggacagagauugcugaugggccacauaguucuagggagagaagugaaguggccgauuggcucucaauagagcuggcugcuggacuauguacguggcuagggugauacacgcacacauacgcccuuauagauguuucuguauuacaccaguggguuacuaaggguuggggucacuuuuaucaacuuuaucaguugguacagaaccugcuggguggugaaggcucuggcguccuuuuggugccuccugucugggccugguaggacugagggcaucgcaucuuugggagcccacaccucugagagcagcaaaagaguggggcaggacuggggcaagcagccagguuccucucucugggcucugggacaggaccugcucagcuucggaaagggaugcacugugccuuaaagcugcuguauccugaggggucccagacccugggcacucugagauggggcuggggcagcgaaggacagggccaucccagcagaccaaacacaggcuacagugcacucaucugucucuucuuggggcaaagaucagagaucacucaugugggcucaagucagaggugggggggacagcaaggguaaggguggcagagaugggcauaggggucccacagcaaccacaauguugacaccaagaaccccaacugccauuaucuuggggccugcacagauucaggcaucaucucauugaaccuagaacuucccuuugaggugguugcuguuauuaucuccauuucauagacaggaaagcagaggcccagcagcaugaagucccuugcccaggucacacagcuuguugggaagggcaccugaaccuaggcacaaaugauucuggagcuauuggaguugggacguuguuuggcuccaugacgcucugggguccaucugugucugucccccuuuuaucucccugcuuugccuaaccuuuugaucccagcuuccuucaguucacucugacuccuaagugugaccaggaggggcucaccuaaucuuucaaaaccaucuuucagaacauuucuuagggggcugguccucuaggaaccagggguucuugaauuagcugccuuucuuuuguucauucagcuguggguggcacgucacaguguguaaguauggucuugggugggcaggugucccguuugcauggucaccuuagcuggcaaucagggaugacuuccuggaggagggcaggcucugggagcagguuggagcauggguggaggagggaggaguaaacagagcugaggaugaggcuggugaaaagugggcucugagagggucgaggugggcauggccagugugaggccuagggcaucagggaaacuaguggagaagguggcaucuuacuggcuuugauccccaggccuacaggaugaugaggaucuacaggcgcugcugaagggcagccagcuccugaaggugaaguccagcucauggaggagagagcgcuucuacaaguugcaggaggacugcaagaccaucuggcaggagucccgcaaggucaugcggaccccggagucccagcugugugagugcccuggggucacaggggaggggauagaguguggaaucugcucagggcuggguaaauacaaaggucagucauggaucaaaaccacagauggggaaacugaggccuggccugguggggcauaggucauuuauauaaccugggcuggcaguggggaaacugaggcuggcugggguuggggagcagggccaguuaaauugccaucgggaaauugaagccuagucuggacuggagagggcagucauggaacgaggaccgcagauggagauggcaaagcuuuugagggauggggauacuuaaccaugaccacagauggggacagccaggcucagaagcagggagggaguuggacgguggcccaagguccaggcagauaagguacuuccgggguugaguggccaggugggagcuagggcugcaggaggcagcuccucccugggacuggagccacaggagggguguuagggcagagcaggacugggacacacagacagaggccacugcuggggagcccuugugggucugagggcauucuggaagcuucuaaaaagaccaaggaacccaagucucaggccacaaauggagagagccuccugcaaggccucagggagaagaaagcucugcucacuucacucaguucucucccuuuaagggagagaauucccuaaagauccuguaaagugagaugucucccucuaugccuuuacuugguggggaaauuuuagaccgaugcuguacaguugaacaaugauggaaauguucuauaucugcacuguccagcaugggagccacuagccacuuguggcuauugauugagaccuugaaauguggcuagugugacugccgaacugaauucucaaucuuauuuaauuuuaacuaauuuauauuuaaauagccccagguggcuaguggcugcugaauuggacagugcauauagaucauugcagccuggguuucacauagccaggccccuggagaucccucgcccauucuccugccauuggcugagguguggguggggagaugggggcaggucuauggggagugagacuggacaugggugauaagcgcagguaggaggagagcauaaggaaggggaggaucaccccaccgagggugccuuucacccaggaagggucugccuugccucaggacacuggacaggacccugagaagguauggccugccaaccuguggccaguggaggggcugaagguaaggcaggacaggagcagggccaguugcagagagccggcuggguccuuggggcugugagccauggaagauuucugggcagggcagggucugagggguaggggcuccagaacauucugaggaaaccacacggagccccagcucagccugcugccacacuguacaggagugaccgccugaccuuuucucuguggcgccagacaggcuccuucauggggcucuugcccugauaugggauuuccuguuagaugcuggugggugggagcacagugagaauggggaucuuauacucugagcccuggggauucccuggagcccaccuaccuaccgauacguauggaugacucccagugugugccuagcucuugggaagcaugagaggggagauagaggaguggaagacccaggccuuuccccgcaggaaccacauuugagcuggcgagaggaggaccuuguauugggacagcugugagcagaugggcaggaaggacauugcaggcaggaggcccagugugagccaaggugcagggugaggaggaggaacaggcaugagugggaggcugaggggcugcguccugccaggaggaggggcugcagggagccagguccagggucagggagccaggugugcgcagguauggagcaaggccugagggggcuuucugcuggucagacgccugagacgggucucgugcugagccugcuuuguuggcugccucccuucucugggugaguggugagacuguugucuucaauugcucuuuaaccuggaaaacagaggccaggugagggaggccuggaauagccuccccuucugcccaguuuucuuuagcucugcuuccugcuuuuuaagucuccccaauccugccacuacuacccacccccaugacucugguucccagaggccaaagguguuaucagcagugaaggcaucuggacuuucucucugugugggugagggcgcuggccuugggugggggucccauggcucaggcuuccuguuuucauuccugacccaggcagcugcagcugcacccugugugcggccgugugggucaccaggggcugcaggcagagggauuaagccgugcuauccucugucccccacauggcccugggcucaugugucccacuccucaaagccugcagcccaggcuggcacauguuacaucugugggcccugcagguggcuaggaggccccugggcacucagagugggugggcacagggagggacagguggacuucagcuagaaccgucuaggagccaggacagauggaugaggauggcucaggauggagguauggcaggggcagagccuggauccugcugcugggaggcacagcaugagccugacuggaagaacuggcuccuggccaggccauggagggcacauuggaagcggggguagacagggccuggcaucucccugaagcuuggaaggcugggugugaggggagggcccuccccuuggcuccccuaagggcagaaugauguaaucucucagaacccugcaggagacccuccaguuugccucuugggacuggggaaggcagagucuuccuguacccccugccaaggggcucccugaagucaggacacacacagcugcacacagggcacgacccugucuccucucccaugcagggcuucucccucugucuucggcccucugcccauagaccccagggcuggggcuaacugagggugguuccagucucuugaauguucaggagaggggccugguggcucuuguggcuuuaucgggucaggacagacccaaaguccaauacagucagaagggugcauggcccuucucugucaugggccccacacuccagaguggucuguccgcaucucuaagagccuugcccugcuccaguccucucccuggggcccugcaccccccaucaccgagagagcaggccuggggucccaggugccuuuuccgcccuaaagucugucuuucucucacucucugucucucccugugugucuccacugugccugcaaugacugugucucaugcucugucucccccucaguuucugucuuccuuucuccuuuuugucccccacuuguccaaccuccugccccucuccuuuccuucuggacucaaggccugagcuccggcccuggcucugugucuccaagccaugccccucucuacuguggccuuggccaugucagggucagggacugaccucacagcauucucucccucucuccuccaccaucccccucucgcagucuccaucgaggacauucaggaggugcgaauggggcaccgcacggagggucuggagaaguucgcccgugaugugcccgaggaccgcugcuucuccauugucuucaaggaccagcgcaauacacuagaccucaucgccccaucgccagcugaugcccagcacugggugcuggggcugcacaagaucauccaccacucaggcuccauggaccagcgucagaagcuacagcaguauccuuuugguggcaguggguccaggccuggcuuguggacacuggcugugguuauccccagggcaacuuggguauggaagcugguuuagguacuuugggcugccauaacaaaauaucauagguggcuuaaacagcauaauuuauuuucucacaguguggaggcuggaaguccaaggucagggagccaguauggucagagccuggugagggcucucuccuuugcuggcagaugacugucuucuugcuguguccucacaugguggggagagagagacuagguucucugccaucucuucuuguaagggcacuaaucccagcgcgggugccccacccucaugaccucaucucaaccaaguuaucuuccaaaggccuuaucuccaaauaucaucacguugggcauuagggcuucaacauauaaauuuuggugaguuggggggugggguauacaauucagaagggaaggagggaagauacaugaagcccucuuuggucuagucugaccagagcccaaauagcucugcugcucccugauacucccuguguccccgucugucaccagcauggaguugggggucuggggagccugaggggagcagccugcugcaaugggagaccagucuuggauguuuuaaucauguuuucuagaguuaccacacgauuucccucugggaguugggaggccaugguacccuccugugccauucuuuggggagugaucaaguuccccugggccugguguguaggccagccugugagcucaaaacaaauuaacuucaacauuuaguuacacaaugacacacugguuuaugauucgaaguggucgggcuucuggcauguauggauuaggguggagccagcucucuccauuuuuuauggcagcuuuauugagguguaauucacauaccauauaauuaacccuuuuaaaguguugaaccugauucagugcuuuuuaguauauucacagaauugugcagccaucaucacaaucaauuuuagcacauuuccaucaccccagaaagaaacacuguaccccuuagcagucaguccccauuucaccucaacccccagcccuagacagccacuaaucuacuuucugccucuauacacuuuccuguucugggcauguuacagaaacggaaucauggagucuuuugugacuggcuucuuucauuuagcgugauguuugcaauauucauccauguuguagccugugucaguacuucauuccuuccaauugucuaguaauaugcuacuguauggauagaccacauguaucucuucaccagaugauggacauuuagauuguuuccacuuuggggcuuuuaugaagaaugcugauauuaacauucguguauaaguuuugguguguauauauguuuucauuucucuuggaguagaaucgcugggucauaugguaacuauguuuaaccuuuugagaaacugccaaacuguuuuccaaacaggcugcaucaauuuacauucccaccagcaguauacgaggguuucaguuuuccauguccuugacacuacauuugucuugauuauagacacccuguggguaugaagugguaucucauugugauuuugauuugcauuucccuaaugauuagugauauugagcauuuuuccauguacguuuauauaucuucuuuggagaaauaucuauucagguccuuugcccauuuuuuggaucauuugucuuuauuauugaguuguaagagcucuuuauauauuauagauacaagucuuuuaugagauuuaugcuugcaaauaauuucuccauucuguggguugucuuuucucuuucuugauggguuuuuuuaggcuagaaaagugaaacagugagaguggagaaggaacaaagaaaucuggaacugcuugugaucaauuaguuguaaacaccccugcacucagaucagccucuugauauucuuugaagcacaaaaguuuuugguuuugaugaaguguaauucauauacuuuauuucuuuuguuguuuauuuuuuuuggcaucauauucacgaaagcuuugccuaauccaaaauucugggauuacagcagugagccacugcgcugggccugaguucucaauuuuauucuguuugucuauaugucuguccuugcaccacuaccacaauauuuugcuuucuguaacuuuguaguaaguuuugaaauaaggaaaugugaguucucuaaauuuguuucuguuuuuuuuuucaauauugcuuuagcuauucugggucccuugaauuucuauacgaauuuuaggauuagccugucaauuucugcaaagaagccagcaagauuuugauagggauuauauugaauguauagaucaauuuggagcauauucccaguauaauaaugucaagucuucugauccaugaacauguaauucuuuccauuuauuuaugucuucuuucauuuuuuuucaacagugccuuaugguuuuccagguuuugcacuuaaacaauuucuuuaaaagcauuuuauucacuuugcugcuacuguaaauggaaauguuuucuuaauuucacuuucaaauuuuucauugcugguguauguccacuccuuaggggacacauuuugagcccuguuaauuuccuuuucugugugcuuuugagcauuugaaagacuuuuaaguguuauuucucaauggcacaucugccugauugugagcuuuuuaaaaagcccaauucuauggcauuuuugucauaaucccaccuuuggcagagccuugaccuuggacagucucaugcccucugcagaguccugcugccuagaccuuaagaucauaaagccauucuaauuuauagugcauacacucaguggaacauuauacagucauuaaagcuguuuauggagacuacacuaacacagggaaauaauuaugauauaauguuacacagaaaauggacuacaaauguaugauuuccauuauuuuuggcagaugcaucauuaggaaaauuaaaauccgggcggggcgcaguggcucacgccuguaaucccagcacuuugggaggccgaggcagguggaucaccaggucaggagaucgagaccauccuggcuaacacggugaaaccccgucucuacuaaaaaauacaaaaaauuagccgggcgugguggugggcgccuguagucccagcuacuugggagguugaggcaggagaauggcgugaucccgggaggcggagcuugcagugagccaagauugcgccacugcacuccagccugggugacagagcuagacuccgucucaggaaaaaaaaaaaaaaaaaaagaaaauuaaaauccagaaaggcugggcucggcggcucacaccucuaguccuagcacuuugggaggcugaggcagguggaucgcuugagcuuaggaguucgagacuagucugggcaacguggcaaaaccccaucucuccaaaaaauacaaaaauuagccaggcauagugacaugcaccuguaguuccagcuacuuagcagacugaggugggaagauuguuugaggcugcagugggccauaaucaugccacugcacucaagccugggcaacagagcgagacccugucucaaaaaaccaaauaaauaaauaaauugcagaaaaaaauauuaggaggaaaaugcaaauaucagaagcuucuggaggagguagguagaucuuuaaaacuucauuauaggccgggugccguggcucacacguguaauccccgcacuuugggaggccaaggcggguggaucacuugaggugaggaguucaagaccagcauagccaacaugcugaaaccccgucucaacuaaaaauacaaaaauuagcugggcaugguagcauacgccuguaaucccagcuccucaggaggcuagggcaggagaauugcuugaauccagagggcagagguugcagugagccgagaucgcgccaguguacucuagccugggcaacagagcaagacuccgucuccaaaaaaaaaaaaaaaaacuucauucuaacauauauauguuuuccaaauuguauauauauggguauagauguggaaaagaauaauuaugacagaaagccaggugaaaaaagucaaguuuagaaugguccagccaagcacgagauucgugugcugaaggcuauucagcagguggaauauccauuucuuuaguguuggauauuuauuauuauauauuauauguugaaaaccaguccagauggcucauaucuguaaucccagcacuuugggaggucaaagcaggaggauugcuugggccuaggaguuugagacuagccugggcaacauagggagacccugucucuacccaaaaaaaaaaaaaaaagccaggcgugguggugcggugcacaccuguagugggaggaucacuugagccugagaggucuaggcugcaaugagcugugauugugccacugcacucuaaucugggcgacagagugagaucuugucaaaaaaaaaaaaaaaagaaaaggaaaaccagaaggauauacuuuggaauguugauaguauuuaucccuaggugauagacuacgggagauuuguuugauuguuuacuuuucugcauuuucuaaauugucuacagugggcccuuuuguaguaagaaaagaaauguuuuaaaaauuuugaaagguuugaaaaccagcaaauagaaaaagaccccuuaacauuuuccucugaagaggccacugaaacauggauguguaguaagucaggccugcagggagcuguggcuauagguggcuucagcuggagccauccauggcucuggcugggaccuugguagguuccaggguuccuggguucuuuccuuacuucuugcccagcuggauucacuccugcuugcgaaaagcugacaaaaacaaggacaacaagaugagcuucaaggagcugcagaacuuccugaaggagcucaacauccagguggacgacagcuaugcccggaagaucuucagggugaggcaggaagugggggcuggggcugccuguccauggggcccuugaccccggcccaaggccugcucugagcccacucggcuguccuggcucugcaggagugugaccacucccagacagacucccuggaggacgaggagauugaggccuucuacaagaugcugacccagcggguggagaucgaccgcaccuucgccgaggccgcgggcucaggggagacucugucgguggaucaguuagugacguuccugcagcaccagcagcgggaggaggcggcagggccugcgcuggcccucucccucauugagcgcuacgagcccagcgagacuggugagagccugaccagggccugcuaccugcagucgcagggccgcacugggcugggagaccccuggggagacugcagccagaaagaagggaaccggagggaaggggcugccucagccagccccggggcccugcuccacacuuucugguccuaugaaagccggcagaugagagacagggcucuggcaucccuacccuucucugguccuguuucccucuuggcaccuccuucagggggcuuugaggaccccuucuucaagaaacaagagagauggcugaaaagcagaugcuacuccugcuucuuuuuuuuuuacucauucuuggcccagcuuugagaugugauagagcagagaagaugggucccugcccuggagggggcuccagucuggagguacagagaacggggagaugacacccuguccucaggggucuuagagugugcagacaggggaggaggaggagacagggccccacucuggaguagccacagucuggucgagagccucagacuuauccuaauuccaagagcucuggaagacuggcucaggacaggcaggcaagcggguucagagggcuccucuguccagaugggugggcagccaggagcgccugcuggaggcuggcucugacgggcaguggccuccucccucccagccaaggcgcagcggcagaugaccaaggacggcuuccucauguacuuacugucggcugacggcagcgccuucagccuggcacaccgccgugucuaccaggacaugggccagccacuuagccacuaccugguguccucuucacacaacaccuaccugcuggaggaccagcuagccgggcccagcagcacugaagccuacauccggugcugcucagggagccuugggucgggagucugggugggacccgggacaggaccuggaggguccuagccaccacccuccccgcagggcacugugcaaaggcugccgaugccuggagcuugacugcugggacgggcccaaccaggaaccaaucaucuaccacggcuauacuuucacuuccaagauccucuucugcgaugugcucagggccauccgggacuaugccuucaaggugggagugccccuggcaggugaggagugggaugcuagggguggcccaccacuccuaaugugcccuugggccuccaggcgucccccuacccugucauccuaucccuggagaaccacugcacacuggagcagcagcgcgugauggcgcggcaccugcaugccauccugggccccaugcuguugaaccgaccacuggauggggucaccaacagccugcccuccccugaggugugugguggggaugggggaucccugggggaggguggggagccuagccggggcgcuaggugugucuugaccaguugccccuccccaccuagcaacugaaggggaagauccugcugaaggggaagaagcucggggggcuccugcccccuggaggggaggguggcccugaggccacuguggugucagacgaagacgaggcugcugagauggaggaugaggcagugaggagccgugugcagcacaagcccaagguuugagggggagcugugggguggggcagcccgggccuuccccauccccucacccgugggaggucugccuugucucaguucucuguggcugccacucagacccucugccccgcucucucugucugucucccucugucucucugcgccuggguuucuggcuuucucagugccuacccuaccccaaccacugaaucuaacccgggccuccccguguuccccaggaggacaagcucaggcuagcacaggagcucucugacauggucauuuacugcaagaguguccacuuugggggcuucuccaguccuggcaccccuggacaggccuucuacgagauggcguccuucucugagaaccgugcccuucgacugcuccaagaaucaggugaggccuggcuccccaccacuccccugcucuguuacagagagaauuggcagggcagggcuugggccucaccaggaggccuccacugcugaccgaaccacaccuccccucaggaaacggcuuuguccgccacaacguggggcaccugagcagaaucuacccggcuggauggagaacagacuccuccaacuacagccccguggagauguggaaugggggcugccagaucgguaugggcuggcuggggcuggaggaggccuggaggaggguuucagucccaaggccgggggccuggagccucgaaggccaugcaguggagcucugaggacccaagcagggucaaaugcaggggcuuguggagcugguaauaucagucuggaaauaucugcccaccagcaugucacagugucugaaaccucauuagcacacuaguccuuugaauucucacaccaggaauggaaggugugguuagcauggugggucacugaggguggcaggagggcagcaggcauuggagugaugcugggcccugcuaacucaccaugugacccuaggccuuaguguacccugagcaggcugugcucuagggccccagggccagcccacagccugugacugcucuguccugccuguaguggcccugaauuuccagacaccugggccagagauggacguguaccagggccgcuuccaggacaacggggccuguggguacgugcugaagcccgccuuccugcgagaccccaacggcaccuuuaacccccgcgcccuggcucaggggcccuggugggcacggaagcggcucaacaucaggguacgcuggaccuaggagggacaggugcccacggaccucccuuccccgcuaccacuccugaacuguccauuguccucugccuuuccucaggucauuucggggcagcagcugccaaaagucaacaagaauaagaauucaauuguggaccccaaagugacaguggagauccauggcgugagccgggacguggccagccgccagacugcugucaucaccaacaaugguaggugcugggccugggcugggcuacuagggcugguguccaugcugcugauauggugccugucccccuagguuucaacccauggugggacacggaguuugcguuugagguaguugugccugaccuugcccucauccgcuucuugguggaagauuaugaugccuccuccaagaaugacuucauuggccagaguaccauccccuugaacagccucaagcaaggugagugucaagagaaggggauggccaagguggugggaagcagggccuggcgucucuugggcuggggcuggcugucccuugacgcauccacccccccuccgccgccgaaugaccagaacucucucuguguucccuccugccuguccacccaccaggauaccgccauguccaccucaugucuaagaacggggaccagcauccaucagccacccucuuugugaagaucucccuccaggacuaggcuggaggaagccagugggguccccccugagugggcugggcccucuguccacauguggggacagggcugguguggcugcucccagccucuugcucagagcuaggcccccaaauugccuucagcccuaacauagugucugcugcugccucccuggggaccaggagcuagcccagucccuggagcuguccuucauuccguuaggaauaacacugcagcccucuccacccuccggccagcgaguggucaaggauuuuuauaaaaaucacgauaagauuaa

SEQ ID NO: 21463 - RNA, 1850 nt, Homo sapiens
cugcucugggauagcacccggccccgcagagcagcgcggcagcccaagggccccggcgccgggggcggcggggaaccccaaacgcaaccgggucuggagggauccccgcgccgagccagccgccgucaccgccuccgcgccgccccugcgggcuuggcaggcgcccggcgcgcccgcacugcgcccggccgccggcucccgcggucccaccgugagcucgccggcccgucgcccgcucgccaugcaaccgccgccggccucgcgcgcguaggcgcccgccgcaggccaugcugccccugcucgccgcgcuccuggccgccgccugcccgcugccgcccguccgcggcggggccgcggacgcgcccggccuccucggggugcccuccaaugcuucagucaacgcguccuccgcggacgagcccaucgccccgcggcugcuggccucggcggcccccgggccccccgagcgcccgggcccggaggaggcggcggcggcggcggcgccgugcaacaucagcgugcagcggcagaugcugagcucgcugcucgugcgcuggggccgcccgcggggcuuccagugcgaccuacugcucuucuccaccaacgcgcacggccgcgcuuucuucgccgccgccuuccaccgcgucgggccgccgcugcucaucgagcaccuggggcuggcggcgggcggcgcgcagcaggaccugcgccucugcgugggcugcggcugggugcgcggucgccgcaccggccgccuccggcccgccgccgcccccagcgccgccgccgccaccgccggggcgcccaccgcgcugccagccuaccccgcggccgagccgcccgggccgcuguggcugcagggcgagccgcugcauuucugcugccuagacuucagccuggaggagcugcagggcgagccgggcuggcggcugaaccguaagcccauugaguccacgcugguggccugcuucaugacccuggucaucgugguguggagcguggccgcccucaucuggccggugcccaucaucgccggcuuccugcccaacggcauggaacagcgccggaccaccgccagcaccaccgcagccacccccgccgcagugcccgcagggaccaccgcagccgccgccgccgccgccgcugccgccgccgccgcggccgucacuucggggguggcgaccaagugacccgcuccgcuccucccuguguccguccuguguccgcgcgcgcgggugccuuucccgccggagacucggccggugugcuucgugcuguaguuaucguuaguuccucuucccgagauggggccgccgagagaccccagcgccuuugaaaagcaagguuugugcugcgcuuccaguuccgaaaagcagauguuuaagcccuuggacugagggugggaucgcagcuccgaagacggagaggagggaaauggggcccuuuccccucuauugcaucccccugcccgacuccuuccccgcacccacgugcccuagauucauggcagaaaaugaccaaauccuguguauuuguuuuauauauuuaauaacuguuuuaaaugaaaguuuuaguaaaaaaaauacaaaacaaaaagauuaaauugcuauugcuguaguaagagaagcucuuuguaucugaacauaguuguauuugaaauuugugguuuuuuaauuuauuuaaaauuggggggagggcaugggaaggauuuaacaccgauauauuguuaccgcugaaaaugaacuuuaugaaccuuuuccaaguugaucuauccagugacguggccuggugggcguuucuucuuguacuuaugugguuuuuuggcuuuuaauacagacauuuuccuccag

SEQ ID NO: 21464 - RNA, 209206 nt, Homo sapiens
ucaacugaagaaauuuauuuacuuuuuucuagguacauagaugacauaauuauagacaaguuuugauacauaggaaaacccuuccguccaccucucuuuaugcuaaaugaaucaucacaauaauuuuuacaauuuuuaaaacaauacacagcuuucuugggcugaagcaauugcaagaacauauugguacugguauauuacagcuacuuacaauguuuuuaagaacagcaauggagaaaaauaaguuauuuaaauauugauuucauauacagaaagugcaauguuguuaguuguuauauaacuugcucgacaguuucuuuucucuaucaauuuuaaaucaagauaacuuggacucagacuauuauauuuuuuucugaaaauaauacaguacacacauggcagcagugacuuggcaaguugaccuuuuuugcugcaguuaugaaagcaaacuuuacuaugucaggaacugauuuccaauagauuaguaauuuccaauuucacccauaccuggggguucaggacagagaaaagggccucugacuaaggcaaggccaugaaacaauaucuuaguuaucuggguacauaaauaguacuagcuggagcugacugcauuuccuuccagacagcuuugaagugaaaaucauacacaauguuauguguagcuaccugagccgaacugccuuuccagguuucuuuugugcuuuccaaagacaacaauuuucaccauuacucaaaauucuguaccaaaugcaacugauuaaaacuggauauuccugaagccuaccaccuguucacuaauguccacaggcagccccaauccaccucagucaaacgucacacccaaacauucagcuuuucucagaccaaauuaaauguuuacagaaaaaaaaaagaccaaacgcuaaagauauuuuuaaaauauuuaaacaacacaauaaaguaaaaacaaccucagaccccucagacuagacauucccacugaaaauucuuuguggucccugaauuugauuuucuaugcaaaggcauugauuuccaaagaagugugauaaaaaugugguuuggcauucucaaaaacuccagaaaguucccucuucugcugcgacuuucacugaaaugaaaauccuucauggagaacgaauuaaaacuuggaaauucacaugagauuucucucgcuccuuuguuaucucaucucuuacacaacuuuugugugguuuuuugcucagcuuaaacaaugacaggaucuguccaaaugucaagccgagguauuuugagagcaggaagagaagaagccugucuacagcacccacauccaccacagcacgugaaaugcauugaacgcuuuagcuauacaagaacccugcagcuucauuacauugcaaauaggcuaggccacaacccgagaggacaaacaaacaugagcuguuuuuaagaguucaacagaaauuuggcagcuuuagcuuuuuauucuacauuuccacaacuucuucacauggcaucuuauagaagaugaaaauuaauuauuaaagaaacaugcauuauuuuuuaaaaaugcauacuaaugcaugaaaaaaauacaucaccugagaaugucuuuuuccucagaaacauggauccagacauaagcaauaugcuaaagauggcuuucuaauuaauuuaugaaaucacuuccccuccaacccaagggaaauuauuuguuuuaauaaguagaugaaauauuauaaaauguucaaucaagggcuuguggucaagguguuucuauuauaaaugauugaccuuuauauuuuagaugauugcauuugaugcuuaaaauaguguucaugauaagaauguaaaggaaaaucauuuuguaagcaauggaaaccauaauaguuuacuuguuuaaauuuacuguuugcuagaaaaccagacacuagacuaaaagaggacagaggccaggugcgguggcucacaccuguaaucccagcacuuugggaggcugaggcggguggaccaccugaggucaggaguugaguuugagaccagccuggccaacauggugaaacccugucucuacuaauaauacaaaaauuagcugggcgugguggugggugccuauaaucccagcuacucgggaggcuaaggcaggagaaucacuugaaccugggagacugagguugcagugagccaagaucgugccauugcacuccagccugggugacaagagcgaaacuccauuucaaaaaaaaaaaaggauagaaugugcugaaaucaguuguaaaacaauuuaaaguagcaaauacuuaacacauggcuaaugagauuugucugguuccauagugaaccuuuguuuaaauuaaaagaauuaucuaaauaaaaaaagaaggauaauaauaguauuaguuguaauacugaaaagucuuuuagaaaacaucuuauacaugacuucccuuauuaaggacaucuuucugaaauaugcagccucacagugaccuuuugcaaacaugauccguuaacugaggacugaauuuugggauggacauggucaggauuccaagucaauacugcagcgcgacgauccacacaguaacgauacuaaacugguuaaaaccaaaagcagucacuaugaauacagacacacacgcgcacgcacgcacgcacacacaugauauuugugaauuucagauagcuuuuuacuagauuuguaguuagcuuaaaaaccaaaaaccaacaugaaguguguggcugaugaauaccucuacaaaauaagccauguuacaaugagacgauuagaaaagcucacuuuugcuggaaacaucccagagagguucgaugucugccuaagcugaagauguggaaguaugguuacaggguuguggacacuaguuagauaacugcuuaaaagcuuauauuaaggcaaauaaaagcugauugcuagaaagcaauuaugaaaaugucucuuguuuaucuaaagaagaacaggacuuuuuuuuuuuuuuuuuccuggugcagccagauguucuaacuuuugaacaaaugagcguggucaguaauguacaauaacucuugagucuguuacuuuggccuagcuaagcccaucuggcccucgggcauccugcaagaugacagacagaagagcaagggcacuaucagaaauggaacaggcugcccccuacuccucccagccucuaccaguacacagagacagacuggagauagagcauucgcagccaguuggcaucuugguucuuuugucuucugaaaauaaaaauaagugcuugucuugucuuugggggucaaagagaaccgcacuaauuuauuuccucgagggggcuuuucuggaggagaggauccucaguccugugccaagguuucacgcuguuuggccacacgccaggccuuucuucuggaucuggucugcacguccagagaugauggaggaauugcaucagcaucauaugcacagugaaaggguggcucuuguccagagaggcccauuccgggccuggcuacauggccucagggccuggcggcaguuugaagagucuggcugcagauaggagcuuucuuaugugucucuccucugugaugccggccuccugaaggcaagugugagacagagaaggcacuuggcucagugugcugaagcccgcgguggagagggugccggcguacaugggcagaccgauggaaaugagccaaucugacacagacgaaaugcacccaggagagacgggcuuucggcagauuuccgugaguccaccacuuggaaucuggauaaauuaagaaagaauaugauagaaacgcuccaugugucaucgaggacuacuucgcguaugucuaaaaggaacagcacugaaauacugcauugcuagacuauuaucagaaagcgacaaugcaaugagugucagagaucaagacuagcaggaaaaauucuucucuaagaugaaacaaaucuuuaaggaagaguuccacaagguucucgaagguguuggaaugaggucaaaucccauuuauguguccgagucuucaaacuauaagcauuuacauauucugcuauuuuguuucacuguggauaugcucuugacaaagagcccuaagguagucugaagggacaaaucugggugaucgugugaaauguagcauucaguggguaggguuuuuauaaaggagacuuuccacuguauuuugaaucuauguuaacaaccagaaaauuacauguuuagucaauacaaguuaugaagaauuuaaaauacaauaauaucaaggguuggcuggaacagggaaguggacauuuaaccuugacuacuggguauauaaagggccugcaccuuucagaaaggugauuugcuaacgaguaugaaaaucuuugggauuuuauacaauuuugaugaagcaaaccaucuuccaggaauaucuacucagaaauuaaccuuuaaagucuacaaagauuuauuaacaaggauguucuucauuacauuauuuaaaauaaaagguuagaaaaaucuaaauguuuuaacuaugagacucacuacuagaguacacugaccuacuagaauacuuugaaauacaauagccaccccccugcuuauccaugguuuugcuuucuacagccugaaaauauuaaaugggaauuuccagaaauaaacaauucauaagucuuauauugcaugccauucugaguagucugaagaaaucucacaccacccagcucugucccaccugacaaucaucccuuugucuaacaaauccacgcugccuacaccaccagccccgcagucacuuaguagcccguagucaucagaucaacuguugcgguaaugcaguacuugcauucaagucacucuuauuugaccuuacaauggcccccaagugcaagaguaacgaugcuggccauucgcacguggcaaagagaagcccuuaagugcuuccuuuaaguaaaaaggugagaguucuugacuuaauaagaaaagaaaaaaaauuguaugcugagguuccuaagaccuacagugaaaacgaaucuucuauccaugaaauugugaaggaaaaagaaauuuguguauaauauauacaggguuugguacucagcaagcuuucaagagauccacuuggaggucuuggaccauaaucccucauggauagggggagacuacuguauugaugauaucaauuuuuuuuuuuuuaaguaacagggaaacagauucaugaucugauaauagccaacaaucagguuucgguacuauacauuuacgcauacauuacgcaugugcagagaaaugacuagacagaguuuuaauggacaaguaaaaauuguguguauuuaugguguaaaacgugguguguugauaaauguacacauuguggaauggcuaaaucaagcuauuugacauaugcauuaccucauauacuauauuuuguggugagaacacuuaagaucugcuguccuagcaauuuucaaguauacauuguuauuaacuguagucaccauguugaacaauagaucuuuggaaguuaugcuucuaacugaaacugugucauucagacggauuuuauuuuauuucuuaagagauggggucucacuauguugcccaggccggcaucaaaauucugggcucaagcaauccuccugcuucugccucccaaguaacuaggauuacaggugugcacuaucacgcccagcacuagacggaucuuuaaaaaguuuuucacaguguugggauuacggauaauuuucauuuuuuuuuucuuucugaaaguguauuuuuaaacauuucuaggcugaccacauauuacuuucuccccagcugucuccuuuccauagcuacgcaagcccuugccuacuuggcaguuguuaguauggucaucacuaagcgugaucacuaaaugugccucaggaagcuggagaacugugggcugcucaccgccaugcggugcugcuuccgaagcugcuucacccggaucugguccauguuggcggcgacgucccgcucgggcugauccaaguccucugcguaucucugcaccagggcuucaggaaucccacagcggccaugcugccagggagaacaggaauaugacaucaagagucauaaggauuuuguuuuucuuucccuaagauacaccacauauaacguagggucucacugucacuuagacuggagugcaguggugugaucauggcucacugcagccucaaacuccugggcucaagcgaucuucucgccuuggccucccaaaguguugggauuccaggcguaagccaccacacccaacccaaaaguuugaauuugaaaugaauauauuuucuuuauuggucaggaugaaugcuuuagagggaauacuuuuacaucuuuaucuuaaaguacugaugagcucuaggaaaauguucugaagcauaguuaaggcagaacacaauuauuccacauuuuucaggacaaugccuucgccucaaucagaucauuuugcaaaauacaacuccucuaauguuacugaagagagucuucuaaacugcaggagagaagggcuaacuucugcuuuacagauauucaacuguuugcacuuuaucugcuacaagugauaccaccagcucacuaggccagcauuuacuguauggucuuucucacuaccuuucauuuaaagacauucacucaggaaauaucaaggagggucagagagguggaggaggaucugauucuaaggcauucauugucaugagaauuuuauaauaaaggacucucaggaaugcauccuaauaggaccuguauuuccaggaguaaaguacugcuguaucuguuagcauugcuuugucuuuggagucacuugguauugguagaucucauuuuuuuugaaugagaaauaauuuuucauuauacagcuaaauguuuuugguacaaugggggauuuuauauuaucuuuuucccauuacccauacagauaacuguauaauacaauuaucacaucugaauaggguucuuuuguccacauuuauuuuauuugcuccuaguaaucccucuaagaggucuucaugcagguuauuuuuaaccucgguuuaccuacggagagaugaaaugggguggugucaauaucugaacacaugcaugucaaguaagguguggacacguggauucaggugucuccuguccacugggcgggcuaccgggcuggcuucagauguggguucaucucaccuggcugccugacuucuacaaacaaaggccugugaacguggugggcccaggaccuuugauaccuuaucagaauacggcuccuccgugagaucgaugccuucagcgugcagcuuguuuucagugagcguuucuagauccacuccccgggcacaggagaccuuccuggucaaagccgggcccagcuucacaccgugcuccuggaggcuuguguucucggggagcucugagagccaggggggcggccuugugcuuggugggcugccaggcgccugcccugagagaggccugggagccagugcugggggacagucgcuagggcugguggggcuggcggggcugccccuuuucacuggcaggcauggcgcaucgggacuggggagggccccacuggggcccaugggaacaggguggaguccguuagcaaggcguucucugcucuuuuuggcaggaacagguggaggcugugauggaauuuugggcugcauucucugcucagcaucuaccccuucuuuggugcccaggggaugguguguuccuucaaacucguguccuuuucuguggcccuccagaggcguccuugcuaaaccguguuuagcuccaggaggcugagcaucauaguuucugggcaaacacugagggggugacaggccgcgaccagaggcugcgauugagcccuccaguuucuuaguugucaauuucugagguucagaaaaucucuugcuuugggucaguagcaaugcauugucgacagcagagucuugcuccaggggcugggccuucguggaagaggcggucgucuucuguggcacuucagguacaaucugagggggcgguucugucaccucgguaggcacgucuugcucagcaccaggcuccacuugaaggucauccagggaaugggaucggggccaaguguccacagucugggggcccuccagggucucacagcuccggcagauggaaacugggaggcuucuucgguuuuuauucaaaccagucacaccaggugggucacagcucuuggacgugucuggggcaaggccaccacccagccugcccuccuccugucccugcuucagugcauccccugauuucauuaaaggcaauguuggguaauugcccaacugguuucugcuaaaagacuucaagcugggcucgguggaugacuuggcagauaggaggcuagcuuuccgagucuugccugugagacaagggaauauuuuacaaucacauuuuaaaagcaaaucaaucaaacggaugcauaaaguugugcuaacauaauugaaaucuccaacacccacauccuauuguucaauuacacuaaaaacauaaaaucaccauuuaugacaucgggugauagaggguuauuaugguuccauuuuuauuuuuagaaagaauucuuagucuuauuaaaggaaucaugaagacugaaauuaauuggguuacaugggaaagaaauacgcugugucaagcaguaaaauaaaucuuggcuuaagucugugccccacugcaaucgacguggaaagaggcugaucaucauaccgcauauugaugagauuuguugggugaguacaauuucucaaggucaugauggaaaaggagagcuggacugaauuucacaacagguucuauaaaugguauccccuacagagugaucugugaauacucaaaucccaccuucccugaagccccuccuucuaguaaguuuauccuagaagcaaucaaccaaccuggacacagacagguaaacuuuugugaguacuuugccaaagaaaaucuacaaaauacugauaaaguuuuaggucccagcaaagcaacaguccuaguuacaacugccagacugauaacugaacuaucaaccagacauaaucuacuuaucugacgacugguaguugauacuaaacugcugcuguuggauaagcuuugccaagaacuuacaauucaugggccagacaaugugcugaaugcuuuguucucaucaguacuuacaugugcgcgcgcacacacacacacacacacacacacacacugucccuuguuacauuuuugguugauaacauguuuguugugugcuuugacccuguccaccuguauguuccacacugauaaacaccaacaugcuaugcauuuguaggauauuauuguuguuacauaaagaucaucagccuagugcuacuacugaagauauugaccaugguccuacuuuucauuauuagaaaaaucaucacaacuuaaggaggccaaggcagguggaucacgaggucaggagaucgagaccauccuggcuaacacggugaaaccccgucucucauaaaaaauauaaaaaauuagccgggcaugguggcaggcgccuguagucccagcuacucgggaggcugaggcgggagaauggcaugaacccgggagguggaccuugcagugagccaagaucgcgccacugcacuccagccugggcgacagagcgagacuccgccucauaaaaagaaaagaaaaaucaucacagauaaaugaagaaauaccucuucagaaaaaaaaaauugcaucagauuuuaaaaguggguugaaauagaaaauuauuagaaccucuuuagcauaaauuuagaaauaugacuuucuuuucccuuaacucccaauauaaaacuauauauauaaguuccauuuuugcauucugcauuacauuagaaagaucccugaacuuacuuugaguucaaaguaugguucgcuagcaaucuaguucuucagcagguacaccugaauucauuugggcaugaaaaauucugccagugauaucugugagauccuuaccaaucaccaacaguugggggaauuaauuuccugaaaaguuuuggauaugaaaagguuauuaagagaaaaaaaaauucuucagaaccuacaugagcuacauaaggauucugauguuuacugaaacugaggauguacugggauacuaggugaguuuugcauccugucuugaccgaggcuaucugaauauuauauauaguuuggggagaacuacuaucuucccaaguugauagaaaaccuugaauagcagggcaucauggcucaaauucugagguccccaagaugcuucuuagaauuggaauuagagugaggcaaacaaggugcccagaggacaaacucuaaggaggugaaugcccagagucaugugagugcagggcugguacccgagagugagcacuugcuuaggguuugcauccuggacacccacuuuccuguccuuagcccuaguuuugguacccacaauggcucucaaacuauuuuuucccaugauucccaguaagaaauacauuuuacauucaacauguaguacacagagacacacaugcauguacacaagcacaaacacacacacagacauaacugaaacaaggauuacaagugacagugcuaacaauacuaaccuuuaucuuaggggaugcucucugauauuuuguauucuauuuugucuuacaaaacugcuguccaugacccacuaaacugcuuucaugaccuacuaauaaaguacaaccugcauuaaguuuuaaaaaaguuugcuuuaguaggugcucaguaaauaucuuaacacaugggcuacuagauaggauuccaauggcugcuaaaagcuaucaaaccugggcauuuuuuaugacggccuucaagaguuugacagagauuuaggucacuguggcagcguaagccucuuaccacuguuucucaucuugcuacaaugggaauucuggggucacaacaggaaaccacaaagccauccaugguaacguuuagcccaccugaccccauaccacuuaagacuccucuucuguuugagacaaguaccuuuucugaaauuucauacugauuacacuuccugacuggcuguacagagaggccacaaacaagacauguggccauccaauccuucucuccugcaguaacugccucgacauucaggccaugcagccgaggcauuuaagacacugcugcugguaugacccugauggauggucuaccugguaaacuguuuuccuuauggaccuaauagcucccaacacuccaauguugguuuuuauugcauacagaaaagggcauaggagacacacaauuuagguuuuacagcugcagguauuugacacagaauuuauuaaccucacccagcagccaggagaauagauagggaggcuaacuuggacuagaaugguguagaggugagaaaggaaacgaugauugcugaguucaugacaggaauagaaucguccuuuugcagaaaacugugcuuugaaaucaguacuugucaaagcagguucccagcgacucaugcugacauuaccguuuuccagguucucacugcuuucguagcauccugagucucggggugagcauccacucaggcccuggcugucaacgagcagcuucuccugggauccugacuggucgcuguuaccuagaggagagaacacggcaugaaaucaacaaggugagugaaaagcagagguuucagagucaacagaucucgacuuuauccucaguuacugcccugagcuuuuggaagagaacaauuuaucuuaaaauagaugagaucaaaaugaacuagugugaucacaacuuuucuuccaauaagguauucaucgcacgaagauaaguuuggagagagcacacaguuggaauauguugacaccuuuuaaguuaguuaugcgaacagaagcugacucuggccuuggggcuaugaggaaaggagaaagguagaguguuguuuuggcaguggggcucccagacccuucugagugauggcaccaucaaggagaagcaaagaaagaauaaacgccccauucacaaggugagauuaggucauauguuuuucggagaucuguaagacuugugcuugaagacaguuauguugccaacuuuccaaauuugggagcuaauauuaaagugucaaaugaaauaaauuuuauuagcauuuaggagcauucuuagcccucagcaacacgugcugagggcucuuguauuagcucagcaagaguaaggcuggcaagacgaggcacaaaccccaaaacucaggacaggccaguggcaaaucuucuuuuguuuuuguuguuugggaugaguuagagguuguuuuuucuuuucugcuucuccuuuugucuugugccagcacauuuuugucuccugcauauaaguaaaagcuggggaaagcuuaggaaacccucgaacuuggaagcugaguaacagauacaugcuugcugguauagauaaauggaugacugaaaacugaauguccucauucugaguggauaaagaaaaugcaguaccuauacaccauggaguacuacuuggccaugaaaaggaaagaaauaaugucuuugcagcaauuuggauggaccuggaggccauuauucuaagugaaguaacacaggaguagaaaaccaaaauccacacggucucacuuguaaguaggagcuaagcuauaagcacauaaaggcauacaaagugauauaauggacuucagagagucagaagaggaaggguggggggagucuagggauaaaaaaacuacacauuagguacaauguauacuacucagaugaugggugcacuaaaaucucagaauucaccacuauauaauucauccauguaacccaaaaccacuuauacccccaaagcuacugaaauaaauaaaaaauaaaauaaagaaaaaaaaaggaagaccucauucugaggaaggcuuuuaaagagaagcaucauuauuugucaacugugccucaacaaagcuggaggggaaaaaaaaaaaaaagcagcaucggacgcuucuguugagugaaucugccccaaguaaaucacguggaaagccacgagggccuucaacacccuagcagcaucacccggcauguuguagaaagggcacauggagccuuacaugggacacugagguuacacgcagaacaucuuugcauuauuaugcagaguaaguaagugcuuggucacauaaaacagaaaccaagaaaacauuuucuacacaaaauagcuaguugcaaugaugaauggcuuuauuuuccuuucuuuucaucccccaccaacuuccccacuccaaccacauacacaaagaaaaaaagaaaucaauaagccagaaaugugaugccuuuucucaggucaucaaaauaaaaaugcggggaggcagaaggcucuggcagcucuccggcuguccaccacuuccugcuugcauuucucacggggaaagcauuuuacagccccaacuacagcagagaucguggcagcguaagucccucaauuagaaucccaaauuaagagugcuacuuuuaaagugacuaaugaaaaauuaacuaauuggaagcacaagagcaaauacugucccccugaccaccuaaaaguggaacauucuagagcgguguccucacuguguggaagagccuguggcuuugcaguggccuuuguucuggccuagcauguuauuuagaaaaaugauacuuauaaaaugagggcuuugugcuauccauuacaacccagggagaggagucgguguacucugucccuggugacaugguucagugcaccacaguggccaaaacagacuccagagugcugggugggaguaacacagaagaccugcuccuacugcagcauggaaguaugugcugugccugcaucuuuggggaccccagccucagcagacacagcagaauaccugaaauuauuuuggagaaggaggggauccauugugucaccugaaaaccacaguuggcguaaggaagggggcuagaaucgcugucuucauuagggagaagagaaaaagaggugaggugccucuccucuguagugcagaaucaagaccaugaccuuuucccacacuugucagcgugggugccaagguacaaaagguaagaaggaagauaagcuagaacgcugaaaauucucacagucaaaucacagcaaagugcuagguugugaggcuguaaccccauuugagcaugaccugaacuuugaccugaagggacucugcuugggcuaagcucucucugccuccagccucaccaaccacacacacacacacacacacacacacacacacacacacacacacacacacacacagaauaugcuaagacaccuaugaauauuccaacaucaaaagguagugguacccaaaggcacauagcauugccuggggagcaguuaccuugggaaagaagagaagggaaugggauucuuugaaagcaggacuuucugugggcuuacaccauauuucuuaaaauguaaaagaaauaagaaaauauggcaaaacauuaacuucagcaugugcaugcauauguuuguuuguuuucuuuuccucuguacuuuucugcauguuugaaauaauuccuaauuagaauucuuauacaaguuauuguuuauacuuagaaauggcuaagacaguaaacuuuagauuaucuguauuuuaccacaaguaaaaauucuuuuagcaauuuguaagaggcuuucauuugccagaccuaagauagugggucugggcuuggcguaaggaauagccaucugacaauuagagucuuuucccaauggaacccuauaugauggcuggcauuuucccacgcuucgagggaggcuggacgggucugacuuccaaguagugcuggaaauguacuuuuugcucucaguuauggcuaagcuagaaaccuuucaagaucccuacauaucuucaaagaucucaauagaccucugcaucucccuaguguauggaaaucuuguuugacagaaaccuaucauguuaucaguuagaggcacuacuucuuagccacgaugacuuuaacuguauuggauguaaaaauccuauaaugcuaggaaaagucuggacccugacucuuggcacuaauggguacucuggaaccuugaagccuuuguuuuagaaccaauaaaaggaaguacaacuuuaucuaucagggacguucuaaacaccagagcagaauagauccacaauggaaugucugaagaggcaaagaggucuucuucaccuuccagguuagcaaccugauggauagcgauacccuccuacaaaaugcuccuugguacaaaaaucucaggaugugaucccaggaggaaugaugggucucagccaaaguggcauggagcagucuaagcacagauuccugccuuacacucaggaguuagcuuuucuccuccaaagcuguggaugauaaaggaaaugucauggagaguauauauaaaccagcuguugguuggaugcaguggcucacaccuguaaucccagcacuuugggaggccgaggugggcggaucaccugaggucaggaguuugaggccagcuuggccaucauggugaaaccccgucucuacuaaaaauacacaaauuagccaugcguaguggugcaugccuguaaucccagcuacucgggaggcugaggcaggagaauugcuugaacccgggaggcggagguugcggugaaccaagaucgcaccacugcacuccagcuugggcaacgagagugaaauucugucucaaaaacaaaacaaaauaaaacaaaacaaaacaaaaaccccagcuguucuuggugacugaggaagagcaagugagcuguuucugggcagaugugguucgggacaauagaugcuuuaauacugauucauacuaauugagcugguaggcuacaccaguuaccgugcaggcucuuuacacgcaaccuggccacagaccccaaagugucucuugggcaaucaaauacuuacuuaaaagaccuuguuauaaagugauauuaacuaugaaucacaauugccuccaaaucuaucccaaaucuaucccuaaaggcagccuguuuaucuuaggcucagacaucuaucugaugguguguguuucucuagcuuaccaguucauuuagagggacugccuauuuagcagaagggaauuucaccuaaugacacuugcuuccacguuucucaggccugauacauuucaguaauguauaauucuuuuuuccaccauuaaccaugguuuuggugugucuuuuagcaacagaaaugcuauuagcuacugauaucccugaagcagaguccuugaaggaaaacguguuugaauucaguaacuggaaaggauacuccuuuaagaugaaugauuucaggaauauuucugauggcagauugaauaauacagagcaagauaagacugaguuaauggagcaaaggguaugguguauucaaauagacagacuucauaaaagcugugagcucagugaugauucugcucacaggcuguaaaaauaagcugucauuuagguugggaauuugcaagccaaucgauacggaauucucugcucuacauauucacugcggagagacgucuccuccuuuaacgaaagcugaugaauuucauuuauucacuaaccagucuauucaauaagaacacaacuccucgugugcucugagaaguaaucaagcuuuggcugagcgaaaaccucccagcuggucagucacuuuugugcucagcugucccaauggccugcuggaggcugcaccucucaaaaguacugaaaguggagucuacccauuuuuuugggaaaacuguaauuccauucuugcagacacuuggugcagaauccucuucaacuaucaccuagaaacaugcccggaaagguggcggcggcacaggagguuuucuuuuguucccaugucugcacugggaauuuaugauuuugugcuguuugaccuuggcaugggaaagaacaggacagaauaagugacuccagggaccuaagcacauacuggcagcguagguggggccugcuguggcagaccucacagggaacaccucugugcguacagggacuuacugucauacucuuguaacagaaagaacaggacagaauaagugacuccagggaccuaagcacauacuggcagcauacguggggccugcuguggcagaccucacagggaacaccucugugcauacagggacuuacugucauacucuuguaacagcuccacugcugucaagagaacagcucuguguuccgggucccugauauuuaacucauccaagucuuccuccuccagcagcuuaaagguguccaaaucuucauauccauugaacaggaaagugggcaugugcuccugugagagggagaaggaagacagaagggugucagccagcccagacacaugauaacaccgccaacaacuagccugcaacccacacacuguucccauagucaccuucaggcuaaucaaaagauuaguaaguaucauuugcaauggauccuguacaucccagcccucuggcuuaguaggcaagcaggguguuuuauuaaucauggguuaggaagauguacauugcaggcugugauggauucugcuggcuugcacuauaauuguacucuugauaagagcuaauuccuuuaccuccacagagcccacaacagaggagacuccuccuccacuuacagagcuauuaaaauccagcuuuuaaguccucaggaucaagaguuuugcaaagaggaaacauaaucucucauugcagacucaugcuaguagaugccuggagugauggugggagagaggugggcgcagaguuuccuuguggccccuguggagcuagcugcgaucaaggugccaggaguuucugccuacagcucuuccagcagcaagguuugacccggggcuuacgcuaucacccacagcugaggucaagggcaguguuggaaaacugguaacuaacuaacucuuucuguagaauaaugaaugcucaucauaguaacgagcugcccuuauuggaccacacagaucagccccaacccuacccuaaaaaugcccucacuugcuuaguguaggagagaaaaaggcagugagguaguagcgugugacaagaaucagaagcgacugacuuuuagguuaauccgauccaggagauccuccacagacuugggcugggguggucguccuuuccgacgccuccugguggggcguuuggguuucuccucgucuucacugagcacguccacguagaugaacuugaacgugccgacuuuguuguucagcaggcccauccagguccccauggguggcuugcugauuauaucgaugauaucuccuuucuguggcccagggagcaaagaucuuuccauuagguacauuccaugaacguacaaaucaagaaucugucagauacacaggucaugcagaagugaagaugccacaaaggccagaaucggggucccacaagucaccccucugagugaccugcauaggaugugacugugagcuccgcagaggccagacaggugucucugacuguacggaauuccacgcaggcccccggucacagccccuccacccuccugcccugcagaaccaggggugccugggguaccccuggugcucucagccaggcugcccgcccggcacucugaacgccuucccuccucagagggcucccacuucuuagaggaggcacuucccaccuguccuaaccaguggcaaucccggcccugucauggcugcacacacuuuguggaaccccaucugucccauaaagguaccucugagcacacagaaggcagaaaucuuucuucagauggagaaaacacagaaaccagguguguggagcaggagccagguggggagagggagggugugcaacaggaauucuagagggaagcugaggucagaggggugaagugaugcuaacccagggauuaacacgagacccucccucugccucgagggcuggcugguucuuguucuguuuuucacuacagaggagaccagugaucgagguagccaagauacuguccagucuguaccauaguagcccagcauucaacagugaggaggaaagaaagccuccuagagaaauggaagagcccaguuagcugcucugaggccagggagagagauaccuugagcuugagugagucugugucauagggacugggggugaagucggugugcacccuggcacgcccgcagaacgggccucgguaaggcggcucuucgucauccccaucuuccgacuugacgcuuucccgguugcugguugaggaaucaguggugcucacuguuugaccgccuguacaggaaacauaggaagaacacggguagauccagauuucccacccagcaaagcagaaagguauugaagguauggcagauuaggaaaugaaggcccagagaaaggaagccuugagccacaacccucugucaggaccagggcagggcccaguuaugaauucuccgagugcuaucccucagcuccucaguggacaggggacucacagcaaguuacccucaugaccugggaauccauguggcacggaggaucccgcguggaggacacugcagggccaggcaccagacucugcucuuaacauucgugaccucucagugguaaugcacacucucucuaaccauuuuacagaugaggaaacaaauucagagcagucaugucauuugcccaaaaggguaagaaagagcuuaaagugguagguuuaaacuugaucucggggcacgguggcucacgccuauaaucccagcacuuuaggaggccgaggugggcagaucgcuugaguccaggaguuccaccagccugggcuacauggcaaaaccccgucucuacaacaaaauuagccgggugugguggcaugacccuguaguacagcuaugcggaaggcugaggcaggaggaucccuugagccagggaggugaagguugcagugagcugagaucacaacacugcacuccagccugggagacagugagacuccaucucaaaaauaaaaauaaaaauaaaauaaaguugaucuuuuccuucauaccauucagccaacuccaacuaccauuggcccgaauuuaucagucacauauaaaauuccccucccuuccccacucccuuuauuuugcuggucaucuucaugugcuugucucccuggcuuauucccccugcucucuagauccuuccucugagaugcuuucccuauugucuccgaucaaaauucaucaccuccuguuuugggcugcugcugcugcaugucuacuaauaaacaaacacgacucugaguccagagaguuuauuggucugauucucuaauagcaccugaagggcaggacuuggucuuauucaccuugaaauugccugaaccuagugcucaguauaugucagauauuaacuccaaagaaaauaaucuacaaugacaaacucgacuuacucauggagcucugcccacugagagaacugcgaagacuuucuacagaacccccggccuugagcuugggcuuguccaaguguucggggucgggcugugaaggcggaggggagccaggcauuccaucaaggcccgaguccugccauggguuucaacaaaaugaagaaguucaucagaguggacagguguuguuuuguaauucucagcgacuuggccuucaacgaaaucaaucaaaucaaucuauaccuauauuugauucuauaaccaauauucuccuccucuuaaacuuacauccucgcuuacuuuuaaagucguggccaaugucacuauuuauuaagcacucaaauacuauuucucauucucgaauagauauucuuggaaucuccaagaaaaaaaaaaucugucuaccacacagacaaaauacuuaaagguuuagagacucagcauacgcaaaagcccaguagcaaggcuggacuucaaauguagaucaaguacaauccaugauuacuagaauaccuggaaguguagucagaggauauuuaaucuacuuggauaggaaacaugcacuuuuaaaaaaguguauuccuggaaaaaaaaaauuggcuagauucuuauauuucuauuuguacaaauuauuggcauuggauaaggaaacaugaauuuaaaacccacauauacagcaaacauacuauuuuccagucuaccauaaaauuuccauauguuacucuaaaguuuuagcuucuuucacuuuucuaaaguguugucaguaaaaagcugggaaaucucuuucacaccagaauccugaugggagugacucagcaguacuuccugcauuuugaguagcuaaguauuauccucucagcggcuccucauuugcacauuugaguauagcaugcuuauuugauucguggugcuacaucaauagacgauaucacacuucagaaaguuugcagugagaauuguuuacuugccaaaauagaaaagucucuggcauauuacauauggccgcagccacacgggcucaaaaccagcuaaaaugaaaccugcuauuugcaugcugccgagucaucagaagggccuuaacacagcuccgcagguccugcaaacaucugaggacaucagcaacagcagcuucugauccaacacacauuagugcuuucaaugugaggaaagugagcaagcgaccucaaaaacaacaaagaaaacuagagcugacauuauuaggaaguuacugaagcuccaaaguaugaauuccuuaaaaaaaaaaaauucauuccuccuuucugcgucauaaaauaaguaacuuuuuucccauuaaaaucuucuguaaugcuucugaaaaaagcacgcaguuugaaaaacagcaauaguaaaugugggucucugauauauuuucaaaugcuuuaaaaaauuauuaauuuauucaucacauguuuaugaauuaccuacaauaacaggcacuaauccagguauugggcauauagcagcaacggagaaaacaaauaucccuaccauaaugguugguauauuuacuaaaaaguuuuuuuaaaaaaacacacaaggugggcgcaguggcucaugccuguaaucccagcacucugggaggcugagguggguggcucacgaggucaggaguucgagaccagccuggccaacguagugaaaccccaucucuacuaaaaauacaauaauuagccggguaugguggcacgugccuguagucccagcuacucaagaggcugaggugggagaaucgcuugaacccaggaggcagagguugcaguaagccgaggccacaccauugcacuccagccugggugacagagugacacuccgucucaaaacaaaaacaaaaacaaaaaaaaaacaaccacauaaaaccuuccauuauuuuugcuuuacagaaaauuuauaaugaucaguuguuucuuuuauuccuuaacuuaugugaaauggcugcuuuaaaaaaacagaacuaagcacauaagauugcuauaugguaguaaaauuauugaaaaaugccaaaaugacauuaaaauucuaugcuucugauucauaaagcagaaaaccucugugaacguaaagcuuaagaguuuuaguggcuguuucaaucuaucuuggggaaaagcaaacuuaauaaaaugcuuucaauuaguagcaugcucucacuagcaugcugacugcuucauugcugggaagaaauauagaaucacuaucacuccgucacccacaaggacaagagaaugaaaagaauaaagaaaaaaaaucauggauaagacaugcugaaggcaguccagacaucuaucuccugcaggucuaacaagccacgguuucucagccugagcacugaucauuuugauggacagcucuuugcugugcagaccguccugugcaugcuaagauguuuggcagcgucccuggccucuauccucuagaucagcauucuccaacucccgggccacggaccagaacccgucuguggccuguuaagaagugggccguacagcaggaggugaguggcgggugagcaggccaagcuucaucuguuuucacagccacucuccauuacccgcauuacugucugagcuccaccuccugucagaucagcggcgguauuagauucucguaggagcacgaauccuauugugaauugugcacacgaggcaucuagguugcacgcuguuuaugagaaucuaaugccugaugaucugucacugucucccaucauccccagaugggaucaucuaguugcaggaaaacaagcucagggcucccacugauucuacauuauggugaguuguauaauuauuucauuauauauuacaauguaauaacaauagaaaugaagugaacaauaaauguaaugcaugugaaucauccugaaaccaccaccuacaccagcuccguggaaaaauugccuuccacgaaaccagucccuggugcaaaaagauugggcacugcugcccuagaugccagcaauauccacuccacuucaccucaacccagucugaccauugaaagacauugcccuggaguccaugggggagcaaaaugauagccucucaccccuuccccgugagaaccacuguaaucaacugaagcugcugugcaggcuuuguuugaaucaagugagguggguggcaggcuggugacguucggucauucgcauaggggcgaugcuugguuuuagcucacugugcccaccagagagcagcagcugagcaaaaaugucugcuuuuccugcuguuuuuauuugguagauaaagugcauuaccuacauauuucaagcagacaaccagcucauacacaggaacuucaacaggcuacaaaaugagugcuauacaggugcuggaggagagugucuugaaaauugaauggucauaauuaccuugaggcccagcucuccaacuaucuuuacucccuccacccaugcaauuuagacagaaacagucauuucucuagcaaugaaauuauagauccaggggggaaaaaucaauucuaugauaccuuccuucauggcuacagauaaggcaaaugagggaaaacaccccucucugaaacauuauuaccaaagccugguacccaggaagaacuuugaguuuauuucuuagacuggcuaugugcuucuagaacaacuuaugcuaugaucgacaagucuacugccacccccccccccaaaaaaaaaaagcuuuagguuugauucagguaacauccauuuuguagcaaggcauaguuuagaaaauaaaauccuuccuuuguauucaaauuuacaacgcuuagugcacugaagaauaaccauuucuuuacaugucugucucucuugucuguacacagaaggcaaguucuguauuuuguauucccagcaccaagcacggugcugagcagcccaaagugcuuaauaaacguguguugaauucaguguuucucuacguaaauaaagcacggacuuggagcagguuaaugccaaggaguauguguauuuagcaccauuuaaaaucucagaagggccauucucagcuuuucuugucaggaagaaccaagggaacauucuaccagguagcugcauaccugcucagagacagagcugcuguauuuuuuagacauucucuuucucaucgucucuuucacugauuucaccuuuuucccaagagagaugcgagaggcaguaggugauuugaugacuucuuuguacacaaagucuccuucuuuacccuguaaaacaaaauguugcaaguauuguuggucgcagaaaaugaagaacagguuuuauuauuuaaaccauuaacauccuagcucucagaaauauugacauuccucauggaucuugacguuuuucuuguguuaacucagugcuauuauuuaucucuuugauuaaaaauuaaagcuuauugacuauuuuuguuugcuuaaagugggaugugagucacuuuuuauuuuacuuacuuuuaguacauucuuaucagguuacauuuuuuccacuauuuuuaacauccaagggggcugcauuucaucaguaaagagugauuuaccuuugggaggcugaggcagguggaucacgaggucaggagaucgagaccauccugacuaacacggugaaaccccgucucuacuaaaaauacaaaaaauuagcugggcgugguggugggcgucuguagucccagcuacucaggaagcugaggcaggagaauggugugaauccgggagguggagcuugcagugagcugagaucgcgucacugcacuccagccugggcgacagagugagacucccucucagagggaaaaaaaaaaaaaaaaagugauuuacaugaaccaauguucauguaaucccagcaaugggggagaauagagggauaauacuaccgaauugccuggagaaagagauuagaacaaauggugaaagcucagucguuagaagagcaacaucugauuggauuuccaucaccauagcacucaguguguaaauuucucucucuuaaagagcuagauuguggucaucucucauucuagucugcauuuuuuuaaaaaacaaacuucucccugagaaagaaaaaaaucauauuuucucucauuucuaaaaaagauugacagcagaaaacuauuggcuuaagaaucaauauaauucgauagccaaauaaaauaguuuaauucucuuccaggaaauuuucaaaacauuucauauauaucccagguggguauuuuagcugacccaugaucauaacaaauaugaaacaugaaaucuucauuuuacaguuuuaugacacaaugcaaaggacaagcuaaacuacauguaagacucaccaaaggccgggcgcguggcucacaccuguaaucccagcacucugggaggccaagaugggcggaucacaaggucaggaguucaagaccagccuggccaacauggagaaaccccaucucuacuaaaaauacacaaauucucugggcaugguggcgugcaccuguaauccuagccagucgggaggcugaggcaggagaauugcuuaacugggaucugggaggcagaaguugcagugaggcaagauugugccacuacacuccagucugggcuacagagcgagacuccaucuuaaaaaaaaaaaaaaaaaaaaaaaaaaaaaagacucaccuucacccuuggggucugagaaagcaaauuucaggaaacaaaacuugugugccacugugguggccugucccuagacuaugaccccaaagcaggucugagagggcagacaccugggccugacaccagaccccugagggaucuggucugcuuuggucccacagagacuggguucauuccaggacaccccagaccacaaaauccuaggcuuaguauaggccauguggggccagguacugggcccauaauaagacugguguuccaaaaugccagcacauacucuuggggaccaaaucacagggcuccacuucauggcacuauguguguguaguaguuacaugcuugcaacuagcaagaagaaaaggccgugugcaaaaugacucagaccacagaggccagacuuaucuggauuuguuacuugaagaaaacuggaagcaaaggcauuaaaggaacugugcuacucaaggaaggagauggcagugagaguggucaucauucauuccacguggaacaguggagucuguaaggcaagugaaauagagcuuuuuuccaaacgugacucaggauuaccaaggaaaacgguacccaguaucaauucucaaagauacucaauggugaacuauugucaaccucaucgccugaauccauauuuuuugcuuuccucugauguuacucaccauugggucagaauuauuacugccaacgugcagagagcgauucgucaagucaaauccuccaaaacugcagguucucuguggaaaagaggguagggcagaaaaacuucaguuaugcuuaagccagccggcagugcaccaacccagcaguccccguuugcaggacaucucugaaucacaaauacguggacaggaugaaaguagaaaacgagaaaugaugagaaaaaaacacaugagucaugucguaaggaaacuucacucauuuuucccuuucacaggccacuggaacucugccuaccccagaggucuagaauccccuuaacaugcaaaaaccaaccauuuuuuuuaaaaagccuaaaaaacaaaagaaaaacccuccaugaguccagugcugugagauucccugucuccagcacagaacuuccccuaacaucagcuacauucaguagagauaaugaagggauauguguuagaggauccauguacucaggcauccugaaaacccagguuugaaaucccacggcucugacaccaacagcaagcuuuucaaacagacuuucauuuuguuuagcuuuaaaucgcugagaagagggggggagaagguuauguuuacaguuguccaaucaggccaagagaauuacucacucaccgcuuccccauccuagccaaaaacgcugguaacuuucccaucgaacugcccaaguuaauucauggugacccuuuucucucagugaaugaagaugccacauuugcccagaaagaaaacgguugauucagugacuguguuugaccacacuuuuuaauuucaguaggaacaaugcugauguuauaaagaaugaaaacuuuauuauccuuuuaggugguugcaaacuucacggaacugcuuauaucuuagugauuucuguauuugcagaacuugauucaaauucacuguuguuuuucuaguaaaagccacugagugaccgcccugugccccacaacacacauuaauguuacagcuaauuaucuuuuuuaaaaaucaguaauaaaaguuuaauuguagauucgggcuucaauauuuuguauuaccagcuucucagagaagucuaaugaacagcuauuaaauggaagaaaugaacagaaaaguacaauguauuagguuggugcaaaaguaaucgcaguuuugccauuauuuucaaugguaaaaacugcgauuacuuuugcaccaaccuaauauacuauaagcauugcuuauucauuaaaaaaaauauauauauauauauauauauauaauuaacugaauugauaaaguagaaacauccuagaaggaaaaugccuacauuuuugaaaucacagaaaucuagaugcaaauccugguucugccacuuacuugcugugugaucucagguaaaguacuuacacucucugagcuuuagauucuucauuauuaaaauaauacuuauaucauauuugaagccuucuagcgcacugccuggcacaaggcagacacucuaugaaugcugguuucuuccacuacuuuucauuaaggcuguacugagaaugugguagucauccugacagcuguuauacugaaguugaggcuuaguuaacauuacaaauaugcaaauacagggcuggagcuuuguucugggccuuacaaucuaaucugggaguucaacuauaaaaucagagcauaccaggaaugggccacaaagugagagacggccauuggggucuggagagggccaggagauaaggaaagcauuucgugacaacugacaucaggaggucucagagcuguucuuauucaccgaugcugcugcugcugcugcuacuaccgacuuguuuucuaauagacauuauccuaauucuguauuaaauaucaaugggcaaucugauuucucuuaucgucagcuuaacuggaccuauaucuauucuauagaaagagaaaaaccuuucuacacaaauauauucaccaaaucaccuaacuggguaagcaauguuaugaccaccucucaaggcuaauuuuuaacauuaaccuucucuuuccagcuuauaaugccauguacauuuccuccuucuugcaaaagcagugauuuuauucuaguuccuuucccgugacucagggcuucacagacaugguauggcacccagaugccucaucauuguauggcuuuugcacgucccugcuuuaaaccacagcaucuacugcaauguuggagcccaaguuauuucugauacauaugaaauaagugacaaagaauuuauguggaaauuaugacugcaauaaauuagaaucucauuuaaguuuucacaugccuauuguaugcauuuauuucuaaaaugaaaaacugaaagaauggaccaguuuucuuaacuaccaacuaaaaccucuuucagugauaggcuaagauaucuggaauugauucuuuuuuacaguggaggagugacaaagaauauaacaauaaagauugcuugaauuaauuucuaacuuuuucuauaagaucaaguaguucuuuaaacagcauuccuucaaaagagaaaauggacuguaaagagacucauaaaaaauaaaucaauacaugaaccagcccuugacguugaugaccuaaauaaaugaagccuaaaugaaguuuuuuuaguucacacacuuccuguacugaaaauuauaaaaacacuuuagauagaugcuugggaugaggagggcuagucaauggaauggccaugcaguuggaaacacauguuuugggguugaauucaaaaauggacaaaauugcaaaaugucaugcaugucuguucucucaaacaaaaauugaaugaccaaauaaaauacgagacaagugaccacuuccaguggauacaaagcauuaucauuucccugaggcuucaucaagcaaauauggcauuuucgaaagacaaagagcuugagguugaagaauaaaggaaacuuuuagauaaaaugaaagaaauaugacaaggagaauggaaaauaaccuuuuaaauaaaucuagcaaagaaauaagauuaaucccuuuuuaaaaaaguucuuucuauuguaagaugauagaacacuuauuuacauucucuggauaauuagaaaguuaaauuuguuugauuguacaacuguacuacaagaaaaggaauaugcaaauauauaacuuccuacugaacacauauuuuugcaaguguucaaacuguccauuagugucucaagcucacaguauuuuaaaaauacucagccucagacugauacuugggauagggauuacacaggagcacguuaggugggggcggugccuggagaugagcuugcccaaauguccauacucaaugucaaugaagaauuaaucacuggccuacaacacuaacuagcacaaaucccagaaauauaacuucuagagacaaggcccucauggaguuauaguauuaaucugacaguaaauaacaugagaggcacaucaacaauucaaggugcucagauugggaaauuucucaguauuacaugauguaaacucacagaggugagucaucaauuaacagaagaagugcgucuguucuaucaaggucaugucaaaacauacaagagcagaugaauuggguagaacacuucugaaaguaaaaaauaaauacauaaaacuaagacugguuauuuuucaaaauaucugugagucagagcaaaccagaggcugaaugagugagaaagagaauuguuauuuuaaaacaaaaacucaaccauugaaaaacuguugccaugauacagaaagagccagaagaaaaguuccugcuacauacuaguaguauuaaaagugcugcaagaauuacaugaauaugaaaggacagaaaauaaggaaagucaacauguggaaauauguggaaaacccaggggcuaggaaggaccuaaggauucuuuuacaacagagaaggucguuuuaagaauggcauugaccaauccgucuucacuuucacaaaagcagaacccgacugaaugaauuuaaauuacacugaucgucuggggaagaacauccuguucaugaacgggaaggcccccugggaaaaccacuauugaaggacacucuauucuuucaggucuuuaaaagggcccacagccaacuguccugagcagaucaagcaaggugccaggugacagagggccaagaaaucuacuuccucacuuugcaccauuuuauaugugccacugugcaaacuaaaaguuaggugggaauuucagaaggaaaaauaucuauauucugaaguucaaaguaagucaugccuugaaaauaaaucuuacuaggucucugaucauccagcguuaaaagugaaaaacauccuacucuuugaaagugaguacuuuauuccuugcugaguacagaagaaucuauaggcuaggggaaggcauuuccaaauguugauuuguuuauaaagauaagaacauggaauagacuuaaguaaaacaaaaaagcucccauuuuuguuguuagauuuacgaacuuucugcuugccucuacuaauaaaauaaaugugcuuuaaaauguuuucaaaucaccaaauuggugacugugaugacggcaguuuuuccaugagccugcuccuauuguuuuaauuuuaaaaccaagagcaagcaucucuuucaagggugaaaugcccuucuguuuugaaucagcuucuuugaggucaagugacauaauggccgagaaucaagacagccacuccuggaggcggccaaaccccaccccuguacccuggaagccccucucuggauuagcuucaaugcuuauuuuaaugggcacucaaacagcuucaucugacaagaggagaaauggaagagaaggugaaagcugccuggaagugaaagcaggauuugaaauugaaggugauggugggaugugcccugacgucaugagcaggagagaggggaggaagccgguccccgcagaagaaaggccauaaugcuugacugcacaucacagaaaugacaaggccguccucaggaccaucuuugugacucacagacuucugguggauucucaagagaacccuuuuaguacagcggucgaccguggcggcccacuuccucuuugccuccucauccuccuccagcaggcaccgccucagguccugucucucagccuugcucaggguccugucugaggcaggccgcacuagcugggucagguucagguggcuguacaggcuccgcuccaccacguaggugauauugaacucgcugaccgaggugcgcccgcgcacccuccugccggggaagccgcagcucccgcccccuuugccuuucugccggagcagcugcaggucacagguggugcuggugacgccuuuucuggagggacgcuggcagagaaaagcucuggaacaggaauaauuaguauccguuuucuucaagcggauuugcuuccggacacucugaaacuccuccagggacaccagaagguggugccugcgacggugguugucauagaagcaaacaccauccguacuuaccccguggcuuagggacccgagacccuucuucaucucccccucggugagggagcgggacacuuucugggccuuuucuucuucuggguaggagaagaauguccccaucuucuuggggggcuuaaucaggccccggcucucuccuuugcugaagguuuugaccaacuuccggccagccccccagguguccaggcugcuggaggauggagacguggugagagagucugagucaucuucgggagguuucucaggagagccaucaaagaaaaggggcuucuugugcacgccagaguagagggcggaccguucauccaggaccggcgaauucucaaacacgugcuccuccccaccuggagggaaaccaacagagucucuugugaacacaccuuugcauucuugcauacaucuuucuuuacauucaccaccuuucuccguaucaugacccucuuuauaaacccagcucccacuuacauauguacagaaaaaugaaaauacacugugcaaauacaugguuucacaugagcuuaauguuaaaaggauucagauguguuuucuucuucuuuaaauaucuuuguagaccuaacaccuucacaggcguauuuaaaaugccguuugcaaaaucuaagcuagccauaaucacaauaugccuuagcauuucgagauaaugcccucugcaguuuguaaaugcaacccucugaaacuaggaaucaggaucuuucccccuucugaaaggcacuccuuuauguuggcucuggucgcuuuuuauaguuggagugugauaaaugucauguggcugacagugauuguuuuauugguacauaugccauuugagugacuaaaucuccaaggaaguuuugguggggagaaacacuauaaagcguuguaucuugcaaaugugacugacacaucgucuccagcugacaggccaaaugcaaaaaguuaggaaacucagugaucccggccagauacucccaucaacucaggccucacuaggagcagccagggcguuuaagggcccugacacgcaggcagcuccagggucccacuggucucagggauuccagcucuugaagcccucacuggagccagguggcaagccaagcccuccagagcccgguggaaagguuuggacuuggcaggaaaaccaaguucuuuuccgcauguguuaugugaacagaugugagaaaagaaguaggucaaacuguggguguagcgaucccaacuggcugugucccuuuaauuauagggaaacuuugagcucugcagcuuuccacccgcugaauugugaagaggaaaaaaggaaaaguuccuuggaacagaaggauggcacuaaauauaccagcugggacgagggcgccagugugugguuaaaugucagagaaaaaggggagcuaugcucaguucagagcaaaacucagaggggaaaagaacggcagccauccuuuaaaauucuaaaaauggcuuacuuucccaauugaugggauuuauagguacaaaucuaacaacaacaacaaaaaagaacagcugcuauuaaauacaacccaaggucaacuuuacauucaugcccagcagacggugguggggaagcuggaaaguggaaaagaagauguaaaacucugccuagcccacaguccccugaagaguuguucagggaucuuucagggggacuuuaaaggcaggauucgggguucucacagaaauucaccagcccagaugcaggguaccaauauccuggaaguuucccgcuccuuccucaggacaccugacugacaagguguggagaccaaggguucuuaugcuguuggaaauaaaaauggcaaccucuucuaguuauagucuacccuccacuuccaagaagaagcgacugggcuaagacuagaggcacaaccuguggcaggggcagcccaaccauggacuucucuauuaaagaagucgagcgugguuguggcuucaccauccgcccagguguccacgcagauguacaaaggcccuucuccacccacaguccuaagggguuucagggaagucaggugaguccacccugcguauccuaaggaucugucacucagcaguugcuuuggacauuuucugggcucugugcuuaggauuguugucagagauuccaauacuuuggugucacaucugagucuggaaccagcuggugcacgcauguccaugacgaauguagcucuauucucggguucaggaaagucagcaucugguaagggguugugagggaaauguagcaaacgcuucccaggaggcugcaucugccggugcugagggcaggccuccuguagugcgggcuuuuccgucugagccugaccaguggcuuggaaucccaaccuugaccuggauggcuugaacuuggagcaucgcuucucccauccuucucugacuugagcguacaacuccccuacuggaagagugaccaucaagaugagcucacuccaucacauuugcugugauuugcuucacgugaaggccuccaucaucuaucuuauucagcugagaccggcuuaccaaaggcaaggugauuuuggcaggaggagagagguaggcugugggcugacuuaaugccaggaacucagggguaugcucugcauccagcccggcucugccacucacagcuccaugaccuugggcaauuacuuccuggcucugagccucuguuuccucaucuguaauaaugccuaccuaucuuuccauaauaccccuggcaaggcuguugugaugauaacaguaaacauuauccucauaaaagaguuacgugaaagugcuguaugaacugaaaggcuuucuacaaaacuggcgauucauuacuggagagaacugagugggagcaaugagggaaggaaaggugugcauucuguggcaaagacacagaaaugggcagauaaagggcaccaauguagccuagguuaaagauuggccaggguugucccugacaggauaaggacuugaaacccagggugcaagggugagaaugaaugaagaacugaucucucuccuggcuuuccgaggacuccagagcuggugggggagacagguggcagcggagugagaacaggcugcugucagggagcaggcugccuggacaucgugcugggccuucugcuggcuggcugaguggccaggagucaauuacuuuuagccucuuugagucucagguuccucauuuucgaaaugaggaugguguaagugcuuacuucugguagcuauucugaggaugacauuaaagagaauauaaaaucuaaaguguuaaggaaagugccuggcacacggugugcccucaauacaugaugauuaucaugcagacaacuugguauuagcacaggcacgcaggaagucaaaggaucaacccuuuguaaguccaagggcgggggaggggggaggggggagggggcgccuacuggcguaugaauccuuccugcucugcaagauggacaggggccaagauagccucucccaaguaccacugccagugaggacccucagagaguucucuauugugcagggguuggaggaaguuccaguuuagcagggaauuggagggcagcccaaagcaggcgccuugagcuacacacacacaccuggggccucuccugagaagaugggugagauuggccaacggcaacucagcacccugacucaucagaugccagaguguaccuuaggauuugaguucacuaaauccaucuuccaucugugaagccugauuugugcccagauaaauuaaaguucagagccagaauuccauaugguuauuacuuuuuacguuagaguuaucccuuuugcuauauuuuuccuuuuccauugaugccucucaaagauaguuggauugauuuauucugaaauaaaugugcaaauuacaaugucuguauuuuuagucauguuauucuaguggaaaggcugcuuuaacacaccacuaucaugugugaagggcccacuggggaacaggcccaggacuagauacuuugcccauguuaucucaguuauggaugaaccccacccaucuauuuguuauaucugaggcuugauuuuggccgaguguucaugagauuuguuaccaaaugugcccuuaaaguugaauguuggcaauuccauaugguucccccaacaguaccaacugacccugucugugauuucgguaagggccgccacaggguacauucaauacuguggaauucacgacuggcgggcagguauuaaaacacccaaauguaaaaucagcauugcauccaaauguaaacagaauuaccacgcaaaaagauacccuaaugaaaccccggaacugaaaacaacccaagaaauuggccacaaagcugauuucucuccccauguuuuuguuuuccauucgaauccccauucucucacaguuacccacuuagcuucgguauuauucuaagggauuuaaacccacgaauaauaccaaacacaaauuaaaagcagcaauaaaaacgaaaaacccuuaucuuugcaaauaaggggaaauucauuucuuuacauggcuugauuuuauuucuauauaacaaaaaugccucuacaaaaauaauuuuaaaaccuacauguuaaaauuuugaaauuccucacaauguagauaugacauuuuaacaaguaagguguuuuuuaaaaagcauagucuuuccaguauuuuuauccaauucaauuauuuucauuuuucaaacagaaaaaaucuuaucuuauucuuucauuuuaccuuuuuggggagaauuuauaagaugcugcaaagaggcacauuacuaacaagagagaugaauaagguugagauuugaacugucauaauuauaugucaaaggcuaacuauccauuucaauaaauccaagcugaugucuuuugacauuacuguuucaccuggcuaaccccagcaauacaacucuuaaaagauucucuuagaauccuagguccuuaaagcccccauuugaauugagacuugagacucucuacaggaagaacaaaucaacccugagaaauuuaaagggauauuaggugccuugauuguuaggcauuucuucaaaauguauguacaugaaauuugaacuaaauucacugagcaagaaccauaguccuuucugggauuggaggcucaugugaaaaaguuagaaaguuuauauaaaaugguauaagcucauacauaaagcuauacuacaccucgagaaaauuuccauuucccaucuuuuaaauugaaaugacuaagcaccccaaacgccugacaccaggacccuucauuccaucacaucaucgcaucugagcaucacucugcuggcaggcauaguccugccagauucagccagagcucaaugcauuuuccacuugaaaucguaucccuuuucugcugagaaacugaccccaaaugauuucuuuuggaauaaccaggguggagucugccuuuuuuuuuuuuuuuuuuuuuuuuuuuuaccuucagugcuggguuuuuucauuucuuccacccuaauuaguuucuuucugacucugcgaguggaguuuaccagcuuguguaaccucuuaaacuucaccgacuccucagucucaucauccgauuguucucuugacuggcaaagaaacaaaggaaaaaguuaaucagguaauugcuccgagcuuugcccguguggcuggauguagccggccuugcugccagucugaaccucggcagcucuguugcugaacuugggaaccaacaaaaauuugcccaagagguuuacaaagugccacauaccaucuuaagaucuaaaucggcguagaauuagguccuaggcacggaaacacacauccuugcccucaagggcaagugggggcaaguggccugugggggcaucugucucaacuacuuccuuguccucucuuaggaggacuccagcaggacucucccuccgaugcuggcccuguaauuccaguuucacugcugugguuugggccaggcucucaucugucuggcccaucagggcuugcuguuuaacguggucaucaacuacuucuccaaaccaaaauucuguuggcuuuuuccagcccucccccgaaaaucaaaaacagcagggcaggaaagggaaagagaugcaaacagccucuuccaucccauuggcuaagacugucugccacauugcagccagcccuuccgccucucccggcuccuucuaagggcucacaaggcgaaugugaggacagacccugcauuccuccaagagagacaagggaaaaagcugaccuuucagccauacaguacaguccauauuccccagcagcccauugcacuuugcagggagucagcaugcucaggcccagcuguuuucccucaaguaucaaacauuacagagagagggaaaaauaucucucucugcagcagugacccaggcuaaaaacaauccuucccuugugaacaaaaugaggguuucauuucuaagucagcuccaacauccaauaugcagcuuccucuguuguaucuguucaaaaugugaaacagcauaagagaucucugacuaaacgagugugcaacacgggugcgugggcaugccugggagcagccgccucggcacacccugugcagugggugagcaauuccagcucacgucgcacgcccugacaacaaccuucucuccauuuccuccaacccaguucauggaacaguaggaagauaaaugccucaaaugaacacacaaaacaaaaacaagccucaucucugaauacaaaucuaauguagagacuuuucucccaaagaaaagcucucacuaaucccaguguuacagacaauaaaacagauaagcaagaguugcagagaauaccucaagagaagaagaaguagaguuucuaugcauuauuuaggcauaaaaauggugcacguugugaguccucuuugcacuauggcacgaacauuaguacaaggauaguaagggauauaaacaacugauguccuggccucuguccucacccuggaacucaaggcauggagccaugguacuuucucccuguaugacuaucagcaaaccguuuacccacuuaugguuaacuauaaaccuaacaucagcaagucaucaggacagaaguguuucucagacuucucuucuguaaaguguauuaauaucuauguccaauuucucuaaaauuacuagauaaaauguugccugcaagugucagaauuaaagcuaaguacugguuaccuaguaauaaagaaugggaacuggacucccagguaacgguggggacaggcuacacuggaugcugacaauuaggcuuaaaacuaaaaauauaaaaaauuagaauaauaaguguaguucauaauacaaaaugguuuugucugguuugaguuucauuucuacuugguuggauuguugacaugugaugaaaugguuggagcggucaaccagaggaaugagaacuugguuaacccucauucuggguaacaagcaccugaaaaacccacaguucauggaauuacauauaaacauuuaaaaacauucugcucucuugauguagcucaaaagccaagcaauucuaauagaagaagaaucaacauuauguuauagaaagucucuauaacuaucaacgggacaaaccuagaauaugucucuaauccucacauuuaaaaauguugaaaucagcacuuugggaggccgaggugggaggaucacgaggucaggugauugagaccaucccggcuaacacggugaaaccccgucucuacuaaaaauacaaaaaauuagcugggcgugguggcgggugccuguagucccagcuacucaggaggcugaggcagaagaauggcgugaacccaggaggcggagcuugcagggagccgggaucgugccacugcacuccagccugggcgacagagcgagacucugucucaaaaaaauaaauaaauaaauaaauaaauaaauguugaaaucaaaugaaaaugaaauagguacagauuguuuguaaucaaaauacaagaagcuguguuacaggaugaaaauuacugauguguauaccucauaccuaguuugcugguuggugguggugguguggguguguguaugcaugggacagugggcaguaagagaaaugggguauagaaaaaacuaauacaaaaauuuuaguccacaaagacacaaaucauuauauguacuagagugaacuuuccaaggagaaaucaaaauaguuaaacaaggacaguagauuuaaaggcaaugccuuccucauaaaauccuacuuuccucugcccagauucacuguggcaaaaaguaacauauuccagguacuuauuuaauuguuuucacauguuccauuuauuuuugagaaacacaccuuugaauuauaccuuugaauuauacuucuuuguaccuuugaauuaaugcuauuuuuauuuuucuagaaaaaucaagauuuggagguguuugucacugacaaaucacaaaccauggcaaccaaguccuucuuuuccaugaucauuuuuuggacgcuagacaagauagaugcggcacaauuuauacgaagaaaaaugcaauauaaaauccaggucauccaagguguguguguguguguguguguguguguguguguguguguguguguguguaauagaaaauuaaccuagaagucagccuagaaguuacuugaguucaacaaccuaucccaagaauguauugcugcauccaugauauugauggagagguguugacuucucacuuccuacugaguccagaggaaaaaagcguugugaaauauuugccuuuaaaaaauucucuccagcuguuuuaacacaaaaacgcuguaaaaggcuugcauuucuucuaaacuggagaguaaaucuugaauuccucaugucauauuucucuuuuuaaguauauuccacuucccaaaugcugaaaauaacacagcaugucuuucuuuuuuuuuuuuuuuuuugagauggagucucgcucugucucccaggcuggggugcaguggugcgaucucagcucacugcaaccucugcguccugaguucaagcgauucuccagccucagccucccgaguagcugggauuacaggcacacaccaccauacccagcuaauuuuuguauuuuuguagagauggcauuucgccauguuggccaggcuggucuugaacuccugacucucagguaaucugcccgccucagccucucaaagugcugggauuacaggcaugaaccaccauggcuggccagcaugucuuuuuauucaggaaauacaccaccagggaugggggcuugagaauuuuuauauuuauaaacauaaaaaauauauaauuuuuaaauucaaauacuauguauauuuuaaaagaaaucuuccuaugugaaaaacuucguagaagauagaggaaaucugcauuguauauaaaauaaaugacugauucuaagaaauagguucagcacuguuauagaacagguuuuaaacuaaaguuaaaaaauaaaaguauauauucacacacauucaaacaugagauaguguggccuccccucccuugucccacccugggucagaguuaaacagaucaucuucucagugagaaggugaacucaaucaucuguaugacagcuccucaccagaaaaccuucaagagaaaaaggcaacuuaucccaccaaaaauuguggaaaaguggauuuccaauauuguaaacagaaacauuugauuuccagccucuccucugcagauuuuuuuccagcagaaagcccauauggcucaacuuuuaauuacuuuggcuaaugcuauauguaguaauucuguggugaaugcuuaaguguuucauuucugguuuccauagcaacauuacaucagauugcagacagcuggcuccacaguuuuaaaccauaacaaauugaccaagccaagacacaaaacuauagcugcuuuaaagagauagcacaccauuugccggccaggccacugaaugaggaaccuauggggcccgucuggcacccggaggaggguggagccuccuuccuucccagcuucuuuuggaacaagugcauccuugacacaucugcaauguucuaauaggaaagacauggagccagcguggagaacuuuuuauaacacagcuacacgcuggaugaucagaaaaaaggaacaaaaugaauagcaucugugaguacaaacauuugugugccggagcucacuaaaugcauccucucccugcuccaaguaaaccugucacugcuggucgguaacagauacuucaccggacccuguaacaaacaguucuugggacugcagugugcagaacaaauccuuuccaaaagccauauggcacaguugugcaagcacaauggcaauaugcuguaauaaagguuaaaaccaauuugcaaggagcaacuagacccuuuggaggaccgcuugagaccaccacgcugaucacaggauuacaacugugcccucugcagaagcacuuucacucagcuuguuucccuagcucgaaacacacgacacgcugucacaauuaacacccagacuaagcccacucaucucccccagcgccacguaacaccgagagauauuuaaacauuucugaaaagcaauuugaaacuggaaauguacuugccugugaaauucacacacuggucucucuaaccuagcgcaugauuagacauacauacuucagcuuucuaggucggcugugucacagcguuaaucuuaaacuuaagagaaggaagccaaucagauauaagcuuaugaaaagcaaugugcaacacugucugaauucaaguccuccccaggaaaagccuccacaauucacagcugagccauauaugcucauugucucaaauucucaaaacaauacucacuauucucuaaaaguuacgcauuuucacuggugaaaaugccaggcaaaaaugcucaggguuaccagguagggaaguaaacaggcgaagaaggacaaaucuagaggaauuuaagaagaaaagagagagaaacaucauaggcaggagcagcaaaaacuuuuacuugaagcaacagaaaacacauucuuucuuucccauugaacgcauucagugacuuaccggcuucggcauuuagcaagccuaagggguaauucugaagacguccuguaccucccaccccccuccccacucggagagcgucuucacucuuguagcaucaaacuccgcaaucucaaaauuaagauuaggcacuccuggaacaugucucucuggaguuacaugaucaggcaggcuccaccgucacagcucaguauccgaaggagaaaggggaagacacuggauucaauuagcuucuuucugcuugcugacugauuccccagucgcuugcuaacugcauaacucgcaagaaaggcauaagucaucagcucuaagcaaaucuccuauucaccacaaggaaaaaagggaguguugugcauggccaacaaucccuguuuucacugaggaaggcucccugaccuccugcuggccuccaguuccuuaauuacugucuauggaauuccagagacagaaaaaagaacgcgagaaucugagcaaauccaggacaaggaggacaaggacuaacccuuaaaagugacugaacuuaaaaaaagaucucuuuuucagacauucuucugaacacccccuuaagggagcagucucaauugaaaauagacaccuuccaauggcuauuuuugaaauuacugaauuaaaacuuaugauugugguuuucuccuagaguugucacuuucucucucucuccccauuccuuuuuaaaauuuuaacaaccaggguaaauguaggauauuuccccuucauuggugcuucuaaagcucucuuaacaaauuguuuuaaugcccauuucagagcauccgaguucuccugcauucuagaaacgugagcaugaggaccgugucacaagaugauuauuuaauuuucucaaggaccucaggggagccacuaggcacaugcuguuacuuaaaaagaacaucaucuaaacaacacaggacuaaaaacccacacaaagucuccaugacgugggcugcaagucacguuugucuuuucagggcuaaguucauucacuuggguaagucauuuauucucacagcacaaugugaguugcuuguuucuagaugucccuccuguugggugagucuucauguauaaugcucuuuauaggacaucacacgacauaaaauaccuagcuacacaggacucagggaugcguaggaaccacugucccuccuuaaaauggcagaaguuuagaguuggacaggauucagagguuaccuaaacuaaaaacggccaggcacaguggcucacgccuguaauuccaacggaggcgggcagaucacuugaggccaggaguucgagaccagccugggaaacauggugaaaacccgucucuacuaaaacuacaaaacuuagucaggcgugguggcauacaccgguaaucccagcuacucaggaggcugggauaggaggauaaauugaguccgggaggcagaggcugcagugagccaagaucgccugacugcacuccagcuugggcgacagagcgagacuccaucucaaacaacaacaacaacaacaacaacaacaaaagggaauuggaauacgaagcucccaaguggagggucauguuuuaccacgcacacauugcggguucugcaucagaucaccagagcuccauccccuuuuccucggcucuuguccugcucuucuucccugggcgggcuggcgucucucacuccuugccaagaauuaaacucccuucucccacucugucuucugcucagaaguaucuccucccaaccuuuauugaauuuccucuucuuucuccugcaaggguucaccacaccuucccuacacugcccaauuccccauuucacaaacugauucucccacaaacuccccuuccccugccaccaucugacggaccaggugcuuuugcgauguuguacuuccaacacuuguauuuguccaaagcuuagcauucccaggcacugugcuaaacauuugcauacagaccccauuucacagcaauggcaggggcagaaucugagacuguaugguuuugcuccugugccacuacccuaccucaacaagaccuuucuucauccaagacugacaacuaugcugcaaaguuaugcucacaguuccuuaaaacugaguguagacauuuuccaccaaauuccuucguuacaggauaaaaacgaagaaaaugagagugccccagugagacugggguaaagggaagaggauuagcccaaggucucagggguuagaaaaaccuggguuuaauuaccaaguucucuagcaaaucacuuuacuuuuaugggucuuaauauuccugcacauaaaugugguauaguagcacuuuucuuacguugugguuguauuaaauacugcguaccugaaauccuuacugaacuggaguucaauaaggacuuaauauuuuuacuauuacuauuaauauuauuauuugagauggaguuuugcucuguugcccaggcuggaguacaauggcuuggucucagcucacugcaaccuccaccucccggguucaagcaauccuccugccucagucucccaaguagcugggauuacaggcacccgccaguaugcccagcuaauuuuuguauuuuuaguagagaugggguuucaccauguuggccaggcuagucucaaaacuccuaaccucagaugaucugccugccuuggccucccaaagugcugggacuacaggcgugagccaccaagcccagccuuauuauuaacucugcagucuucuauucauaacucacuggaguucaaauaacaccuaauuuucacaaacuguucuuuuaggugcuguguaaauagcaaagaccacuuaaaaacccaacaaccaggccgggcgugguggcucacgccuguaaucccagcacuuugggaggccgaggugggcagaucacgagcucaggagaucgagaccauccuggcuaacacagugaaaccccgucucuacuaaaaauacagaaauuagcugggcgcgguggcucacaccuguaaucccagcacuuugggaagccaaggugggcggaucacgaggucaggaguucgagaccagccugaacaacauggugaaaccccgucucuacuaaaaauacagaaauuagccaugugugguggcacaugccuguaaucccagcuacccagggggcugaagcaggagaauugcuugaaccugggaggcagagguugcagugagcugagaucaugccacugcacgccugggugacagagcgacacucuaucuccaaaaagaaaaaagaaaaaaaaaaacaacaacaaaaaaacccaacaaccagccaggcacaguggcucaugccuguaaucccagcacuuugggaggccaaggcaggcagaucacuugaggccaggaguucaagaccagccuggccaacauggugaaacauggucucuacuaaaaauacaaaaauuagucaggcauagugcacaucuguaaucccagcuacucaggaggcugagacacaagaaucgcuugaaccugggaggcaguggcugcacugagccgaaaucgugccacugcacuccagccugggugacagagcaagacuccaucucaaaaaacaaaaacagaaaaaaccaacaaccuuuuuacgugugaaagcuugucauauggccagcaucugaggcugguucuggacaggcuguucagauauagagaagacucugagccaaugcagguucagauccccucugugccacaugggaagagccuguggcugugggcauguuucuucucucauuucuaagauaggcagugagaagccuccuagggcucucuagaggauaaaaugagaccuugaaugugaagucuagagcuuggcagguaaggaagcccucguuccaugugaaauacacaugaaguucaugcacugauuuauccagauacuuuggggaggguggcgggaaggauacauccccaguacuuccccugagcggccucuccucacagcacaggacuuggagaguguccuaagaggaugggagagagagccgaccuuguccaccccuuuuuaaccucacugccacgccucucagggagucauucagguauuuaucaagauacucgauguugggcccuuugugaggacguaccauggcuugacuuucagaaaacaggaggcuccccgggccaggagccuugucugaucuccugcuccuugcauuccuagugcccacccauaaauacuggugcgaucacuguggaaugaagaaguugagacuccccagcccuguggcucucagcccuggccaugugucagaguaaacugggggauauuuggaagacuagacugagccaggccacccuaggaagcucccuggugagggacagauugggagauagacuuugugagggaaggccacugcugguccuguucucuggguggcgggcuugaacacaguagaugugcaaauuugcugagaagggacuucaguauuugacuccuauggugaggaauugguccucauuagcuccuuggaacaagguccaaaggccuuauaguggaauaugugacugugugcggucagauucaguuucugguacauugugcuccacucuucagauaccacgugguagaaagggcaccagagcacccggucucacccccugcuuccuugcagcaucucaaacaccccaugcccaucacugcccugauggcucaucuucugcaaacagcucugcugauugcauccacaccccuaacuccuaugcauccuucaaguuucagucugcauauugccuccucuggaaagcucuccuggcuuugcuccucaucuaccuuagacuaaagauacuuuauccaaggacuucacacauauauuggcauugcuagauucccuagcccaucacuaacugucaugcagacaauguacaugaccauauucauuuccacaucuguauguuaguagcauuuauuguuucugacuacacaugacauauauuauuaaaaauuuggagaaugcaaaaaugcacaaaguaguaagagaaaugacguaucaucccauacucagaaaacuugguaauauuuugguuuaugccuucccacuuuuuccccauacacacacauaugcacaugcacacacaaaauacacccugauguuucuguauguuucuuuuuuuuuuuuuuacaagaaaggguuaucuuugaucuuuaccuccuccaacuccucuagucacuaucaguguccccaaauccucccucaaaugcacacgcacagucuaaguagaaauaacacauuugccuguaaguggggaccuucucugggucacggcugccucaaaagauuuuccuuuagagaaaccccaggccccuggugugcaccguagccacacuguuucauagcccauuuuuuaaagcuguauguuuugaauauuuucgcaugucaagaaauagucaauacaauacaauguauuaaugaugcaguaguauuuagccaucaaaguauaccauaauuuacugauaucauggucccccguaauuagacauuugccuguuuccaauuuuucaaauaauccuuggaugcacacuuugugguaaaauuucuaacaugucuaacacauucuuuuuuuuuuuagaaagaugacucgacuguagaauugacggguaaaagggugugucuuuaggacuuuugauacauaucaacaacuugcucugaaaaaauguuguaucguuuuaaaaucucaggagcaguuaccaacacugagaauuacaauauucuuuuccacuuagauaaauaaauaucuauguuugugcuaaacagauauuuccugauugaaaugaacaaaugaaugaaugcacugauucaaggcauuaggaaaggcaaggaauagcaauaggaggaagccagcauucccuggguuuauaaagguuaucaucuagacgucugaggguagggacagccccaagagaaguucagaaauaugauuaauguuaaggucaaccgcgacaaccgcaagagaaaaacacagagauauaggaauuccgaugugggaagacucaucucuggguaaggaaauugaggcacacuuccgugaggggaagaggaaacugccauggguuuagggauauuuccaugucccuacaugagccuaguccaguauuuacauggcccuggggcccuacuucucccacccaccccaucccaaccuuagaugcccuccuaucuagacaaagaagagcucagcugauguuguugcuuuuauaaacagcaugugacaccagucaacaggagcuucccggcccuccucuuccccaagcuugauuucauaaucucuccaacugccugaucucccuccacgguccaaaaagugaagcaccgaaagucccucccuaccucaggggcacugcacugacucuggggccguggcagaggccuuuuggucacagucaucagguuaauguguuauucuucguauuuagaaaaaaauuagucucacuguucaaauaaguuagaguuacuugaaaguguguuuaugaguugcuagaaguaacaguagaaaauaugaaacacacuguggguaaguuuuuuuuuucuuuuaucacaaaggagucaggggaggacucaucuguuuaguaagaaauauuuugcucauuagcuggugacaucauugcccucugaaauuaggagauuuugguuagcauauggaaaaaaaaagaugagauuccauucuucucccagagguacaguggaacacugaaauaaucucucuggcaguuucaaaauuaacuaguuguugccagauuugaagaaagagacggaggaggaggcggcggcagagagaagaagauaauuacaugauaguuuuauuuggaaaaaguaugugagaauuugagguaauauuaccauuccuuuggggcaaaggcuugucagcacuuaauucacuuaagaaacugcuuuaaaauuuaaccauaaaaccaaaggagcagcaaauggauguuauguucccuaaucaacugcaaucuauuucuuaaacucaugaacuuugaaucguuuuuaaucgcccccaugaggagaagggagaaaaauacaaaaucucaggaguccuacagccagaucuagggagacauaaaacaaaagugaauccucccaccccaauucugcagguugccacagagcagagaaugccuuuccuccugaauggguggggggagagagugguaaguagaggcgagaggacuggcuucuccuucacucuguaaaucuuuggaagacauuucugccuggggcuuugucacccugaccauaggucagagaaacguauuguuucauauuaaauaggugaguuaggaaacaaaguguugggaagguaaucuacagcucuacaggucccucuguucagagugggguaguguuauccagagcaaaucuaugggaucagacacacugaagacuaaagcaaaacaccaaacccacucauucccaagggcauccaauucucacaugccauggaaaaaggaugauucagaacaggacugccaaguagggcaauuacauacgcauuuaaggcgcuaguuucuggagcugaugaaaguguucaucccagaagccguaagucuccuaagggauugggugguguuugcaaagucacauuacuuuuauggcaucuuaggcugaaugacucauguaucaggcacgaugacuucuccgacagggcugccaaacaaccuugucuaggcaaauggcaauguagaaauacagagaacugauggagccaaauggcaauggagggaaggugggaccaccaagaccauuccuccaagccaaacuuaugccaccaggucaguggucaucugucgaagcuggaggcaggaggguccaauguuaccuccuagacugacgaucuacaaccuuaacguuaaucuccuucuguuugcagaauaaauaagcaaauuuacuucaaguuccaaauugaagaaaucuagacuaaauaccuucagagaggaauuauuuagagcuagaaagguucuuuguggucauccaauuggcaaaacaaucaggucaugaacucugcugaacacugaaccacagaauauucuucucacaacgacuaacaaaaugagcaaaagccccccaagaagaaaaaacaaacaaacaaacaaacaauaaaacacuaaaaacuagcaaaaauauugcgccaagagcaaccaaagagagaaagcuacauaaucuaauguacuaaacuccaugacuaagguaagaaacaaauuucugaggcccacuggaaaaggcccacaacuucuacaaaagccaggcuggcaggaauccacagaauccuuucaugugacuccaaaucuggaaggaaacugugugaccucuuuaucuuuuucugaccuaacagcaguggaaauggcuacagaagagcaaugagugaaacgauggaaagucaagugagguuguucuugauugaaauacagucucuaaaauucaaaaaaugaaugaaaggcagaauggcuauguucuaccaauuaccccagcuaugaaccagguggcaucaauuacgauacggcacauucaacacaguuucaggagagaaaaggcagaguccagcuaucccaaugaagaccacauuucaccauauaucauggccagguuguagcaacaacaaacauaaauggaccacaaaaugaagcccucaacuguaucuugaaaggagaaaaaaaaaaaaaaucuauugucagauagcauggcaaacaggucaaaacauaacccucaauaucagcacaaauggagaacgugaucagagccacccaaacaggaccaaggacaugacaacuauacaaacaaacuacggcaaagagagggggaaaagaagaagcauagauaaaaacaaaaagccaaucuuugcucucaucacuucaucaucucaacucaaggaacaggaagaaauuccuaauaguugcuucucucuauaaaauaauuuaauaagaacgugaauucaauuaaaugagaccucaaagacaagauaaaaaacauaaauuauauaaauuuaaaguuugcagaaauaaggaaacaaccuauuacagaaccaauuuauaaauaaaaauaaguaaagaauagaaucuauacccuagaagucaaaauacugagagagagaaaugcuucauauuacuugaccuaauuuucucauauuacccaaguuuuccgauuuacucagcucuucaucuagaccucugacuuugcugcugccucuccugacacacauuucuccuucuccuggaaagcucuuccucagugucaaccaccuucucugggaaggcucccagacccucuuugcuggggcuugcuggacuuucugugugcaccuaucacaauaggcaggaaaaucucaaugaaguccacaaccacgccaucuauuaaucuaauccuuuucucaaacccaagcucccuguguacaaggacuggcacauaguggguacucaauaaaugcuugcacauaaauaaaugaaagaaugcucaagauggcauuguuucaaccuacacuuugguucaaaugcucaguguaagaagagauuugcauccuuuuauaaacuaauuaugugaugcuauuagcauaauacuaauaauaaauauuagagugaacauuagaaaguuaguaguguggugugguacaaagagggagaugaacggcauagagaagagaauaaaaggauauuuugauagaaauuauauuguaaaaaaauuugguuguguuaaaauauugcuuuccaaaugauuugucucaugacugacuaucguucuaagaauuuuguugcagugagccgagauagugccacugcacuccagcuugggcgacagagugagacuccaucuccaaaaaaaaaaaaaaaaacaaaaaaaagaauuuugauacaauggguaauugugacaacauucaaauggacucaaaacaagugaagggcaaccuaugauucuaauaagcaggcuuagguuggagauggcccgcagucuaaauucuacuuacgaauaacaauagugccuggguaucuccccaacccauccauuaaauaaggaccggcgcuagggcaaaugauuuaacaaggaauugacauguaaucaaucaguaacauugaacaaguaauggaaauccucuuauccccaacuuccccagcguuguucccaagagcacaauaaaaaacugggauugcaaacugaaaugccaaucucuaaaccaaauuagauuacaaauaucuguacugaaauauaaucagcuagcaggggaaauguggcauauccucugugguauguauguauuagguuggacaaaggaaaucaccacuuuuauaggucaaaagcugucuaguaucucgaguuccacaagguucaaccaaaugaaagaaacagaccaaauuguauccguaaucuaucuuaaauuaauuuuuuaaaaauagguauccucagauuauauaguaucuggguuauuuugucauuuguuuuuaucaauguggcccuugauauguuuuucuuuuucuuuuuuuuuucuuuuuuagagacagguucuugcucugccacccaggcuggagugcaguggcaugaacacagcucacuacagccucguucaggcaauccucccgccucagccccacaaguagcugggacuacagaugcacacuacuaugcccagcuaaauuuguuuuuuuuguuuuuuuuuuuuuguuuguuuguuuuuguagagaugagguuucaccauguuggccgggcuggucuagaacuccugagcucaggcaauccacccaccuuggccucccaaaaagcugggauuacaggugugagccaccacgcccagccagccuuugauaugucgaggaaggccuccaagcagcaagcacccucaacuuccugaaacugcagaaaucaguaaugauaaagaugugccugguuaguucccaaagucaaagagccaaaugggccugccaugagagugccuuccgacauaacagguauggaacacacacccacacacuccaugagacgacgucaucagcacuguagggcccuagauuauuucaguacaauaacuacuuacacuucacagacaguacuaaguccaaacaugcuuacuaaaaucauaccagacccacccuuaaacccacuuacacaauaaugccuucugaaauagaaaauaaauugauuauguguuugguaaaaguguaaccaaguaugcacuuuuacauuaaguuuguucugacaauucuagccuaucugcugauacaugaauauaagccauuacuaccauguuaauggcauguacaaaaauagcacuuuuaugggaacucaaguauuuuaagaaugacaguugacgggaagggcagaagaucuucacaucaaauaacaaagagaugaagugccuggccacagauacagagcuaauaggugggagauuuggaucugagccccaggucugacucaagucugagcuuaaccagucuccucucuugcccacgcagggugaaggccugguuuccagggccuaguagaggcaacagcuuccuucuuguguaacuuuguggaaacauggugaucuuagggacucaacaaauacaugccugaaaacuuuggccccugucccagagaaaagacugggaaugggagggcagaagagaagaagugacaagaagccaccuaagcaauggcuccugggcagcuuauaaccagacggaacaaaacgggcauuucucaaaaccucucacuauguauauuuuuccaauggacugauuuuuccuuuagucucacccuaagcuguagauuaaaggaauuauuacuuuuacucuuuuaguaagaacuuuaauauauucuuauuuuacuaucauuuuaguuucagaaucaugguuuuauuaaaauacagaguaauacuuccuccuauaaucuccuacccagcgaaauaaaaugaaaauuuauaagaauuauccauaaaaaucagaauaaucauaugaaggucucaaacacauuaaaagacuaagaucaguauacauuauuuuauauuuuuaaaaaauuuacuuuuuuuuuuucuuuuuuuugagacagggucucgcucugucaccuaggcuggagugcagugguacaaucauagcucacugcaguuucggccucuugggcucaagaaauccucccgacucagccuucugaguagcugggacuacaggcgugugccaccaugcccggcuaacuuuuuuauuuuauguagaucccaugcuggucuugaacuucuggccucaagugauccuccugccucagcgucccaaagugcuggcauuacaggcaugggccaccacacccagccaauaaaaguuaauuuuaacauaguuacauguagaaagauuuuugaaaaggguucaucuacacaagguaauacugcaugcaucguauacagaauugcugauaccuaucccaaggauacagggcauaaaugccuucugauaaauuauugcuauguuuuguuucuucuuucuccuggucauauuacaagucaaacaaguaaacucuucugugugagaaauaaagaacugaagaacaugagccuaagacaacuauuagagcuuuaauaaguagaaccauuuucuagcuguaaaccaaaaagcaucuugccaauuagaacccuuuuaaauuuaaacccacacacucagaguuaugaaaagaucccuuaggaaaagagaugcaguggaaaaaaaaguaaacaccauuaaaaagcaaaacgcuuauucagaaaugaaaguuauuuuuauacuuggaaucuauccucucuuaaacuuccuuaucaaacacgccuauaauuccagcacuuugggaggccgaggcaggcggaucaccugaggucaggaguucgacaacagccuggccaacauggugaaacccugucucuacuaaaaaauacaaaaaaaaaaaaaaaauuagccaggcgugauggcgugcgccuguaaucccagcuacucuggaggcugaggcaggagaaucgcgugaacccaggagguggagguugcagagggccgagaucgugccacugcacuccagccugggugacagaaugagacuccuucucaaaaaauaaaugaauaauuacaagaagacaaagacaguagaaauaaaauccaucauuuucuuggggauacuuucaccggaccuacaacgccgacugaaguacuacaguaugugucacucuucacauaauuuaugcaucuaaucaauauucacugccauccaagucagcaaaacuauaaaaauuguacacauuuuuuuagauugcugggaauauuuauaggugggagcagauuuuguaaauucaucauaugcugccauuaaagaaaucuuugcggucagacuuuuccacaugaugaagcuaaugauauagguuuauauguuaacaccuuugaaauguaaaaauaaaacaucugguaaauuuuaaccuagugucuaaaaguuacucuaguaaaaaauaaaauaaaauaaaauucaaaauaaacacagcaagaauagucaaccuuuaaaauuuugaguugagcucacaauagcagauucuauaaaagacgacagugguuauacaaguagaaggaugcugccacucugcuccaaaaagcagugaaaucacaacugcucaggccaccuuaugagugugugcacuguucuuccgccauauucuauaaaaagggauuacacuguuaaccuuuucuugugucauaauggaaauuaagccauuugccacaagaaccacuuaaaaggaacuucugccggugcccuggcuuucggcacauaccagaauuguuauuagcaaauuaucuuucagaauguucuauuucgacuagggcugugacuaccuuuccuuccaaaacuucgaaacuaaauccucuggcuugaagacaaugucuguuauugaggcuggugaaaggacauugaaaacucuaaguaaaaccuggccacuggagaggcacauguuuaugguuuacaauuuuagaaagucccaaaaagauuuaaaaggugccaacuaaaagaucuuauaaucuggggauauuuuaguugagaccuuggaaguccucaaucaaggaaacauugaaaauagcuccacggcauucugugucuguggcccaaaguuuuggacacaguucaaccacauggcucucucuaccucaaaccaaauuagugacaaaaauguacauaugguugaauggaaggcuaugaagagugcacacauggagguaaggugguguuauaaggccacaagcccacaguuauaacauucuuuuuuuguuuuuguuuuuguuuuuuguuuuuuugagacggagucuuguucugucgccaggcuggagagcaguggcgugaucucggcucacugcaaccucuaccucccggguucaagcgacucuccugccucagccuccuguauaacauucuuugcacaaauauuucccaacucuaaaacuccccaaaagcaaaagugaucaguuaugaaacgaugacuugcuuuacucacucaaaacaacauuucccuagagguccuccauccugguaaggaacuccagcuacagaaacacaauuccagcuuuuccuggaacacauuuugcuaugaagugaaaaaucuacugaacgguaaagaugacucuagcccaucuugugcuuuguugucaugguuguugcuuucauuuuucuucauacauuauauauauucuuaaaaaauuuuaaauaagauugccaucaaaugaccuuucauuuggaaagaucuuucacagcaaacauuuuuguuaauauucaaguaccagguauagaucacuaacucuuacccaccagcuuucuaaaaacagaaaaaccaugauuuacaacuuacauuagcaaaaaacuagaaaacccgguaaaacagagaucauaauuucuuuaaaugucuucuuaacuagaaaauaaacugaaucuuagggcacaaagcuugagaacucuuacaaucaccccucccugcaggaggcaaaggaaaaaauaaacuuaccaaacuaaauuaaaaugaaaaauaauaaauaaaugugcagacauuuaauaagaaaucgagcuaagcucucaaccaaaaaucucuuuuaaaacuuuuagcacucccaacagaaguuuauuauuaauggaaaacagcacaaaacagauucuucucuggcaaagggaaaucuauuuuucacuuccccugguaacuaucuuuaguacuuuacacucuuggaaacuaggaaugugcauauggauuuauugugaggcaacacgcgauuaucuaauuucagcgauugggguggggaagccuaugaaaucaaugcaaaugaaauccuaaggcaugacaggcaucaauauaggcauugaggucuggugacaaaggccuugugaucccuaaaacuuucauggccugggcauuccugauucgagccagugggcuauucacaucucuguauucuagaaaggaaucgauagaaaacagaaaagcuccggcucuugcacaaaaaauauucaaagcgccuauaacccgugguggcugaauucugaaauuaacugcucugccacagaggaaaaucuaaaauaaugagaaugaauauuuuggaugggguuucuggccaacucuucauaaaaaugcagaacaggcuaaagccagaguaagaggggcaagggucauauauauaccuuaggauuacaaucaaguucaagcaaacuucaguggugauggugguggguuguagcucugaacagcaugaccagaggugggcauggguguuggcagaaagucagcuagcaaaauacacagaguaaaucaacugcuucaaaaaacugcauugcugacuagccuaucaucaccuacgccucucagccaaaagagaagucacucuucagaacuucuggaagaccgugcucugagaggaggaagcauaugguauuucuggcccuaggucuaacuaagacaggcugaauuuauuugcgggccaucuaugaagaaauaguuugguaagaaguuaguaaugcaaauguguauauggcaucucaaaucugugugcauacacgagugugauuuuauuuauuuauuuauuuauuuauuuauuuauuuauuuauuuauuuauauuuuaugagacagagucuugcucuauugcccaggcuggagugcaguccugugaucuuggcucacugcaaccuccgccuccuggguucaaaagauuuccuugccucagccucccaaguagcugggacuauaggcacagaccaccacaucuggcuaauuuucuauuguauuuuuguagagaccggguuucaccauguuggccuggauggucuugaacuccugaccucagguaauccgccugccucagccucccaaagugcugggauuacaggugugagccacugugcccugccacauggaugugauuuuaaccucugcucuacagcauaaacugucagaaaaggaccuuucucuuucuccuuuacuuuuauaacucaaacaucuagcacaaugccugcuauauagcaagggcuccauaaacgucucccaaaugaauaaagaaaugcugaagagaaugaaauguuccaacuauuaagaagaacccauuucauucucacaauuuauaucuagcuaaugguucugaccagcccucugaaaggggucucauaaaccaaugcuuaauaaugcuuucuuagcagcuuguucuaaaugcuugauaauacuuauauuaacuuuuuccuaaacaaaacaagcuucucucuuugaagucuaagugugugagguuuuacuacaguccuguuucucugaauggacaaagucuucuaaccucucccuugacucagaugcuauuaaucagggcaguauacagugggucugauacuaagggacccgguauggacaacugggucuuuguuuucucccccaaguuggguuugaaucaguccugaguuacuguauuuauuucucaugauccuuuagguucgugauuuacaucuauauuauguuagacuucaggacuugaggauuagagacccaaaaaggcacauugauaaccauggacacggcucuuuugauuaccucaucgucccgggacacacugcuggcuggccuaugacacauuuauuauuauaaacgguaaugucucagucacuuucacacaaaaguaaaccaggcagggcuuucagauucauaauccuuuguuuuuuagcugcaguggaaaucuggugcuugauucaggaaauugggagaugaugggaggauuauauuuauuucugauaaacugccauuuguugcuuagauagaaaaaaagguaaagacugaaucuguaguugcaagacauaaaacaugcucuuaaggcagccaggaagaaugaauguucaggccaggugcgguggcucacgccuguaaucccaguacuuugguaggccgaggcgggugaaucaccugaggucagagguucgagaccaaccuggucaacauggugaaaccccaucucuacuaaaaauagaaaaauuagcuuggcgucguggcgcaugccuauaaucccagcuaaucgggacacugaggcaggacaauugcuugaacccaggaggcagaaguugcagugagccgagaucaugccgcugcacuccagccugagcgacggagugagacuccgucucaacaacaacaacaaaaaagaaugaauguucaaauacaaugcucuucuugaaauauuucuauaggagcuggacauuggagagacaaagaauacagucuuucuugcccaagggggucacuauuuccaaggaggcugaaauauguacaaccaauuuugauauucuaggauaauucuuuaaguuugaucuauaaagccaguuuaacaaaagcacauaauagguagcaauaaauacgcuugaggacgggaaggaaaguuucagagagcaaggaacaguuggacuccaccuugaaaaacucagauuuuuaccaggaaaauuuuggaggaaaacauuuuagauaaagaaaauuaugugaguuaaagggcagaagaaugaaaaauacaagguuuguucagucaugcauaugggguccaauaugucugguguauaggcuauuggguguggagauagaauaugagauuuaagaaauugauuaaagccagaucacauagaauuuuaagugugccaagaaggguggaauuuaucuuauagaaauggaaaaccaucagcguuuucaaaacauaacugcaagaacagagggauguuuuacaaagaugacugguuguauggaacauagauaggaaaagacaagagacugaagacagggagaugggguaguuuccaaauuuuaaggaugagauaaccuaaaaaacaaaacacaacuauauaauacgugaaaagagguaauuccuucuguuucugcuccacacauugugaagauggcacccuacaauguuuguaugaggccaggcgcaguggcucaugccuguaaucucagcauuuugggagcccgagguggguggaucacaaggucaggaguucgagaccagccuggccaauauggugaaacccugucucuacuaaaaaauacaaaacuuagcugagugcgggagugcacaccuugaguccuaacuacucgggaggcugaggcaggagaaucacuggaaccugggagguggagguugcagugagcugagaucgcgccacuguacuccagccugggugacagagcaauacucuuaucaaaaaaaaaagccuauaugaaauucuggagccuucauuccuaucaucccuauggaacuuguagaauaagaagcacuguuuuggucauauugaaacagugugaauaauacaagguacguaagauggaaaggaaaaaguuaaauuauuauuauuauuauuauuauuuuuugcagaagacaugaucuuguuuucuuguuuuuuuuuuuuuuuuuuuuaaagacaggauggagugcagugguacaaucacagcuuacugcagccuuggccuucugggcucaagcaauccucccaccucagccuccugaagacaugaucuuauauauagaaaacccuaacacuauacacacacacacacacacacacacacacacacacacagccuauauagcuaauaaauucagcaaagugacaggauagaauaucaaugcaugaaaauccacugcauuuuuauacacuagcaaugaacaauuugaaaaaaauuuaaaaagcauugucacuuacaauaacaucaaaaagaauaaaauacuuagaaauaaacuuaauuaaggaagcaagacuuauauacugaaaacugcaaaacacugcugaaagaaauuaaugaagacauaaauaaauggaaagauacccuauguucauugacuggaagauuucguauaguuaaaaugauauuacccaagucaaucuaaagauucaaugcaaucccuaucaauaucccaacgauauauuuuucaaaaauagaaaaacucaaacuaagauuaauguggaaucucaaggaaccuuuaaauagccaaaacaaccuuaaaaaacuagaacaaaaucggaggugucauacuuccuaauuucaaaacuuacuauaaagcuaugguaaucaaaacagcauuguacuagcaaaaugacagagauaguccaauggaauaaaauagagagcccagaaauacaucaucacauauaugaucaaucaauuuucaaaaaguaugccaugaccauaaaaugaggaaaggacagucuuuucaacaaaugguucuggaaaaacuggauauccacaugcaaaugaaugaaguuggacccauauauuucaucauauacaaauauuaacucaaaacaggucaaaaaccuaaacuuaaaggcuaaaacuaugaaacccucagaaaaaaccagagggcaacaucuucaugauauuagauuuggcaaugauuuuuuggauaugacaccaaaagcacaggcaacaaaaaaacaaauagacacacuagauuucaaaauuuaaaagugugugcaucaaggacacuaucaagagagguaaaaggcaucccacagagugggaggaaauauuuacaaaucacauaucugauaagggauuaauauccagaaaauagaaagaaccccugcaagcuaacaacagcagcaaaacaacauaacugaagaccaggcaaaagacucagacauuucuacaaagaugauacacaaauggccaaugaacaugugaaagaugcuugagggaaaugcaaaucaaaaucacgagauaccauuucacaccauuaggauaauuauuaucaaaaaaguaaaacaacaaguguugaugagaaaggcaagaauuuggaacuuuuguacauuguuggcaggaagguaaaacgauacagcuacugugagaaaacauauggcgguuccucaaaaagguaaauacagaauuacuacaugauccagaaauucuaccccuagguaugugcuagguaugugcaaaagaacugaaagcagagacucagagauacuuguacaccaguguucagagcagcauuguucauaauggcuaaaagcuggaagcaaccuaaguguccauuaacagaugaauggauaaacaaaaugugguauacacauagaguggaauauuauuuauccauaaaaagggaugaaguucugauacaugcugcagcguggaugaacccugaaagaauuaugcuagugaaauaaaccagacacacaaagacaaauauuguauaauuccacuuacaugagcuauugagaggugucaaauucacaggggcagaaaguagaacgguggcugccaggggcaggguguguguggaggugggugaggcgggggcguagggagaguuauuguuuaauuggaacagaguuucgguuugaaaugaugaagaacuucuggaaguaaauuaugaugcugguugcacagcaaugugaauguacuuaaugaucaauaucauuaacaguaccaguaucacugaacacuuuaaaauagcugauaugguaaaugucaucuuauguauacuuuacugcaauuaaaaaaaaaaaaaacaaaaccccagcaugauaacacuauuuugacuguagaugagucucugucagguagagaaaauaagcaaucuauaugaacagacaccucuuugcagacccaggugcgagucggaaguuucgaaaagaaauacaaagacuaaaauggugaagacugucccuuaucggcguaggugaucaagaugucaaagacaugauaaacucacauugcaguuugaugagccaucaaacguuggguaagaaccaucuggccagucagcaggguccagggcagccgacugccggugcugggccucguauuccuugagcuguaacaagaagaaauggauacugaaauggaaagaauggccagacacuggccagaccuuuuacagggaaaugacucaaauaauacaucuagguuccugguucauaaucuugugcucacgcagcacagagaucacuuuggguaccuucuucaugccaguguugguaacuaaguaccagccaaagacaccuuucccaaaaccaagaggaagacaaguacccugcccuauggguuuucaucuaagucaaaucaacaggcaaaauggacucuuuguauccuguguuccagaaagaauuuucacuuucccccuccaacaucaaaacuucuguuuccucagccugauuauaaagaaauugucuguaauuuggccucugaauuaccuuuccaaguguguaagucaaaaacaugcaugcccuuuuuaggaagagaaaaugacagacuacagacauuuuagugaaauggggucaaacccugaaacauacacauauauauauauauauauguguguguguguguguguguauauauauguguuauauauauauauuuguuuuuuacauauauauaaaacaaauauauauaacaaauauauauauaaaaacauauauauaagcaaauacauauauauauauauauauauauauauauauauauauauauauauauauauauauauauuuguuguuguuguugagacagggucucuacucugucacccaggcuacaaugcaguggugcaaucauggcucacugcagauuugaccucccaggcucaagcgaucccaccccagcaucccggguagcuuggacuacaggcaugcaccaccaugcccaccuaauuuuuguauuuuuuuuuuuuuuuuguagagaugggguuuugccauguugcccaggcuggucucaaaauccuaagcucaaguguuccacccccucagccucccaaaaugcugggguuacaggugugagccaccauacccgacccugaaacagauuuuuaacaaucacauguuugucuuguucaaaauggcuucaaguugcuagucccauguuaucaccuaacaaacgugaugggguuauuggagaccuuugaggauggucucucuauugagaucuuagagauauuaaaaguuuagguucagaaacaagguuucuaguuuuugaaaaacacagaaagacaauugaaauccuauagcaggccaggcgcaguagcucacaccuguaaucccagaaccuugggaggccaagagagguggaucaccugaggucaggaguucgagaccagccuggccaagaugaugaaaccccaucucuacuaaaaacacaaaaauuagcugggcuugguggcacaugccuguaaucccagcuacucaggaggcugaggcaggagaaucgcuugaaccugggaggcagagguugcggugagccgagaucgcaccacugcacuccagcccgggcgacaagagcaaaacuccgaggaaagaaagaaaggaaagaaaggcuauagcaaagugagcagauuuacuuuuaaaaauuuuuuauaaugucuuuuacuauacuucccaaauaagugagcaaauuuaacuuagcaagaugagaucuuucagaauggcauaugugagagaguguuacacagaaauugagcucugggguucaaaacaauugucacugcauucaaacccuauuacaaagcagugugcacauaugaauuuaagacagugaucaaaucauguuccaugugccaagcaacuuaaaaacagaaauaauugaaccugccugcccacgugauggugacuggacaaucccgaagcccuggagcuugaggaugugguagcgccacuacaaugacaguuauugcuccaggaaaaagccacuuucacaacugugauuucaaccugcgaaauucuuuucugcauguaugugggaggagguaggcaguauugauuauugaguaagagcuugaaugcagaaccaaauaccagcugggaggccugaggacaaauuauuuaaccccucuauguuucgguuccuccaccuggaaaacaggcaugacgauaaaucugucuuacagagcuguuaccagaauuaacuaugauaaugcagcaaaacucucagcacacuguaucaaagcaauagaguuaguauaauacuauuauuauuaccauugugcuuucagagaaaagaaagcucaaaguucacauuaacuugacauguuuaaacuuuuggguauuagagguauuaaucacuuuaauauuuccauuacauuagggacacuuggauuguuccagucuuuacauuauguuauacacuaggauguucucuccauuuugauauauuggccugugaaaugcuacauucucccuguaugauugagaguaucugcccguuggaaaaugggauuaucaugagauuauuaugucuucaggucucuaguccauguuuauauccaaccuuagcugcaucuccuaggagccacuaaauaacuuucagcuuuaaggaaaacagguacaaauuucuaacuagucaaucauauaugacgauuuuuuuuuccugcuguaugcucaucucugcuaucuacuuuggggccuaaaacuaugugugcucuucugaaagagauuuuaauucugugcccuacccaaacuuugcuacuuaacugguuuuuugguuuguuuucuguaacagggucucgcucuguuguccaggcuggagugcaguagugcaaucacggcucauugcaaccuugaucucccugauucaagcaauccucccaucucagccucccgaguagcugggacuacaggggcauggcaccacauccagcuaauuuuuuuguauuuuuuguagagaugagguuucaucaugaugcccagguuggugucgaacuccugggcucaagugauccaccugccuuggccucucaaagugcugagauuagaggugugagccgccgcaccuggcaacuguuuuuuuuaauuauccuaauuacacaacucuaaguguuuuaaaguuacaaaacaagcucucuauuuuuuuuuuaagugcacugcacaggaaaaaaaaaaacccauguaauuacacagguuauuacauggauaauuaccuguuauaauuacauuuuuauauuccacuuugguucgagaaguuuugguuuaauuauaauuucaugaaggcaugaccauuuguaauuucauuaaagaauguauauuaaagcaaaucuguaguguuuuacauuaauuccaggaguuauaaaauaaugacauuuuaaggugugugugugugucuuaagcaaaaacauucccucacauccuguguucccaaaucucauuguuuucucacaguugaaguccaugacaugauuuuuuuagaaugauggccaucuuuaaaagaguaaugcuuauuccaucuuggagaccuuuagggagagauauaucauaauguuccaauuucuacuaguacuuacuauaaagagcauuuacauuauauuaaaccgaaauccacuccagcugcuuuuuaaauucauuucuuucuaaucuguccucaguagagauuuuaaaaaacaaacaaacaaucaaacauucuccaggacauccgaaauauguacucuuuaacaacccucaggcacuugaagacugugauuaaguucuuuucugcuucuuuugagauaaauccuuuccaacuucuccccaugagaucaauuuuuuaaaaaccuccuauggacucuauauguguccaaaucucugugauuugaugcacagucgcuuuuauaaggaaaugacucaacaauacaucuagguuccugguucauaaucuugugcucugguauaccagaugcccagauuaccuuaaugacuuuauaagaauauccuauagguauaaauucacauacccugcucuagagaacaugacuaaaagaagcugucuccacaaagauaucuagauggcugcuccccauccccaaucagcuuucagacaucucaucccuggcaugacaaacucuacaaugccauucacccuccagggcuccccacucccuuuggaaucaggcugagugaggcuagacuccuccugaaaucacaucucuguccaacuucauccuucucccucacuuagagguuucucuuaaaagcuuucuuucaacaggccacuugcacaaugcuauauauaguuuggaugucucuuuccccaaaccuuauacugaaauugaauuccaauauuggggauggaggccuaaagagagguguuuggggccaugagggaggaucccuuaagaauaguuuaauacccuggggagggguggggaaggugauuucucagucuauuuguuccccaaauagcagcuguuauaaaagagccaggcaccuccccucucccucuuguuucuucucaccaagugaucucugcacacacacugccuuccaccauaaguggaagcagccugagguuuucacuagaugaccaaucucucggcaguagaaucaugagccaaauaaaccuccuuucuuuauaaguuacccugucucagguauuccuuuauagcaacacuaaauagacuaagauacacaagagucccuaucucaggcugugcuuccagggaaucagauguaugacaccugaauuaagaaaaguuugaaccaggcacgguggcucacgccuguaaucccaccacuuugggaggcugaggcagguggaucacuugaggucaggaguucgagaccagccuggccaacauggugaaacccugucucuacuaaaaauacaaaaauuagcugggcguuguggcacgugccuguagucccagcuacuugggaggcugaggcaggagaauugcuugaaccugggagguggagguugcagugagccaagaucgcgccacugcacucuagccugggcgacagagcaagacucucucucaaaaaaaaaaaaaaaaaauuagccaggugugguggcacaugccuagagucuaagcuacuaaggaagcugaggcaugagaacugcuugagccuggaaggucgaggcugcagugaaccauuaucacgccacugcacucuagcaugggcuacagagcaagauccuaccucgaaaaaaaaaaaaaaguucaccaugccaaaacaucagugacagucaaugacaaacauuaagugcucuuugcuucaucuccaaaggacuuuauuucugacuuucacacagauauggucuuguuggacucacauacauacauuaucagaucaauguguaauacuuauugauuagaucacauugacuugagcagucuuuaguauaaauaauuauuuuuaaggaaaugugauuauuaaaucacggucauagaucucucucaauuucauauagacagugcuuccaguuaaaauggcaaaggacauauuuuucuacaauaucacucaucaaugcugaguauuaucauuccaauacauuuacuacuauucuuuuuuauccaaggcuuuaaacaugaguguauucccuucccucuuaucuuccacccuccaacaaacaaauuacucacauaaaugaauaaccuauagcuuccaaguaugggcuuucuacaucuuauggaauuaguaaaagauugaauguccugaacuuacuugccaagagcuauguaagcccuuaaaauugguacagccgcaccucauuuuacugagcuucacuucacugcacaucacagaaacugcauuuuacaaacugaagguuuguggcagcccugcaucgaacgaguuuaucagugccauuuuucuaacagcacaggcucacucugagucccuguugucacauuuuggcaauuccuacaguauuucaaacuuuuucauucuuauuacaucuguuauggugaccugugauccgugaccuuggauguuaauauuguaauuguuuuggggagccaugaaccuaaacauauaagauagugaacuuaauggauaaauauguguguucugacggcuccacugaccggccauucucccaucucucucccuccugcucaagccuccccauuuccugagacacaacauauuuaaauuaggccaauuaauaacccugcaaucgccucugugccuuaaauuguaaggaagaguagcaugcuucucacuuuaaaucaaaagcuaggaaugauuaagcuuagugaggagggcacguugaaagccaggguaagcuaaaagcgaggccuuuugcauccaacaguuaaguugggaaugcaaaggaaaaguucucaaaggaaacgaaaagugcuacuccacuggacacacaaaugauaagaaaauggaacagccuuauugcugacauggagaaaguuugaauggucugcguagaagaucagaacagccacaacacucucguaagccaacgccgaauccagagcaaggcccuaacucuuuucaguucuaugaagagauaaggaggugcgucuuauauuaaauccagaaacuauuuuuuugagaacaccaacaaauuuaugugacucacuuuacugcaauauucccuuuacugcaguggucugauggcaaaccugcaauaccucugagguaucccaguacacagaaauuguuauuuaaaaucugccgaugaccuagaucucccuaagcaacauuuuuacuaaugagcucgacuuccuuaaagcauauguguuaauuauccaucauaaagcuauuagaaaaugucuguuaaugccauuagaugggaugaaagcauucaguaaauaaaauaucgaaauccuaacuuaagcuaucuuuuaaaauuacacuaaaaaagacaguacacugagguuuguuuuguaaauuucauucuuuuccagugauuuuucagcuuacgguaauguuucacauauuaguucuuuguagccuuuuucauuuugaucuucauuuguaugugauaacuggguuuuuaggggugugaugaaccacgguuuuauaauuuacagugggaaaauauccaucaaugaaaucaaauucauacaaaugaaacagaguggaccaaacugucuugaucugaacaugggcaaaauuuuucccaauaugaugacgcccgccuccaagaccaucuucucuccuguugagauguccuguaaucacugaucaggauccacaagcuccacccaagugucuugaaauccuugauugacagugagagauaaacccauuugguggccugcaggaaugguacguccuaucacacccucugaggcaguuuagccauucucaauauagucaauacaggaagucuaagucuuaacuuucucuguacggugauuaaauaaguuucaaucuuucuuuuuuuuuuuuuuuuuuuaagauggaguuuugcucuguuugcccaggcuagagugcaauggugcgaucucggcucacugcaaccucugccuccgcgauucuccugccucagcuucccauguagcugggauuacacgugcgugccaccacgucuggcuaauuuuguauuuuuauuagagacgggguuucaucauguuggccagacuggucuugaacuucuaaccucaucaggugaucugccugccucggccuccuaaauugcuggggaguuucaaucuugagcaggucauaaguuaaagaagguagauccucuccacggacaguuuucugcuucaaauaacauuuuucaugaaguguuucaucucuggcuacaaagcagcucauuuaggcaccaguaguugaggauguaugcugcccugagaacagucuaauaagcagcccugugacuuccucaucugccaacaggugcucacccuugucuguaguauccaguaaaguuuggagaaugccuuggauuuuuucuucugguuucuguguuucuggguugccuuacagacaauaguugugcucucaaugagcuuuguagcugcuucugcaaccacgcagaggcagccaacguggccgcagccaggccaaaggcuugaagccgccacucacaucugcgcacagcugugccaccucuuacugaguugacuucugauuuccuuuccauguaaaccauggcuagcuaucaaauuaugagcucagaaagagcuucacacaauuuuuuucucugcuuucuccccagcuugaaaguauuccuuucuuuuucaguuauagaaacuugcugucuaaagugggcuacuuuaaggcuacuuuuuaacauuuucucuugccccaagaacgcuggauuaggcaugucacauucaacucccuucccaaacgcagguguccugagaugacuguagacaucuucugcaucuuugguuuuacuauuaaaaaguggugcagucggcuggacgcaguggcucaggccuauaauccuagcacuuugggagaccaaggcagguggaucacaugaggucaggaguuugagaccacacuggccaacaugguaaaaccccaucucuacuaaaaauacaaaaauuagccgggcgugguggcaggcgccuauaaucccagcuacuugggaggcugaggcaggagaaucgcuugaacccaggagguggaggcugcagugagccaagaucaugcuacuucacuccagccuggcugaaagggcaaaacuccgucucaaaaaaaaaaaaaaaaaaaaaguagugcagucucaucucucuccaggaguaaaugucuugcucaccacagaaaaacuacauacagguccauacuucucauaugcccauacuucucauaugcacuuucuagaaauucaauuuaacuuuucccaaauguauggcaugcccaaggaauguaaugggagagaaaacauaugaugagcauuuugcaccagcuggcagcuaggccaggugguuacuauuguggcaaagcagaccaggcugagaaugaaggcgcaggagaugagcagcauggacaggaggcugucacuuucaccugccacccacuccaccagcugccccagcgccgaccugcucaucugcacuaagcccagcauuccaauuauaaucuuuuaguuauuuuuaaauguacaauauauuauuguugacuguagucacccuguugugcuagcaaauccuagauguuauucauucuuucuaacuauacuuucguacccauuaaccauccauacuuccccucaccuccucacuaccauccccaggcucugguaaccaucauucuacucucuaucuccaucaguucaauuguuuuaauuuuuaccucccacaaaugagugagaacuugugcaguuugacuuucugugccuggauuauuucacuuaauauaauguccuccaauucuauccauguuguuguaaaugacagagacucauucuuuuuuauggcuggguaguguuccaccguguauauguaccacauuuucuuuauccauucaucuguugauggacacuuagguugcuuccaagucuuggcgaucgucaacagcacugcaauaaacaugagagugcagauagcucuaugcuuacuucccuucuuuuggguagauacuagcagugggauugcugcaucauaugguaguucuauuuuuuuguauugugaggaaccuccauacuguucuccauaguggcuguaauaauuuacauucccaucaacaauauaugagggucccccuuucuccauauccuuaacagcauuuguuauugccugucuuuuggauaaaagccauuuuaggccaggcacagugacucaugcccguaaucacaacacuuugggaggccgaggcggguggaucaccugaggucaggaguucgagaccagccuggccaacauggugaaacacugucucuacuaaaaauacaaaaauuagccaggcaugguggugggaccuguaaucccagcuucucgggaggcugaggcaggagaauugcuggaaccugggagguggagguugcacugauccaagauugcaccauugcacuccaaccugggcgacagagcaagacuccaucucaaaaaaaaaaaaaaaaaaaaaaauuagccaggugugguggcaggcaccugugaucccagcuauucgggacgccgaugcaggagaaucacuugaacccaggaggcggaggucgcagugagccgagaucucgccacugcauuccagccugggcgacagagugagacuccaucccacaaagccauuuuaauuggggugagaugauaucuuacuguaguuuugauuugcaugucucugaugaccaauaauguugagcaccuuuucacaugucuguuuucccuuugucuucuucugagaaaugucuauucagauacuuucucuauuuuuuaaauuagauuauuggauuuuuuuuccuauugaguuguuugaguuccacauauauuguuuauuaauccuuugucagacgguuaguuugcaaauauuuucucccaguauguggguugucuuuucacuuugccuauugcuuuguuugcugugcagaagcauuuuaacaugauguaaucccauuuguccauuuuuguuuuagcugccuguacuuuuaggauaucacucaagaaauuuuugcccaguccgguguccuggagaauuuccucaauguuuuccuuuuacuaguuucauaguugagucuuaaagauuuguuuuuaauccauuuugauuagauuuuucuauauggcaagagagaggggucuaguuucauucuucugccuaugaauauccaauuuucccagcaccauuuauugaagagauuguucuuuccccauuguauauucuuggcaccuuuguugaaagugaguucacugcagaugcacggguuuauuuccgggcucucuauucuauuccauuggucuauaugucuguuuuuaugccaguaccaugcuguuuugguuacuacagcuccguaguauagauuugaagucaguuaauguuauucccccaguuuuguucuuuuugcucaggguggcuuuggcuguucuagguauucugugguucaauacaaauuuuaagauuauuuuuucuucuuccuuuuuuuggggguugggggggauggauucucacucucgcccacguuggaguucaacggcaugaucuuggcuuacugcgaccuccgccuccccgauucaagcuauucuucugcuucagccuuccaaguagcuugcuacagacacgugccaccacgccuggcuaauuuuuguauuuuuaguggagacgggguuucaccauguuggccagguuggucccgaacuccugaucucaagugaucuguccgccucggccucccaaaguguaagaucauuucuucuaauucugugaagcaugucacugguauuuugguauggauugcacugaaucuguagauugcuuuggguagcauagccauuuuaaugauauugauucuucuaauccgugaacagggaauagcuuuccuuuuuuuuuuuuuuuuuuugguguccuuuucuugcaucaauguuuuauuguuuucauuauagagagcuuucacuucuuugguugaguuuauucuuagguauuuuauuuguggcuacuauaaaugggauuacuuucuugauuucuuuucagaguauuuguugcugaacacauacacagaaauguauguguugauuuuguagccugcaacuuuacuuaucaguucuaauaguuuuucaguggaaucuuugguucucuuuuauuucucucucuugccugauugcuauagcuaggacuuucaguacuauguggaauaacaguagugaaaauggacaucuuugucacauaacuuuuauuauaggauauuguuguaauugcucuauuuuauuuuuauuguuguuaauuuuuuauuauaccuaauuuauagauuaaacucuaccauggauauguaugcauaggaacauaagaaaaaacauacauaguauguauaggguuugguaccaucugcaguuucaggcauccacugggggucucagaacauaucccuugcauguaagagggaacuacuguauauuaaacuaaacugaguauaugugugccauuguuucaagguuucagaccuuuaagguuccacucaaugguugcuauagguugaauguuacgguuucuauguguugaauguuuguuucuccccaaggucauggugagaauuugguaguuguuguggcgguguuaagaggugaaacuuugggaggugauaggguagcauuaccgucauuaucaaagggcaaguuugcccccuuuagcuucuuggcauuccuccuucuggcuuauaagcaucuagccuuccuccccugcagaucaugugguguacaaggugucaucuuagaagagcacagucucaccagacaccaaaccugcuggggccccuugacauuagauuucccagccuccagagcuaugcgccaauaaauuccuguucuugaugaauuacccagucugugguauucuguuacagcagcacaaaauggaccaagacaaugguaaagucuuaacucauucaaugguuccuuggugauuugaagguuuuugucaauuucuaaaccuguuuauuugggacuuaucugcacaguacugaaccaacuguucaaagugaaaauucaagaaucaauggguuuguuguucaacaacaaagcagggaaucucuuaauaaauugcugccuuacuaucauaaaugcugcucuaguauacuaaagguuaauuaggcuucuuguagugccuaacuuaacucagggggaaguaauaaaaacaaaaaacaaacacaauaaauugcaauuaauauuuacuuggauaugaaaguaaguauaaccuuuagauuauucaaaauucaguuugugaaggcaucuuauagaaccgauauuuauaggccaggugcgcuugcuuaugccuguaauuccaacauguugggaggccgaggugagaggaucacuugagcccacggguuugagaccagccugggcaacaugaagagacccugucucuguaaaaaauuuaaaaacuagguagguguggugucacacaccuguggucccagcuacucaggaggcugacaugggaggauuacuuggacccaggagguugaggcugcugugaguugugauugcaccacugcacuacagucugggcaacauagugagacccuaucucaaaaaaacaaaaaauccugauguuuacaauguuuuuaguacauuugauuuuuauuuaauaauugaucuuuuacuacugauuacauucuuuucaaaaggcuugugaauuuugcagcugcauucagaaggccauuuuccucauuaaugugguccacagaucaaaaauauuugccauucauucauucacguuuucauugaccauagaaguuucaccucacaaaguagaauguuuguaucaaguaaacagaauaaauauuuuaucugacaacauggguaccugauuccuauaccccuuguuggccgcaaacauuuuuacacuucagaaagucaaguccucacaaauauaaaccagguaucugcaugcuuacccuagcaagugcuuccucaauugugaucaucuuuucuuugaccaucaucauuagcugaauccgcuccucaucgcucaucguuauuucacuggcaacauaaccaacgucuucuccuggagauugaggacaaagaacaacaggagugaaaacaagaauggcgaaacagaacgucaaugcggaacaucugcugucucgggcuagagaagaauguugcucaggacacuauguauguugaacguuacugaugaagcaaaggguggcaaaaauaugcugcuuuuuaagaagccaauaagcaccucugauugagaaacaggcuugcagaacacgugggugucaccauagaaacaaauccuucaagaugaucagagccuuugagauagaguacccaguggauggguuuuggaggaaagugagagagagauccucgcuauagguggaguaaagaucuaauuuacacacccaacuggaucauacaagcauuccaaggcuccuucagcuguggguucuuuguguccuuccauuagcaauacaaaugagaagaaaauauuuuugcaaagaagugggaaagaauccuaggucaugacagaggaaggucacagaguucagaccuggcaaaaccuuccauuccuacuaagcuauuucacuguuauuauuccucaaaacuaagugcaccgggcacaguggcucaugccuguaaucccagcacuuugggaggccaaggcagguggaucacuugagguuaggaguucgagaccagccuggccaacaaggugaaaccccaucuccacuaaaaauacagaaauuagccgggcaugguggcaggcaccuguaaucccagacacucaggagacugaagcaggagaauugcuuugaacccgggaggugaagguugcagugagccaagaucacaccacugcacuccagccuacgugacagagcaagacuccaucugaagacaaaaaaaauaaauaaauaaaaaaugcuaagugcaaaucacagacaugaagcauguugaguuaaucagaagaagggugccauauaggucuguaucugaaaguauuauugucauaaauugguuuccaaacugagggaaaaucaacuuccaacucgcaccugaaggcagcuagaaccucagagaagagaaugucccauuagauuccaaagauuuuccuacagagcaaacagacugcuauugccucugguauaucugagccacauugggcaauggugccucuggucagcguguggggaaggacauguuacugaacaugagcuuuaacauccccacuccagucccacacccugcucuccuccccaucuuucucauucauacuuuuuaccagcuuccaauaucguuaggaugcccccggcuguggcuuaauuugccuuugguguaagagacagagggaaagagucugccuguagacuuguaggaaaccauuucaggcacggcugacuuuggaauuuauguugcccuguauuuccaucuaauuuccauuuuguaaucaaucaauccaaaaauacuccucaaguucccucaaguucccuuugcuacuugcacagggagaauaauagcgugugcugggugaagagagaagccugcuggguugauucauuuuacuaucugugucaccgcaaauggcagagugggugauggggaguugguuggguucuuuaaaaauccacauuagcugguaaacuguuggcuuccuccuucccucccucucccucuguaccucucccuuucccuuagcuuuagacuguuuuuuuuuuuuuuagaauccaagguuuauuuugaaucacaagugacgcugggugaauacaaaaaacugggaaugcuuaaaaguaggacaacuugaaaaaagaaccaaguggaauguugccaaggaacccaggugugcugugacgugucugcuguucacauccguuuuucucauuuccacgcguacugauaauuagacagacguuccacacagcacaggacacuaagauuuuguaaaggaaagcaagcagugucacuggugaucaaggaaaacuuuuuaaucuacugauaaccucauucagcuggacuggaaucuggaaguggauuuguucugguuucuucucugaauacuggggaaacauaaauuauguaacugagccucaaagggaugauauauuuacuuacuauauaaacaacaacaaaagacacagccaagaguagggcagaacucccuucacaaagccgcccgggcaaauucccaugaugucagaccacuggaguuuccaggggcaacaccccauaaccgucccgcugcagaagagcaucagaaguucagaagaaugcaaaggaucucagugggaacgcggacaggagagccccaaaccaacacaugcuagggcucucuaggcccuuucaggcuagaucuugacgagagaagaguaaagaucuuucugagguuggugcaacugaggaaacgaaaguuucggccucugcugucagaucuaugaaaggaaagaacugugaacuuguccccuuuuguuuucuuugacuuaaaacaaaagaaaaucacuggaacaaagucuuaaaguaauaacagaaaugucagaaaaguugaacaucuuaugggcacaugcggugaguuacgcuaacuuauagcauccacugagauuagccgcauaggauucuucccauguuagagcuaaaaggaccuacuguccgccagcugcauugcaguaccuuuugaagucugucucauuauuccuuucugguucuuucggaaguucugccagaaauacuuauuuuucuucuuccagucuccuuuuccuuaaaaaaaaaaaaaaaaaaaaaaaaaaagaacaaaaagcacaagcaauaaauucaucauuaauaacaaaaguagccucuuccuuguaauucaaagcugguaggaauacuuugauuucacaaaaggacaguuuuuucuuucaguuagugaaagaaugggagaugccuauaaaguuguuuaaaagaaaugcaaauuuccuaguagcaagaaacggugcagugagguuaagaggagaaacggaaacaucaaaaaggaaggcagaacaugcauucuuguguuuacuuugauguuuguuuaacuaguaugccuaauuuggccucgucuugcaguauauuuccccccuuuggucuuagccacaauuauuucaacuacaccacaaauaggguauuuuaagaaguucacuugguuuuguuguuauuucuguuguugaucuacccuugguuuauuucuguuauuccagauuuaacaacaagaagagaaugguugguauguccugggcccacaggucaggggaguugguccccugguucucugggucuggcccccaguguuacucucagaaguguggucugcacgggucuugcuauggcaugcuuauggcacucccuggcauucaggcuaccuggugacccaccuacagcuuacccagggcacaaagacaagcaagacugcaaucccgcugugucaucucccaaaugggucucccucuacccaccgcacccccgauccuuuccagaugacugcggugacuuucaagugaaaacaaauucgcugcuauagcuagacauuuuuaauaugugguaggguuccgaucauugauaacacguaauaccuuuuuaaaagcaaagcgaaaggggagaguaaguaaaaugaguggguagagcaguccuuuauucuuuacaaauaaaaagcagcagcagcggugucugccaucgugcugauguggcacauucaaaauagcagcucugucaccacuuguugucugucugguugcuccauggccacuggaaacagggcccagcgaagugauggguuuccccagucuagacugguggugccaagcaaugaagcagacgugugggaaccaugucuuuggugcucccaggcuagaaagggcgucgucugucaaaacaggaugcccucacauuuaaguuuugacagcccccagagcugugggaaugaaacccgagccuuuccgccaaagacagagcuucauggcaaguuuuguaucacccacugccuuugggcuuaacacugaagcaaaugucagacaugcaggguuaaagcagacuaguuauuauuaacucaaucuugcucuuggacaguucgggaauauucauuuucuuucuuuuuucuuuucuuucuuuuucuuucuuuuuuuuuuuuuagugagacagagucuugcucugucgcccaggcuggagugcagcggugcaaucuuggcucacuacaaccucugcuuccuggguucaggugauucuccugccucagccuccugaauagcugggauugcaggcaggagccaccacgcccagcuaauuuuuguauucuuaguagagaugagguuucgacauauuggccaggcuggucucgaacuccugaucucgucauccacccuccucggccucccaaagugcugggauuacagaugugagccaccacguccggccuauuuauuuucuuuuuaagagacauggucucuuuguccaagcuggagugcaguggugcaaucacagcucacuguagccucaaacucuugggcucaagggauccgcccaccucagccucccaaguagcugggacuacagguacauggugcuaugcccaccuaauuuuuaaauuuuugguagagaaagcaucuugcuauguugcccaggucagucucgaacuccugggcucaaguaauucucccuccuuggccucccaaauugcugggauaagagaagugagccacugcacaggcugacaauauauuucuuugacuauaagcuauauucccuucucccuucucccauuuucauguuucugaaacagagaugcagccuaauaaaugguaauagcuaacauuuauucagcuacuauauccaggcacuuagcuaucuaauggcaagauuucauuuaauacucaauuauaugacacaucauuguucccaccuagcagaugagaaaacugaggcuuggugcaagugagcugcacaaggugauagcuauugggucggcauauucaaagucaggcagccaggguugauugaguacuuaauguuccuaaucacuaucagccacccacccugugacccaaacaaaauagcuguuacuaaaccaagagugaauuuuauaaucaagaauauauaaaacauacaaugccuuaauuaugcauaaucuuggauccaaaaaauuccaaauugaaggauuuauccuaaggacauuauuagggacacagaccccaggauuuuuauagcagcaguaaauuuuuaagucugcauaauauuccaccauauuggaugugccauaagcuaauuaaccaauucauucuuugcuggauauuuagguugcuucuaauuuuucuguauuaacguagagaauauucagucaugggaaaaugcucauaacauauucaaguuaaaaacuauaaaacaguaugcagaauaugaucacaauuauauuuuuuuaaaacugccuagaaaaaggagaauaaggauguacaucaaaaucuuaacaguguuuauuucugaguagaaggauucuuguggguuuuguauuuucacauauucguguuuucuauaaaguauugaaauaauuaaauagguaaaccaagaaaagugguacugaccuacagagcugucuucugaguuugauuuaugaagaggguuccuagaaaagaaaaacaaaucagauuaccagagagccuugcuuucaugggagaacugaaaauccuccuaacuaguuugacccagcaucaauacuacuuaauacagccagggaaauuguuauaggcuauuuaccacuggcuuuuucuacccaucugcugacuuccuagaaauagacucgugugccauuugucgacauuuauuaaagacucacucgaaggugagaccuguaauauuaaaugaagaagacagacuucacuagacgaucacugaaguaccuuucauucugugaacuacuaauacaagugaaguuacugccauugggaagucucuuguguaagaggaaaagagaaagcaaauaauaaugaaaacauaaacucagcaccacaaaugccacuugggcccacagaugaguacaguggucggcucuaggaaaacaaagggggcagggaggcgggugagacacccacaacaggauauugagugucccuaauaaagggggcggccaguacacaguuccuccaguugguugcugccaauuggcaagugcaauguccauccugcugaaucuuccaauguucaaaaagaagacagaaaucugcauuuuuuuuuuugagacagucuugcucuguaguccaagcuggaguacaguggcaugaucuuggcucacugcaaccuccgccuccuggguucaagcgauucuccugucucagccucccaaguagcugagauuacagguaugcgccaucacgccuggcuaauuuuuguauuuuuaguagagacgggguuucaccauguuggccaggauggucuggaacuccugaccucaugcaauccuccugccucggccccccaaagugcugggauuacaggcgugagccacugugcccagccagaaaucuguauuuuuauacaagagcucuaacauuuuuaagugaugguaaagaaaccaauguuuuuaaacauguguccaaauuaaucaauacaugucugggcaucgaauuugccucccaccccaacaccuuuggcugccaguuugugaaggcagauacagauuaacccaaauaaucugaaaagugugcacagcccaaaaccaguucauuaagcauuucuccagaaaaaaacuuagacaaacaaaauuuaaagaaagaaagcgggaaagccaaagaaaguuaaaauugguuguaucaaaaagggaacgaggugggcagaucacuugaggucaggaguuugagaccagacuggacaacauggcaaagcuccgucucuacuaaaaauacaaaaauuagcuaggcgugguggcacaggccuguaauccuagcuacucgggaggcugaggcaggagaauugcuugaaucugggaggcagagguugaagugagccaagaucgcaccauugcacuccagacugggcaacagagugaaacuguaucaccaaaaaaaaaaaaaaaaaaaaaaaaaggaacagggaacaguagaguguggagcaaaaucuuucauuagguguguccaaaucccagaaggaaaauacaguauccuugggcuuacagccaagggaaaccagaaagaaggcaccugcaucagaagagacacagacacuugggggauuuaaaccugaaucuucacuacaaguucaccaccaggaaggaagauggaagaggugauuuuugcaucugaaggcuagggaagacaagaaagugggaggccagguaugaguuacacugaaaaaauuagagcaaaggcugaggcaggaggagagcagccugggcaacauagugagacacugucucuuuaaaaaaaaaacuucuaaaaaguucaacuggguauggugacaugcaucuauagugcuaguucuagcuacucaggaggcugcagcaggaggacuacuugagcccaggaguccgagguuguagugagcuaugaucacaccacugaccuccaaacugggugacugaaugagacucugucucauucagaggaagaagaauugaauauccuaaucaccuaaagugauuuucugccuaccuuuuggauaaaaggaccuugagaaucuaaggugaccagagagaggggagggaggcuuuuucacgcagagcagccuuuaauaagccaccacccuuugguguagcugcacuggugugggcugaccacugggugccauuucugaguggcaggcccaugcccugcaagcaccaccauucuccacggcugagugcagagaacuguugaugaccagcacaaaaaucugaaagcuuucuauuguaaacuaagggagagucggagcuaagaacagaaucaggggagaaaccgcuagagaggacaagagcuaguuuugaauucuaguuauuuccccuuauuccugugcugugaauacagaacauguaaggaaaaucucacuuaucaccaaauugugccaaaacauggcuaggaccuacucuccuuccuccuauccacacaaaaaugaaaauaccuguauuuaccugcaaggcuuuuaggagguagccauuucaaaauuuaaaucuuucagccaaaauguacugaacaacgcacaaguaagguacauggaugaacacgaaggaaggggagccacagguuagagacggagggagacaggaacaaaaaagcauaagaaaugacgagggggaaggggaggagaagaaugaggaagagaagcagcaaauguaacaugcucagggccacgggagaagugggagcaaaauaagagcaagcuaguuggcuggggacugaggcaggaaauccuucagaaagaaagaaggguuucugcuaaguuuagcuucuuaauuuuuuuaaaaaaucuuacugugcuguacuuugcacuucaagucaugggacugugcagcugccaccuuacuucagcgggcuggggucugcagcugguuaaacauguuuucuguaaggggccaccagagggacagggagccccauauguauuuuuguccucacccuaaggacuagggaugucuuuuuuuuuuuuuuuuuucuccuggagacagagucucacucugcugcccaggcuggaguacagugaugcgaucucggcucacugcaaccuccacccccagguucaugcgauucuccugccucagccuccugggacuacaggcauaugacacuaugccuggcuaauuuuuguauuuuuaguagacacgggguuucaccauguugaccaggcuggacuugaacuccugaccucaggugauuugcccgccucggccucccaaagugcugggauugcaggcaugagccaccgugaccggccaggacuagagaagucuugaccuaacugcuauggaccaaauauccccaccucaggauaaaacuuauuauguaauaagugaaaacacaaauugugaauuuuuacuuucccuaaaagucaucaaaauacuucaaaaaguacacugcagaaaaauguacgcucccacugcuacaccauuagcacaaaaugugauugcauuuuccucucugaaaugaugacugacaauauuuucacuauuuuuaaucuacugucuucaaacuaccacacacuuugaauaauuuuauccuccgguuuggacuuggcccaggcauugcuugaacuuccccaggaugccagcagauggcacuguaguuucuuuauucaucuugcuguggugagugggauuuuguuuuuaaaauuucacaaguucaccaccuagaugcuggccaaagaauaacaagcccauguuucauaagcgugaggcuccccaacucaucaaauuuacaauccuuugaauuuuacguugaauccaaauucaaugugugaauuuggaugcagugacuuucucccugcaaacagaagcuggcauagaagcagugcaaaaugccaucuccuuucuccuugagaaugauuauuacaauucauccagcaggagcaaaaaucaaugauauaacccaaguccaaaaguggauggcagcagguggaaggggucauuuacuaaucuccugguggaagaaauuaaugcucagacgucagcuccaaagaggccuccugguaguaguaccuccuuccuccagccagaagccccaggccugaggauggugggcgcuggagcuggaucugcucuuuggacucaucuuuuucauugucaauggguaaaaaguaugguaacuucagcauggauuuugaugaccaggaagcaauaauuaauauucugcugugcuuuaaaaauccauuuaaacauuuaauuaucaucaaguauuggauuuaaagucucagaacugaaccuuagcaaauauuuguucaucaauaacuccuacuauuaagaccccaaaucuaucugcuuaagugucaacauuuuuccucaagaucccuaaacugcuuuagcuguuccugaaggcaaaauucacuuaagaaaauuccuacauuaaggaauuuaucaaucccauugaaaaauaaaaauaauuuaagagacaguauccccagaacugguuucuuuccuccuaccucugucuuuaacaaauucuuuguuaaauugcuuuguguauucauuuucacucauucuuucauucaguauuuauuuauucaccucucaguaggagucaggcauccucugagguccugagaacauagcaauaaacaagacagauucaagaagggcgacugcagagucaaggagugaggagaaguugaggugaugggacagagaaggcuucucugagcagaaaccuaaauaaugaaauaacauucacuuccccagauggggaaagcugggcaggggaacagcaggggagggaacaagagguccccuuuggacaugcuaagugugcggugcuuauuaaacaucccugugcagacaguaaagaaacaguuggacaugugagucuagagcugcagauaagaauuuguaagugacuugcauacucuaagcucugacugaacacuacgaagagaaacauuaugaagacugagcuccagggcaacccgauuuuuaguggucauaaagagaaagugaggcccagcaaugagacuuaggaggagcagccagugggagaaggaaaagaaggcagagugcuccuuuaccuuucugguuagaauauuauuaaacuccguuuuacaaaaauuauaucgcagcugggcgcagugucugacccuguaaucccagcacuuugaggccgagacggguggaucaccugaggucaggaguucgaguccagccuggacaacauggugaaaccccaugucuacuaaaaauacaauaauuagccaggcgugguggagagcaccuguaaucgcagcuacucaggaggcugaggcaggagaaucacuugaacccaggagguggagguugcggugagccgagauugcgccacugcacuccagccugggugacaaagugagacuccaucuuaaaaaaaaaaaaaaauuauauugcagucucucacuccacacaguggaaacucuagguugccauauuuucuuuuccagugagucuacugcuuuacaguggagauccucguaagaccauagaguaggaggaggaacacaacacaggucaacaugaaauucuuuacacuuguauagaauuccaccucucaaaugcaauacucucauuaccccccaucacagaauaggacugucacugagaugggagugaugacaugccugagguccaaucgugcugggcaagggcauaacugggcuugguggccacgucucugacuccugaguucaacaccucacccucuuccccagacuccuccucauuuguauaacagaauuccaaauuguauacauucuuuaacaggaugcuucuuuucuauuauuuaagggauagacagaaaggggauaccauuacauacuggcccagcucuugaguaaauugcuaaaaugauacucagaagaaccugcaaaaacagaaaguuuucaacaccaaaccucaccauggucuauggaaguaucagaacuaaauauuccaagaacacuuuucaggaauugacuaucuggcuauugcaagaccccccuaucugcuucuagaaggaaaggaagccaaauacuauggcucaaacucauuuuucuucuucuguuuauauacaaauagucuaagcuacauccagacaaagacaacucuaucucguuucuacauacugaguccagcacaccagaaaagugcaaugaauggccaagcauaaacaaauuccuaaaauacacuucauguuuuggcuuugaugagcuguccagaaacuucauuauaaccaagaaaaaaaaaaaagaaaagaaaagaaaaagaaaggaaagugguuauaaccucauuuccaagaaaggaacauaugcuauauguuacuggaaaaccuguacuuaagggauuuucaaaguuccuuaaucuugagucucaggaaaucaacuucuccauuaguugauuuccugcugaauuugaaaucuggucuuuugcugugucugggucuuuuccugcaucaucccaggccugccaaggcagucccgaaagccaguagcagccuuuucuccaccauuuaaaaaaaaaagccugacacaucugugcuacugaauugugcauguacagggggaggcaggggaagguuaaaagguugaagggcuuacauuaagaaguaguuaagauuuucauuuucuuuauguccuacuuaaguauggauaacuguaccuucauauuuugcuccuuucaugacaaaucauuacauguuaaagaaguaauuccucaauuuaauauuucuuucuauccuuuggguaucaaagauacuuuuaucacacaaaccuaucuccucuguuuaagagaaauagauaugaaacaaaauucaauucauacuauccacuaguugccauaaaaacucaagagucacccuuucuccagccacagggccaggacuuggaugaugccagagagacacagauagcccaaguuguaagaggucaccucuuacagauuugguguugauuugguguaagauucucucagaauccggcaggugcagggagugaguugccuccuuaaauuccaugcccuaugcaccucucuugcuuggccccaugauuuagcuugugaauucacuggcugagacagaaaagcaauucuauugccaaaaucuggcauacuguuagaacuccaggaauaaucaauaucaaugacaacaugggugacauuuugucaagccggucaaaacaauccccauacagguuuuuucuuucauuucacagucuauucccagccugaacuugcuggcuuuuuguuacagggucaccuuuauaaaugaacaaggcaggugucugcaauaccaaaaccaagacaauggccugacccagcacacacauucaggagucaggcagaacuagggguaaaugacagcgcugccaccaaucuaagccuugacugucuuucuaagugcaguugugaugauaaaaacaguaccccuuaauggacuguuaagaggaucacaugagacagugaauguuaagagcuuugcgcagugucuggcacuggggaagcuccaaggaaauguuacuucuuguaacuauucacagagcagucccaaacugacgaacuuagucuucuccagcagacucgcuguucccauuccaccaaguauugccaugagguaucuccuauucuagaaucuaaguuuccaaaucacuaagguuccuccuuguaaauuauuuuaucauuaaccucucucaaauaauugagauggacacaaggauuucucuucuacuugccacuuuauaaaagcaauuuguauguuuuuuagaauuacaaaaaacaacacacauaaugauuaagcaugacaucaaaaucucuuuauccaauggauuuucagcauauuauuuccauuauucucauguuauuauauccuauugucuuccuuaagcaguauuuagcuuauuguguauggcacacugucuacuaaauaauuugucauugauguugcauagcuuuucaauauaggcacuuacaucaagggaaauggcuugaguccgucgauuaccucaauuaucauuaacucuccaaaacauuaacucuccgaaagaaauggcaggauuuucagguaugaaguguggacguugacucuaaacaguaauaccaucuaaucuuuaauucugguucaaagaggacuuuuugccccauaauccaaauucucacacuuggaggugcuagauggacacugaaagaucuaaauucuccaacugugaguuguagaauguuuaauuuuucuaccccacccucuuuguauaucuuugauuuacaacugccaucagaaccacuuuaagucagccuauuccuucuauauaagaugucucaaaagggcaucuugcucagaaaaauaaggagaaagaugcagcuaauuuagacaugcaggguuaguucuauugacaaucaccuuuguuauccuucaauccccugcuaauugcauuagacauauggagguuguagguaacuaaacauuaucuuuccugcugcaaaucaagccugccuccuuuuguucugucugugguagagaucaugagcagcugacugguaccuccaugugaaggaugucucaaaugcugucauaaggccacuacccaggaaguggcaccacacaaugaauggcucagaauguggguucaggaguccaagugccaguauucaaagccaagcucuaccugcuacugacucugggcacauuacuuagucccacugauucccaguuuccugcuaugcaaaacagagacaaaauguuaccgaucacauagaauuuuuagaguuuucuguugugacuuuuacuuuacuuacuacaugccugcacaugcuaagcacuaaaaaaauuaaauaaaauaagcuagcuauuauuagcggccuuuuuuuucaaccacccuaccuaugaaccaagucauccucaguccuucuucaaauauacuuccauuucuuaacuuguaaggggcugguucucuggcaccucgggaauggccaaaaggcuuuccaggccaaggacagaucccacuccuguugacucuaaaaaucccuacaaaggugcagugaaagagauuuguguccuuucauucaccaacuggugacuuguaccgaaaguuaaugaugugggucacuggcagaaacuuaaagaguuucacaucugaaaagcagccaaaugccaucucuccacaggggaggcccauggucugguugugucugggccacggccucacuaaggccaggacuauccaagugcaggagcgaugugggcuugaaggagggagaaucagaucugggaugggauucagucauccucugagguuuccaaaaaccccucagugggucuucucuuuuccaucugggccauauuuuucuucauuuguggcuucaugggucugaacugcauaagaaguugagauaaaauugcuccaugaaugccagcuuugauacuaacaacacuauugacaguaacagcaccuauuccagcacugugaaguuauaaaugccuucucaauuccuucaaaguuaauaacuaauguucagaauauccccgugacauaugcuagaggguguguguguguguguguguguguguguguguguguguguauacuuuuuuuuuuuuugagacagguucuugcucuaucacccaggcuagaauacaguggcacaaucauggcucacugcagccucuaccucuuggagucgagcaaucuuccugcuuuggccuuccacguagcugggacucgagucgcaugccaucaugcccgacuaaucuuuugauuuuuuguuuuuuguacagacaucucauuauguagcccaggcuggucuuguccuggccucaagcaauucucccaccuuggccucccuaagugcugggauuacaggugugagcccccaugccucagcccacauaguauuuuuuauaaugagaggucauauaaaaaggaaucagcaacugaccaguuucauauacaaucaaugauuuauuguuugcuugguauagauaauaaagcucuaugccacuggaugaguaaacugcacacgacauggcgcauaccuuccaggaguuuacaaaacucaagaagaucuuacuguaacauaaaaauagucaagcuaguugccucccaugucaauauccaguucauuuucuuucuuacuuacagagucccgaguuuguuugggguagcaguacaccuuguuaaaaacucacuuccccagacucccuugaaguuaguugaggccaagugucagugucuggcagagaagaaauacuagaacuuuaucgugagauguuucuaagaaagcuaguguuucuaugacaaaaaggauuuacuccaucuacaugccuuuugcccggcucuucccauuaucccuccuggaacaggcaucauuuuaucauaaggaagaaaguuccauacuaaggaugguagaguaggagagggaauaauucccugagcagcugcucaagccuuggaaagcccaacuccagacuaccugcuauaugagaagauguccccauugucuaaacacugaagucacaugucaguuacaugcaggugaauauaaucauaacaguuugauaucauuuggcucugugucgccaacaggggugagaccugguuggaggugauuuaaucaugggggcgguuacccucaugcuguucucgcgauagugagugaguucucaugagagcugaugguuuuauaagggcuucccccuuugcuggcacacauucuucuccuucuugucaucaugugaagaaggauguguuuguuuccucuucuaccaugauugcaaguuuccugaggucuccccagcccuguugaacugugagucaauuaaaccucuuuccuuuauaaauuacucagucuuggguaugucuuuguuaguagcgugaggauggaugaauacacaguuaguggcgaagaaacgaaaaugacuaacuuccacaaagcauuggucuggcuuaccaaaguagauucauaaaucucaucguauuucagucucacaaaaacacucaaaaaaacuagccuugcuguauguaugaagagauucuggccuagagucuuuauauaagugacuuguccaaggucacgcaauuagucacuguaagucacagagcuggagauuaaacucagcucuuccgacacccaaaccaauguuuuucccacuaaaacuugagcuucauggagucaagggguucacuagucuuacugaucacaguauucacaguaccuggugcaauacugugagccgaaagccaaaaccacauugucucuaauuaccgguacugaaagugcaauuuaaguuuguaaugcugccccuggagucugcggcuucaggucaaauucugacuuuugaugauucuucaguaggcauaaaaauuaagguguaaaaaaaaggggcgggggagggggccuugaaauucugcuuuuuauucugguuuugaucuaaccaguaaaaacaaaugccuucauuuuauggccucacugugaauuuuaaauuuuacuuagguuuuuuuuuuuuuugucuuaaggaauuacuaaauuauuaucaaaagcaaaauaaaauaaaacagggcuguagcacauuguuuucaccacaaaaacuaguuauuauaaaaaugagcaaaaauuucuuaugagcuuaagcagccuacuaaaaagaaaguaccuuuguuuacauuauauuauuauuauuauuauuauuauuauuguuaugagacacucugggucucacucuguuggccaggcuggaaugaagugaugugauuauagcucacugcagccacaaccuccccaggcucaggugauccucccaccuccucagcccccaaauagcugggacuacaggcgcgcaccaccauguccagcuaauuuuuguuuguuuuuguagagacaggauuucgccauguugcccaggcuggucucgaacuccugggcucaagcaauccaccagccucugccucccaaaguccuuggauuacaggcaugagccacugcgccugcuauuuacauuacuaaauggcucccaaguauuuuguaaauggggcaaaauuauucguuugcucuauuuccuuuauuaaaauuuccugcauauguguaauaaauaugggguccaagagaggcuuuucuauggggaaauguggcugaggcuggcaggggcuccucuggaaggcccucucuggcccucuguuugcgugaggcaggcccagguuaagagcugcugugagaaugggcugccacacgcucgggcgguauggagauggggucacugaucccuauagagacgggcagggagggcccccagcuuugaguauuuuuaccaaaugugcaagaaccuagggggaaagugaggcagcagggggcuggcccuuaccagccucggccugggguggggaagggaguagggcagauggggaggaaagaggcuccauucaagaaccuccuccuugcguuuccauggcaauggcuccggaagcaggucaggacuuucucaguggaaacaaacaguggcucccauucaccauccccgaggccugcuggccacgcaggccguugugcagccuggacacagaggacccuggagggauguggggccuggggcugccgcuuuucuucugccagcugcccugggggcagcaggggaguccaggggaagcagcacugaaggccaaggcuggaggcacugcgggcauggagggcccuuccucucgcugccacagcacagugaccaacaaccccuccagaccauggcugugggagccgcccaccugcccuacuucucccaacgggcagcauggacacgcggcagcccugaaucugcguccagccagcagcaaccacuucagccuuccccugccccacuucuaauucauucacagacauggcuaauggaaaauuuguauauguuauaaauacuaugaaaauggaaacucaaguuuuccugucuucucagaucucauuuuuaaauucccaagcaucucugucacuuccaugcgcccuccacaccuagacucacuccaaguggacccuguccucccauucuuaaucacuccacucgcugauuucacccugcccucagaugacuucacguccuuccccuucugauguugugagcgcaccagcaccugcuggaaaugauucagacaccgggaagcuuuccaaggucaccgugacgaugaaaugaccucuacccacaucagcugaacagcccccaacucgaccugugcuuacgaugcagaguagaagccaagagcuuaaagcugacaagacacugaucuggguggcgaugaauaaagccaagcuggcugcuuaagagucuccugggaaacuucuuagaagccuccaggguuccacaucuggauauugaaugcauuaggucugggcaaggccugaggaucugucucuccaacaagcucuccaaguaauugugaugugcagauaugcuugcaaccacuggcuuggccuaggagaggccagggaucacagggcccaucuucauucuccauucccuccuuguauccaacaccuccaaaauaaaauaagcaauacugcaagugagguguucagaaaagaauacagaguaauacgauaaaacaaguggcaaauacuuuucaagcauuauccugacuuguaagguuuuauuugggcaaagcuuuuagaugagagguuggggacugcguugucuugaccaccaagcauuccugacaugaaggagacacucccuaaagauucaacgaaguaaugaaucagccgguggauaaaagaauuuagaaaguggaagcaaaauaaagaaaggcuugacaaggccuuuagaccuuccagaucucucccucucuucacaguucucccugccuccugugaugcacacagcccaccuccucacgcugacaguggcccgucuaaaauacaaagcccaucaccaggaaaugccugagcuggcucugaaagccuuccaccagcuaggccuggggcuccaccacccauucccccaagaugcugugcuccuaugguuucgcacacccuuucuuccaccaggaacuuccuuccucucugcuuuugccuaagagaacccccagucagcccucagguucucacuccuaugggaaccugugacgauuuggagucuugacaauuuagaacagccggauuacauuucuccgaauucucuuccuugcauaguuccagguuagccuggaccacaagagagauuuuacaugaaaugcagaaaguagcucuuuuuuuuccgugcuucaccgucagugugggcauggggcccugcuauagcuguuauuguugguccucugggucaggggcuggcauggggcagcagcugggcccacagcgcucacauuccugcugggucuccuccucagcuccucaguccugggccugugauguguggagcuccugaggaaggacgucaacaacuccugcaggcccucugcacccgcgaagcugaagccucgcuuggagacggugacugauggcaugggugucagcccacccuggcaggguggacuuuguccuugcucucuucacuuugcaggcauuguuuuugcugaacugccugcccugcugacuucaggcuguaccaccugacacagaaggaacagccucaccuggccugugcagccagcacgggcugugaugcaugaggucaaaagcauauaaccaaguccuuauucuaucuuaacauucuacuucucaaauagaacccugacugaugccaaaauacagggcccucagcaccaugccuaucccccaagcgggguucaccauaccuccuucugcaguuccccuguccugaugguuuucgcauugcauuauaagcaucuuuccaugucuucagauuguaagaggacagcuacccuaccuaucuuacucaucuuuccagggcuuacugcuggauaaaugcuuaucaaauuaaacuuccugagcugccuggcccaucacuggucucuccgagcaccccagucuuugauuguaccuguaguuggguggaugagaagcagucugccccuugcagauaaacagagcuggauucagaauccagcucugccuuacccaaggucugugaucuugcuaagucacugaccuuucuaaaccuugguuuccuuaacuguagaauaccaucugcauuauagauuugguaggagaauuaauaagacaugcagggagcacgcacuaagcuguagguguugagucuccacaucuuccugcaaguauaggaaugauauuuauuuacugauagccucccaccaucaccccauccuuggccuaauauucuguuucuucuuaugcaggagagagaauaaacagcagccaccuccguacauuaaacaauuccuggcagcagcaccuguccccagccaucccagcaagaacacacacagccugccaccggcaaaggacacagggcagacgugcggacucaagcuguguccgggucggcugguggcucacucgccagacagagggaagggcaacggaguuuccaguugggaacagcugaggaggaggauuguggaccagcugcuccuaccccaagcuccugcauucuggaaugcugagcccuucaaauaugcugugcaauggugcacgcgugcacacacacguguggacgcaguuaugccugcacaaacgcacgcuucagcgcauugcuacugcacaggcucuaugaaaauagcuguuguuuccuagucgcccccauugcaggcaucacaaaagaaacgaaaggucaugugggaagggcauauuuuaggggaccauggccagugauaagcucuguguguauggcaccgucuaaugagccugagaagagacaccacagacucacugcccucaccaggggcagcacugcacauuacagagggggugaggggagggaacagcagaaugugagcaccuaucgcgugccaggcagugugcugggcauuucacagcaccacccuugaaaagagcuguuuuugugcaugcuuuauugaauagaaaccugaggcguaaagaauucgaauaacuuguucccagucccacaacuagcggagcguaaacucacgcucagauucuguccagcuccagagccuaggccagcuacaacauagugggauaugcagaguccaagcuaaauugaucggugcagggcaugcuuuagacuggagcagaaaacaaaagauggccugagcuagaaggacccuggagaccaccugacucacacuccucaccaugcccacgagggagcugaagcccagaagaugaaguggcaaagaggacaagucacagauggacgagccuccuggccagugaccuggcccucaugcccucagccucuacugauuaaggcagaagaguaccuaauaucauaacaacaccuggcucuugggccaguccauuuauuuucugaaaauuaaguuugccauuuugccuaugcuucccacccuagugugccugaaaaaacaaauaaugauggcuccaguugccuuugguuaucuuagggaugcucuaacagcucauggggaccgagaagaugcugggcacagaaggacacauccaccuccguggggcagaagcgcccugugacccacucugaagggcaugccucugugugacauccucacucccauacacacaggccccaggcgcagggcacacacacaugcucccugggggaaaacaugggugucuccacccuacaccacagccccgccacaaacaggauguggagacaggaugcauucaugucagcaccaggggacguggcuugaccuggauuuccuagcaaacucacagaccucaucagcccuuuucacugaaucuggucuacuuccaaaggcggacugauaauuccacagcaugauuuucuaaaucacaauauuacguaugaguuucuugguauuguaccuucaucugaagguauuaugucgucuguuguuucuuucuuccuuucuuucuuuuaagagacugggucuugcuguguugcccaggcuagucccaaacuccugagcucaagcaaucuuccugccucagccucccgaguagcuaggacuacaggcgcaucucaccgugcucagcaguuguuucuauuuuagaagaggaaaaucuagggagacuugaaccagacuaugaaauagaauccgguaagaaaaggggggcaacccuuagaaaaagauuuggcaauuuauggaagcuacuaugucaaauguuuauuuagaggugucuuuauaauguugauauuuacaagccgaaagcacuuuuuauucacaccgucagucuggggagacacugacacauguugggucacgaguaagcccaagguagcuucucugaaauuccaguccugggaacaauccauuuguagcccuauuucaaauaacuaggggcauucagugaauucaaugcaaguacuaaaugagcacuugcucugugcaaaccauuauucuggacacugaagaaaaucagaagagugagcucucagccucagggcucaugacuauguugguucuucugggauuagggaaguauacaaguggcucaagccacaggcaaaggcaugaaugugggccagacaagauagauaacagacaagauuaucaagcacuuacuaugcucuugauggcuaagugagguaagcacuauaaugaucaucuucauuugauaauuguggaaacuacagauagaaaggucaaguggcuugcccaagaguuacagagcugguaaggaagacaaccuggauuugaacccagagagucugguaucagguagggcaucuuaauuccaaggcuauaaugacacucagaauggauugagauguuugccucuagcucuggaaauuuaggcaagcuaaugagucucaaauauaauauauaccucaaugaguuuauacaaaaaaaaaaaaaagauaacauauaauaagagauucacacaguacccaguacauagacaucacccgagaagccacguuaugaugauguuaacaacaaugaugauaugauacguguuaaaguacauuaagagacaucagauccauggaaaaugcuacuagaguccaaggagaggagaggauacagacaguuaagagacugagaaaguacucagugagaagcaguccuucaaauaggacuugaaggaaggaaaugcuuccaaugcaugaaauucagacagccaagggggcauuuggguaaucguaauauccaguugggcuggaauugggguuauauggagguaugagguuauugcuggggagacugagcaauaaagaagggcuagggauauauguaggggccacugauuaccaaggugaaaaccuagacagguccuaauuuauagaugucacuggggagagcugagcauccccucaaugagauguggccugaguguauuuucgggagauaaauccaaaagcaauuucuugaaugcucuuuaguucacggaaagagcauuaagggucucacuuggaacaauaaagauuaaaaauaaacagagagugcuauaguuuggguauggucuuucuguccccacugaaacucaugaugaaauuugauuuccaguguggugauguugggagguggggccuagcaggagguguugggucacgggagcagaucccucacgaaugguuugcugccaugcuugugguagugagugaguucucccucuugagggccuggauuaauuuccauggaaauggaucaguuccugagagagugggcuguuauaaagugagguuacucucuuguuugguccuggcucuucacacauauucacuuccucuuuggccuuuuucaccauguuaucaccccacaggacggcccuccccggaagccagggccaugcucuugaacuucccaggcugcagaacccugagcuaaauaaacauuuuucuuuagaaauuagccagucuccgacugggcgcaguggcucacaccuguaaucccagcacuuugggaggccaaggcggguggaucaccugaggucgggaguucgagaccaggcugaccaacauggagaaacccugucucugcuaaaaauacaaaauuagccgggcaugguggugcaugccuguaaucccagcuacucgggaggcugaggcaggagaaucacuuaaacccaauggguggagguugcagugagccgagauugcaccauugcacuccagccugggcaacaagagcgaaacuacgucucagaaaaaaaaaaaaagaaagaaauuagccagucucagccagguacggugacucacaccuguaauccuagcacuucggggggcugaggcagguggaucacuugagaucaggaguucauaacaagccuggccaauauggugaaacccugucucuacuaaaaauacaaaaauuaguugggcgugguggcacaugccuguagucccagcuacucgagaggcugaggcaggagaaucacuugaacccagaaggcagagguugcagugagccgagauuugcaccacugcacuccagccugggugagacucugucuccaaaaaaaaaaaaaaagaaaugaaaugaaauuagccagucucggguauucuaucacagcaacacaaaauggacuaaaacagagggaaacaaaggaaagacuauagaaguugaaaaacaggauuuggcaacugacaaucaagggucaaggaaaaaaagcaggacagcaugaugaaaaagucugggugaagggcagaaaaguuucucaaggauagagagagggaaguguggacaaagagcagguaguuagagaagggucaagaggaaguggugaauuauguuauaugaaugggcaguuuggguggcugagauauuagugagcaggcauuuuucagcaagaggcuguaauaggcaggccaccagauugcaaaggucagagcgagagaguuaaaucuacaaugaguaccuaaagagcucaaagccaugggcgcagguaagagccuugggagagcucacaggcuggguaaaaagccuggggugcacucacaggaaggggugggcagagcugcacagagugcacauaaaggagaagaaacucgaaacuugguggcaaagucgcagccaccaagggagaugagagaagugugacccggggaaaagucagcaggacccaaugcaacagggacucacguggggagaggccucugguuagguuccuaugaagccacugaccucugaaauaacauuucaucagggaaugaagacaggagccaggcuucauggcaaaaguuuagcaacuagggaaagagagaaaaagaaacauagucuggaagaacggcaagaagauuuuucuagaguaaagaagaccuaagcauguuugugcaugcucacucacucaaucgauuuauucaacauuauggaauaucuucugugugccaggagagaagcaaaagaucuagggcucaaggaguucaggguggaaggugacaacgcacgcacgcacgcacacacacacauacacacacacacacacacacacacucucuccacugcaauagaagcaggagaguccaggggguguagaggccaaguaccaggccacuucaccucaagucuguggauuacgggagaauucugggaggggccaaccccagagcugagguuuuaagauugaauggagcuugcccagggaaaggucggggagugggcagcgggggguaauggugagagugggagacagaguaucccgcugaaggagcagcauuuccaaggcucagcacgcccugggagaauagggccugucugagaaacugcagcggcuuuugcucugccuagggagcacauagcaagggcuaagguggccagguagguggauggcagaccacagaggaagaggaggacgaggaggaggaggaggaagaggaggaggaggaugaggaggaggagaaggaggaagaggagaagaggaagaagaagaggaggaagaacaagaggaagaagaggaggaaaaggaggaggaggaggagaaggaaggggaggaggaugacgacaagaucagaucaguggugcaagcaaucaagagagcagcagaugauccaaagcagggaguuggagggacugcaacaggcaugugugugcugggacuucuucccugcagucagaggaaagagggugaagacaaagaucuuugagagggagaaaaggaaagcugacauuaucaaaagaguaaucagcuugccagauaaaacauaccugagagcgaagcauuguccaaggagaguaaguguccgcagagaacauuuauaaacuauauucgauccucuuuauuucaccacagaacacugcucuauuggccuucucuacuuuuauuuaccuuccuuuuccaucgugcuauauauuuuuggacuuuuucaccauaaaauaguucaaguguagccacagauaaugaaaaaaagugaaacuaaaucagugaauguucaacuccagugaaagacuuaguagaaaagaaguuauaaauauuggcuuaggugaaguuuugagauuuauuuuggaccuuccugccucuacagauaaauaacugggaccuagcuuauaucuggaugaggguagaauuugcuccuauuuucaagggagcccugaaguguagguuuuaccugcugcuguuuauuugaugcuaacgaacacgauuugccacuagccucuguauuugcauaagcaaugcauucuaaggacuuuggaauuacagcucugugguuaggguuauggguucuuaacugggaucaaaucuguguacugcuucuuaguaaguguguggcccugggcaacuuaccucuguccuuuaguuuugcauuuguagaugggaaucauaccauuugucaucucguaggauuuuuguauuaagugagucaauguuaagugcuuagcucaguuccuggcacauaauaagaacucaauaagcaucaccuauuauuaccugucuaugccuuuucaauuuuuagucuauauaaaccaccccaugaagauuuccuccauaaacauauuacaaaauagccagguggcccucccuacaguuggcuuccuugaauguaaugacacuaaagaaucuugacacacagcuugucagacaucuagguaauuuucagauuccuuuguuuacaugcauacaaauaaaaguuaaacuuuucauagaaaauacugcuagucuccuacgcaaugucuauucacccucuuuccuuaagaaaagaacccuggccaggcacgguggcucacgccugucaucccagcacuuuaggaggccaaggcgggcggaucaugaggucaggagaucaagaccauccuggcuaacacggugaaaccccgucucuacuaaaaauacaaaaaauuagcugggcaugauggcgggcaccuguagucccagcuacuggggaggcugaggcaggagaauggcguggaccugggaggcggagcuugcagugagccaagaucgcgccacugcacuccagccugggcgacagagugaggcuccgucucaaaaaaaaaaaaaaaaaaaaaaaaaaaaaaaaaaaaaagaacccuauguuguucaggauagcaaugugcuccguuaaaaaugcucacuucucuaaacucccuuauagcuaugguggucaagugacccaauucuggguccccuuucuuugcuuuauuuuucuccauaccaugacuuuaaauauguaauuuuuguucuaguauaugccccugccuucaaacguaagcucgugacaguucuguccaucacuauauccugggcccccugaagggagccuucuacaaccgguaguuggucagcaaacagcugcugcacgaggaaaugaguggcacacacuggaaugugguggacaggguuucuaggaaagcucugcaaagcacaagguuuagccuugggaccuacugccuucuucccucucuucgcccugcuuuuucuucccaccuagaagaugcagcagccacuuugaggcuaugacgggaaagaaaaagaaagaagaaaaaagaaagcaguccagccaucuggguuucugaaggccgacuugagucauggagccagcccuggacccauucauggaacucagaugugucuaaggaaucacuauuugucagguuuucugcgacucguagcuaaacucauuuguuguaguuauaaagcuauuucccagcccucucaagaaaagccuuacccucuaaauauucuuaaaagugucugguaauagaaaauuaguuaauuucaccuguucagccaguugacacaaauccgagauugagcaauaaagcagguaugucagaggcauuugaaccagagcgucuccaccuugaacuggggcuggguaaaauaaggcugagaccugcugggcugcauucccagaaggcuaggcauucuuagugacaggaugagacaggagguuggcaggacuggugucacaagauacaggucaaagauccugccgauaaaacaggaugcaguaaagaagauugccaaaacccaccaaauccaagauggcgaugaaagugaccucuggucauccucacugcucauuauaugugaauuauaaugcaauagcacaccaaaagacacuccuagcagcaccaugacaguuuacaggugccguggcaacaucuggaaguuacccuauguggucuaaaaagggagggaugcucaguucugggaacugccugcccuuuccccagaaaacucauaaauaauucaccccuuguuuagcauauaaucaaaaaucaacuguaagucuauucagucgagcagcccaugccacugcucugccuauggaguagcuauucuuugguuucuuuacuucucugauaaacuugcuuucaguuuacucuauggacuugcccugaauucuuucuugcaugagguccaagaacccucucuuggggucuagaucaggacccccuuccaguaacagauagucucaucaauaagcgauguagauagauauaaagagaagaggcucaaaugaaaucucccuuggccuucuuuauuaaacuuccagugaaagcauauggagagaccagauaguguaagaaaauaaggaugaauggggaccccaccaaacucauaaugggguagggagggucuguucuuucuuuccacacaccuacuuaccuaucaccuaccuaucaacccaccucuuguauaugcaggucaagcacaucuagaggucagcagccccacuuggcaggggcauccacaauagaugcugagaugccagguaugucggaaaucucacugcuugucucucucccucccccucuucuggucagagcuaacuuccugugacuugagacuuuaaacccuguuaaaugcuaaauacuacugacagaagugauguuauuuuuuagaaacagacauuugaaacauaauuaaggccagauaccucccuuagaauagguuucagcugggcaaggaggacagaggcgugcacacagggggucccugagacaagcugggagacuggaucugcgaggcaggagucgcaggagcagugcucagcuuccacgcugccuccuucuuugcauuucugcuucuaagggugggccccugcaggucuugcccacauguguuuucuaaguucucuuguuuuuggaauaaaaagcagagaaaacuucugcccacagaacaccacucugacgcagaaugauauuuugguuggcagagacuuuugcagacaccaaccagacacagccaacugguucgccaggucacccuuugaggguccuguacucaacagcaaggcucccagcaagcauuuugauguaagggaauagugagauugucuauuugcaucuucaaauacaauguauaaauuauucuauagcgacaaugcaucaaaccuauucaaauuauaaucugacuuaggauuuucagggugauacaucuuuaaaagcaaaugaaauuuaaacacaaaaccucuugggagauuuuauacaaaauaaucaucaaugcaagaauaaguaucacccuucugcaaccaucacaguaacacugauucaggcaagaaucauggaaagaaucuaaaaccaacagguaaaaguuugaugagaaacauaauaguuucacggucucagaggaucaccucacaauauauguauauacauacauacauauauauaaaauauauauaaaaauauauaauauguauuauauauaauauauauauuauauauauauucacuacaaagaagaaauuguaacuucucagagaaaaccuggcagauaccaccuuaagugaaugaccaaaauuaauaucacuaauaaugaaauaaacggacaucacgggcccccgauauaaugcacuguggcgcaaaaaaacacaaaaacaaauaaacccuaaacaacaaauacuucaucaaacaacuagcuuacacucugaaaaaggcuaagaaacccuuucagauuaaaugugacaaaagacgugacaccaacaugccgugagccauuuuuuuuuuuuuuuuuuuuuuucuaaaaagugcuggauuggaaaaacacugcuaaaagagacauuauugggacaauuaguaaaacaaauacagcuggcacgguggcucaucccuguaaucccagcacuuugggaggcugaggcgggcagaucauuugaggucaggaguucgagaacagucugcccaacauggugaaacccugucccuacuaaaauacaaaaaauaguagccggguaugguggcgggugccuguaaucucagcuacucaagaggcuaaggcaggagaauagcuugaacccaagagguggagguugcagugagccgagaugacgccacugcacuccagccugggcgacagagcgauacucccucucaaaaauaaauaaauaaauaaaaaagaaaagaaaagaaaaagaaaaacuugaauagaaacuauguauuagaaaaaguuauuaaguuuccuguauuuggucauuauacuauauuauucuguaacagaaugucauuguccuuaggaaauauuugcuuaagcauuuaggggugacaaucaugaugucuaccauuuauucucaaacaggccagcaguaauaauaauuaauggugguguauguggggggcagggggugugugagagagagagagagaaagcucaggagugugcaaaugucaacaacugguggcccacgugaagauuacaugaacauucacugcacaauucucaauccuugaaacuuuacuguaacuuuaaauuuauuuuaauauuuuuuucuuuugagauggggucuuguucuuucacccaagcaugaucacaacucacugcagccuuaacuuccugggcucaggggacccaccugccucagccucacgaguagcugggacuacaggugggcaccaccacaccuggcuaauuuugggggggcugggggcggggggcuggugcuggaucagacagggucuuacuauguugcccaggcugaucucaaacuccuugccucaagugauccucccaccucagccucccaaagugcuggaauuacaggccugagccacugcacccagccauaaaaguuuucaaaagaaaguguuuuuaaguuaaaagcaaaggauagcauaguuuucaaaagccauuaacagagaaauaaaggacaaaauguuuuuaaacuuucaaauuguuuagaaacacauuaaguuugaaccacuuaaaauuacagaggcaaaaugacaauauuacaaauggagacagugggcguguguuuaaaauuuuuuguuaaccucagaggaggccaucagucucucucagccacaagagccaugccacauuuuacuaaguaaaggauauaaacacggaaagaaugacucuccacaauugaggggaagaaguacuacccagccuaacuaagguuaguacaaauuuggugagucacuuccucuuaggaggaagagcaaacauuucucguuuccugaaggauucagagauucugagggaacaccugagcucucagccugaaucauggcacauaauaaacuagggcaggaaaagcuacagcccguucacucgaugcuucuaccccaccacaauaccuccaaguucaaagucaaugucaacuugagccuuuuuugucuauuucagccuccauauuacuagguuccugggaggaggcaaggcaagcaaaacaaaaaaagcugauggggugugcacaguuaucuucucaaccugagugggcaguggccuugguuugcuaugguacaucacccacaacguuccucagaccagaacaaaacccacaaagccucuuaaguuuagaauuauagcuuucuggcaaagcagcccuccucccagaaccgccugugccagcagcacacacacguggauggauuaggcaaagcugugcucuaaagcacacacacgcucuccccaacgugugcuuugcauuccagaaauacuugaugccuaaaccacuucugugccucccuuggcaugaacguacaaguggcuccgugccaaaggaagcgucuguuuagagauguggacuuucuuuaaaauuuuuuaccauggaagaucacaaauagaacauucuaguacaaugaugaugcaauaaagcagaaaaagaaaagguuuuagaaaaaagauucucuuguuuuugucuuauuuauguugccuaaaagaaauacugaaaauauaacaagaaacauaaaauuagcuuccaugagagcagaaauuacaggguccaaguugggucaaggaagcaaaaauauuaccuuuaacaggaaacgcuagggaucauuugccauuuuuuaacacacacauucacuguuguuuuaaggucaccuaccaaaaugaggugcagaagacggguuuuuaaucauugguuuauucuggaauauaguauauuuuauauuuguaucuugcuucuugauaacuuuuauccuacauuaaaaauuaauguaaaagaugaaaauccaucuugguuaaugcaccuauccuuucccuuucuauuuccggagauuuauuuaggguuuauucacaauaaguguaaaaucaguaacucuucacaaaauccucagacaucaccaacugcauuacaaaacacacucuuagccaccuagauacacacacaugcaugcaacauguuaaggaaaaugacaucgcauaacuccauaguacauacgcacaugaucgccuguuugauuuccgucagcauggaccuaaaagacaccuucuuggaaggugguccugggcagagggagaaagacuuacuuucuuuccacuucugggguugacacggcgcuacagaagccaagcgacuccuacgagagaagauucguauagucaguguggucagagcagcaggcuucaucugauuuguacagagugucacuuaaaaaaaaaaggcagaagcaaaacuagaugauuaaagucauugugcuuacuucgaucugggaccgcagcugaagugacguggggcuagcaucggguuucuccuaaaacagaacagaugccaguuuaacgggacuuccaaacaugucacacgcgagaaagacaaauagacauguaagaagagaggggaggauucgggaaagguugggguauagagugggaggagauggcagagauaaacagauuuucugggaaaacuaaaauacuuuuaaaaugagagcucuagcccccuaagauugaaauauuuuccaaacuuuguugccagacucugcugacaauuuuauuucagaagaaaaaaagcacaauuucagucaaggggacugacaguucauggugaaauaauucuguggauauacuuaguuggucacuaagacacugaauuuacugcaacccauuugaguuuagcuguuuuccaacgacacuagacuuccaauccaauuuuuuuuuuuuuugagacagagucuagcucugucaccaggcuggagugcaguggcaugaccucggcucacugcaaccuccgccuuccagguucaagugauucuccugccucagccucccaaguagcugggauuacaggcaugcgccaccacgcccagcugauuuuugcauuuuuaguagagaugggauuucacuauguuggccaggguggucucgaucucuugaccucaugauccgccccccucagcuucccaaagugcugggauuacaggcaugagccaccgcgcccagccccaauccaauuuuaaaguucuaaauguauucagagcacuuaauagcuuaggagaaguuguuaaugucuuuaggaaguugggaagcuaacugaauguuaucuugcagccuuaaaaaucacuauacuucccuaacacaaaugaacugaccuaucuggaaauuuaaaaacaaacacucgcgcgguaucgaguugauaaaugaaauauaaauacuugauauuaagaaugcacugaaauaucauuaaauugugagaggcagaagaaucaaagaauauuacagauaaaaccauaugguguaacacccucauuucauaguucaaggaggcuguaucuccuuugaaaguaaaagaaaacgaagaguauuuagauaaacaaauuaccugugauaaaaauaaauuauguaaauuaugcauuuucacaugcaucuaauuguucaauugcccuuuucaucauuaacacaauuauaaaacuacaccaauaccgaaaaccuuuuguugauguauaaaaguagcaauaaaguauuaaaauaaguauaacucagagcaaaguuauacuuuuaaauaaggaacaggaauccagcacgaauauagaguaucggaaugaaugcacuuucaugcaggauugugggggaguguucugggaaucuguugcucaacaaugugcauguggcugacaacgcugcaccgcacacuuggguaaacuguugggagugugaauuuuauguuacgugguuuuuuuuuuuguuuguuuugguuuuuuuuuuuuuuuuuuuuugccacaaugaaaaaaaaagaaugugcugggaugaguacaucugagaaugggaugacuguagacaagcggccagaaagagaaauggguuuuaauggacaagaauuuaaugaacuggcaacucacucuuccccuaaucucaggcccuuguuauaaacaguuaucacaguggcguaaaaccuccauagaacucucauuaaccuccuccugguuuucauugcugccgcuguucaugacagacauauuucuguaccaaacuugauacaccauuucuaccaaacaguauauggacaauguuuugaguuauauauuccaaaugugaaugguaggaugucaggcucaggugcaguuaacaaaggggauauauacuuuuggacauuucuggugcuuacagaccaaucacaauuuuccaggaccuaaccuuucagccucacauagagaaauuuacaaacuuaaauggcaggagguaagcaaaaguauaauuagcaauuuuuuaaucccaaaucuuccuuccuauucaggaguugguacagagaacucagagugaugaugaaacuaaacuguuaguuugucugaaauuuucucugaaauugcuccuuuaacacccaauugcagcccaugaccuucuauaaccaucagcaaaagugacugguucaauucaccuccccuccuccauuuuuaccuuuucuucaagcucuaaguuucuaccucacuaguaaucauaauagucaugcuaggaaacgaucuucuuuuauuuaucugcauuuuuuugaauagauuuuauuugcuaagugcaucauuugccaugucauaucacaaacguaacauauaugguacauuaugcaaaacguaccugccccugcauacaaaguaguugcuuauuaacaaccauauuaaauguuugaugauagggaagcaaaauuuuaaucauuucaucuuagcauguucauuugcuacuuauaauaggcauuugauucuuuuagcuauuuaaacaaauuuuuuuuuuuaaagaaacagcaucuugcuauguuacccacacuggaguguaguggcuauucaugggcgugaucaucacgcaaugccgucuugugcccagagcucaagccauuccucagccucccaaguagcuagaacuauaguucaugaccacgcccagcuuguuuagcuacuuuucagaaaauugauuggggcuauaguuugacauauaauguuaaaaucauggagacaggcaauguuuucaugcaggacguuuguuuuaucaagggcagcuuacugauguugagcaggagaucuuguauagugauauuucuagugacuuguuuuuuuuaagaccaaguaagagaauaacuuuuucaggacgucuucuuaauuuuaucccccgaggauaagagauuacagucaucauuuagaugcaugucuucuagcaaacacauucuaaaguaaaaauauugcacaacugaggagaagcuuguaaagucauccacuaaguuaaggaccuauaaaugauuggagaaagaaaaauggaauaaacuauuggcaaaauuccguuauuauaacacugaugagugucacaugaugucaaugacaaaagagcagaagaguaauuccuauaaugugccaugugccaugcaccugacugcucagccaugaccccuuuauucagagaauagcugaugguuuacacuacagcucccgaucuggaugucacaauguagacagaaauaguaaacauugugaaccucaucaaaacaaucauugaguauauguguaaauauguauaacuuuugggcauguuguacacugagaaauaagaaccuucucuccuccccuaacauacaccgacuguuucauuuacuacugccguguaacaaaucaucccaaauguaguggcauaaaccaacaagcaccuuaugauguucacagguucugugaauaugaauucagaaaggcaauagcagaaaaggcuugcucugcucuacaguguuuggagccucagcugggaacaugcaaaagcuggggaugacuugaugggugggcuguaaucacuggaaagcuugcucacucaaaugucuggaagcugaugcuagggcugcacggguugcugaggcuuccucacagcaggaugcuggguugcaagaguaagcauauggagaaaggcaggcagcagcuguauugccccuuugguuuuuuguuuuuuuuaauuuuuauuuuuauuuuuauuuuugagacaaggucucauucuguugcccaggcuggaauucaguggcgagaucauggcucacugcagccuugaccuuccaggcucaaaggauccuuccaccucagccucccagguagcugggaggcacaugccucuagguggcacaugccaucaugccuggcuacuuuuuuuguacuuuguguagagaugggguuucaccauguugcccaggcuggucucgaacuccugggcucaagcaauccgcccaccuuggccucccaaagugcugagauuuguauugccuccuauaacagccuccuaugguaagauaucugccagagucacaagcccucccaggguucacggccaccucucucagcugggggagugccaaagccacaccgugagagcaacacuggauggcagacaucgcuguggccagcuuugggaauuacaguccgccaugcugacugccaaggaaaugggccugcucaugaguuuucaaaaugaggaauggggugcaaccauuuauucaugacaauaucuggaaggauuaucucguggcuuuuacaacauuuacucaaguauaucuuggcaauagucagccugaauuaucacuuaaggucaaaauauugcacuguauuaggcugcaaugaucaugucucucauuucaaaccuaugauuauagaaaauuuuaaauauacaaaaguaaagagaagaggauaauaaacuccccaauuccuacuacccagcuccaacaaucagcaguucagaguugauuuuguuuccucuauaccuuuacuguuacuucauguucaucucauuuuacuuugaagaaaaucccagacaucaaaucaugaaauaucaccauuucuaaguuaagaauuagcuaucagaguuccuuaacuguugcucaaucuugagcacguggcucaaccaccaagaauuugacuccuuccugguacuggaggacuuucuuuggucauaaggaaaaaucguauuuaugaaauuuagauacuccaucuaaauguugcaaagggacaugaagaaaugcauucugaaguugaauguaacuuuagaguuuauuagaaaaguauucacuauuguuuccuaaguguaaauauacuauccuuuuuuuuuuuuuuuuuuugagucagagucuggcucugucucccaggcuggagcgcaauggcacgaucuucggcuuacugcaaccuccaccucccagguucaagugauucuccugccucagccucucaagcagcugggauuacagguacccaccaccacgcccagauaauuuuuguauuuuuaguagagaugggguuucaccauauuggccaggcuggucucuuggccagacuggucuccaacuuccgaccucgggauccauccacuucggccucccaaaaugcuaggauuacaggcaugagccaccucaccuagcaaugcuuucaauauuuuuuucuuauuuccucacccccuccaauagagacaagucucguuauguuggccaggcuggucuugaacuccuggccucaagcaauccuuccaccucagccucuaaaagugcugggauuacaggcauaagccccugcaccuggcuacauccuuuaaaauuucugaauaugauaugcacauaaacuuugcuuggaaaaagcauauucuacgcagaauuuaaugagaaauuacuccucagaaugaccugggagagccacacaacacugguggcugaacuugaaccuuaagugagggcauuauaacuuaguuugaaauguuuuaaauacauuaaaaaaagaaagugaauugugaauuuuuucuguggcuggugaggugagaagauuuugaaauuugaccuauagauugaauuguucaucauuaagucacauauggauaccuuaguuaagaaugacaaaucucauuaacauuacaaacucuuaaagaaaccaucccaaguuaaguguaacagugaaaacuaaacacaaauacaaauauaucccaacaugaacgcaugcauguuuguucauauaugaaugugugcacauagaggaaaaaaaacgcugagaguauaucucacugaauuuuuuuacaagcauguagucuugcauuacuuuuuucuaaagaugaaagauuagcuuaaaaauacgaucuccaggccgcgcacgguggcucaugccuguaaucccagcacuuugggaggcugaggcaggcagaucacgaggucaggagauugagaccacccuggcuaacacggugaaaccccaucucuacuaaaauacaaaaaauuagccuggcgugguggcgggcgccuguagucccagcuacucgggaggcugaggcaggagaauggcaugaacucaggaggcagagcuugcagugagccaagauugcgccacugcacuccagccugggggacagugcaagccuccgucucaaaaaaaaaaaaaaaaaaaaaaaaaaaaaaaucuccaguuccccuauguuuuuaaauuaucuacauauguaugucuauaaaugcagaagaaaauaucuaaaagaauucuacacgccaaugguuacuucucaauuuauaaccuuuuucaauuacuuuaauauauuuuuaaaacauaauaaaagauauauauaacaaauuccuuuuguaauaaaaaguauacauauacaaauuauucauauauuuuuuaaaacuuaauaaaaguccccaaaguuaacucugauaacaauuuaagaaugacaaaucucauuaacauuacaaacucuuaaagaaacccucccaaguuaaguguaacaauuaaguccaacaauuaagcuaaaaagcuaccuaagaaauguuaaaacaggccgggcaugguggcucaccagcacuuugggaagcugaggcgggcggaucacgagaucaguaguucaagaccagccuggccaacauacugaaacccugucucuacugaaaauacaaaaauaagccaggugugaaggcacacaccuguagucccagcuacucaggacacugaggcaugggaauggcuugaacugggaggcagggguugcagugagcagagaucacgccacugcacuccacccugggcgacaaagagagacuccgucucaaaaaaaaaaaaaaaaaagaaaaaagaaacaaaaguauuaauacuuuauuucucuaguuaggucauggcuaguauugaaauauuuucuugauguguuaaaauuuguauauuuuauuauuaauagagaaggaccaugcugaaaugauuucauauucauacuuugacuaaaagaggcuccgcuauaguaugguauaguuaaaaagaaaaaugaaucaggugaucaaaaaucuuacuggggagaaaaaccucaaaugcauuuauugucagauuggacaauuuguagaaaaaauaguuccacaaacauuuauuguaucuaauacagaagcuaaaaaaauaaauaaauccaacaacaaaagcaaaacccaaguauugcaagaugaaaucaguaguuugccaaaaccaaaaccgaaacaaauguguaccugugugugcuuucaccugcuuguguauguauacacacacacaucuacagccacacuaaaagggacuaggucaaauacaaaacuaagucucugacccuaaaugaugacauucuggcuuuaggagcuacaucccauugugcaaaauaccagacucaaaaacccacccagggcagaauuagauccuggaaaacaaauaucaugcccucauccccacucccacuuugucuccaccuuccuguggaaauccacacguuccuccucccuuaaugcugccaaggcugcaagccaaaugaacuucacagcuggaaaagcaggagggacaaaucccccuucuguuccaaaaauggagaggaagaauaccaggcgcccaccagcucagcucagugccaaguucuccuccuccacacuagguacaggaaggaggagguggaaaaagccagaggcgaucggaugcuuagccacaugcagcuaaaaguaaaaugccacaugcuacuacugaugcaugcaauuaauggaaggacccaagcucugaacugcuguggaaaguugcugccggucacagauuuacguuuuuuuuaucacuuuacaagaaggcuguagaguugugguaucucccaguuggcaaacuacauuauauguguucuucaccggagagauccuuaccaaguaacagauaaaccagaagaacagaaacuuccagauaaacucuacuuaaaaauguauauauugcucaggcgugggggcucacgccuauaaucccagcacuuugggaggccgaggcaggcagaucaccugaggucgggaguuugagaccagccuaaccaacauggagaaaccccaucucuacgaaaaacacaaaauuagcccagcgugguggcacaggccuguaaucucagcugcuugggaggcugaggcaucagaaucgcuugaacccaggaggcagacauugcugugagccgagauugcgucacugcacuccaccugggcaacaagagugaaauucagucucaaaaaaaaaaaaaaaaauuauauuacuuuguacacuaucuagucuuggcuuuuauuugguuuccugcuuaugacaaauggguccauaugaucagauucaaguagguuauuucucaccuuuuaaaggaggccccuuucuccauguuuuaaaccuaaaaauaccaucacgucuuuauuuuuauugaaaauucaaagagacucuaacuauuugcaaaguucugggaguccaagcguugacuccaugaccugcuggcugcuguuuaaccuuucaguccuggcugaccugucucagacgaaccagccgucccacuagaugagcuccagcagucaacacauggacuagugcagggcggucaggcauguagaucccagggcaaccugaaagucaacauucucacccuugccaggaaaucauuccacucuugucugacuucucuauuccagucaauucauggaacaugugucgauuuuaccaggacuuaaaauucaacauugucagccaggcgugauggcuuauaccuauaauccagcacuuugggagguugagguggguggaucaucugaggucaugaguuugagaccagccuggccaacauggugaaacccuaucucuucuaaaaauacaauaauuagccgggcguggaggccggcaucuguagucccagccacuagggaggcuaaggcaggagaauggcuugaacccgggaggaggagguugcagugagccgagaucgugccacugcaccccagccugggcgacagagugacuccgucucaaaaaaaaaaaaaaucuauugucuuaggagucuucucacuccccacuaaaucagcugcccaaagcuacugcuuuucucuucccaagguuucuggcauccauccagugaauccauuccacuuguaguccuucgccucacagcuaccugggcuaccagcauacggcugcauggaaaguacugucagcugggagacuggaguccaguucugcucccugcuguaguguaaccuuuagaaccuguuuuguuugguuugguuuuuccaauggcaacaaacggcaaauggaccacuugauaaucuuuaggguccuuuuuuacucuaaaagggcuauaaguggugucaugccccucuaaucacuauugucaacuccaucuucuggaaauaguacucugugucucugcuauucaaaaugugauuuguggaccaucugcaucagcaucaccugggaaccugcuauacauccagucauggucccaucccagaccuccugaaucaaaaucugcaauuugccaaaauuccccagugauguguauuguuugagaaacucacugcuucugugucacuucucucuuccaaaaucuuuccuggaggcagggugcaguggcucaagccuguaauccuaacacucugggaggccaaggcggguggaucgcuugaggucaggaguuugagaccagccuggccaacagggugaaaccucaucuccacuaaaaauacaaauauuagccaggcaugguggcaugcgccuauaaucccagcuacuugggaggccaaggcaggagaaucgcuugaacccaggaggcgaaggcugcagcaagcugagauggcgccacugcacuccagccugggugacagagcgagacucugacuaaaacaaaacgaaauccacaaaaucuuucauggaaacacaauacugacaggaugaaguccacguuucagaagaagaagcccccuucaccaaauagccugaucauaaacccucuuagugaacaguuaccauguccucugcucccugagugcagacugagccuggugucucacuucugcuuaugcuaccuagagugcuucuccuuucuauccauccaaauccuacucauccuuuagcuccaaucccaauacgcucuccuauuuaaccuucucugcccacuugggccuuaaaugauaucccugaguaugggcacaccaaugacuagccacaucacuuauucauuaaauguaccuauggguagcgacucuucuacucacuuacugguuuuccucaacuagacuguaaauggccuuccaauaaauuccuguugaaauucauuguaugccaccacaauccaucaaaaucuauuuacuuagcauuuacuaucugccaggacauccccuugagaauguuacuuucuacagccuugcacaggcucccuguacaagggaguacuacugggaaucuauugauuuuuuuguuuguuuguuuguuuuuguuuuuuuuuaaagagaugggaucuugcucugucgcccaggcuggaguaccguggugugaccauagcucgcuacagccuugaccuccuaaacucaagugauccucccgccugaggcucccaagcagcuggggcuguggguauacaccaccaugccuaauuuauuuuuuuuagagauggagucuugcuauguuggccaggcuggucucaaacuccuggccucaagcaaaccucccaccucagccucccaaaaugaugggauuagaagugugaacaacuguccuaggccugguuuguuuaaauuggaucacuuugccaauaagccugacucuuuuuuccuuccucuuuuuuuuuuuuuuuuuuuuuuuuuuuaagagacagggucuugcucugucacccaggccuagguuggagugcagucauaguccacugcagccuugaccucccaggcucaagcaauccuccugccucagccuccuggauagcugggacuacagguaugugcuaccaugcccagcuuccuuccuuuaauuuguguuugcaauuuuacugcaugggauguguauuuucauguuuuuauuuaagauuuacuuuuggauugcagaguuacacuaggaagcaaaaauaauucaacaaauauuuaagaucuacaaccuagauacauaagaacuuaaaacagaauguuguaauguuuaaucacuuuuagguaaaaaucaguaguggccugucaguuucuucauccauaccuaacucuucagcuuuucaugucucauuucacccguauugcucgagguauagcagaagauguuagucauuguucuggacccccauaagcucuuggccugguauaagaaauuuucuuccgagugaaacugaaggaaaaguacucucaucccaucauaucaaagaagaaagguucuaagggggaaauuuuuauuucacagcugaagaauucuauuccacuaacugcaaccuuuaagucucaccauaauuaagggaucagugaauuucugcaagcuuucauaagaaagaaaccugaaguggcaauuuccacccagccauuagugcucucuguuaaaauaauugagccuuuugcuguauuaguuuauauucucuuuuuuuuuuuuugagauaaaguuucacucuuguggcucuggcuggagugcaguggcgccaucucagcucacugcaaccuccgccucucagguucaagcaauucuccucccucagccucccgaguagcugggauuacagauguguaccaccacaccuagcuaauuuuuguauuuuuaguagagaugguuucaccauguuggccaggcugucgcgaacucuuaaccucaaguuaagauccgccugccuuggccucccaaagugcugggauuacaggcaugagccaccgcacccggccugauaguuuauauucugcaguuauuaguuacuuauuuauuuaggccucaccacguuccagaaaaugacuuaagauggcuaaguaacuuaguucaguguuacaugauaaaaguaaaaagcuaaagagcuaauuaauuuauaugacacaaauagcagagggaacaagacuacaaaguagaguaggcccagggauucaguuaguucauaaaaggugagccaugggaugcuacaguacagacagacaacaugaucaguuacgagauggauguuacuauacuuuuaugucuuaagguagccauaggaaaauggcucuuucucugaguaaaaauuucuccucuggcuucuggcagagauaacacacuauuacucugaaagauaccacauggaaaauuccugaagaagucaccuugcucuggaaaugcuuucacauugggcaaagcugaaauuaggucugagauccccgaaugaaagcggaggagcauaccaagggggccucccugagguccacacucccguacccauucagaggagacaagaaguacccagggcaggaacagaaaucagucugggaagacaggaggguaaguuccaccaucuugaagcauggcugugcuaaaauacaucagaguugaauugguuaaauucaggaguaauuugaaucuaagagggucaagcuuggugcucccacaccucaugucaaacaaggcguauacugcuuuaaugucuaaacugucuuuguuuaaaacuauguacuagaucguuuaagcuacaacuuuaccaauguugagugcauaccacauaccaagcauuuugcauggagauaagaauaagaucuacacaccacaauguggcaauggaucacuucaauaagaugugaguguuguguuagaagaaugcaccuuuuacaguguacaaaacaccagagugucauguuauauaaauguaaucauuaaaagacacaguguccaugaagacauuuuaguuauccuaaaaaacaaauccaacaaguucuauaauucaauuuuucauucuacuagcaggacuuggcauauccacacuauaauccacccccugggugaauuucccagggguaaagaccaugauaucuggccauucuagaugguaguggcuauccccagaauccucucacccucccuguucucaucccaugcucacuaagugaucuccuuugcuuuuuugagacagagucucacucuguugcccaagcuggagugcagugugcaguggcacaaucucagcucacugcaaccucugccuccuggguucaagugauuccccugccucagccacccgaguagcugagauuauaggcacgcaccacccacacugagcauguauauauauauuguauuuuuaauagagaugggguuuugccaugcugaccaggcuggucucaaacuccuggucucaagugaccagccgccucagccucccaaagugcugggauuacccgugugagccaccgugcccgaccacuaagugaucuucugaguacauccaguugcucacugggauugacuaacauaagacaaaagugacaggaagcacuacauaagcucauuuccuuuugcuuucucuguuuuuuuccaucuccucuuucaucuaaucauuccaucauuuuaaaaauaguuacugagcccauaagucaacgaggauaaaacagugaaacagacacgcaccacuucagugggguuuccaucuagugaauucuuaagucacucacuuugcauuucaacucuaagccacagguacaacacuccuucuguucgggcaccaggcacaugacaucuggguaacucugcucagcucuggaugccacauuucccggggacaauggaaaccagagcaccuucacuagaauggugucuggaaaugguaucaaauacucaggaucaauuggaggaagcagggcuguuuacacagagaagggaagaaaaauauaaacaugggaaagccuuccagggagcagggaacugcccagugcagagcuguccgaccccuuuccccacagcgguccccugacaaugagagcgcacugcacacuaggagaaacugagaaaauuuuaaauggaaaaaaaaguauuauuauuuuuauuuauuuauuuauuuauuuugagauggaguuucacuguuguugcccaggcuaaaagagugcaguggcacgaucucggcucacugcagccuccgccucccagguucaagccauucugcugccucagccuccccaguagcugggauuacaggcgugugccaccacacccagcuaacuuuuguauuuuuaauagagaccagguuucaccauguuggccaggcuagucucgaacuccugaccucaggugaucugcccgccuuggcaucucaaagugcugggauuacagguaugcgccaccacgccuggccagaaguauucuuuuaaaguaauaccuaaugaccauugagaaaauaaaaucaggccagacacaguggcucacggaggcugaggcaggagaaucacuugacccuaggaggcagagguugccgugagccaagauugugccauugcauuccagccugggggacacagggggacagggaaaaaaaaaaaggaggagggggaggggaagggagagggggaugggaggggagaaggggaggggaggggaggggaaagagaaaaaaucagaguauuagugaagauauuaaauaucgaauugacauaauacuuuuaaauaaaauauuuuccaauuuuuucaagaauguugagcuuacuucuuugaaaauaauugucuuugaaauaacugucuauaugcuugaaagaacuauaugccauuccagaucaagauguuuaaugaugaucucuugauguucuuguugguuauuaguaacaagaaguuuuacucaaacuaagagguaaaaauuguuuuaaccuuuuuuacaaccauuuuaaauuuauuaagcauuuuacagccaacagaaauacggcaauuucuauuucaagaauguaaaagcaccuuauuucauuaacagacacagugaaaucucuuaugaaaacauaacagauuuuaaaucuaguuuaauuuuucaauuagguacuacaauauacugacaaaguucuugcgugcagccuugugcaugcaguguucauccugaagcuagcuuggccgugcugguccagagcugccucccaccacaucugaccacugcaccuuggacuccaugccugaagcuucaauucaucucuuccaugagcuucagggacccuugaccaugaugaccaaguaugccgcugaaguacacaucacccauccuguguacugcucaugggaaucacuuacaccgcucugcccugggaccauguuccaauaagcccugucagcgguucucaaacuuagugccuugcaaucccuggagggcuucuuaaacacagauugcuggguccuacccaagaguuucaucugcauuuuuaccaaguucccaggugacacugaugcuacaggcugaggagccacacuuugagaacuacugguccaaagaaggcugcucagagcugcuucuagucagauucaguggccugcaggugaagggguagguguaucuggagccccaccugaagucuggccugguuuucagugcucuaaaagggaugaucaagacuaaggauuuuaaaguuaagaggaggcuggacucaguggcucacaccaguaaacccagugcuuugggaggcccaggcaggaagauccuuagaggccaggaguuagagguuacagugaguuaugauugcaccacggcacuccagccugggcaaacagaacaagccccaucuggccggauaugguggcucacgccuguaaccccagaacuuugggaggccaaggugggcggacaacuugaggucaggaguuugagaccagcaugccaacauggugaaaccccgucucuacuaaagauauaaaaauugaucaggcaugguagcacaugccuguaauacuaaguacuugggaggcugaggcaggagaaucacuugaacccacaguaagcugagauugcgccaccgcacuccagccugggugacagagcgagacccugucccaccucccccccccaaaaaaaaaaaagaagaagaacaagacaccgucucuaaaagaaaaaaaauuuuuuaaaagacaaagauggacucaccaucauuuuauuaaaaaggaugggggaggagggcaagcagagccagguguccaacaauagaauaaauuacuuacaacauguggaaaccacaucaauggagcauucaagcuugacugcaggacugucugcugucugggauggggauuuuuuuuuuuuuucuucagaaacuggucagaccucugaccgacuacuauaauuccacuacuugauuggaguguaaucauuggaaaugaaauuaaguuauugugguauaauuuaucguuuacaugaguuuuuuuuaaugggagaaggaacugcaaguucuagcccaaucacucaaacauuugaaacagacgaccuuccaaaguuggcaacagccuacaacugaacaaacauuuaugucuucaucuauucaacgaguguuuccugaccaguuuguacucaguugacgugcuggguacuggcaguauaaaaaaacagucacugaccuucaagagcucgcaguuaagcaagagaaacaguaacugagaauauaaaaaauuaaaggcuuucauguuaucauauaaauaacgucggaacugauuaguaugcagauugggugacugaauaagggauuuacaaaauuaugcagccugaucaaacaggaggugcuaaauuugaaugguuccucuaauagaucagcucacauuuuguacuaaugaagugucacuauuauuguugucuuugcuauuguaaaaucauguggugcuaucaugacauuuaaccacuuucucauucucugaaccauauuuucuaaccaucuuuaaauauuguguaaccaucuuuaaaaagcuccagaaucaauugcaagccaauacauucugaaaucaucagccacaaauuugcuuuuaaaauaaauaaacuuuugacuuagucauguuguauaaugauguaacacauuaaaaaacacauggggcugggcgcgguggcucacgccuguaaucccaacacuuugggaggcugaggcaggcggaucacaaggucaagagauggagaccauccuggccaacauggugaaacccugucucuaauaaaaauacaaaaauuagcugggcgugguggcgugcgccuguagucccagcuacucgggaggcugaggcaggagaaucgcuugaaccugggaggcagagguugcaguaagccgagaucacgccacugcacuccagccuggcgacagagcgagacuccaucuuaaaaacaaacaaacaaacaaacaaacaaaaaaccacacacggauagauaucauauuauuugagaaagaaaagaauuauauaaaaauuggaaucucagaaacaaauggcaaacucuagcccagggcaaacuuuuuauuggucuauuauaaauguuugcaaaaucagguuuauaauggaaacaggcggacaaaguuccaauguaauauacauaaaugacauguuucuguucuuguauagugauuuuccucccuucugagcauuaaucuuugaaugacuuacucuauaaauuaugaaacuuaguucaaaagcaaaugaaauuuaaaauacccauuuauugaauggcaaaagugccacguugaaauuacugugauuuaucugugucuguaaugguuacuacagcaaacauacuucauugcucaaaauuauuaccugguugcauaguuuacugugguuuaaacauaaauuuaucucgcuguucagaacagcagcuguuugucagggucauguucauucauccacagccacaaggcccaacuuuuucuuucuacaacucuaaaguggcacacugacguauacacguaacacucacuuucuggaaaccaauuaaauucacacggaucacugacuacuaauaugggaggaggggacaagguggaguacuguuuauccagaacagaguucaucuccaugcucacaugccugcuuggaccccgcaugguucuggcagcucaggcagaaagcauagauuggcacuauaaaagcagcccugucugcaaaacaaaugggauucuugggcauuggugcuugugggcacugccaucacagugacugagucauugcugcugugccuagguagagagauucugguugaaaagccaacccuuccucuauaccaagaggagggccuucuccuuucccuccucgucauuuaccugguagagaaguuggacaaaaaugcauauucuccaucuggaagaaaaugugccacauuaugauaauggacuaaauggcucacuauauaaaaagugcugauaaauaaacaagaaagacauuacuuuaaauagaaaaaugagcaaaugacuuuaagagaugggucagacaaauaaggauagaaaaauaugugugcucuuauaaauaacgagagcaauauaguuuaaaagcacaauaagauuacuuuccaaacugguaacuuuuucucccuaaauacugggaaguauaagauaagaacagggcaagagugcugcuggugggagugcagacuguagaacauuuccagguggucaacaguguuucaagagucuuucaaauguuccuacuuuucagccugcuacacucauaucuaauaauuggcccuggcugggcacaguggcucaugccuguaaucccagcacuuugggaggccaagguggguggaucaccugaggucaggaguucgagaccagccuggccaacauggucaaaccaugucucuacuaaaaauacaaaaauuagcugggcaugguggcacaggccuguagucccagcuacuugggaggccgaggcaggagaauugcuugaacccggaggguggaggaugcagugagcugagauuacaccacugcacuccagcccagguaacagagcgagacucugucucagaaaaaauaauaaauaaaaauaauuggcccuaaggagacagugaacucuuaagguaaagauacacauuuaaagauguucauagucacuuccuucuuucuuucuuuuucuuucuuucuuucuuucuuucuuucuuucuuucuuucuuucuuucuuucuuucuuucuuucuuucuuccuuccuuccuuccuuccuuucuuccuuucuuuuccuuucuuuucuuuucuuuucuuuuuuuggagacagggucucacucugucacccagacuggagugcaguggcggaaucucggcucaucacaaccuccgccucccagguucaagugauucuccugccucagccacccugaguagcugggauuacaggcacgcgccaacacacccagcuaauuuuuguguauuuuuaauagagacgggguuuugccauguuggccaggcuagucucgaacuccugaccucaaaugauccacccgccucagccucccaaagugcugggauuacaggugugagccacugugcccagccacuuauuucuaucauaacaaaaaauuggaaauugccuaaauaguucaaacugggggacacaaauuaugguauacucaaagacaaagacaaaggguacauaacgauuaaaaaaauagggaacaauaauucauaagggaaagguauuccuuagugaaggcuaaggaguaugaacaagcccaccauaugacuucagcauacagcuugaagucauuguauauuuugguauaugguauacauauauaaacaguggcauguaaacucccuggggaaggaaauuuuguguguuuucuucacugguguaucuucaggacccagcagagugccuggcacuuaauagauacucaauacuuacagaacagauauguaugucagacaaaagcaugugguuauaucugaguugcaagugugaauagaggacuuaaguaucauccuuauuuuuuuuaagccuucugaauuuucuacaauguauauauacaaauuuuacagucgaaagcagaacaaaaauguuucugcuuaaaaucgguuuuucuuaauguuauuccuucuacagacccagagucagauuugaucuaaaauuuacauacacacacgcacacuaucaagauucuauaccacaacugggauauagaagguccaugacauagaagaucuauguuaacuuuuuaaaaucauauauaacaaacuucuuuucuacacauagaucuuugcagggcacuugucauuuaaagguacauuauucaauacgcacacacuucuuuuuuacuguauuauauuaauaaggauuuuugaaacaucaauaaugcagaauuuuucucacagaaauuuugcuuuacuuucccuuuuucuuaaaacaccuuguugaacucuccuuuccuguagcaugaaaaggaagaauuaaaguauuuucuuguugucucuuaacuggccucaaucagcuaaauaccaccaggguguuaauuacaaaacaguuauuucauauaagguuaugcauauuacuacauagaaaaucuccauguacacaaacuaagccaauuucccccuagcacauagcaugucuuuuucucaggaaaagccaacaagcaaaaacucagaagaguacaaacaggaaaccuauuaggaccugcucuccaagggcagaaaacggauggucuguagcagagcagauaaaagcagcgagucugaacacaaugauugauguggcugagaaacaggacaggagggcggacggcauccccaauacuacauggucaucuaaaaaggaugacgugaaccuagagauaugauuguuauuuaaagaauagagacaaucaagagucuuacaugaguaccaucagaucuguuuuuuaaagagccauaaucccuauagggauacggcaucaaccucaaagucauccacauuuucucugucaugcccuaaaacaacguaugcaaauucaaagcacuaacacuugaauuuuucauucauucuauaaaacauaaagagaauccaaaaagggugcucaccuuugccccaaaacuccaagcuagaaugagaaaccauuagcaucccaucccaguacagauuuuaaauauucuaccuauacguuuugaaaguugcuaugaagacucucuuugaauauuccaaauuuuaaucaccagacaaauggccuucacauguaaaugcuuauuaccugaaacagaaaaugaucuuuggaaauggagaggauuugucuguuuuugccauaaauuauucacagagcaacaagaaaaccucucaaauuucaccaaaaauauuauaaaguugggagcaauaugccacgugacaaugccagaauggacaggagaugggaggggaguaaguuucaaggaagauucaaucuuggggaaaggacuggcugcauggaaacugcagagggcuuucaaaguuaugaucugaggguggaagaaggguuaugauuuggggucuggagauuaagguguauucacagaacuuuagagaaauuaaagaugcugccuccuccugggccuucccugauccccuaagacuggaucaggugcuuccaucggaauacugcaccacgcuaucuguacucagacuucaguguacccugggcacaggcuaucgguugcucaccauuaacaucucaagaccuagcgaagugccugguucagaguaaguaucuaauaaauaucuguaucgugaauucaaaaaggaaagaguagagaagacuggaagcggagacaccaucacacauaaagcccagugccuuacuauggaagucauuuaaaguccuacuguguuuuuaguugcugguuacuaacauuguauaauuugacugacaaagcaggagaaagacaguauguucaacagugaagcaaaacaaugacagaaacauguucacggaaggacacaaaccauguuaagugcuauauauaacuucuaccacaugugucaaggguuuugucagggaucacguagacugccauuuguccuuguuuaucccgaguaggcagccagggaaaagcugaguggcgugguaaggaaauacauaaaaguaaauuaacuauuuucuugaaaauucccucuuaaauaacuauaugcaagugguaaacaaaaaauugaaaugauggcugauuugguuauuuacaccuagauguugucaaaauuaacuauagaaagaacaaugucaaacaccuuuggagcuaccaaacaucuauauaccucauaagccccaaguauucaccaagugcccacuaggaccacuggguuuguuuucagauugcaucccacuuccccaccuuuugucaaucacaacaucuccaccuauaaauugaguacaugugccagggccaauccuggagcuucaggugcuucuguagcgcuuucugguucaucauaaccaucaucaucaucaaaguuaucaucaacgugauuaucaccaucuucaucuucuucuuugcuucauucccaucauugccaacauuuaucuaaugcuaacugggugccauacaccauucuaagcacuuuuucguuacguguaaucugaaaaaaacuuauaagguaggaacuuugccuauuuccaguuuuuuuuaaaaaaaaccaaugaggaaacugaggcauggagagauuaagucaucuugcccaagaccaugucugaagguggcaggcucuguggagucuaucugauuugacuaugggauacaugcucuuuuauuuauuuauuuauuuauuuauuuugacagagucccgcucuauugccaggcuggagugcaguggcacaaucuuggcucacugcaaccucugccuccuagguucaagcgauucuccugucucagccucucgaguagcugggacuacaggugcaugccaccacacccagcuauuuuuuguauuuuuaguagccacgggguuucaccauguuggccaggauggucucaaucucuugaccuugugauccgcccgcuucacccucccaaagcgcugggaauacaggcaugagccaccgcgcccgaccagggauacacacucuuaacugcuacccuaagaucuacuggcccucccagucagugcuccagggcugauaacaggcuuccuuuagcuuccugagucucugcccuccuccccuacucucuagccuguacccaaguguguuuucauuucuucuuugcaaggccuuguucugguaacugcacaauaacccucgucuucucccagggcagggguuccaccccauccauguucagugacugagucucuuccaccuacucacagaccuagcuaugagcagacacacaaauaugggcuguucucaguuucccagggcuaccucuaccccauuaucuugucuugaggguccccaucaccugcugcuugcccagacuucaacuaccuacuggaggacugagucuuuccaguaaauccccacaaugaggucucccucaauggcugggucuaaauucaggcuggucucuccugcaaauuucugcucaacuaaccauaacuggccuuguguggcaaaaacccaagguugcuaagaaugguaaugaaucucacuuaaugauuccccguguuccagggcagauccuggguuauuuaucuguuucuguugcaauccaacgaagucacauucucucuagaggcaacacaaccccaagacacagagccacuguucugagcugguggcgugugugcaggagcccccucuuccugcaggccucugaggggucugccaccugucagacauugugccguuaauuagguaacacuugugaaggguuuugcgacacauagcacacaugucguccaggaucucacacauggugcuccacgcugcaaaacucaagagcuauuuuuaaacuguaucuaacaguugagcaaaacuugaguaucuccuauugcagaccacuuuaaacucauuacucuuccacugaaaauuccucaaaaagaguguacagcuaguggggauuauuaaauaggauacagaggacacuuuaggaaaaaaagaaaagaaaaaaagaaacaaccuuguugcaauccaugccaaguuucagggaaaccucaaagacuuugcuuuuguuucaucuauucuuuugaaaacaagcaauucaagaggaacaggagggaacaaauugcauccugucugcccagaugucauguccauauaggugagugugucacggcacuggugggccaucugaggguacacugaagaggcaucugugaugccuguaaccugcuaagacaaaggccagcuuuucuaaagcccuggacagacuugcuugggcaguuaaccaaaugccuugauggauguaggcuugaagugugggaucuccuuuaccgccccacacuauaauuacacaaagcuuuucuggcuuagggaaaaauaaaagguuuauuuuuaauuaaugagagcaggucccuaauucucucuuuaaaagagcuuccucuugccaaagggaauccucugaaugaguggguagguuuaauggacugccuuuggcuaagagguuugcggguaguuuccccaaagaguuaaacuccaaugacagagccauggaugugggcuuccucuuauggcacuccauaucaugauggcucugcggugaccuuuguccugcuggcucucaggugauugcuaucaaucuuuaaauucuugaaguuugcaagggcaggugcuagcauguguucaaaccuauuuguauuuaucuuucagauaucugugcucccagacaacauuaaugaucauaccaaguuacuuagucaaaccugaagagugaucuucccucugauuuaagugguuuucauuuuuuaaagaaaacgguccuacaaaauuaauuuauguauauuuccugcaaaauuaauauuaaguauugcuuuaucaaucuugucuucaccccagaugugugacauaacccagggacccuuuaaagaacagguugugucaagcaaaugucagaaaagugauacuauuuccucgcacuuacuauuuaauaggaaggaaaggaagcggcacaaauacauuaaaaucagugcccaggccccuuuagaguaaucagaacuuccuagacaaacaaauaauuaucacuaaugucaguauguaaauuguucagcuggcaugcacacaccaauagcacuaauuaauuuuuucucucaaauuaaaaauacucaauacaaaguucuaaacucauuugucaauggaagcccuacucauuugucaucauaaaaauaagaaaauacugugcacucugugaagucgaugguggugacucauguugauuaaaugcacagucaggcauuauacuuggcacuuuaaaaauauucccucuugagaaauguauuaacucuuccugggcucaguagaauguaagcuccaagaggcuggaugcaguggcugacgccuguauucccagcacuuugggaggccgagguggguggaucacuuaaggucaggaguucaagaccagccuggccaagaaacuacaaaaaauuagcccgguaugguggcaggcaucuguaaacccaguuacucaggaggcugaggcaagagaauagcuugagcccagaaggcagagguugcgguaugccaaaaucgcaucacugcacuccagccugggcgacaaaacaagacccugucucaaaaaaauaaaaaauaaaaaaaaagaauguaagcuccacaagagcagacacuacccacuucccucacugcugcagcuccaggaccuagaccagugccuggcacguuguaggcauucaauaaguauguguuggauaaacuuuuuaauauuauuucccauaguucucacugcagccuccaaagguagguaugguguuuaucuccuuacagaaagagaaccugaagcucagagagacuaaaucacuugcucauaaucacauagcuaauaaguggcaaugccaagguuucuaccccagucuaccaccuuccugcauucacccucgcccucauccugaaccauucugcuugacugccuaagagucucuuacauucaauucucugcuaaagacauuugcauccacaaaaguguccacaugaauauacauaugggaacacgccagaaauucuucccauuauauuuuuucugacugugccuuaagaccuaauacucagcaugccuugguucuagaaccuaauuauuuuagugcuucuuuuauuuccuuacauaauaauuuuuguuuuuaguaaauaucguacugacaaaaguacagacacaaauuuuauaggacaacuugccccugcuguaaauauuacugaugugcuccuggcuaaggagggucccagaagugacccaagcuuccaguguuuuccauucuccaaagagggacgguuaccauucuucaaugguuuuuacauagacuucauaaaagggaggagugauuccccauauauuuauucuuuuuuuuuuuaugcuucgucaucauucuuuucucuucccuuuggcauguucauacaaccagguucaacucuccccauagaaagaagaggggagcagaaggagaggcccggagaaggaaugggagagggguaaggggagaagagggaggaaggaagguagggugguucauucucuuauuguauccauuccuucagagccaaaagugcaaacuucuugacuaaauguucuacaucaacggccucgauuuaccugacauugauuauuucaggccacacaucaagcuaggugcuaagagcacaaugacgaaugagccuggaugcauuucuuucacuccuaccgcuucucuugagcccgcauuccacaagaaugucccagcagcaccucaaauacauaucguaagaugagcuccugaucuuucccgcacauucuccuuccuccuccccuuucucccuguuaacagccacacuccccucccagcaucuucaguuagcccuauccauuccaauuuaggucaaucgagaccuaaauuccuccaacaaaauauuucuucuguucguuuccucauuuccauuucuacacuuagugucuuugcucagccagcagcaauacccuuuggacugcucuuccuccucccaagagcauaauccuugggucauucucccaaucaaaaguuuuccuauguccccucuuaacaacagaacaaugucaaacuauuaaacuggcauuuaaagcuuccacauuauggauggaaccuauucuccaagucacuuagucucacuaauguaacugaaacugaacuucucuaaguucccuugagcauccuaaacaagauucaaacuaaucaaauaccaaaguagcucaaauuacuaaauuaaaaguaaagaacugugcauucaacaagaaaucaacacaaacaacagguuuacaguuuccaaaaugguaaauauuucccuacagagucucaucauuaaaacuucagcaauauucugauacacugagcugcuuuaaggaacacgacuuuucuuuuuucaacaguaaugauuuuccuaugacccuuucucuguauucuuuaugacuuagcauccuagugauauaguuuggaugucuguccccucuaaaucucauauugaaaugugauccccagugguggagguggggccuggucggggguguuugggucauggggguggaucccucaugaagaacuugcugcccuccccaugguaaugacuggguucuugcucuauucguucaccagaagccaagcagauucugguguugugcuuguauggccugaagaacccugagccaaauacacuuuucuuuagaaauuauccagccucagguauuccuuuauagcaaugagaggcggacugauacgcauagcuuuuagggaacucauugcaaacugacauaacuaugguacaaauucuaaguugaaaaacgaaacacuaaaugcuucaucaaaucacuuuauaucauuuuuuaaagcaacuuuuucuuucauucauggaugcuguagguguaacuauaauuuauuaaauaauuauucucucaaaaccccacugcccauuuacauaccugcuacuauuaccaggaauagaaugagauacaaauugaaauuuaugugaaaaacaaacacuaagugcuaaauaaauguaaaauaaaauaaaaauaaaagugauuucuuaagugaaccauaaauuucucaauccuuguaucaaaaucuagccaaaauaaugcuucugauuugcaaaaaaauggaaccaccuuaaacaucuucaaauacauauauauauauuccuucaacaucucaacuacaaguuacaacgagucaugaguggcaacauucaguguggcuucaggccaugaaaggguuaugcaacaacauaaauuauaucaaaacggagauucaguauuugaaaaacugaugaaaaaucuaucaagagugaaaccuccauagagacuugggugaauauucccauuaugguuuuugggaauaaauuuucaaacaacugagaauuucaagggggauuuuaugauucauauuaauuucaucaaguuggcugagcacaguggcucacgccuguaaucucagcacuuugggaggccgaggcaggcagaucacuugaggucaggaguucaagaccagcccagacaacauggugaaacugcgucucuacuaaaaguacaaaaauuauuuggaaguagugguguaugccuauaaucccagcuacuugggaggccaaggcacaagaaucgcuugaacccgggaggcaaagguugcagugagccaguaucacaccauugcacuccagccugggcaacagaguaaaacucuaucucaaaaaaaaaauaacacuaauaaauaaaauaaaaauucaucaaguuuuacagagacaauuacuaaaaggccaaauggcauuucuguuuucuuuuauaaaguuuagauacagccuuguacaugcugaggauucaauauauguugacuggauauaauugcauaagacugaacuccauaaaucuugucuucuauguuaugugcguauguuuacuggggaaauauuuuuauauuguauuucucuuggucccuaggguaccuguaaggcucaaucaauauuuagugacugauugaaucacagaauuauauauguaacuagaacuaaugaaguagauaaaacaaaaauacaaaaauacagaccuggaaggccuuuuuuuuuuuuuuuuuuuuuuuuuuuuuuggagauggaguuucgcucuuguuguaggcacucaggcuggagugcaguggcacgaucucagcucaccgcaaccucugccuccuggguucaagcaauucuccugccucagccucccgcauagcuaggacuacaggcaugcgccaccaugcccagcuaauuuuguauuuuuaauagagauagguuuucgccauguuggucaggcuggucucgaacuccuaacuucaggugauccacccgucucagccccccaaagugcugggauuacaggcaugagccacugugcccggccgccuuuuaugucugucacagaugugugagcaaagcuuuuauauucuacuacuggguagccuguggcacuacagcguguuaguucacagugagguccuccuuacaacuaacccaccuuacacugaacacucauaucuaaagcaacaugguuguuuauuuccuuaugaaguuucuguuuacuacggaaugucacuuuaagugcaacuuauaauuaggcuuguccuauacagaaaauguaauccuaaaaauugugauucauuggcuuacaggaaaauauggcucuugucucaagagaacuaauucugagaacuuuaagaacuuucugggauaagaaacaccugcucuagauuacuaguaaucucuuuugagauuugaauaugcaaccauuaaauguaucacugugaaguacugccuuccacaaauguuaccuuuuccuuauaacaaaaacauacagccgccccaacauuucagcaguuucuuacggggagggcucaucaggacugcucuguugggaggccgaggcaggcagaucacaaggucagggguucgagaccagccugaccaacauggugaaaccccgucucuacuaaaaauacaaaaauuagcugggcgugguggcgggcgccuguaaucucagcuacucacgaggcugaggcaggagaauugcuugaacccgggaggcggagguugcagugagccaagaucgcgccacugcacuccagccugggcaacagaguaagacucugucucaaaaaaaaaaaaaaaaaaaaaaaaaaaaaggacugcucuggaaaacacccuaccuaguucaaugucccucuugcacagguacccucacaccuucuauuuuaagaagaaaucaaauuugugucaagauaagagcauguucccuuauagucuggggugaaaguuauucuccuuuuuuguuguuuguuuguuugagauggagucuugcucuguugcccaggcuggagugcaguggugcaaucucggcucacugcagccucgccucugccuccccaguucaagcgauuugccugacucagccuuccgaguagcugggauuacagacacgugccaccacgcucagcuaauauuuguauuuuuaguacagaugggguuucaccauguuggccagacuggucucgaacuccugaccucaugauccgcccaccuaggccucccagaaugcugggauuacaggcgugagccaccacgcccagaauuggucacuugauacauacuuuguggcugcuuccagccguucacauuuauuaaaaacacaagaaaaucucuuucuguugucugacuuaaaauauggauugcaguuuuuaaugacaaucuugaagucacuaagguaagaaauuucuuacauagcccugaggugguacugguagaagacagccucuccucucuugccuuagcaauauggauggcagcuuucagaguauuucagacacuuucaagaaaacaaaacugaauuugagaguugauuuacgcaggaacugaauaaacuucuacauuuaauauuguuaaucauaaaauaccaucuauuuaugacucuuuauaauuggauauccaguuaauaucuguuaagcuucugcaaaauacaagucaccgugaggcacaaggcacuauggcauauggucugaaggacacagagaugcaacuuaaacccagccauccagaugcuuagaauuuggcagaagagaugagacaagcacgugaauaauaaugcaugguaggaaagcacagacacgacaugagaaguaucauaaaacugcaaugcagguacacaagggcaagagccacuuagcuuggggaaccaagaagagccugcagagaaagcggcauuagagcaggguggagugacaagcauagcaggugaauguagccgagugacaaguguagcgggcaaaaaagguggugggagggaggcaggggcugccuuuuucuccaaagcaaaucacuucaauuuaugcgacuauguguaaacugcaagauaaugaaaauaaggggacaccuuacaccauaugcaaauauuaacucaaaguggaucagaggccuaaacguaagacguaaaaguguaaaacucuuacaagacaacauagugagaaaggcucacaacacuggauuuggcaaugauuucaguggauaugacaccaaaagcacaggcaacaaaagaauaaacugaacuccaucagaauuaugaaaacguuugugcaucaaaggacacgaucaagagugaaaggcaacccacagaagugaagaaaauauuugcaaaucauaucugauaagggauucauauccagaauguauaaagaacuuuauacauggaguuggauugaaauaaacuucuuuuauacauugaguuggauugaaauaaacaauccaacucauaaauggggaaagacuuguguagacauuucuccaaagaaaauacacaaauggcuaauaaguauaugaaaagaugcgcugggcgugguggcucacaccuguaaucccagcacucugggaggcugaggcgggcggaucacaaggucaggaguucaagaccaaccuggccaacacagugaaaccccaucucuacuaaaaauacaaaaauuagccgggcgugguggcgggcaccuguagucccugcuacuugggagguugaggcaggagaaucgcuugaacccaggaguaggagguugcagugacacagcaagacucugucucaaaaaaaaaaaaaaaaaaaaggaaagaugcccaacaucacuaacauuaggaaaaugcaaaucaaaaccauaaugagauaccauuuuauguccauuaggauaguuauuaucaaaaaggaaaaaaaaguguuagcaaggaugacgagaaauuagaaccccuguucccucccugcugguaggaauguaaaauggcauagccaguauggagguuccucaaaaauuuaaaaguagcugggugcgguggcucacgccuguaaucccagcacuuugggaggccgaggcggguggaucaccuaaggucaggaguuugagaccagccuggcuaacauggugaaaccccaucucuaccaaaaauacaaaaauuagccaggugugguggugcgcgccuguagucccagcuacucgggaggcugagacaagagaauugcuucaacucgggcggcagagguugcagugagccgagacugcgccacugcacuccagccggagugacagagcaagacuccaucucaaaacaaaaacaaaaaaauuaaaaguagaacugccagaucauccagcaguuccaccucuaggcauauucccaaaagaaaugaaagcagggauuugaagagcuauuuguacacucauguucauagcagcauuacucacaauagaaaaaugauggaagcaacccaacuggcuguugguggauaaauaaacaaaaugugguauaugggacaaggaaauauuauucagccucaaaagggaagaaaauucugacacaugcuacaagacagaugaacgcugagggcauaaagcuaagugaaaaaaaacagucacaaaaggacaaauacuacauaauuccacuuacaggagguauugcgaauggucaaauucauacagacaaaaguagaaugguggcugccaggagaugugaggaggggaaauagggaguuguuuaauaggcacaggguuucagcuuugcaggacggaaagagcucuguggaugguugguggugaugguggaacaacaugugauuaugcugucacugaacugcaacucaaaaucaguuaggaugguaaauuuuacguuauguauauuuuacuauaauuuuuuaaaauaauuuuuuuuaaaaaacuaaaauaauacaagauaaacucaacuuaaaaaguuccacccuccucuauaccacuccugccauggacuaggcuuuccuagacccuuggagcgccugauucucucugcuccucccuuggagaggcugauucucucugcuccucccuuggagagccugauucucucugcuccucccuuggagcgccugauucucucugcuccucccuuggagcgccugauccucucuguuccucccuuggagagccugauucucucugcuccucccuuggagagccugauucucucugcuccucccuuggagagcuugauucucucugcuccucccuuggagcaccugauucucucugcuccucccuuggaaagccugauucucucugcuccucccugccuucacugucaucccuggacuuggcaccuugcuucaccugucucuuggggccagacccugucuugcuuaccuggauccccaagcccagcauucugcaucuaugcuccaugaucccccacaagcuguuguagaaggugauaggcauauguuggcugccuuuucugcugugugcugauggagaggacacuguucuaaguuugaauacuggcaaguaggaaucuguaugcaaacuguaacacuauuucacauaaugcaacagauuaaaauaacauuaaacauauuccaacugcuuuuaucuacgacuucuuuuuuuuuuaucucuugcagcucagaaauagauuuuacucguaucagcaauguucacacugggcccccaaaugaaguccuucagagguauucuuugagauuccuaugaccagccagaacaaacaagcacaaacaaaaacaagcagauugcugaauaaauucaaaucucacuaaaaugcuggcuuguguucaaaauugucaucuccuggggucagggcaggugacuggcacccagcaaugagaagaaugcccaucugaccuguucuacagcccugcccuacccugccccauucugaaaucgguguggcauaggcacagggcacaucucugccugcagaaaaugucucuaaguuuucuuuuaccauggaggccacuuccagcacaagaacuggaguccaaagauuacacugucgauuucugauuuuuuuuccuaaguaacaaguugcacuuuaaaguuagcaaaagaagacacauucccaggucaaaccaguaagugcagcuuuucucaugaugugcugggauacagaaguacagaacuuauccaccaggcauaacaaguuucuaugggaaaauggagucagggguccagcugggguuucuaagaugaauccacuccacagagggaaagagugagugcauacggccucagccuagagucauuacuaguggccauuuucaucugggcgguagaggcagugaggacccagaagugaggaugggcucuagguggauggagagccaagcaauaugaggagggaacaaaggccagagguagcaaggaagaaggcucacaggagugagguggggcugugcagaggaacagauggaaagggagaaggagcagacugccaggguaguuccuugguaucuucauucucagcccugcuaaccugagccuggaguagaaugcagugggaacagggcagaacuuucuguuuuccucugugccuuucaaccaaaacccccuagucaaggcgggaaggaagaagggacaagaguuggaggggagcuuucuauucuccuuucuuccugcuccuccuucucucucuuuuccacuucuccuggcaaccauuacuugcuaauauucucacuggcacauacauacaugcacacagaggugaucacaagcagaaggggaugcuuaggugggcacagcuaggagacaggccuaagaaaggcacagaaucaccccauguccaggguguggaguaggaagaggaaaaggaagagggaagcagaggcaagaggcagaaggcaggaguauccccgguuugagcaguaaguucugcaagcuuucagucaagccgcccugugagcagaaucaacuaucucuuccuagacugugaugagcuagcuugguuccacuccgcuuccaacacugcauuauuauuuuuuccucucugcuauucugcagcuccuugcgacuacacaauacacucagcuguguuaaacaaaaacacaaaaaguugcugcugucuuggacaguucccuaucagaugaacagaaaggccagcaaccauagccugggcuggggcugggggugggguguuggagggggacuggggacugggaugagggcgaggcugggguggggcacgggcugggagaggggaacgguggggcuggggcaggaggcugggcuuggggggcaggugguggggguggggcugggguugggaugaggguacgauagggcugggauggaacugggacaggagugagggugugggaggccgguggugcugggcuggggguggggcaggugguggggguuggggcggagcagggaugggcugggcuggggguggguaguaagucaguuuagaaaggacugaagugccaagcacauuuuuuuuucuauuguaccgguuuuuauguaguuuauccucaguggauccuggacguuuauauuuguauacccauuuuaagacaacagccuaucccuuagaaccauauuuaaaaaauagguuuacauaagcaaacuuuacagcaugaaagacuuuugucuuaucaaauacacuuucauugggagccuuucuuccucuaauuagaagucugaacuuguuaacauauuuuauguuuuuauuagccagcagguucauucuguaauaaaggcauuucuuuuccagaauuauacuuucaaaacuuucuugcuuaaaagauuuuucucauuaaauauuuaugcuuauuuuuaaaacccaagaguguaauaagaaagccucacuuuaugagucuaggaaugcaaauaucuccagaaugcacagcuauugucauucauucaccccacaaaaauuuauuugucaccuacuauauucaggggauugcucuggccauagagauacaguaauggacaacauacucacuauagaaaggugaaacagcauucaaaguacuauggaauuuuggaauuaggaauaaagguacuaaaaaucacugaauuguacacuuaaaagggugaauauuaugguauaugaaucauaucccaauuaaaacacucauuuuaaaaaacacuaugggaagguggggugcaguggcucacgccuguaaucccagcacuucgggaggucgagguggguggaucaccuguggucaggaguucaagaccagccuggccaacauagcaaaacccaaucucuacuaaaaauacaaaaaucagccaggggugguggcaggcaccuggaaucccagcuacuuaggaggcugaggcagggagaaucacuugcacccaggaggaagagguugcggugagccaagauugagccauugcacuccagccuaggugacaagagcaaaaacuuugucucaaaacaaaacaaaaacccagcuguuaacaauuguuaucuuugagaccuggguauuaagagacguuacaauucuacuguggaauuuuuauucaauuuuuuuacaaugaauguauguuguaauuguauagcaaaaauuacuuuuggcugggcacaguggcucaugccuguaaucccagcacuuugggaggccuaggugggaggaucgcuugaggccaagaguucgaggccagaccaggcaacauagugagaccccaucucuuaaaauauauauauauucuuauauuaauauucuauauuauaucaugcuuuauaauauagcguuuugauaucauauuacccaaggacauaaacuaaucuauaaaucaagucaacacaaacugauucuucuagaaggcucugaggagacucuagagaagaaaaugcaagguuagggaguggccagggaagauuuggcauuggccuccugguuucaaaucucaucucugauacuuacuagcuguucaacuuuuaacaagugcuaacuuuauaaugaauaucucuacuauaaauaauaauaucuaugauaaguauucauugagcucuagcauguacccaggaacuaugucaacucuaaugugcuuuuaaaaaugucguuuuugggccgggugcuguggcucacgcuuguaaucccagcacuuugggaggccgagacaggcagaucacgaggucaggagaucuagaccauccuggcuaacauggugaaacccugucucuacuaaaaaauagaaaaaauuagccgggcgugguggcgggcgccuguagucccagcuacucaggaggaaggggaauggugugaacccgggaggcggagcuugcagugagccaagaucgugccacugcauuccagccugggcgaccgagcgagacucugucuccaaaaaaaaaaaaaugucauuuuuggccggucgcaguggcucaccccuguaaucccagcacuuugggaggccaaggcaggcggaucauuugaggucagauguuugagaccagccuggccaaaaugacaaaacccugucucuacuaaaaauacaaaaaaaguccggcauggugguacacgccuguaauccuagcuacuugggaggcugaggcaggagaaucacuuaacccgggaggcagagguugcagugagcugagaucgcaccacuucacuccagccugggugacagagcaagacucuuaaacaaaaaaacaaacaaacaaaaagucauuuuugugauaauuaucagcaugguuguuauuaccgccuucccauacuuuguuuuuuccucuuuaguuuuuggcaguacuuuagguagcaaggcagauaaaguaccguacccugagguuuagacaugugaagugaaacugaugaucaaugaugcagaauagcuuaauugauaauuaucacaucgcuagcauugaaaagauucaucaaaaauauuaaauaguaaaacuuuccuuaaguugaaauucuccuuuagaaggaaauguuuaaucuucaugaaucaaaaugacugacuccaaugaagaauucagauaaaauacccaaacagaucccgaaagaugaaagagaucaaaggaauaucucggagaaaagaaacccacacccuaaggagaaaggacacacacauacaaacaaagacacccuuugaaaucacagaugaaaaucugucuuccuuuuggcaucuuuguuaagaaaucaugucucugcuguugcacacacuaaaaaaaaacauacacccccccacacacacauccagauguucacgaauauucaugaugugcuuccaauuugguuuggacuugcucuugauuuauuuuugauuaaguuucaucagcuucugcuggggcccaugagauggaugacauugcuguagcacaaauuuagaacgucuucauauucuaaauaauugcuccagucucucaaacuaugccuuauacauaaauuacuuaugcacaggucucagaauggccagagacaggagcaguggcuuacuccugaacuuagauucuuaauaccauucuagaguugguaaauuaagucuccauuucuaauacacagauugaccugucaagggagaaaaaaaagcaacaacuuaauuuucuuuuuugagaagugcagugaaacacuaagggaaagguaugagcugugcucugggguguauugagauguauuuuccaaaguuaccccaugagcuaguguguguccuuccugauauugaauaguugaaaagucaggauaacugaugugaccgcaucaauuuuuuuuuuuuuuuuugagauagggucucauucuguugcccaggcugaauugcaguggugcaaucucggcucacugcaaccucugccuccuaagcucaagccauccucccaccuuaaccuccgaaguagcugugacuacaggcaugcgccaccauucccagcucguuuuuguuuucuggguguuuuugguagaggugggauuucaccauguugcccaggccagucucaaacuccuaaacucaagcgauccaccagccuuggccucccaaagugcugggauuacagucaugagccaccacaccuggccaacaccaaacaaauuugcucaacauuuuaccaucuuguuuucuucaacuuaaaauucuuaaaacuuccaaaccgaaagaaaagacaaucccaaaugcaaacauacugcuggaaugggggcaauggucuucuaaugagagggagcgagagaaaccucccacugauacacauggugauccacagcucagagcuuaauucucuuucuuuuucccccagacaaagucucacucugucgcccaggcugcaguguaguggcgcuaucauggcucacugcagccucaacuucccggguuuaagugauccucccacuucaggcuucccaguggcugggacaauaggugugugccaccacgcccuguuuauuuuuguauuuuuuuguagagacaggguuuugccauguuacccaggcuggucucaaacuccuaggcucaaaggauccaccugccucugccucccaaagugcugggauuacaggcaugagccaccaggcccagcccagagcucaguucucucuacuguuagucauuucgguguacaggagcuguggugagagaucagucuaaaauauggacugcgugcgucaggaggacaaugucagguguagugugugacaacaccagcauaggcucagggcccugccucagcugacuaccaggcugggcccugcaggugucugccuaauuccauuccagaugccaaacugccucaggccccacacaggguucugcagaauaggugggccacuuggcuuggaccacucagucaucuccuacagucucaaauguagacuguugacaucaccgcuaaaugacauagauccagcuacagaaacccacucugagggccuggaaauaagcaaacauucacugcacuccuuuacauuuugucucacuucagaucauacugccucuagugugcuacaaauuaacauuuuuaaauagccuauaauuagcuucugauuagccuaaauaaauuauacuguaaucuuccauguuaaaaauguauauaauuguuaaauguaaagacugagaucacacuacaauuuuggcauccugguuuuaauauuccaggcuccaaaaaggcaccuggccugggccucguucacccccugaaugguccugacuccaaaaacagggaugcuccuuucccucccaagcccuggccaagcccuggccaaacccuggauaccugcuagguuccgccaucaaaguggccacuuuuaccugaguuccuaacucuucuccccaguuagugucaauuuccucaacauuuaggaaugcugucuguuguaugcaaauggaaacaacaaagcucagacuuuuuccuuuuuggcaaguacuaguauugaaguaguaugcuaguuugguguuuaagcccucagguguacuacuuuuuauuaaagcaagcaaacaaaaaccauuucuaaauguucaggagcaagagaaaaagaagcugaaauucuguaauccuagcauuuuggggggcugacgcggguggcucaccugaggucaggaauucaagaccagccuagccaacauggugaaaccucaucucuacuaaaaauacaaaaauuagcugggugugguggcgggcaccugcaaucccaacuacuugagaacuugagaggcugaggcaggagaaucacuugaacccgggagguggagguuccagugagccgagaucacgccacugaaccccagccuggcagacaagagugaaacucaaaaaaaaaaaaaaaaaaaaaaaaaagaagcugaaauuguugaugcacauuugaaaaaucugaagcucucucuacucuuagacugucaugcacaacacagccaacccggugguuuccgcaagugcacaaacagucugcaaaggugucuagugccuaaguguaagguuggaaacaccugaacugacugcaggguuaauaaaaaagaaaagccuucuuaauuaccaaagguacagaaugccaagaucaaaucuggcaccaagagaucuguugauguccacguucccauagugccaugugcaaaaaaugcugacuaaauuggaacagggcauuugauuacaaaugugacuuugucugagagaggccagagcacagaacuguauuaccaucuggcuuaagauauaaugcuucaguguauuugacaucaagugugugaaucccacagcagaauggaguucagacucaccaucuaaugcccacagauacugaucaccaucuucaaaucagcuguagcccaaagcuagcaaauaauguaagugaagacaaaaggaaacagaacaaaaacuaaugccauuuagagaaacaacggggcuucagcaggauaacucaggauagugugcggcacaguucucauucuuauccuauggggauaagaauaagaauucagggacgacauaagucuucuguguuucuaugcucugggggcagaccuguguuccuuaaaaacaauggugaccuuguagacugagcugggcagagucucacuuuccugaucauuuucuugaauauucaggaagcucaaauguacaacaggaaaccuguuucccauaugcuuugcugucuguagcaaauaacaaaagagcagucagugaaaccaaacaaaaacccacacagacuggacuaugugcgcaugucugcgugaagccacaggcaaagcaagaacaaguucaccuuggcccagcggucaacaauugcaaaauggcaauuuauucuguuucgcccugugaauaggaaugaaucggaauauucuacuuuaucuuuuauaucauuaauaauccaaggaccugugaaagaacagccugccucuuuuuuccccucacaucguuuauaccauaguuucuagccacauuuaccccucccuccauuuuuggccuuggaugaaacugugacgucucccugaaguuacuccccacgguccacaccucccucaaccaggucagucuucccugugccuucugauugggaagccuggguuaccacuuccucuaaggagucaucagggacccucuucuguacuccugcacagcacgguaagaguauguuacuugccucacaccccuacuaaacuguggccucuuugugggcagggaauacauauuuugucugugauucuggaaaggcaaaaucccacaugacagacucaaugcucauuaaauauuucaaauauauuuaaaugcucaguugaauauuuacacacaugaaugaauucaacaaauacuuauugggcaccuauuaugugccaugcacuguucucuaugcaaggguacaguagugaccaaaacagaccaacaaaaaucccugcccucaaaccaggcaggacccacuagaagggacaggaagcaacuuugcaggugcugaauguguucucuaucaugcugggcugcgggugacguggguauauuuauuugaugaaguuauacaacugacauuugugcauuuagauguauauaaguuauaccucaaaacaaauuuuuuuuuugagacggagucucacucugucacccaggcugcagugcaauagugcgaucucggcucacugcaaccuccaccuccaguguucaagcgauucuccugcuucagccuccaaguagcugggacuacaggugccagccaccacaccuggcuaaauuuuuuuuuggauuuuuaguagagaugggguuucaccauguuggacaagcugguuucaaacuccugaccucaggugauccacgugccucagccucccaaagugcugggauuacagacacgagccaccgugccaggacaaaacaaacuuuuaaaaaacauaguaaucaugaagugugagugggaugugaggaugaaacaauggcaggaugcugcuagcuguggacgccgggaaacaggcacaggacguucacgguauuaugaucuuuauagauguucacauuuccaacauaaaaagcuauuaaaaaaaucccugcacucacuugaauaaauauuaaugaaguacaaguaauggauacucuucagcauuacugcagggauuuuucaacucagaacagaaaggaacggaaagaaaucaacaguuacagucacuuaugaugacagcaauuuuuuucauuuaagccucuaauaacuuugagauacuuuacucccauuuuauaaauugggaaacugaggccaggagagguuaccucacuugccagguaaguaaaagagccagaauuugaaccaagucugugacucccucagccucuuuccauuaauguuucuuacacccucuugcucacugcaacaagcccggguaagggcucuuccuccagcuuggagagggggugguacagucaaaagaggcucugacaauuagcacugguuacaauggacacuacucuuacugccucugucuuaauccagaacuauauuuggaagguuuaaguuauuaaaauugcaaggaaugauaagucauuccuacaccauuaacaaugguucucuuucuuucuuuuuuuuuuuuuuuuuuuuuuuuucugagaugcagucucacucuggcacccaggcuggaguaaagcggcaugaucuuggcucacugcaaccucgccuccuggguucaagcgauucuccuuucucagccucccaaguagcugggauuauaggugcgcaccaccacaccuggcuaauuuuguguuuuugguagagauggaguuucaccauguuagccaggcuagucuugaacuccugaccucaagugaucugcccgccuuggccucccaaagugcugggauuacaggugugagccacugcacccguccagcaauggcccugcuaugaccuuucacaguuauaauaugcaauauuuuuauugacauucccaguccuuaaagaccucagugcaucuccaccugggcucccuuuuccuuguauucacaaagucaugacaacaaauuggcacagaagcugggccaggcuucagcugcugaugaguaugucaucaucaacagagugcugcuggggguagggacuucucugucagcuccgugccacaucaacaacugcacaaacuuguuuucugccaauacccacacagauuccaccucaagaugcugaggaagcugauacugccaguaauaagaagccaccuugaguacuuuccugaccauggugucacuuugacagaugucagacuuaguaucauucaaguuggaccauuauggacuuggaaagccacuagcauuucugauugcagcuucucccagccaaaaaaacacauggugcccagggauugugccaaauguggagagauaugggcaacuucccugcuguucacaagcacuaaugucccaauccccagcagagggaaaggcugugguccaaacacaccauuccuguagggcccauuuggugcuaaauaaaaacucucaccauaguuauaaaugugaaucauaaucucuguuuauauuguugaauuuuuacccaucuguacucucuguugucuucaccaaaacuaacuggccccaaagacacuuuaucaaaugcauuauuccagucaggauccgggugauuaaguccuagagaaagagcuugacauccaguccagaaaguuaauuacuaacauaauuaucaaaaccuuuuauuuuucaggguuaagucaagcaacucuguaggcugaguguccuuuuguuucguuuguucuccaguugauacauaauuagcucuuaaggacaaugcauuuuuugacuuuuuaaagccaaacacaaauaucuaaguauccuaucuguagacuauuucuucaaucuccaaaauucacccagaagauuuagaaugaaacaaagccauaaaccaauucaacccaucacccaaaauucucuguccccaaggcugucuucuaaaaugacuuuuucuagagcagauacaacaaaucuaaugcuacuuuuccccuauaaaauguuugaggcuucuaauauguuacugcauauuuccucuucugcuuuuaacagguuauuucaucucaaagccaucucgcacucagcuuugacagggcugcugacaaacauagaaagaaacuggccagucacaguggcucaugccuauaaucccagcucuuugggaggccgaggcagguagaucaccugagaucaggaguuugagaccagccugaccaacauggugaaaccccaacucuacuaaauacaaaaaauuagccgggaggggugguacacaccuguaauccuagcuacucgggaggcuaaugcaagagaaucgcuugaacccaggaggcagaaauugcggugagcugagauugcgccaaugcacaccagccugggcaacaaaagugaaacuccaucucaaaaaagaaagaaagaaagagagagagauagagaaagagagaaagaaagaaaaaaauuauuaagcugcagguccucagaccugaaguugugccaaccaagcagccagcagggaaggcauauuguuuacuugucugaaggcagaauugaaagauuagaaauacauguaaaauucugaugcaauaaaagggaacaugacagacuggaagucacagcuuuucaaggaaaugaguucccaucaggaaucaaaacuguuaagcacugugagagggaacuuucaguagguuaacaguguuguaucauagccuaaaugaugacuagccucaaaacacaucuaacauggacaucuagacuuuggagccaugugagugacacaggaaacauccagcaccuaaacccgauccuugccaguuuuagaauuucccuuuuccacugcaacuugucuggaauuucauagaaagagaaucugaaggcugagcgcagugacucacgccuguaaucccagcacuuugggaggccaagccgggaggaucaucugaggucgggaguucgaggccacccuagccaacaugguaaaacccuaucucuacuaaaaauacaaaaauuagccaggcgugguagcgggcaccuguaaucccagcuacuugggaggaugaggcaagagaacuacuuaaacccaggaggcagagguugcagugagccgagaccaugacauugcacuccacccugggcaacaagagcaaaacucugucucaaaaaaaaaaaaaaaaaaaaagagagagagagaaucugaauaugccaauuuggggucuuacuugcuaacuacaauuuaaagaaugaacagucaugcuuccagccuggcuugaaucagcucccaucaauuuuacucaccaccaaauucuugcaccuuugaugggaacuaauuaagcucaugugguguuuucuccccccagacugucuucugcgguuuuggaacagagcacgccaaauuagccccaucuguuugaaugagaaggagguuuuauuaucuaaauaauaaaucaaaauaauaaucuaaaucccaccgaugggcagacuuucucuccuaccuagaagcugccuuccaaaguucccaaacaccaugggaugaugaugguaaccccaacuccuaaccagcuagaauccugagaagagcaguuuaguguugugucaguggucugucuucugccaguucacagcaaucauuuccucaagcacaguaaaaugucugaggaggccacagaguccuaccagacuaucauuugaggcaagaauugcaacauucuggccaggcgcgguggcuuacgccuguaaucccagcacuuugggaggccaaggcgggcagaucaccugaggucaggaguuugagaccagccugaccaacauggagaaacccugucucugcuaaaaaaaaaaaaaaaaaaauacaaaauuagccgggcaugguggugggcaccuguaaucccagcuacucgggaggcugaggcaggagaaucaguugaacccaggagguggagguugcggugagcugagaucacaccacugcacuccagccugggcaacaggagggaaacuccaucucaaaaaaaaaaaaaaaaaaaaaauugaaacauucaagaauucagggcauuaugcaauauuuauuuaaguuguccugugguaaucuugccaaaaugagaguauuuuuucauuaacuaugcuucaacaggagagccuaaugaauuuuaagagugugggagucuuuugacacauaaaguuacuuucuucaaaaggaggaaauaaccccagcauucacacaugucaaggaacaaaguuaaaagaaagaagcccuugacaacacugccgcccaccugggccaaggcgucaggcucccguggugauggcugucagccccuggaugacacuucucagccucagucaacuuuaaacuaacucccaucccugcagcuacuaaauuggugaacauaaaagaaagagaaucaauuaauauuuggcagucaugauauaauguuacuccugauccaaggaauguuuacuugguuaagaaaagaaauaauaguacauaagaacaccauagucuuaccguggaaacagauuauguucacuugcacaauauagggcagugguacccaaccacuugcugagucccuuguaugagaggacucacagaacccuuguauguaacauaaaaauaauuauuaacaaaagaauuaucuguuccuacuuaguucuaaauuaguuacuuaauuauuauuuuugugugugugcucacccuaaguagauaaacaggaggugggaggaggauaaauaaggauucaacugaaucagcaguuuucaaacuuuuuuuuuuuuuuuuuuugagacagaguuucacucuuguugcccaggcuggagugcaauggcgcgaucucggcucaccacaaccuccgccucccaguuucaagugauucuccugccucagccucccgaguaguugggauuagaggcaugcgccaccacgcccggcuaauuuuauauuuuuuuaguagagacgggguuucuccguguuggucaggcuggucucgaacucccgaccucaagugaucugccagccucggucucccaaagugcugggauuacaggcaugagccaccgcucccggcuuaguuuucaaacauuuuuuuaaaggcagaggaacucuguuacuuaaaacauauccaugcagcccccacuauaugagauggcucaaaaggaacaggucuggaugaggagacagaggguugaacauuuucuucugccucaaccccacuucuugaggagguccugagguuggcauaaugaaacaaaacuauuugaaaggcacggaacuaaagugaauccaauaguaagacauuuaaacugagaaaugcagacgcuuuuaugauauuuuauagcaaauauacaauuuugaacuacuaguauacauauaaauuauauauauagcaccuaugcuauuuaguuacuguuuaucacauacaaguccaaaugcaucucugauuauacacauaaagguuuucacaaacagccaaauuuauuucaaugcaccugagugagaggagacuauaaccaugaaagauggugaugacaagucucaaggacagggaauaugagcugcaauaaaauguuaaguaauaaaggaagaaguuuuuuuuaaauauauagauacagcauuguaucacugauuuuuuuuuuuuuuuuuuuuuuuauaaaagugucuuuaggccggacgugguggcucacgccuguaaucccaacacuuugggaggccaacgcggguggucaccugaagucgggaguucaagaucggccugaccaacauggagaaaccccgucucuacuaaaaauacaaaauuagcugggugugguggcgcaugccuguaaucccagccacucgggaggcugaggcaggagaaucacuugaaccugggagguggaaguuguggugagcccagaucacgccacugcacuccagccugggggacaagagagaaacuccgucucaaaaaaaaaaaaaagagugucuuuaguggugggcuaguuuugcugauuuuuaaaugcccacaaaaacacuagaaggauacccgcuaaaacaccaacgugauuauugcuaggugagggacuacaggugauuuauuguuccuuaaaauuuuauguugcuuuccaaaagaagaaaagaaaaagagaagaaaagaaaaaaggaacgaaagcuggaaaaaaaauuagccuagacacccuuugggcuuagagucaauaaaaaauguaguauacacuggugaacaguaaaaauauacuuuucccuuaaguaaaaaaauaaaaauaaaaaucuauuuuuuuuuuuuugagacggagucuugcucugucgcccaggcuggagugcaguggcgugaucuuggcucacugcaagcucugccacccagguucacgccagucuccugccucagccucccgaguagcugggacuacaggcacccaucaccacgcccggcuaauuuuuuuucuauuuuuaguagagacgggguuucaccguguuagcgaggauggucuugaucuccugaccucgugauccgcccgccugggccucucaaagugcugggauuacaggcgugagccacagcgcccggccaaaucuguucuuuuaaugagugcaaagguucgauccuauugcuccagccaacacucacucaguuugauaucugcggcagaacugggccagucuuuuagggaccugaacauucuaccccacacuagugcagcagccuacagauugauaccccaggaagagcuagcacugggauaaagaccaaggaaaagcccaaauuggagcagcucugcucacagaagcauauucccaggacccccacucaccacuuccagguccugggaaacccgccguuuccgcagcuccuccauccucucgcacacgucggagaaacagguguuguaauaaucugcauacugcugcgccaggucaucgauguuucccagugaaccguccugaagggguggacaaacaaaggcggucaggucaguccacccuggaaaagcccacagccaucggaccucccucuacgcagaguuaauaguaauaaagguugguauuuaagugggaaacaucaagugccagguuguuuuacaugcaggaucuccuaacccucaggacagcccucugacaggggccuguuuuuucccacuuauauugauggguaaacaggagcucaaagaaguugagcgacugcccacaaaucccaggacuaagaagcacagaggccagcucuccaaccucggacggucuggugccaacaccaaagucuucaauccccaucucucugccugccuagcagggcuaagagaggaaacaccagggaagcaccuucagcaaaggcacugugugaggaagaggcuccuaaugcccaauguggccccuggacugcaccaccaccuacugggaagcucauaaaagagaugucaggaccccucccagggauucugaugggagccugagaauucaggaaccgauagagaauugcaucugggacaaaucucacugcaccucucaggagacccucagaaaaguggaaaaucuuuuuauucauuuagucauuaguguucauuaauauucauuauuauggucauuaauauucauauuauucauuagacucauuauucacuaggcauuccaaguccaggugcaagaguacauguuacaaauucaccugcauaaauaaauaaacaugucacuuguuucuuccccaaggcaagugccacguaauugcucuagagcucauucugaguuuccacccagcuccauagcgccugguauugguuaaguggccuuaggcacgucucaaccucugaggaacacugaauaaucacaacaccuacuucagugaggacuacuggaguaacacgugugaagcgcuuagacuuuagccggcucguguaguccacccggcauguaguaaaugcuaaaaauuucucgcaguguaauacucacugcaagauuauguuccacacuauagucuuccuuuagagcaauggauuccuaaaaacauaccugaauacauacagggaggaugacagaaauaccuuguacauuuguaaguuaugccauuucuucuaucaauucauucagaaagaccucuccucuccuccagcucuuuuuuuuuuuuuuaaccucccaacauucugcucuuugguauaaauaaaugacuuuaccaagacaaccaaggaaaauacgacuuuuagaccaccuaaagccacacacacauuuuccauuuuacagacugcuagccaaccccuucaguuauuuaauguuggugcacugcccauagcaacacacgccuaacacugcgaagcaggcuuagaugcaagcagggcuugggaguugaauuucucccaaagccuuucugcuaaagaccuacacccuggucagcaggccuggggcagagcaaggaucaucucuacccuacuucugcauucacugauuuuacagaaccaagggagaggagaaacagagacgggaaaaaaaugacgcuucagaaaagcuccuugcuuccccaccaauaacauguucugcauuugagcugauugccucaaaguuccuagcacaguguggagacaagaaggacucuucuaaggccaguaagaucuuugaaugugucuggacaaaagucaccccuucacuacaaucagucuugucugucugagcccacagccuggacugacacagcaggcaacgugggagacccccuccucuucaaaaugucgucuauugucaaguguccaguagaaaaauaacaaaggucaagauagaaucuguugcugccccucugaggacaugcaccguggcccucagccuccuggccucugcugugcugccuccaggaaaggaaacugccugaaaacagaaccugggccgggcgcaggggcucacgccuguaaucccagcacuuugggaggcugaggugggcggaucaccugcggucaggaguucgagaccagccucaccaacauggagaaaccccgucucuacuaaaaauacaaaauuagcugggcaugguggugcaugccuguaaucccagcuacucaggaggcugaggcaggagaaucacuugaacccgggagucagagguugcggugagccaggauugugccauugcacuccagccugggcaacaagagugaaacccugucucaaaaaaaaaaaaaaaaaaaaaaaaaaauuagcagggcgcauuagugggcaccuguaaucccagcuacucaggaggcugaagcaggagaaucaccugagccugggaggcaaagguugcaguaagcagagaucgcacuauugcucuccaaccuggccagggcagcagagugaaacuccgucaaagaaagaaagaaaagaaaagaaagaauggaaagaaaagaaauaauuuacuaaggaugccgaaagaaagaaagaaagaaagaaagaaagaaagaaagaaagaaagaaagaaagaaagaaagaaagaaagaaagaaagaaagaaagaaagaaagaaagaaagaaagaaagaaagaaagaaagaaagagaaaagaaagaaaggaaaagaaaagaaagaaagaagaaagaaagaaagaaggaaaaagaaagagagagaagagagaagggaagggaagagaagagaagagaaaagagaagaaaagggaagagaagagaagaaaaaaggaaaagaaaagaaaggagggccgggugcgguggcucacgccuguaaucccagcacuuugggaggcagguggaucaugaggucagcaguucgagaccagccugaccaacauggugaaaccccgucucuacuaaaaauacaaaaaaauuagcugggcuugcuggugggugccuguagucccagcuacuuuggagccugaggcaggagaauugcuugaaaccagaaggcggaggcugcagugagccgagauugcgccacugcacucuagccugggcaacgagagcaaaauuacaccucaaaaaaaaaaaaaaaaagaaaagaaagaaaggaaggagagagagagagagagagacagagggagaaagcaagaaagaaagagagggagaaagcaagaaagaaagagagagagaaagcaagcaagcacccagguaguucccaggacagagggagcugggcuaucuucagcaccagggcauccuccuugauucaccuagggauguuuguuugcugauacuucaaagaaacaaagugcucaccaucccuguucacccugaagccucuccuaguuucuuagcuccuuuccccagccuauauugacaaagacaaaggagcucccuuuugugugugaguuugagggcaaaggggagcaacuuaaccugaaagcccauuuuuaugaguuacagaucugaucccuaucacaaccggggacccuggaagauccugggcucuuuggaguugucuuggucucaggaacgugaugcuguccucauccagaaacuucugccuucauccagccaggaaacaaaacacaccugccacuuugaccaaauagaaaguccaugucucccaacagccaaguguacuuguuaaggggguuuacagcuuacacacuacccuguggcuuucuggucuggaauagaaauccaucacucucucugucucuuauacacagagguccacacugagguauuccaacauggaauacugguuucucucuaaaacaaccagcuuucacguuugugaacuguccaacuuaucacaaccaaccgucgucuuggacuaaccaagaccacugggaaaaaaacuauuuauauauuauuuauguaauuauuaauauagcuuuguccaaacuacuuucuuccccuuuuucucuucucucucauauauccuaagaauauucugaugauguagaaaaaccaaacucaaugucuucuacagccucacaacagagaucacuucugacaccagacaugguugggcaggggaggugguuccccucccuccacacuccaaagaagcagcaaguucugcaguggacacuagcuggguguuuuccaguucaaauccgacacuaccgaaccagagacagccucauaacccaaaggcugaaggcucagucccacaagacugcucuucacuucugaugccagaagcaagcuccagguuguuuuaccugcuacaaauuaggguucccacgacccccuuuuggggcucaauuaauuugcuagaguggcucggaaaacuuggggaaacacuauacuuacauuuacugacuuauuuugaaagaauucacaaaggauaccaaugaauaccagaugaagagaugcacaaggcagaguauugaggaagggugucggagcuuccgugcccuuuccagaugcuccacccuacacaaauuucuauguguucagcuauccagaagcucccagaacccagucuuuugggguuuuuauggaagcuucauuaugcaggcaugauugauuaaaucaaaggccaaugacuaucagcucaaccuucagccccucuccccuccccagagguugggagguggggcuaaaugucccaacccucuaauccagcccgggucuuuccugugaccagcuuccauucugaagcuaccuagaguggccagccaucagucaacucauuaacauacaaaaaaauacacuuaucacuuuggagguuccaaggguuuuaggaguuugccggaaaacaagauuaagaccaaauauguauuucacaauaucauaaaaccaacaacaagccaacucuucacuucaguucuguuuuuccuacgagugaaauucucuaucccauucccaaucacucaaaacucccccaauaacuuggggaccugaaaaauauauuuguugcuccugaggaaaagagcagcuguucaaaucaacucaggccaaagaaagccagcauuucacacccuacaacaugccauaauagccacuccucacuccagauaauaauuagaaaaggguggcacagcugcuuuuacaucuucccaaauuacuuuccagaugugcaguaaguccccauaauuaccacuuucaucaguccugaugauuuaaaugccaagaaaggcaacagaauagaagaauguauauguguguuuuuaagagugggucuugucugccaucccacaaaaagaaucuuuuacauuccaaucaaugaaaccaaccaacuaccugaugauuaucuuuacccacucaaaauucaggcuuuaaaaaaugaaauaauaagaauaaucaucauuucuauguuauaugggggugggaggaaacucugggaaugauggauauguuuaugauguugaugguauggcauauacuuauucccaaacucaucgaauuguauacauucaaaaugcacagcuuuucacuuaucaagcauaccucaauaaagcaguuuuuaaaaagccaugcucuuucaggacugacaguguuugcauuauuuuuauucagcuuauuccuugagauagcuacagaccuacuccauaaaaauauuuaauuuuacuaaaaauacuugcaacaugagucugcaggaaauuuaaauaauguagaugagguuuccauaggaucgcaugcugccaucuuuacggaaacacaaaaucuacgucugacucaacaccccaccauacuaaugucaagcacugauguugcaaaauaaacuuguaacuauaauaagacuuaaaaucaucucuacauuuauuauaauaaauaucaugauuaaaacacugaaacggauucuuuuuuaaaccuuuucuuuuaagguguucaaaaguuucuggucuggaguuuauugcuugccucaucuguuucacuucuuucuuauuuucccucuuugguucucuggcauuaaacuuaagcaauauuaguucaaguuuaggaacaugggaaaacguuauuuccucaaaauaauuuuuugagaaaauugugaaauuuugagucacgcgaucuuuuuauaagaauuuucccaccccugucuuugaaaacaggaaaagagauacaugcagauucaaguucucuuuccuuuucuucucauagaaccuggucacagcaucuguccauauguaugacaauccauuucacuugcugaagauuuaaauuaaaucuguggagucaucacccgugucagcucaacggacaacaaacuuguauaaucuucccccaaagccacagagcaucuuugucccaaacacccgucuuucauacaaccaacauaaaaauacagagauaaggggcauuguaccgagcaguucagauuggguggacugcuguugcaauuaaggagaaaagacacagagcacuguuuccucaacaaucgguuucacaguauuucugagauuuaucccaauucacuucugucucuggaaaauggaaaaccuaaaacuacuaggaaaacaaaaggcauuuguaucguuacuuuuguuauuucugcgcuucuuuccccagaugucacuuccaguuuagaauaaguugacagauucaggagaggaaaaaaauaaaaagaaaaaaaagcaucugaaaacaucaggagauacaaugugaucuguugcaugcagauuguaugcaaacgaaugugugauccuccuauuuuauguaucuauaaaguuuuccccaagggaaaacucauguguguugcucuaacuccccaaaguugagagaaagacagacugcugacuccuuuauuguuucuuuaccuuuuccguccuuaauaauaaguacauauauuuuuauauaacauaaauucuguuauauuuacauugcuccuuguuugaagagggauggauggagauauauacauccccucuaagcuaaauccauuaaaaaaagaaaucacuaugguacaaugaaaccuaacugauuuuuugaaugacuucccaagguguuuucacccuuaauuagcuuguuuaaagauuuuuaaggugauaaacacuuuuagcaaccuuucaggugaaauugcuacaaccauaaaaaugucuuuaauucucguuuucuuguucggccucauugaaucccuguaauguuacuguucucaccagcucugucaucacuuccugccacgucgucgucguucugcagacauucacugacuguaauaacuaaucucaaauacuuuucugagguaucacucccaguguuucuacagauggguugagcuggaaguauacuuugucucaggaaaaaguuuuaacguguaacgacauaugccagagggacguauuaggucaugcaaauggcaagugaagcccccaggggcacacccauagggcagguggcuggagugaggcuuauuucauaccuuccauccccucucuccaaaaacacccaaaaccugccagcacccaugucaaauccuggcuuuggcauauacggucauggugaugcuauugcgcacagguggaucccgguuaccacagauccccuccugaagaauaaacggccucccagaaggcaggauugacaaacccuccuccucagagcucucucagcaccugcuucuaggucuccaaaugucuaaggaaaaaaauagcaggaaaaaaaauuggggggccaggcacgguggcucaugccuguaaucccagcacuuuggaaggccaaggcagguggaucaccugaggucgggaauucgagaccagccugaccaacauggagaaacuccgucucuacuaaaaauacaaaaauuagccaggcgugguggugggugccuguaaucccagcuacucaggaggcugaggcuggagaaucacuugaacccaggaggcggagguugcagugagccaagauggcaccaucgcacuccagccugggugacagagcgagaccgucacacucuucacaauggaccugcacacauggccgaggacacagaaggcggagaucuggcgggcucuggagcuguuguggguucagaugcugucucaugccagcaagguaagccagcagaucagugacaccauguggaagcugccacaaugccuggcauccuacaccaaccuucagagucaaaaaaauaugcugcugauucacuuccagcucccaaaucucacacaaggugucuuuuguaaaggucgcuaacccagaaccauaccagaaagggugaacgcaguacaaucccccacagagucuuuggauaaauuuaaacauuugagacuugcauuuguuuaaaggauaucacauagcauauuagaagagcacagaagaggcugggcacaguggcucacaccuguaauuccagcacuuuggggaggcagaggugggugaaucacuugaggucaggaguuugagaccagccuggccaaccaaaauggugaaaccucaucucuacuaaaaaaauuacaaaacuuagcugggcgugguggugcaugccuguaaucccagcuacucaggaagcugaggcgagagaaucacuugagcccaggagguagaggcugcagugagccaagauuauugcgccacugcacuccagccugggcagcaaagcaagacucugucucaaaaaaaaaaaaaaaaaaaaaaaaaagaaagcaagaaaggcacugauggaguucgcuuccuaggcaacagccaugggggcccacacugucucuauuuuagaaccccacugccugugaguuucccugucaccauccaccccuccuccucagcacacccuuacaugcaaugauuccccaagguccucugcauuuuucucuucuuacacucccugcucccuuggggaaaugucaucugugguaggacagaguuaaagucgcggcagaaacacuuucccucuccucuacuuccaacaggcccagugcagccugcuugacccuaggauucggcaggcuugagacugguagcaaaaauguuauuaccaaaaucuuaugcaugaacuagucauccccaacuaccuacugggaagaaaucugaaaaguuuagucuaaauaugaacaaacucaguuuccuggccaggcagaggagcagcucuaauaaaagagaugacgaagaaggccuacuccacaucccucaugcggaguauaugcuagcaccucugcacagcacagugauuuucacguaugaugaagaaacugaggaaagcugucaacauucgccuguguuuaugcccuucaaucaucaacaguucacaggauauuucauuaauucaaauaauauuuacuaaacaucuacuauauuccgaguguugugcuagguauuaaguauccaauauaaaaucaaaaaacaugaauguuuauuucuacugcacagaagagcaaaguguggccauuaguuuauuuuaaugcagucauacgguuaagucaugagaacuuguugaagggauuuacuaagcugugugcuuaauauuagaucucuuuggaacgaaaggcucugaaaaauccaaucugcuggcuaucaguggcucaaaagaguauuacacaaaaacccuaagaacuugaaaauguggagaaaagaaugggaacauugaucauugguuuuuagaaaguacaagccuagauucagacucaaaauggacauuuggauuuagcagauggcaguuuuagacugaacucauuuuccauuuuuaaucugcccugagcuuaacagaaucacagauuugaaaagcagcacagauaauugggugggaaugaagucacaauuauagaccacauucacagaucuugaugagcaugaaucacacuggguuuucucuggccgccuuuuuggcacacaaacgugaggcugugaacauuuucaagcauuugaccaacaagaucugaaugugauaugaccagaauuuuagaaaugaaaauauugaucucagaacaaucugaaauuucuaguacuaugguuaaaugauguacaauauuugaguuuuuguguuuuagaaaaauuauaaucugccacagcuugacuagagagccucgcggugugaccgucugugguaugagacugagcuugacucuggcugauuuccucacacagcuccccggcgcaacugguaagugagacgcaggaguccagacaacucaaucaaaacugacugacaacaggcaugacgcugguaacccucugcuuuuauacagcuaagguugaagcaacuguuucuuggugcuauugccaaaacuccacauuuuuaagaacugacagguaacaacugaaaaauacucuuuguguggcaccuacguuccgcaucucacaaauggcugcacacgauauccaggacuugcuuuaaaauccugggccugggagggguggugagugcagauauagauggaacaagaucagcggugauggaacauggcagcucuuuaacauaugcuccccacuugguauacaucugaaauuucccacuguaaggaguuuuuaaaaggugacuuauuuguuuacguguuuguuguuaccaggcaacuuuagaguuuaugaaaacugggaauggaucuuauucauuuuuauaaccucaauaucuaacauuauugcaacacccaacacuuagcaguuacguaauaaauacuuaucaaaugaaugaacagauggauggauggauggauggauggauugauggauggauggcaguaaaguugaucccucucuuuccugagagugccauaaaauucacucgguaacuaggaauugacagacugcccgcuaaaccagcauuuuuauauauaauggugagcuucuagucacgauucuugucccuacugaccucacaagaguaauacagucuaaugagacauugauacaugaaauauaucauuagaaacaauaacaaacgaagaucugagggaaggggguaggaagaaguuccauacagagggaauaucaaauguaauuccucugaguccagagagagagcuuaacauguuccaagagguaaagcuacccugggugacuaaaaggucagaaugcagagguguggcaggacaggggacuggagagacaggaagaaacccagguuuggugauuccucaugaauucaauagccauagauauuuaagcaggaauauagagggcaugcacuuugcuuuaaauaaaguacgaaacucgcugucauacacuucaaugaaaaccaaaccacagagauuuugaaaacugugacccugauuucauuaacuuugcacccacacaaaaaccucucaacagaacauacaguuggcaccugugaauugauagugccuugucccucaccagcuagaaaaaccaaacuaacaaauggggauauaauccuagaagcucauccagcccuuggccagcucuguuucauuauauuuuuguccagcugugaaucuuaaugcugcugacaccaauaaagugaaccauuagcauggugucugccucugugauccuugacagcagacccagucccaccucugucauggaagaggcugaacagugaagacaagaucuaaacccacugggauguuauuccucuuuacagguauggccacagcccaacaggaagagaaaagcuucacagaauaaggguggccuacaugagaaagaauuaucaaccaggcacgguggcucacgcugauaaucacagcacuuuaaggcaggcggaucacuugagcccaggaguuugagaccaaccugagcaucguggucaaaccccaguucuaccaagaaaaauauauaaaaauuagcggggcaugauggcacacgccugcggccccagcuacucaggaagcugaggugggagguucaauuaagccagggaggcagaggcugcagugagccaacaucgugccacugcacuccagccugggcgacagagugagacccugucucaaaaaaaaaaaaaaauuguggccgggcucaguggcucaugccuguaaucccaggacucugggaggcugaggcggguggaucaccugaaguugggaguuugagacuagccuggccaacauggugaaaccccgccuuuacugaaaauacaaaaaaauuagccaggcaugguggcgcaugccuguaaucccagcuacuccggaggcugaggcaggagaaucucuugaaccugguaggcugagguugcagugagccaagauugcgccacugcacuccagccugggugacaagagcaaaacuccgucaaaaaaaaaaaaaaaaauugugggugacagagaacuccagucaauggaacaggaaguuuggcaucugaacccuucucucuuucucugcuacuuacugacccagaguaagguaguuaaauguguacggccucauuuuccucaucuguaaaaugguaauuacaaagcuaccccacaggcuguaauaggauuaaauaaaauacuuguaaacccuugacagaucaucuggcauucaauaagcacucaugaaauagaaguccucacuccuccaacaggaagguuaaaauuucuccuauuauuugaugggaccaaguuauaucacaugaguggcacagaauuccaaccuauuauaaaaauaaagaucuagaauuucaauacagggaagggccuuaaauaugaucucauuugauaacuuuauuucaaagaugaauuaagaguaaccaaagaccacaggguuuugagugacuugucccaaaagacaagaaaccaagccuccuaaaucagaguacaggaauuauugauuucuaauuauuuacauuuauugcugauaauuuuuaacauguugagagucaaagaucuuccugaauccaaagauauuucccacaccaaaaggaauaaauggaaaguuccuggguucaaugggcuuaauuaaagucucacaaucuucucauauccugacagaaaaaaagcaacuaagauuuuaaaauaaagauagcccaucuagaagggcacugaauacacaaggagcuuauccagaaaauccucagcauuuuacuaccaucagggagaccaggaggaaugccacugguucccuccacagguuugaguuucaucuuuuguguuuuuuuuuguuuguuuguuuguuuuguuuuuuuuuuguuuuuuuuuuguuuuuuuuuuuuuugagacggagucucgcucugucgcccaggcuggagugcaguggcgggaucucggcucacugcaagcuccgccucccggguucacgccauucuccugccucagccucccaaguagcugggacuacaggcgcccgccacuacgcccggcuaauuuuuuguauuuuuaguagagacgggguuucaccguuuuagccgggauggucucgaucuccugaccucgugauccgcccgccucggccucccaaagugcugggauuacaggcgugagccaccgcgcccggccgaguuucaucuuuuguuuuuaaaaacaggaucucauucugucacccaggcuggaaugcagugcugcaaccaccguucacuguaaccucgaauuccugggcucaagugauccucccuccuaaggcagccucccgaguagcugggacuacaggucacgccaccaggcccagcuaauuuuuuguauuuuuuguagagaugggaguuucaccauguugcccaagguggucuugaacuccugggcucaaugugaugcucuugccucagccucccaaagugcuaggauuacaggcaugaggcaccauauauggccugguucggguguuguaagaaaacaaauacaagagcaaugcuguagccacggaaaacaugcauauauuccuuuuguggugaugagcgcuuacaauaagccccacccagaagcuaaaggaaaaccuguuuguuucuauuuacuagaaacuauuuuagagcccuucauucauaugacaccaguuggauagugucuuuccaaagucagaaagacgcaggaggcacuguggcucacuccucuaaucccagcacuuugggaggcccagguggaugaaucacuugaggucaggaguucaagaccagccuggccaacauggugaaaccccaucucuaguaaaaauacaaaaaaauuagcuaggcaugguggcacacgccuguaauccuagcuacuugggaggcugaggugggaggauugcuugaauccagaaggcagggguugcagugagguuggagauuguaccacugcacuccagccugggugacagagcaagacugucucaaaucaaaaacaaaaucagaaagaaaccaguuuacccccacugucuggaaaaaugccaugcaauccccaaaaaacucuucacaacacaccuagcccucuccaaguacagugcaugaguuagcuucuggcaucuacccuucugauggcuccuugaacuccaggccaaucacaccacacagcucagugcacuaaggaugccauucagggacucagaggccagcuugugaaugucagguauaggggaacucuguugcguucauccuauaccacacucugaucuguaauauacaggaaaaauccgauuuagagaaugucaguccuacaaaggaacuuuucuuguuccggcacauguguauuaucuguauccauaucuaugcaucugcccaucuauccagguaacuauauaaaauauuacauaugacaucauggccauacuuucauuuccguuuuguggggaagaaaaguuauuuccuaacuacaucauuuccccucaagaugaucucaauuuucaucauaaaaggcuuuuacuuuugccaagaaaauaaugugaaaguacucugaaaaagcaucugaagcacaugaaucuguucuuauucguagauuuaaaacaucuuggaaguuaaugaaauugucuuccguuagggauuucuguuaaguaaguagauuuuagcuguucuugucaccacaaaaaaaaaaaaaaguuaacuaugugagauaauagguguguuaaccucuucacuagacugucuaaauguaucucuaugucucuguguaucccacaacaucauguuguggccaggugugguggcucaugccuguaauuccagcacuuugggaggcugaggcggguggaucauuugagcucaggaguucgagaccagccugggcaacauggugaaacccuaucucuacaaaacaugcaaaaaauuagauguguguggcggugcaugccuguaguuuuagcuauuugggaggcugaggagggaggaugaccugagcccaggagguugaggcugcagugagcuaucauugagccauugcacuccagccugagacagagugagacccugucucaaaaaacaaaaaaaggccaggugugguggcuugcaccuguaaucccagcacuuugggaggacaaggcaggcagaucacuugaggccacguguucgaggccagccuggccaacauggcgaaaccccgucucuacuaaaaauacaaaaauuagccaugcaugguggcaagcaccuguaaucccagguacucaggaggcugaggcaggagaucgcuugaacccagaagacggagguugcagugagcugagaucgcaccacugcacuccagccugggugacaagagugagacuccaucucccccccccccaaaaaaaaugcuguaaaccucaaauacacacaauaaaauuuaaguuugaaaagaacaauaucuuggaaguuaagagugagaguggagauuauuugcuuugugucacauucuacacaggguuacaauguaaacuugacagucauuucugccuaagagaacuaaaaaagcugcaacgaauucacaucauucuccuaacccaguuacugugagaaugaaaauacccauuuucucaguuugcuuacaaggugagaauuuauuaacaucaccacuggcuuuuucacugacaucuaauacauaauuuuuugaaagagcaauucauuucauugaagaauuaacauuuuuaucaguucaucuuggcuaacaguuuuacuggucaauguuugcuuggacauuccuacuccccuccuucccauucauauuccuggauuuacaaugaaacaaucccuuaaaaggaaaugaacuaguuaaggcaugccuaucaccuacccaaacuuguuuaugcuucucgauugcccuauaaaaagggguaauuucacuuucuucucugggauguggauacaaguauuuuuauuuuaauuguuugacacauuaugggaagaaagccugcaaaaaauucaauguacugucaagacgccuaguugauucugucaggauggaccguguguuuccauucucagagcacagcaguucaacuguuuuuuguuguuguccuuguuguuguuuuugagacggagucucacucugucacccaggcuggagugcagaguacaacagcaccaucucagcuuagugcaaccuccgucucccagguucaagcaauucuccugccucagccacccaggcagcugcgauuacaggugcacaccaucaugcucaacuaauuuuuuuguauuuuuaguggagaugggguuucaccauguuggccaggcuggucucgaacuccugaccucaagugaucccccccaccuuggccucccaaagugcugggauuacaggugugagccacugcgcccagcccaguucagcuguauuuuauacugggaaaucaaauucugggcuccccacuguacccucaagcacccucuaaacacaacaguuggaaagauccugcuauccuguuggagacuaagucagaucaugucccucugcucagaaaccuuacucgggcuccuguuucuuucagagaaaaggccacagcccccaggaugacacagaaggcuccucacaacuauacaccccuacaucuuuccugcuucaaugugugccucucccagccucacugccccagccacacuggccaccuugcuacuccuccaacacaccagagccacuccaccuuggccaggccuuugaacuugcuccucucucggccugcucagcucuucccacaauuaccuacccucauccucugcggauauuacucaaauacccucuucucaagaauaucaugucuaaaauugcagcucccugaccuguccacauugccucugccuuauauuucuucuuuuuuuuugagacggaguuucgcucuuguugcccaggcuggagugcaauggcgcaaucuuggcucaccacaaccucugccucccagguucaagcaauucuccugccucagccucccgaguagcugggauuacaggcaugcaccaccaugccugguuaauuuuauauuuuuaguagagacaggguuucuccauguugaggcuggucucgaacuccugaccucaggugaucugcccaccucguccucccaaagugcugggauuacaggagugagccaccgugcccggccccuuauauuucuucuuaccauuuuuucaccaucugaaauaguuuggauauuauuuguguagguuuucauuguuucccuccccuaacuaaggugucaaguccaggagggcaaagauuuuucuaaguuuucuuuuuugugcuuaggacaguaucuagcaggcucucaauauaaaugcacugaaugaaugaaugaaugaaugaaugaacgaacaaauggaauaaaugaaacaaucaaucaacaugcaccuugccaggcacuaagcucaggcccuuggggagaugaauauaaacaauuuauauauugcuuuaugcuuuaauuuuuuucccuucuaaguagcauaucuacuuuucaguccucagaccuuaaaaguaacuagcaaguuuuaacuuguaaaacauccaugacuucauuauaauuuuuaaagccaauaaggcacuaugcuggugccuuaugcauguauaucauccuguucucuuuguaugauuucaaaagaaacaaauggaauacaguucaagguguuaauuacauaagcuuauuaaaaacaaacuccuaagaggcgucaguucuaacaucuggcacgucuauguuuauguaguuuauuaguuuuauauaugugagaaaguaaaauguaggagcauaauauugcaaaacagccacuaccaaaggaaaauuauuucauuccauaaacaagccuuauaaagaacuagcucuaguguaagucugaaagggaaagagcguggcagcaaaaacagguuuuuacaugcuaguguuucuggauucaugggagggugguacugugcuuccuuauguaacugcaaucuaaacaauuuuacauaaucagaaaauaaguguuugcauuaucccauuuuauaaaaaugagugaagaccuuuuccaggcauuuugcauagccaggucauaaaugaucuacauugagaacucuggauaauuuuuugcaauuuguaagugaauaacuacuacugggggaaaugguucugauaguaaacaucccagaauaaggccuaugaccuccaggagcaaacucaggccacaaauacaggaaacaaagauucucaguaggccauuagaauuaacuguccuccaagaacuggcagguacuucaccauccuccugggucacggggaggcaggugcauggaggggccugagugcaggagguucccugcccccacucugccuuuccuuauuuaggaccaccaugaacccagaggacauccuggcucugaccuaaacucaagucagaucuguacccaccucccuacagacaagaguggcaguggggaccugacaugacucucaugcuaaacugcagaagagccaacaaggcagcugagcacaguggcucacgccuguaaucccaacacuuugggaagccaaggcagguggaucaccugaggucuggaguuugagaucagccuggccaacaugaugaaaucccaucucuacuaaaaauacaaaaaaaaaaaaaaauuuagcuagguguacuggcgggugccuguaaucccagcuacucaggaggcugaggcaggagaaucacuugaaccuaggaggcagagguugcagugagcugagauugcgccacugcacuccagccuggauaaaaaaaaaaaagaauagccaacuaggugcuccauagauauaauucagaaaaugcccaaaaagagaucagucaguuaauuucaacuuaacuucauuuucucuuaaauauuagcccagugacauuggucucuucucuccccauccuccucuguggcaacaaagaccuuagaagguaaaacauggaggagggaagggagauuggccacuccugaaacacacuucugugaggcugguauucucacagcaacauucaaggagaucgccaagagaaugacaguaagcacaaggcacuggguaagauccuucaccaauuguguuuucaugacagcguuucacuucuuacauaaaaaacauguauuaguccucauuugagaauaccuuauaaagucaguacauauuuuugaaaaaaugagacccuuauuaggucagaauauauuuuuguaggguuuuuuuguuuugucuuuuguuuuuuugagacagagucucacucaguugcccaggcugaaguacaguggugugaucucggcucacugcaagcuccgccucccggguucacuucauucuccugccucagccucccgaguagcugggacuacaggcgcccgucaccacgcccagcuaguuuuuuguauuuuuaguagacacaggguuucacuguguuagccaggauggucucgaucuccugaccucgugaucugcccaccuuggcuucccaaagugcugggauuacaggcgugagccaccgcaccuggccaggucagaauauauuuuugaaaaagcaugagacuccaaagcaaagagagaauuuaauaggagaaaaccaagauggcacuguuaagagacaagaaaaggaaaaaccugaaauugagauauuucaaccuaguguguuaacauagggaugacucaaggacuagaugcugggaccaguauuucaaaacuuuccacacaccaguucuguguaaauuuccuccugauuccaaaucuugccaaccaucuuuaaaucuccagugauaguuaauuaccuacuuguuuuuuagaguugucuuggguuuugucuauauaucacaauuuguuuuuuaauaaaagauguacagauagacuuaaaaggccacagaauacuuuguguagacagggacauucgaaaggucacuuucacuugaucuauccuucuauccuuccucaccucugccuuccacuuacaaaagagaaaaaugcuauuuguuauuaacaaauuaucuauuuugagaauuuuuuuugaggaggugguuggauuuuuguuuuugcugguuuggguuggguuuuucuuuccuuuuuuuuuuuuuuuuuuuuguuuuucuuuuuuuugagacaaucucgcuguguugcucagacuggagugcaguggcaugaucucggcucauugcagccucugccucuccgguucaagcgaaucucaugccucagccuccugaguagcugggauuacaagcacacaccaccacacccagcuaauuuuuguauuuuuaguagagaugggguuucgccaugcuggccaggcuggucucaaacuccugaccucaaaugauccacccgucuuggccucccaaagugccaggaucgcaggcaugagucaccacguccggccagguuggguuuuuuugucauggaaagggaacagccaguaugguagagugguuaagaugcuaggcucugaccuuaagaaaguuauuaaauuuuuuuugugucuuggagagagguaucugccucagguauuauuugcauugcugccaaauaaagacauaauccauguagaacacucagaacagugucugauacccagaacuccauaacgauuacucuuaucauuaacaauggccacuguugcuuaucauuuuaauagacuaugaugaccaacucuuaaacuaucuucaaaaaacuuuccugcaucauaaugaaaucaccuuugccugaguagaaacaguuucaacaugugaagcagaugugacuacagaugaaaacagucugcagaagucccagagacucaugacaaacccagcuuccaaaacagccuuuuccccucucauagcaggcugugccacuaaagacagauucucccucugugcugcauuccuggaacaagcagccagucucucuaccuugcacacgcugaugauuucuaguuguuucacuuaagcacauccagguacucuccccaacacguacagcucugccaggccaaugcacgugucuguuuccuucauaacucuuugcagcuccaccacaauguugcacaaggcaggcauuuacuaaaagcuccacaagugaauggauccguaucuuccagaguaagagacagcaugcaacuucccacaucauaugaaugccuugaaaauuauuuguuuuuguuccauuugaucaaguuuguaaaacaagcuaaaugccuucuauugacuuccugauauuuguggauucagagcccaggaagauucuuguaucuauaucagacaacaaauagaaccccgugugugugugugugugugugugugcgcgcgcgugcgcgcgcaugugggggagguuggaaggaugagaauuaaggggaaaauuuccauuuauugagcaucuguauaccuauacuacauugucgguauucuuguacaucauuucaauuaaugcacaacaccaaugaggacaucaaagcaggaagguuccauguccacugccacauggcuaacaaagagcugguccuagcugggagcaguggcucacacccguaaucccaacacuuugggaggcugaggcagguggaucacuugaggucaggaguuugagaccagccuggccaacauggugaaaacccgucucuacuaaaaacacaaaaauuagcugagugugguggcuugcgccuguaaucccagcuacucagggggcugaggcaggagaaucacuugaaccugggaggcagagguuacagugagucgagaucgugccacugcauuccaaccugggcaacagacucugucuaaaaaacaaaaaaagaaaaaagagagcagauccuggcuucaaauccauuccugucuacuccaaaaucugccuucaccaccacagaaguacgggcucacugcaguugggcacacaacaagcuuaagcuaaccuuacugcuuauuuaaacuauaaagccaucuacugaggccuuccacagaaaguaauccccaccccauaauauuuuaaaauaaaacuuaggguuaguuaacaguacuccugagaugccuacaguguacaguugaauaauucacuuaaccugaauugaggaaacauauggcugggugcuuggccaggccaaauugccacauccuccacuccauuauuucuuccugaggcugggcuugcgguagaccccgcagcccugaacgacuccacccacaggccccaugggaaaagcugugacugaaaugcuggcacagccgcugccacccaggcacucgaggccuccgaggggugucccccuccugggcuuuucaccccagcacugcagauaagaaaaugaaauggaaguaaggagccagggggaugggggcagcagcuccguccauccccaccaacuccaucaccccaaccuggggcagaagaccuggacuuguaacucacagacuaggaagcauaggccagauacagauagaggcuucaccucagcuggcugcagagggcaggagggcugcgugucaucacauccugcuucacccugguccacccuccccaaggaaagcuuccugaggaaauccugacugcuacagagaaaugggugguucagcccgaggacguaaacaagagcaauguguuuuguucuguuucccugcagaccugcgcagggccucuggcuaaacaauucuuuggcagccaugcaacuaaaaaccaagcuaagcgguggcucagacaacuaaaacuuguaaguaagaaugugcauggucagacucaacugaggauugcuaaaaggacugagguguguucucaccuaaguuuuuagcuuaaggaagcauaauuauaaaccgcgauuacuuuugcaccaaccuaauacaauaacaaaaagauacacuguggccaggugcgguggcucacgccuguaauccccgcacuuugggaggccgaggaagguggaucaccugaggucaggaguucgagaccagccuggccaauguggugaaacccugccuccacuaaaaauacaaaaauuagccagguaugguggcaggcgccugggaggcagagguugcagugagcagagaucacgccauugcacuccagccugggcaacagagcaagacucagucuuaaaaaaaaaaaaaaaaaagcuacccacuaguuacagaauccaucagaacccaaagaugaugagaaggaagggaaauuacuugcagaagcguauccaaauggaauccuuggcuuaugccuguaaucccagcacuuugggaggcagacgggcaggaucaggaggucaggaguuugagaccagccugaccaauacggugaaaccccgucucugccaaaaauacaaaaauuacgcgggcuugguggcccguaccuguaaucccagcuacucaggaggcugaggcaggagaaucgcuugaaccugggaggcagagguugcagugagcugagaucgcaccauugcacuccagccugggcaacaagaacaauacuccaucucaaacaaacaaacaaacaaaacaaauggaaucccuauuuucuuuuaguuuuacaaaugacaaaauucaggcccaaaccuaaaugcuugccgagcuuauacucaggauccagacauugcaagucagacaccagaaaugcaccaucgccccaccaaguccggacaagacuuuaaaugaaguucuucuuguucuguugucugcucgucuccuuccaaguauccaauauuuucuugugucuauaucuuagcaacuaaguuccucagcacagugucuaccuuucuuaaacuucuucucaaaaaugaucucuauggguuuuuuuugguuuguguuuuugagacaggcucucccucuuuugcccaggcuggacugcaguggcgcgaacacagcucacugcagccacaaugucccaggcucaagcaaucuucccaccucagcccuccaaguaguuggaaauacaggcagcgcuaccaugccuggcuaauuuuuuuuuuucuuuucuuuuuugagacagaguuucacucuaucccccaggcuggagugcaguggugccaccucggcucaccgcaaccuccaccucccagguucaagcaauucuccugucucagccuccugaguagcugggauuacaggcgcacgccaccacgccuggcuaauuuuuguguuuuuaguagagaugagguuucaccacuuuggccaggcuggucucaaacuccugaccucaggugaucugccugccuuggccucccaaagugcugggauuacaggcacgagcuacccugcccggcuaauuuuuguauuuuuuuuuuguagacaugggguuucaucauguugugcaagcuggucucgaacuccugagcucaacgauccacccaccucagccucccaaagggcugggauuauagggaugagccacuacacccaggcaaaaaugaucuuuauauuccuagcuccaucucuccuucaguuaaagcucccauuaugugagccauuucagcaagggagagcaagacaucaaaggugcuuaaggaucgaucauggaggaugcaucauuugaauucuuaaagggaaauauggucaugaggugggcaagaaugagauguacuucaguaugacccccuccucaucaccucuaccaggagaaccaacaauaucuuugcagagaacucugugcccugcaagaugucucaguuaaaaaaaaaaaaaagauaguaaaagaauuugauccaauaaaacaaaaaauggccaucaggcuuccuaaauacuguaaaugucaaaugacugauacaaauaguaggugcuaaagaaugugcaaagaagagaaauacugauuuugcaaugucaacagaccauacgauuuaaaaaagcaaucauggguuguaaaucauaugauaaugaggcaugacagcugggagcuagcuugaucacaaaguaccugacacagugaaauacuugaagggaaaauuuucuuuuuccucuccuuucuuuuuuuuuuuugugacagagucucacuuuggugcccaggcuggagugcaguggcacgaucucagcucacugcaaccuccgccucucagguucaagugauucuccugccucagccucucaaguagcugggauuacaggcacauaccaccaugccuggcuaauuuuuguauuuuugguagagaugggguuucacuauguuggccaggcuggucucccacuccugaccucaggugaucugucuuccuaagccucccaaagugcugagauuacaggcaugaagcacugugcccggccggagggaaaauuuuuguuaaucauggaauguucuuaauuuuuuaauauugguaucuuugacuccaugcuucauuuguacuauuuugcaauguuuccuauggucagaacccuuggggaugaugcagacucuauccuuguguucuucccauuucccguggcagaaccuauucucaucuugaccuuguaucuacagaaaccuuccuuuuggacuugagucauuuccugucccaacuauagcaacugcuagccuuacguucuucuugaauauugaauugugaacucuaaacgugcucaggacaggcaacuuucacguuucaacuuccacccuacauuaguuaggagucuacacucuugcuuuuguaauccaucgcugagcuugauucaaaauuacugauuccacugucauucuuuuaauugaguaugguccucuccacacaccccaucgacuucccacagcuaauggugaguguguguguccccaaaggaaaguggagcaguggugagccaucucucaagacuucaggggaccuuucccuucgugaccaugaaucaucuuccuucucgaucucaacgugaaaacuuuccuuuuccucugcuaauaagaaguuucuuaauaggaugucugcugggcuguguaauaaucuccaaagggaagugauggagguuuuggcaugagucauugacguggagcuggaggaaguaaugggcaguaauggaccagagggagcaguccuuuaccaacaggaugggcugccgaugagcugggaaauuuuauuuuucuaacucuccauuuuuauauuacuuggugaggacauuucucucaaugcauuuacucugaaugaauggugggcauuaauauuaauuuauucagggaucagaacuuuuuagaauguaugucccauuagaguuuaauuaaaauguccauuauagaauccacagggaauaaaauauccuauaagugguuuccauuuucuccauauccucuuuuacuuucauugcuaacccucagcaauccagcaaggagugauuucugacucuccaaaucuuguaagaugccugcacaucuuacacagccucaaagaccagggagugaggugguaccaggaggggucugaagcagagguuaagaagagccucaaucggccgggcgugguggcuuaugccuguaaucccagcacuuugggaggccgagacggguggaucacgaggucaggaguucaagaccagcauggccaagauggugaaaccccgucccuacuaaaaauacagaaaauuagccgggugugguggcgggcgccuguaaucccagcuacucaggaggcugaggcagagaauugcuugaaucugggaggugcagguugcagugagcgaagaucgugccacugcacuccagccuuggcaacagaccaagacuccaucucaaaaaaaaaagaaguguugggaggcccaggcaggcgcaucauuggagcccaggaguuugaggccagucugggcaacauggugaaacccugucucuacaaaaaaauaaauaaauaaaaaaaauaaagaagagccucaaucacuccgucccuaacacuauccaccgccacguccuccagaacaccgugauucaucugauguugcauucaaaggauugaggacagggaauucaaagggugaggccaaggggugaggcagggcagcccuguguuuauggauaucaccaccaagguuccuuugcagccaugcagcccaugcccaaaacccuuggccagggucccugccccacaucagcauaucugcccagaccuaagaagccacuucaggaaucccugcaccaauaagacuucuaugcugcacuacaacuuucucuccacacccucucucccagcucuguccuggguggcaguugggauagguagcaguugagauucaaagaggaaaacaaagagguauuaucuucuuuaggaaacuuuaacucaauuccacuacuuguauguauguauguauuuuugaggcaaggucuugcucuguuucccgggcuggagugcaguggcacaaucauggcucacugcagccucaaccuccugggcuaaggugauccuccugcuucauccuuccaaguagcugggacuacagucacacgccaccacaccugacuaauuuuuuauuuuuuguagagaaggggucucacuauguuacccaggcucaauuccacuauuuuaaaacaaagauggaaagcauuccuaagccuccguuuccucauacgaccacacccucacccucaccucacuuucaaaaaaaaaaaaggcauauaauaguaaaaauggcaagcaggaaaggggagaaaaccaggggcauuagacugaggccuugugugggagggaagauggggcacauugcaaucucuuccucauugcucaguccacaucacugcuuaucucauagaaccuaguaagaaaugcuggacauuuggccaggcaugguggcacaugccuguaaucccagcuacucgggaggcugaggcaggagaaucucuuaaaccagagaggcagagguuguagugagccaagauggcgccacugcacuccagccugagcgacaaagcaagacuccaucucaaaaaaaaaaaagaggccaggcacgguggcucacgccuguaaucccagcacuuugggaggccaaggugggcggaucacaaggucaggauaucgagaccauccuggcuaacacggagaaaccccgucucuacuaaaaauacaacaaacaaacaaacaaaaaauagcugggcgugguugugggcgucuguagucccagcuacucgggaggcugaggcaggagaauggcaugaacccgggaggcggagcuugcagugagccgagaucgcgccacugcacuccagccugggcgacagagugagacucugucucaaaaaaaaaaaaaaaaagaaaaagaaaaagaaaaaagaaaugcuggacauucaucagggaaaccgugcuucccucugucucugucucuccuguugcucacuaaguacccuggaggaggccccugucuucuucuuccacacugguccaacccauaccugauaaauguuuccugagucgguuucuaugcugccauggccagggucauauugaggcucucugcuuaucuaucuucucaauguucuuuuucuacuggccaagguguagggcugugcaagguaggaaaccuggaaaaaguucugcuguccuuuuuuucccuuuccuuuuuuuuuuugagacagaguuucacucuuguugcccaggcuggagugcaauggugcgaucagcucaccacaaccucugccucccagguucaagcgauucuccggccucggccucccgaguagcugggacuacaggcaugcaccaccacgccuggcuaauuuuguauuuuuaauagagacaggguuucuccaugcuggucaggcugggcuggucucaaacuccugaccucaggugauccacccgccuugcccucccaaagugcugggauuacaggcaugagccaccgcgucuggccuugcugucuuuauacuuuccucuuucucccaacagcucaaagcugcuacccugugguaauagagcagccaucuguauuguuuccuaggggcugccauaacaaagcaccaauaauuggguggcuuaaaacuacagaaauguauugucucccaguucuagaggcuagagguccucgccacuuccuagcugcugggggcugccagcgaucuucggcauuccuuagccugcaggugcaucacugcaauucuccaccaucacaugcuguucucugugggugucuuuacuucaucuuccccccgugcacaucugugucugugucccaguaaggacaucaaucauguuggacuagggcccacccuaaugaccucaacuuaacuuggcuaaaucugaaaagaagccauuuccaaacaaagucacacucagauaccagggauuaggacuucgagguauccuuuuuugugggaaaaaaaaucaacccacaaccacaccucacagggucacuguaacaauuaaaugaguuaagguauggagagagcuuaguauaguguuuaacacauaguccaugcuccauaaauaacugcagcuaauaucaauauuauccuuacucuuauuacuaggucauccauucuuucugccccacagcaucuuuguuaaaaaggcuuuaaagccuggcggggggguggcucacgccuguaaucccaacacuggggggccaagguggcagaucacuggcagucaggaguuugagaccagccuggucaaccaaaauggugaaacccugucucuacuaaaaauacaaaaauuaacuggacgugguagcacaugccuguaaucccagcuauucaggagacugaggcgagagaaucgcuugaacccaggagguggagguugcagugagccaagaucacgccacugcacuccagccagggcaacagagcaagacucugucucgaaaaaaaaaaaaaaaaacaaaggcauuaaaagcaaguccuguggcagccaaguuucaaagaauauuccagcuaucacacaaaaaugcaaccuccaauccaacuccuugggaaaaaaucaauuacgaugacugacuagauuaaaaaaaaaaaugaaggacgucccuuguucuguccacugagcucugaggcaucaaggaagcauggaaugcagagccauguaggaaucaguaaaggaaguccuccaaagaagcaggugacaaccaaauuucugguuccuuugguuuguaaagaaagaaaaaaaaaauucagcugggugcgguggcucacgccuguaaucccagcacuuugggagcggaggcggguggaucacaaggucaggagaucaagaccauccuggcuaacacggugaaaccccgucucuacuaaaaauacaaaaaauuagccaggcaugguggcgggcaccuguagucccagcuacucaggaggcugaggcaggagauucacuugaauccggcaggcaaagguugcagugagcugagauugcaccacuguacuccagcccuggcaacagagugacucuaucucagaaaaauaaaauaaaauaaaagacaauaaagaaaucugcugcaucaagggacucuuccuuucaugaaagauuucuccuuaacauacuauacugugugauagcacuuuacccacagcagaaccucuuucaaaauaggaaugaauccucuuaaacucugauacugcuuuaucaacuaaguuuauggaauacccaaaauccuuuguugucauuuuaacaauguucacaucaucuucaccaggaguaguuuccagcucaagaaaccacuuucuuuacucauccauaagaagcaacuccacaucuguucagguuuaaucaugagauugcagcaauucagcuucaaaaugugacauagggacucaaaaugagcgcacgguauuggaaaaauggcaccaaaaaucuugcucaacacaggguugccacaaaccuucaauuuguuaaaaaaaaaaaaaaaaccggccaagcacaauggcucaugccuguaaucccagcuacucaggaggccgaggcaggagaaucacuugagcccaggaggcggagguuacagugagcugagauggcgcagcugcacuucagcuuggacaauagagugagacaccgucucaagaaaaacaaaaacaaaaacagaaacaagccauaacugcaaagugcauaaaaugaaguaugccuauauauacauacuuguauuuuuuuuuuauuuuuaaauaaaaauuccaaggaccacagauguuuaaacauggcauuagggccggguguaguggcucacgccuguaaucccugcacuuugggaggccaaggcaggcggaucacaaggucaggagaucaagaccauccuggcuaacacggugaaaccccgucucuacuaaaaauacaaaaaauuagccggguguggugaugggugcuuguagucccagcuacucgggaggcugaggcaggagaauggcgugaacccgggaggcggagcuugcagugagccgagaucacgccacugcacuccagccucggugaugaagggagacuccgucucaaaaaaaaaaaaaaaaaaaacaaaaacauggcauuaggaaacaggaaaccaaagaaccaaccaagcaucuaaggaggggugacuuaaauuuaacgcaaaacaauaaagguaaucacuucuaguuuuaaaagauaguuaagagucuggccauaucccuaguuguacaacagugacuaucugucacaaccaaggcacugguacaauaucagugugcuucucucugccuccauaaaaauuauuuugaaacagacccuccugggaccccagaagguagugugucacuauucccuccccucauucauuuugcuaaguaguuuuucugccaaaacaacacuccgagccgcuucaauccucccugccaacugcauugcauaauucagugcuuacuucucuugagccaaccagcaaaugcaagauucaaaccaaucugcuuucacuugcucauuggucucuggcugauccuugggagccaucggugaccuacaguccuugagcaacucucgcccuggauuaucuucuuuauacaucaagacuugaaauagaacauacucaaacuugucugcaagucugucugcagguguacaaauaacagguuuaugugucuucaaaucuugauuuuuuuuuuaaagccaaaccuaagauaaaaccuaacugcucugcagcuugaauuuuuuuuuuuuuuuuuuuuuuuuugagacggaguuuugcucuuguugcccagucuggagugcugcggugcaaucucagcucacugcaaccuccgccucccagguucaagcgauucuccugucgcacccucccgaguagcugggauuacaggcacaugccaccacaccgggcuaauuuuuguauuuuuaguagagacgggguuucaucauauuggucagguuggucucgaacgccugaccucaggugauccaucuaccucagucucccaaaaugcugggaucacaggugugagccacugugccuggccgaaaaucuuuuaggugacaacaggaggcugacuuucccgaugucguggaaguaggccuuucuauuuucuacaauaaagaacaaaguggacagucaugggugcuguucuggagccugucucaagcugguuacaaugaggaguaggagucugugcuucucuccaccaccuuggaauugauggaccugcaaaugcaaagccuuagguguuugccacacugacccacacuggcauccaagacaccaggauccagggagccuggguggaaacugggaaaacccagacugugggagacuuucuggcuuuaccaucaaacucugcucaaagagcagaggccaaauccaucugggucugguccacccuguggggcagugugcaaagauauauaagcucaguauuuuaccuguuuuacagguaaaacagaugaguuuggaagucuaaaaucugcagaagccaaagucagccagcaauuguugaauuaugguuauugaauaaaauguggguguguuuaaaaggaaaccaggaacccuacauuauuuacauggccaaaggaugccaacaacaggaaguuucuaguagcucugagggcauaaauccaaucagcauaugugcacagcaaaagaaauaaucagcagaguaaacagacaacccacagagugggagaaaauuuucgcaaacuauacacccaacaaagaacuaauauccagaaucuacaaggaacucaaacaaaucagcaagaaaaacaaauaaucccaucaaaaagugggcuaaguacaugaauagacaauucucaaaagaagauauacaaacggccaacaaacaaaggaaaaaaaugcucaacaucacuaucagggaaauacaaaucaaaaccccaauguaauacuaccuuacuucugcaagaauggccauaaucaaaaaauaacagauguggguauggauguggugaaaagggaaaacacuuuuacacugcuggugggaauguaaacuaguacaaccacuauggagauuccuuaaacaacuaaaaguaggccaggcgugguggcucacacuguaauccuagcacuuugggaggccaaggcuggaggaucaccugaggucaggagcucgagaccagccuggccugucucuacuaaaaauacaaaaauuagcuggaugugguggugggugccuguaaucccagcuacuugggagguugaggcaggagaaucgcuugaacccaggaggcagaguuugaggugagccaagacaagagcaaaacccagucucaaaaaaaaaaaaaaaaaaaagaacuaaaaguagaucuaccauuugaugcagcaaucccacuccuggggguaucuacccagaggaaaagaagucauuauaugaaaaagacacuugcacaggcauccucaugggcugugugugguggcucaugccuguaaucccagcacuuugggaggcugaggcaggcggaucaccuaaggucaggaguucgagaccagccuggccaacauggugaaacucugucucuacuaaaaauacaagaauuagccagguaugguggugugugccuguaaucccagcuacccaggaggcugaggcaggaggaucacuggaaccugggaggcagaagcugcagugagcagagaucacgccacugcacuccagccugggggauagagcaagacuccaucucaaaaaagaaaagaaaagaaaaaaaaaaaaaaacagaaugauacaauggacuuugggggacuuggggggaagcguggaagaggaugagguauaaaagacugcacacugagugcuguguacacuccucaagugauggguuuaccaaaaucucagaaauuaccccuaaagaacuuauucauguaaccaaauacuaccugaccuguuccccaaaaacuauugaaauuuuuuuaaccuguauucaaaaauaaaauaaaauaaaaccaaucagcauauguaaaaguacauaugaagugcaagaaaucauaccaauguaaauaugaucauucuaaucucuagagcagcacuucuuagauuaagggaugugaccugguaagcuucucucgagguuuaaggaauguguucauucuauucgucuccccuccuggucucuauggaagcucuuccacuauagaaggcauccugcuuucuaaagacccagacucagaauaugcagccacucaggggcaugacaaaccaaagaguucuugauacaaaauauuaacgugggguaacuagcugacauuuucuucuguugaaaaaggagccaguucuuugauaaugcuaaaguuacaucaugaagauuuuauaauaucuucuacauaucauuuaggaaucauuugacaccuauuuaaugcucaucaugaagucucaguuucccaauccucuaaucaaggcaaauugcuacuacacaucaguguuaugacgcucuuccaguaaaucaccaccugggcgucacauguuaggugaguuacaacaacauguugcagaagacaguaaugaccauaccccaguagacuaugucuuaaugccauacauucugagaagguuuuuuuuaaaaaacuguaauucacaauaaaaugagccuuaaaaaugaaauguuuuaccuuuucagaauaaauguuuauggucuuuacagacuuucccaaagauuucaaauuccuguaggcucucuuuagauucauaacuaaaucaucccaaaauaacaauuuauguaaguggcaaguuuggccgggugcgguggcucaugccuguaaucccagcacuuugggaggcagagguggguggaucaccugaggucaggaguucgagaccagccuggccaacauggugaaaccccaucuuuacuaaaauacaaaaaucagaugggggugguggcauaugccccuaaucccagcuacuugggaugcugagggagaauugcuugaacgcgggaggcagagguugcagugagccgagauugcgccacugcacuucagccugggugacagagcaagacuccaucucgcgggaaaauaaaauaaaauaaaauaaguggcagguuuauucauuacaggcuuauaguucuuccucaaaccacaaugagucccauuuucugccauauucacgcugaaauguguggucaaguuuuucauaagucugguggggccauuguuauaugauggcuuuauaaauucuugacuggaaaccuaagacucuuaauuaaagcucaaagaugcagaaugagugauuugcagaaaauagcucauaaaaaauagcugcuaacugaaugaaacccugggaaaagagucuacaaaacaaaacaaaaaaaacacaaaaaaaucaggauuauaaaaaccaauuuaguacauucaugaauccaucacucaaaaaaugaaaucauaagugaaugcuuuuaauauuuuacauguuucuaaauaaguaaacuauucaaaagcucucuuauauuauugugccacuuagacacauaaaaaaacuaaaaauggcaauguggguaccauuuaaacagaaaauauacuuuuauuacaagcauuuucuuguuuucagaaaaucuuggcuauucaaaagcauucauauuuucucucuuuuuuucuuucuuuuuuguucuguuuugcuuuguuuugacacaaugucuugcuccaucacccaggcuggagugcaauggugccaucacaacucacugaagccuugaccucaugggcucaagggauccuccugacucagccucccaaguagcugggacuacagguccaugccugguuacucuuuuaaauuuuuuuuguagagguguggucucuccaucuugcucaggccagucuugaacuccuggccucaagcaacucuccugucuuggccucccaaaacacugggauuacaggagugaaccacuguacacagccuuuuucucuugugaguauagaagauauuuuacacacauauuucucaauauguaaacugaagguuaauaccuugaagcaauuuauguacuuauuuuuaagcuacauauuaaaaagggcauauuaccucaaucaaaucaauaguuaagaucaauuggucagguaugguggcucacgccuguaaucccagcauuuugggaggccaaggcagguggaucaccugaggucaggaguucgagacuagccuggccaacauggcaaaaccccaucucuacuaaaaauacaaaaauuagccaggugugguggugcaugccuguaaucccagcuacucaggaggcugaggcaggagaaucauuugaaucugggaggcagagguugcagugagccgagaucgcgccacugcacuccagcgugggagacagcaagacucuguccaaaaaaaaaaaaaaaaaaaaucaaucuuaaauugaacauguagaaucagaacaucaucccuucauuuaaaaaugaaaaauuaguaaugcagugguucacacuuguaaucccaucacuuuaggaaguuaacuugggaggacugcuugaggccaagaguucaagaucagccugugcaacaaaaagagaccccuccaaugcuagaaaaaauaagaaaaauauaauaagcugagcgugguaaugcacgccuauagucucagcuacugggaggcugaggcaggugaaucccuugagcacagggaggcgaggcagcagugagucuugauuacaccacugcacuccagccugcgugacacagggagacccugccucugaaaaacaaaaaauaaaaaauuaaaaagauuaaaauaaagauauauuaauucauauucuaaauaaagagauucaacuauuguuaguaguuaauaauaacucacuuuuuuuucuuuggagacagagacuugcucugucacccgggcuggcguacaguagcacaaucucagcucacugcaaccuccaccucccagguucaagcaauucucccugccucagccuccccaguagcugggauuacaagugcccacuaccacaccuggcuaauuuuuguauuuuuaguggaggugggguuucgccauguuggccaggccggucuugaacuccugacaggugauccaccugccucggccucccaaagugcuggaauuacaggcaugagccaccguacccagccaauaacucacauuuaugaacugcucaucguaugucaugcacaguucuauuuauuuauuuauuuauuuauuuauuuauuuauuuauuuauuuauaagaaggagucucacucugucucccaggcuggaguacgguggugugaucuuggcucacugcaaccuccaccuccuggguucaagcaauccuccugccucagccucuuaaguagcugggacuacaggcgccugccacuaugccuggcuaauuuuuguauuuuugguagagaugggguuucacuauguuggccaggguggucuugaacuccugacuuuaggugauccaccgccuuggccucccaaaaugcugggauuacaggcgugagccaccaagccuggccuuuguucucauuauuuaaauaauccucaugagaacccaaugauguuggugacuguuaaccucauuuuacagauaaggaaacugagguacagaauaauuaaauaacucacccaggucacauguccgguaaggguuaaagccacaauuugaacucaaacaaccuaaaauaguuccuuugcucuuaacuacuuuacuauucuaccuaucaguuuucuaagagauguucaauuaacuuuuguuuguuuguuucuaaauguuuuaacucacagauuaagguuguuacucuucucuuucaaaacuuuuuuuuuaaaagacugggcauuuccaaacaaggaaugcuacaaaguuguuaaugguuuauuucacaaaggagguccuuaaaauccuaugaaaacagacaaagacaaacuccuauagcaaagauacauauucuugaacuagaguauuccuuuccucuacaaauaauuuaauguugaaacacuaaauuuuuaaagcacacacacacauaaacauguuuuagcucuagguuaaaaacaauuguuggcugacagcaagaccaauacaaaauuauuauuaaagucaacaaagucaagggugcuuaggauacauuuuaaaggaaacuagguccuacuagauuaagggcaguuaaaaaaaaaaaaaaaaaaagcggugaguaacuagggcucagggcauaucccaagauuuuuuauucugcuccucaauggcucuuuacuuaaaaaucaugugauucuuauaaugcuuuuauuuucuuucuuacuaccucaugcuaggagaaagaaggaagccacaaccaggcagagugauggguggacacauggaaacuuccucacucacuacuugcugcaaaaggaaucuagcaaauagugaaugaaacaucaaaaucaaccaugaauggaacuugcaucagacacccaaggagaacugcaauguaucucugugaacacagagaacauuagucugaagagcaaacauaaauacaaauauauuuccguuuucaccaaucaucuugaaaaacaaacauaaauacaaauauauuuccauuuucaccaaucaucuugaaagccauagaagagccuuucagaaaaaaaaaaaaaaaaaaaaaaacuacuaucgcagaaaggaaauacuagcccuuucucaagcguuugucuucugagucucagaguuaccauaaugccuggauacccagucuccaggauggagaugucuguauuacaugacuugacauggcaggaaagauacaagauagguuaucucugugaagcaucucuccucauaaagaauuaaugcugcccagugaaacacuucagagaacaaaagaagggacguucaacaucuggcuaggagcaaagcuaaugaggaagagaccuaccauuuucaggucuucuuacaaaagugaauuaauaaauagaugagcauaucauuugaaaaaugacaauuuauguacucaaaaaauacauuuuaucucaaaauuagucugaagguuuaguuaauucuuguagucucagucuguacucacagguauuaaaugguaucacugauagugagagucagucucuguccauuuagauucacucuuuugagaccaauuucauuuuuacuaaugccaagaaugugugucaaccacagguaggcacaucgucuauuacagugggauuaugacagucaagucuuagacacgaaacaaucagguagcaccacagcacucuuaaaaaggacacauuagauaaacaauaguuuuuccucuuacauccuuuguaaaauugagcuacggauuugcaaaugaauaaauuugcauugaacuacauauuucccacuauuucacuguacucuacaauuagcuuuuaaaagaaugauuuaaagaucuuucaguggugugcauauuguuauaaauaauaauucccccuuuuaaggaaccacauucuaucaguauagagagacagguauacaaauauuuguacauauauacauggauagauacuuuuuucuuuuuucuuuaauaagaauuacagaugagaucucgcuauguuacccaggcuggucuaacuccuggccucaagcgauccuccagccuuggccucccaaagcagugggauuacaggugugaggcgcugugccuggccgccuuuuccuuuagagagaaagaaaaucugccgggcgcgguggcucacaccuguaauaccaacacuuugggaggccgaggugaguggaucacgaggucaggagaucgagaccauccuggcuaacacggugaaaccccaucucuacuaaaaauacaaaaaauuagccgggcgugguggcaggcgccuguagucccagcugcgcaggaggcugaggcaggagaaugacaugaacccgggaggaggagcuugcagcgagucgagaucacaccacuguacuccagccugggcgacagagcgagacuccgucucaaaaaaaaaaaaagaaaaaaagaaaaucacaaggcauacgacaucucuaaaaugucuugcauuaacucagcccacucuugagcauaaaagaauuaucaaaagaaaguuaccauggagcagucuugauuacuuuagagacuguacaaaguguugggccucaggcagccagaggacagguaaugacucgacacagaaacaucugguuggggcucucacuaucccugccugggucacuaaaguagucuccuucccuccaaccucauugccaccccaucgccuacaaaaguuacuuuucuggccgggcgggcgucguggcucacgccuguaaucccagcacuuuggaaggccgaggcaggcagaucaccuuaggucaggaguucaagaccagccuggacaauauggugaaaacccauuucuacuaaaaauacaaaaauuagccgggcaugguggcagaugccuguaaucccagccacuugggaggcugaggcaggagaauugcuugaaccuggaagguugaggguugcagugagccgagaucgcgccacuguaacuccagccugggcaacagaguuugacucacucaaaaaaaaaaaaaaaaaaaaaaaaaaaaagaaagaaagaagaaagaaugaaauaaaaaaguuacuuuuccaaaacacagacgcaaguagucccaugcccaauggccucuuucaccggugcccacaaaccuuauccagcaacaucagcacccagaucugggagaucugugcccuuccaccuuugucccucuuugcucuguggggaagggcccaccucgcaccuuccuuuuuaucccucucacuagaaaagaccucucugggaacuccuacuuaucccucagggcccaaauccaaagguaugucugguaggggccgcccagacgcuccuggguugcugauccugagugaagggauccuaccgccuucggggcgcucugcccacugcccugugagguuggguauauacucagcgaccguggggcugaggcuuuugcagcaaaacuaaccuuuuguagaauucaagggcaaguaucgcuaauagcucaauagcuuaaacaaacaaaaauuagcagccaauaaacgucugaagaagaugugugaaagaaugaacuauacacaguugcaaauggaagucaguuucagggaaauacaugauccaacucucagcuuccccaucuacuaucugcaugacuuaggacacagacguuuacaucugaacuguaaaaugagggcaagaauacucacugaccacaccuccuacaaggaucaaguaaggaaauguaugcgcaagauccagcacagccccaggacucuacacaggagcacugccucucacuccguccccauagagcugcaugcaaaggaccucaguaagaagccagguggcagagggaaggguuguauggcugagcaaaagaaagacaagguagagaacagcaaauaaaggcagaaaggcaggagaagggaaucauggaagaaggucacuuaagcuuaaggggucuccuuuagcaggaaaagauucggcaaccccaaccaaaauuaucaaagccggccaggcgcaguggcucacgccuguaaucccagcacuuugggagaccgagguggguggaucacuuguggccagggauuugagaccagccuaaacccugucucuacuaaaaauacaaaaauuagccaggugugguggcagacgccuguaaucccagcuacuugggaggcugaggcaggagaaucgcuugaacucgggaggcagagguugcagugaccggagauugcaccacugcacuccagccugggagacagagugagacuccuucucaaaaauaaauaaauaaacaaauaaauaaauaaaauuaugaaagccauugacuuagucuuugccaaagaagugaacauccagacgccugaguucugccuccucucuguuacccugaguaagucuuuuacaccuggaagcccuccaaacccuucucucuaaaugagaguugagggugcauuuccaagggcgcuucaaucccuuccaguacauaacccugcaacuucuccacauagagaggccacaaggcuuucuucagugggcuaaaaggaacaucauaaaauuaaggugaagucagaauauuugaaaugugcuugacucucaaauuccaagacguaaaauuaauuaagucauuagcugauaggcacaacucuagacaccucccaagagaacauguaaauuaacugcuuucaaaggaguuagcauuuuaaaagcccccucaggaucucacuaacaucuccccgccccacacugggccuaaaacaacaaaggaaaagagggagacauuuuguuuguuuguuuuagggguuuucuuguuaauuuuuuaggaauggaguaaauaguaagauaggaugaauauagcaguucuguggacugaugccugccuuucuguagcuugcacaggaauuagaguaggggaagguucggaguaucucuauacaauggauauuuuuuaaacaugcugggaaauggguguaaauuguagaaacagagcaaaaacagaggaaauuucagguuugggggaggugcaucuugcaggauccugcaaacaauaggcacuuacuaacccccuucccaguuaacaaguagauuuaaaggcuucuaaggcuuugccuuagaaguccucaaauccuguaggcagaagcugaagaaccaucacaauuuaccaaauggauaaaucaguucugaaaaaaggaucuaccacaccuaacuguaucaacaaccuuagcaauucccgcucuuaaaaacaacuucccuccccuaccuaaaaaaaggaaugccgugucugccaacuauggaguaaagaaaaaaggguaaaauuccacaggauucuaacucaguuuugcacuucucaauagaagucuacacaugucacagggagaagugacaugcuuugaaaacccuggccuaccacaugucgugguguuagugaacagaauggcacauuucacaagaacgccaagguuuaauagcucagggcuuauaaacauguugcaguuuaccauuaguuuccaguggaagcacugggauuuuaauuugcacgaugaaacugcccaaaaugcaguuucagccagagcagaauguauucacaucuuuauaaauguaacccauuacauuacagcaggcacaugugucuugacagaacaaugcuuugaugugacuccugcauuuaagaaauacauacuuuuccccuuuuucuuucaacaaagccauguucucagcacccaguuaagucaggagcacuggagauagaaaaaugaguaagacacugacccugcccuccaggcacucacaaucuaguuaauuuuuuuuuuuuuuugcaagcuuguuuucucuuaauucuauauccauuuauauauucacuuauuagcauuuauuuauucuaguacugcucaaacauuuucaugccguaaauuauacuauuauuucuuuucuaaaugagcacuuuguuaacaauuaucugaaagcaacuauuuggugcuuaacugugcauggacugaauuaaucuaaaugcaaaauguguccuaaugaacucaaacaaccauccuguauuuacugagauccaugacucuggggcaauacuuucacuggguuauaaccaacaaaauccccugggggacaacugcucaauauugcucauucaccuaaaaauguuuucacuuacuaagcugugaguuuugucauuucaaaguuccacauacaguauugauaagcugugugguuugauuuccacaauuagaauaaucugaaaaaguaagguagaacugugucugaaaucuguuaaggauaauguucagauguguaauuucccaacuaccucuacuguccucuucaaguucaguacggaaaaagaaucuuguaagucacauuuuaccuaaaacacacaggauuucuaaauguacugaacuacauuucuacugaauucaucugagaguuaacuauggagcgucaugacaucaggaucccuacuggaggggccagcgaccagggacaagucuaacauugucacuaacaugguaugugccauuggccaagucacuucaccugucuagauugauagaugauugcaaaaucuuauauuuuaaauaaaaaaggaaggaaauggugucucuuguuucagugagaauaaagucaacuguuaauuuugugucuugauguauuuccccgaagacucaguuuguauaaacacuuggaugacagcuuucccucccuuuuagccuggugucucccugcaagacaucuacaaaggagcaguaagccaugucuuccucugaauuuuacuaaggaacaaucuccaugccuguuuaccccagauaaacaagaggaaaacaugagcaaacacaaccugucugggacaggcuuuacguucuucccagccugauccugaaugauuagcugaaguacauauuuucuuugcuccugcaucugcccuuucaauagcagguuugagcuucugaagccccaccccaucuuuuaacucagccaaagaacacuccacuacaacugacccaacagugcuggaaucugucagggaagggaaagcaaaucugcagaaaaugccacuggccaacccucuuccccaaaagaacccucagcccaaguuucauuuaaacaggcccccaauccuccccgcccccagcccaacgcccuagaguaagggauacaaugggauauuaucaaaccaauuuccucagugacugaaaacuuagaacuggaucuagacaagaaauaacaggauaacuuaaaaacagucuaucgggcgcgguggcucacgccuguaaucccagcacuuugggaggccgaggugggcagaucacaaggucaggaguucgagaccagccuggcuaacauggugaaaccccgucucuacuaaaaauacaaaaaucagccgggugugguguugcgcgccuguaaucccagcuacucaggaggcugaggcaggaaaauugcuugaacucaggaggcggagguugcagugagcugagcucgugccacugcaccccagccugggcgacggagcaagacuucgucucaaaaaaaaaaaaaaaaaagaaaagaaaaaguuuaucacaacuuuaaaauguccauuagguuuucuggaacuucagugaaggaucauauucaucuguauacuucagaaaaugcaaaaacaaaaccuuuuaaaucuaaaauauauauuagauuuagguauauuauauacaugugcuauauauaguauguaaauauacauugcaugcauauuuauauacauuuuucaauacuggagagugacaagagcagauagaaaucuuuaaccaacgcucgcugguucucuguauaguaagaaucauaaauaccaauggucaccugaaaauggaguaacugggcuuuuaggauguccagaaggaagagacaggagacuuugcaggaaacaaauaaaaccugaaagacagcuacacuuauugagccucuacuauaugcuauacagucugcugaguacuugauacacacaucaacccagcuaaaucucagaaaccccaagaagcaagucuucuuuucuucaauuuucaggugaugaaacugaggaucagagagguugaaugacuuggccaagaucauguaaacagucaauuggagagcuggcauuugaccuaguauaacuuacuuugaagcccaagaguuuaaucacugugcuaaaaacuguacacgguuuaucauucccaaagaagaacuuucacuccaucuccucccacucaaaaaauauaagaucucaaagcaaaucuagagacuuuucugauaaucugcacaucuggccauuccaagucuuuaaacuaaaguugucuuuuauguauggauuaagaugucugacuguaauaaaccucgcccaucugauuccagucuaccugccuaacuacagcuccaccaaagcaaaucuauuacuuccccaagguauucaacccugagcagguuaaaacuucacccuccauacagaagaacugcuucccagagacuaugccaaauccaggggcgcuuuuagucacuggacauuucaaaauacaugacagcacagauuuagcaaaauaaguccuauuguuuuagccccaaacauauaaaacaaauauccuguaacuccacaaauugaaaaacugcaaaaaaaaguaggcaaacauuuuggcaguucugaguaaggaaauguuuguuuucccucuuguggucacacaacaaauggugaagagauaaacaucaguaacaucagccuuuucccuaauccagcaccaaccaaauauuuauuuacaucuacuuuuugaaggccucuuucucgccuuuuccacaccaacaugucagcaggugucccagauuaaacuguugaauaucauacccgauuguuuaaaaaacaccuuuugacgggaccuguggcugguuauuuuuuaauuaggguuugaaauccuauacuguguguauuuagcccccuaagaacuagagccagagaaggacgccucugcggaguggguugcccagugggugggcgagaagggagcccccgguuucagaggggcugcugcgaacuguacuuccugcgccgcccccuccccagguaacuuaccaggauacccaucacgucgguccagagucgggagaacgccucggaugugccagcacccggcuugggcuccgguuccggcuccggcgcgggcucgggcuccggcucgggcucgggcucaggcuccggccccgggccagcugcucccgcguccuccauggccgugucccgcgcgcgggccgugcgucccaguccccgcggcgcccucgccccgcacccgcgcgcagccugcccggaugccggguccccgcccgcggcgucaccgagccgcgcccccgcgcugcaugccccggcggccccggccaccccgcgggggcccuucgcaggcgcccgcaccucgggucuagguggccacgggcugcgcgacugacaacuccagaaacuuuccc

SEQ ID NO: 21465 - RNA, 79531 nt, Homo sapiens
cagcuaggcgcugugguuucugggucucccgggggaccccuacacguuccggcaaaaagcgcucgugcccaccucaagcccauguucgguggguggcgaaugcgugcccgugaucugcugggucuguagaggagcgcaggccuggugcaaacagacucaagaggcucggagaaccagcuuggguaggcgcuugggugauggaaggucaggggucagaggucgggagggagggagggagguggucuuuggccuccgggaccagggagggaggacgcugguuguccuggagcccgggaagcucaagggcugagagggagccgcugcgcgagucuuccccaccucuucccgaucccggacuagcgaacuucggaccaccacgucccuccggggauaaaguggggucgugggaaaggaggcugugcuucuccucaugcacuggggccugcgguguuugucucgagcguccaacacacuaggauccgggaguccgucgucacgcuccuuggccucgcggucgcuuguuugcucggccugcugggagcgauccggcgcugacagccccgcucagacuccgggagccgcuugugggucuuucggaagauaacugaguggguaccgugcgccgcagaucuacccccggaggcuggaacugggucgccgccucccuucuuugugcgcggcauuguauuaguaaaaggggaggcagagguuucucagucccacucaaaguucuccguuaccuuuggagccagauuaauuacauucgaauucagaaccacucuuugacauuguacaguuugacugguaguugcuauguuuaugaacgaagauaggguguuauuugaugauuaauagucacuguauaaugaucaguuaaauaaugaccaggaagcuugugcccuuuuuccaaguaguuugacauuagcacgagguagaaauccgagauguuugaugccuuccaacuuguacuuaaggaacuuaaggaacuuggggcuuuuucugaacaaaauaagauaaaguuauuacuguuacuuuaaauuauuccagugggcauuaguaggaaugaugaaacucuugaauagaaacgauccaugauaucucuacugucacaaaaaagacuauuuaguuuaugauuaguaaacaugcuggagacagagcaguccugagcaguauuguaaugauuaugucugugcucgauaaccugcacuuucuagagcuuuaaaggaccaguuaaccaguaagcuggcaauugagaauaaaauaguuuacuuuugagagaugcucuuguauauccucuuuguccacccgaaaggagcuggacuuacagaauuauuaaaacaaaacuuuuauuauuaagaguuuaggccaguaagauuuaggggaaacaauuugcuggugaaaaagcuucuuaugagggcauuuuuaaaguuuauguaacuagcauauuuuagcauucaguagaagaaaauacucucaccuugcuggaauuauuucuacagaaaaggaaaagauuauguuaacccugggucauuaagagcuuccuaguacuuaguaaugagugggcuucauuuccauaacacaacauuuuggacaggaauauggcaaguauguaauccuuuuugcccuuaauagccuaaacccagaucuaccauggauuuguuguaauucaagauuuguguguaucuuuuaaagaggaaauaauauuuuggagggaaaaaaugugaauuuaaguuguguuauucauuuguuggauugucuuaguaauguaacauuuuauguuuauuuuucuagcauuccauccuuguuuucuguuaaagauacaguucaggcaguuuucccugccucguucuaguauuucauuuuucucagaaauacuaguuucauauuaccuauagucuucuagaauguggauaagagagacuucuccaaaaagaaauaagaguaaaguaucguuagguccucaaaaggagggaauacauccacggaauuagagaucuuuguuucacccuuuuuguaugucuuuacuuccuagcacugaccuggcauugggaguacaacacugaauaggauacuacuccugcccaucuuucaaagugaacacucuagcaguugggaucgaggagagagaggcccuuaacucagcuucucuagucauggaagccuuuccagggaagauugggauggagacaggcauaaaagcaauucaagcaaaaggcuuuuauauuuaaauacaagacaguaaaagugcgguccauauagaaaacuucacauaauuacguuuuacccaaacacugcuaauuaaggaggaggaagaaguaguugugacugauaagguaugaauaaaaccagaagaauaugggaugugguuagauacagaauuucaccaguacuugacuuacuaguugccaaauugcauuuuagucauaaguauauuugaccaaauacuauuuucuuugguucaagaaguuaacccugaauagagauuuccuuaaguaaagacucagucaaaaccaggagcuuuuuguuugguugguugauuuuugaucaugaauguuuacucaguuaagaacuggacaaagggagagcauugcuagaaauucugguguugacuuuucugcaguuuaucauuaucacugauaaguaccuugaggcacuaauauuggaagaaucaggcugaaagaauacaucugaaggaaugugcaaauuauaaugguguacauaauuuaaaagauacuggauagguuuuaccagagaacagaauaaauaguugaaguaauguuuucugguuugguaauaugucuguuacaaaauuauugugggaaacauggcacauauuacuucucacauuccauuggcuaggacuggucacaggaccaaaccaagcugggcagucauuucucaacuacucuauacuuugaguggaaauaaguggauuuuaguuggcagcugguuauccauaacaagguuuuuugaacuuggcugcacccuggaauuuuuuagggauucuaaaaaauaaagggaguagugccugggcccuucuccaagacauucugacuuaguuggcucgacaucaggauuuuuuuaaguuccccuggugauucuaaugugcagucaaguuugagaagcacuaaucuguggucccccauccugcgacauuacaguuugguuauugugaaaugugguuuagagcagggguccccaccccucaggccauggaccggugccaguccguggccuguuagaaccgggcugcauugcaggaggugaguugcgggcaagcgagcauuaccaccugagcugugccuccugucagaucaacagucaguagauuaccauaagagcaugaaugcuaucgugaacugcauaugcgcaggaucuagguugugcacuucuuauuaaaaccuaaugccugaugaucuaagguggaauaguuucaucccuaaacaacccccucuccacuccaccccucuccuccgguccauggaaaacuugucuuccaugaaacccauuuaugguaccaaaaagguugggaacugcugguuuagaguguucucaggaugaugauaaguagcaacuaccauuuauggaauacaggccaaauuucuaguacugcuguuguacuuaaauuauuucuaaccacaauccugcuaucauccccauuuuagagaugagaaaauuggcacagaagacuggauaacuauuccaaugccacacagucaguaaaugccaaagcuggaauuagaaugaauauaagacuucaaagcauugcauucucaccuuuaagccacaucgcuuugcuaaugugagacucugcuagacaguugcuuuuuggguuuucagaguuaaugauuccacaauaaccauguuauuaauauuauuaugguuagugugauacauuguguaacuggcccaauucccuuccaacacucccucuacccuuccaccccccauauccaugcucuuugccaugugcaguuucaccuaguaaagagguguaguauauuucuucaccacuugacauuggguccauggauaugucuugcuuuggucuguggcaccuuagugguuuuuaagcacuuugaaaacuacuugugugauuggauuugcaguaauacaccucaaccauugccauaaagaacauuccugaguuacuuugcugauccaaggagaggggauaggaacuacauuaagcagagccaaacugcuuuuccagaaaccuagccuagauuagccuccuucagcuaaugugcagaucuaugagaauaaaugauugcuauaucaagguauugagcuuugagguaguguguuacacagcauguuuguggcaguaguuaacugauaagcuacuauagcauaacuuuuuaaaguuccugcagagugacccacuuucaguauuccagcuuaugcuuugaggaaaacuggacaaacauaaacacuuaggaaauuaagagcuuucuauauuauuccacuaagauaagagaggauaagaugcuuuaaaaguaguugaccauagccaaggauugauuuuaauccaucaccugcacauucauaagugaagcacgggcuaagggaauagaauucucaugauugacuuaaacaagcacugucugauacauagacuuuuugcaauuaugugaaugcucuauauuugugcuguccaguacaguagccacuagucacauagcgcuacugagcacauggggcuagugagacugaagagcugaguuuauaacauuuaauuuuauuuauagucaugcaucacuuaaugauggggcuguguuuugaggaaugcaucauaggcaaguuuguugugugaacaucuuaagaguauacuuacacaaaccuaggugguaccgccagccuacuacacaccuaggcucuaugguacagccugcugcuccuaggcuacaaaccuguacaguauauucgguacuggauacuguaggcaguugucacaccguaguauuuguauauuuaaacauauuuaaauauagaaaauguacaauaaagauaugguauaaaagauaaaaaauaguacaccuuugugggguacuuagcaugaaugcagcuuauaacacugaagguugcucuggguuagucagggagugaaugugaaggccugggacauuacuguacacuucuguagacuuuguaaacacuguacacuuaugcuacacaaaguuuauuaaaaaauaaaguaaugcggcuaggcgcgguggcucacgccuguagucccagcacuuugggaggcugaggcaugcagaucuugaguucaggaguucaaaaccauccuggcuaacacaugaaaccccgucucuacuaaaaauacaaaaaaaaaguuagcugggcauaguggcaggcgccuguagucccagcuacucaggaggcugaggcaggagaauggcaugaacccaggagguggagcuugcagugagcagagaucacgccacugcacuccagcugggcaacagagugagucucuaucucaauaaauaaauaaauaaauaaaugcauuaugauguuacaauggcuaugaugucacuaguccauaggaauuuuucagcucccuuauggaaccacuguaauauuuggucccucauugaccaaaaugucauuauacaaugcauaacuguauugaaaguuaaguagucacaugcagccaauaacuaccuuauuggauuugcuuuggccaauaguagcuagaaacuacuuccuuggaggugccaaggaaaucacuuccuuugaaucauagggccaccuuguuccuaaauaaagguucagucaucagggaaggaggauagaccuuaggcagguaaauaaugucacuuuaguuucuuuuaugguuauuggucuauucauauuuuccuucuugggccaguuuuguucauuuguauuuuguuagcaaaauuuuaucacuuuauaauuuaucauuuuaucuagauuuuucagauuuauugaauaaaguuauacuuaauauuaaaauuucuaaaucucgugcaucuuuuuguuuuugcucuuuaaaucaacuuuaugauauaauuuauguauaagaaaauucaauuuaaaguauauaauuugaugaguuuugacagauguauacucugcaaucauguguugaacauuuaugucaccccaaagccugccuuccugcuccuuuacugucagucaccucuuuauacuuccuugccccugguaaccacucaucuacuuucugcaaucagguuuuugccauuucuagaauuucauguaaauggaaucauauaguauauagucuuucacaucuagcuuucuucaguuuagcauaaugcuuuaacaguucauucagguuauuuuacagaagucucuuuuuaucacagaauaguauuccauugugugacuaugccacaauuuguccauucaccaguugauggacauuuggguuuucuuccaguuuggggcuuuuaauaguaaagcuguuaacauucaaguuuaaauuuuuguggauuuauguuuugauuucucuuggauaaauaccuaagagagggauuacuaggcugcauaguaaguuauauucaauuuuauuagaaacugauacuuuuccaaagugacugugcuguguucaaauguuggagaguucaguucuguuugagccauacucucaguguuuuaaauuuuugacuauuuuaguauaugaauaguggcaucucauugugauuuguggguugaauuuguauugcuuuaaugacugaugcuggugaaaauauuuucauaugcuuauuuuacacuuauaggucaucuuuggugaaaugucuauucaaaauuuuugacuuuuuuaaauguuugucuuacuauuaauuugugagaguucuuuauauauucugcaaacauauccuucaucagauacuugauuugcuaauauuuucucccaucugugacuugcugucauauuuugaugacaguaucuuuugaagaaccaaaauauuuaauuuugaugaaacuuaguuuaucauauucuuacauagucuaugguuuuuguuuccugcuuaaaaauuuuugugccuuuuuuuugggcuaauccaaugucauuuagguuuucuccucuguuuucuuugagaaguuuuaguuuuagcuuuuauaguuuauuaucuauuuuuaguuaauucuuacauuuuaggagguaaagcuucauuucauugcauauugguauccauuuacuaaaaggauaccuuucccauugacugccucugaacuucuuucaaaaaucaauugaccauccauguguggguccacuacaggacauuucccuugaucuauauguuggucuuuacaccacuacugcaccauuuuuauuucuuuugacauaugucuuggaaucaguguaagucauucaacuuuauuuuucuuuucuaaaauuauauugacuuuccuguauuguaggcauuuuaguauaaauuuuaacaucagguugucaguuucuacagaacaaaccuguuggaauuuugaaugggauugcuuuucuauaggucaguacuaagaaauugacaucugaacauuuugagucuucuaguccaugaacauaguacacuguauagaucucugauuauacuguuauacuauuuucuaaauuuuuauguaugcuugaaaauuuucagaaugaaaguauaguaaguuaucuuuuacagaaauuuaaaaaucaagaaaaaaguuuacuauauuuauacacauauuuuuuguuuuugcuuuuuauuuccuuguguguggauccagauuuccaucugaugucauauuucuucuacccaagcgcuucuuacauuacuuagauuguagguauacaggugauaaguccuuuuggcuuuuguugaucuuuuuuucaccuucauuuuugaaagauauuuugcuggguuuagagcuguggggugggagcagugucuaaaccagagaaauagggccaaucuggagagaaguccucacuuuucaguaauuuaauuauggcauaccuuauugugauuguucuuuauguuugcccugauuggguuucauugagcuucuugguuuucugaguugaugguuuuuauagaaguuggaaaauuuucaugcaugauuuuuucaaaaaguuuuuuguauccuuuccauucuuugcugcugagauuccaguuuuaugcauguuugacuccuuaacauugucuaguagguuucugauguucuauuuauuguuuuuucagucuuuguuuaucucuacuucauuuuugacaguuucuguuguuacuguuguuuccauuguuuaagcuuauucugcuucuuuuuuucuuugccauuucuaaucugcugguaaucucauacaauguguuuuucguuuuagauguugcauuuccaucugcauaaauucuauaggagucacuuguauaucuaucauuuuucuuugucauauucauguuuuccucuaccuuuaacauauugagaauauuuacaguagcuguuugaauguuuguuucugcuaauuauaucaucugugucuuuucuggggcuuuuugauuuuuuucuuguaaugggucuuauuuuucuguuuuauuuucauuuuuuuugcgugccugauaauuuuagauuugaugccagacauuuguguuggauuuuguuucgcucuuuuaaguauuguugggcuuuguucugaggggcaguuaaauuacuugggauugagagauuuaccuuccuauuauauugcuuauuaaauguauuucuacaauuuauuuuauuuuauacaacaaauugccuuuacuauuaaagacuagcaaaaccauuagaauuuauuugauaaaugagauuaugguuaauauguucauuccuuagucauaaugaccugguaaaaaaauuacucauugccuuauaucucacagaagauuucauauuauguuuaugggcuaugaauuuaugcugaauuucucaucugguaacccuuaaauacuaaaucaucucuuguuauaccuccuguuguuucauuuguccucuagaguucacaguuaccagccaagaaaacuugaaaaugagcagccgacggaaacgugcuccuccagugaggguagaugaggaaaagaggcagcagcuucauuggaauaugcaugaggacagaaggaaugaaccuaucaucauaagugaugaugacgagcagcccugcccagguucagauaccucuucugcucauuauaucauucuaagugauagucuaaaggaagaaguggcucacagagauaagaagagguguucaaaaguggugagcuucucaaaaccaauugaaaaagaagagacuguugguauuuuuuccccuuugucuguaaaguuaaauauugugauuucucccuaucauuuugauaauuccuggaaagcauuucuaggagaauuaacucuucagcuucuuccugcacagaguuuaauugaaaauuuuuccgaaaggaguauuacauugaugaguucagagucaagcaaucaguuccugauuuauguucauucaaaaggugaagauguagagaaacaaaaaaaagaaccgaugaguauuugugacaaggguauucugguggagucauccuucaguggugaaauguuagaagauuugggguggcuacaaaagaagagaagaauaaaacucuaucagaaaccagaaggaaaucacauuaucaagguacucaguuuuuuguggugucuuuuuugaggcucuucuacauuggcaguccaauuuuaaauuaacuugugagagaagucugaaaagccagcaauaagccuuucauuguuaaguuucaaaguacacuuuaagcuuuuaauaacuauucaaaguauguuacaacuaaucauuuucaggcuacacuuuuucaagaucuuccaucucuacuuucagugacuuguuuugguccucaucaucaguuccucuuacugcagcagucauuuaaccauuuaucuguuugcuauuuugccuuuucaaaugcuucgauuuugucucuggaauuguaugauugaaugcaaaugaaauucuacccauuacugccuacagaauuaaguauaaucuuucuaaucuggcacacaaguuccucccuugacaagcccuugagccuuacccuuuauuacucugcuuuuuauuuugucccagaaacuccaaauugauuuauuuucuccauauaccacacugacuuucugcgucuuugcuuuuguucuuauaguuccuucugcuugaguuguucccuuccccuucccugguaauuccugguuauucuuuaauauuuaguauagcauuuaauucacccagggagaucguuucuuaaaucuauugguaguauuaugugcccucuccucagaaucucugguagauuuuuuuuuuuggccuuggcggcuugucacauacuuaacauuuuagaucauuccccucugcuaaacuaugaagccuuucaucuuuacagccuaguaaaguaccugguaccuaaauuuucaguagaugaaugaauaaauuuguaauuuauuucagucucugucauucacuggccaaauaacuuuaugugaaucauuuaaaugcucuaauuucaguuucuuuaugaaauguaaauaauacccauucuucuuacagcauagaauuguguugaaaaucaggccagauaauguaagaaaguauacuuuguaaacugugaagcaaguuaauaugcuuuuaugcuaaaccugaaaauuuaaaauguuaauuucauguuguuuaacugaaaacugucucauauauuucuugcaucgauaaccuuaguuauaguuuuagaauugucagaaggaaaggagaacauuuagaauuauuagacuccaauuaauuuuucccuguacagugaaacuauguaaucaaacauucccucucuuuacugauuuugccaaaauuguggcucagugauaacaaguauguaacaauuuaugacucacauaucuguguucuaucuacguucccuacagaccaaguguuaaucuauucuguuuuuccugauccugaauuuuacaaauauuuaaacauuuauugcugcuguaguaagacaucaccaagcgagccaagacagaauacuagcaguaaugaaauacacucuuugucauucauuucuguguaaggcugguggauuccuguucuguagugaaagaauaugagauucucagugauuagggagucagguacaacauagucaacaugaaguaaagggaauuaacauuuauugagugucuaccauuagaaacuuuuauaguuauauuauuuaagauggacuucucuccauuuuguaaaugagaacacuuaggucaaaaucaauagguuauuuuucucaaauucauuuagcuuccaaauaucaaugccaguauucaaaaucaagucuuucaacuguaaaacuucauaccacauugcuucacuagggucaaaauauuaacauuaaucaaggucuguuuuuuuacacguuuuaguguuugauucaguaaugaggaugcccaaaccuaacugugcagaagauuccuagcauguaugucauaaucuucuggggaaaucggcauuuuuaacaaacuugacugauuaauucaucaguuuugggaaucauugcauugguagauagaacuagguguucuuaucacauucucccagguucgauuucaguuaggggaauauuuuuuuccagcaacucgaauuguacauuguaggcacuuacauuuauaauuuguuagugaaaaugaaacacgugggggaaauuugguaggcauguauuuauuguuugugucacacaugcuaugaauaccuuuaaaaguagugaugcuaauuuuuucuugcuuauguccucauaaagaaugguauauuucaaaugaaacuacuuuuauuuugauuaauuguuuuuagguuggaauuuaucuuuuggaagcuggccuagcaaaacuagacuucuugagugaugcaaauucaagaaugaaaaaguucaaucagcucaugaagaaaguaauggaaaaguuacacaauucuauuauuccagguaauauuuacaguaaacuuaaaaauugcuauuacuuaggaguugugaguuuuuuccucuaaccccuggacauaacaaucagaaaaacagcuaauaaagccauaauaaaaauuaaaugauuauauggcaaauuauacuuauuugaaaugcacccacuaauauaauuuguuucuuugguuaacucugugcuuaccuuauauuaaauauuaaagaaauauuugcggagucaauaugcaagucaaaaggcagagucuaaagggaucugagcugguugggauuuuugcauuauuccugugcuuuuauuuugucaugggccagaaauucuuggcuggcguuuauuccaccucuccuuugcagucugacaaauaauuucaaaagccugguucccauaaagaccagauaacuuugcucuguuucuuggcaagacguugcaucuuuggucaggacugcagauucagaguugucugccauuggucaccuugggagaguguggauggcuuggugcagcucaucaacacuacuggaaaaacagcccaaauucuccaaguucugcucauggugggucagcauuauuucaggugcaaauuauagaacauugucauacuggaguauuugaaaaucaguuucuaacuucgauuguuauuucucuaguacauucuuugcaaugcuuuauaauaucaguaauaguaaaucguuuugcaaguuagauacuuuaaauuaggaaaucucugguuucgggauuagaaggaaugaauuuaaguacaucuagaguuuuuaaacuuauggccuuuuaaaaauauuacaauuuguucauuuuaaagccugguaucuaaggaaaacuucaaauuuagcuauuaaucuuagauuauauaauuauaguaaaagucuaaaacaacugagcauaaagcuguacauuaauugugaaguuuuggaaauuuuacauggcauauuuauuggaaaaaaauaaguugugaauuuuuuggugucaucuuuuaguuuuagaaguuaugagguauguccuauaaaaguauauaggccucuuucaaagcaauucagaaauaaaugauauacuuuuucaccuugaaagaauuauguuuuuaauaaagaaccauuagcugaaaggaguuuguaaauauguucaagguuuuuauuacuuuuuucauguuauaguaaguauaaaucuucuuccacagaacaauugugcccaccaagugaacuuaguguuuuuacaaauuugcauuaauaacauaaucacuugucuuccaguuggcugcuacugcuaccaaaugccuauccuuuucuagcauaagaaauaaaaugagaacccauuucuuauugggcauagaacaguuaugucuccauauggauuuuguauguuaaaauuacaaaaguaaaguaaguuguuccuauauaaacuucaaacaguauucacauugaguuccucaaauguuuauaaaacauccacaauagacaauacacgugucagcuacgugucagcuucucugaggggcuacaaaaaugaaaaacuuugccuuuguuacccuggggaaaggaccaguggacauaaauguuugcaguaccagauagauuacaauguaauaauacuguauccacagaggagaacauaauuccagccagggaaaacaaaagaaaaugccauggaaaaaguaucaguuaaacuuucuugaagaauggaugaguagauuuuugauuaaugaagaauuaaagauagggccuuucagugacaaaacacacugagcaaggccccagaguugggcaaguucauuguaugcucuuagaauaagaauugcuuauaguuagaaaaaaccuaucaguuuuugaguacauuugcugugugauguacagauguguuggaagaggaugaagaugauccggagagugagccagagggacaagacauugacgagcuguaucacuuugugaaacaaacacaucagcaagaaacgcaguccauccaaguggauguccagcauccugcauugaucccuguguugagacccuaccaaagagaggcugucaauuggaugcuacaacaagaguguuucagaagcaguccugcuacugguaagaauaagauguuuaaagaaaguccaauugauuagagagauuacaucagagacaauuagggcagggugaaauugaucauuaaaauaaacauccugaaaauauaagauagaaugggugccauaaaauuauuuucuaagaaauucuuuaaaauugaaaucuagaaaaaugaauuugugaguuucuucauucauaaaaguuuguacugguuuuucuugccaaaaggaaaucaauccugccucaauuggaauuuuuaaaaaccaagaaauuuuuuuuacauuccuuucaaacaaagaauugcucuuuagaaucugguccagugggaaucuuacugaccaucugcaagaaacucacaauguaauggugaauguuggugacagaaagcaaauuuacaaaaguaggagacuuaugugugaugaauuuuccuagacuuugcauuuuuuucuuuacaguaauaaaaugucaucuguugaguauuuuuaugaaaguaguaguuuuacgggaggcauuuaugccacuucuuuauugcugucuuuuuucaauaacuuuguggggguaaaagugguuuuugguuacauggaugaauugcauaguggugaagucugggcuuuuaguauacccaucaccugaauaguguauaucguacccacuauguaauuuuucaucccucacuucccuucugaguuuccaguauccguuauacuauucuguaugcccccauguacuuauagcuuagcucacacuuguaaguaagaacaugugguauuuguuuuucuguuccagaguuacuucacuugggauaauggccuccauuuucaugcaaguugcugcaaaagacauuauuucauucuuuuuuguggcuguauaguauuccaugguuuccaugguguguauacacaccugccccccuccacacacauuuucuuuauccacucauugguugaugggcacuuaaguugauuucauaucuuugcaauugugaauuuguacuucaauaaacauguaagcaugggugacuuuuugauauaaugacuuguuucacuuuggguagauacccaguaguguucuggagugaaugauagaucuacuuuuaguucuuugagaaaucuccauacuguuuuccauagagauuguacuaauuugcauucccaucagccguguaaaagcauucccuuuuuacuggcuucgugccaacauccauaguuuuuugaauuuuuaauggccauuuuauucuagaauauaaaaauauaaaauaucuauuaaucucuaaagaagccaauuaaaaauuacuugcuguuucauugguggguagagacaugcuacuuauuuggcaguugguuuaaauaaguuaaaauauuaaggagaaggcuaguggaagauucugguagaaacaaacucagcacuucugaguuaugguuuuagauauuuuuuucccaguuaaguaagccuuucuucccacucucagacccguagaagaggucaggucugauucggguaaauguauuuagccaccuagcauaugucuauugaguuauucaaagacuucauauaauuuauugcaagauuuauuaaaaauagacucauucaucagguaggagcugguuauauguauuaguuuuccuguuaauucucuguaaucugccacacuuugcuuaucuguccuauuauuugcugauguggauuugugcccaaaacaaagggagcuaaagaguaauaucagaagaaaggaaauagagggacuuuuagcuuuuuacucauguguuaaguauguggcuuuuccagaaugagauuucacaagaauauggguaucacuaugccagaguauccucacuguuaaccuauucuuuuuuuaaugugauuaucugacugaagggaaaacaaaaauuuguuauuaugauuauauuuuucuuuagaaagugcccugcacuucuuauggcgagagauuguuacaucugagggucugaaacucuacuauaauccauauacaggcugguaaggcaaaauuuuacuuauaugcuugauuuaaaaaauaaauauaaugaaaaacugucugagauuguuagcauaucuguaacuuugacucuaccucaugaaggaaucaaaggugaagucuugauuagacauaucuauggauaggauagauuuagaauuaauagcacuugucauuuuucaguaaaugaauuuggaauaauagacauaaggugcuuaguuaucaagacuaaaagagauuauuauuuaaaguaaaaauguuaucuuguuuauuauggggucaguuuuauuuuuucuuaguaaucauuaaacaucaugaaugaauaguaguuauugcccuuuguauuuuuuuuuauucauagauucauaaaggucauagaaagaaggcagacguguucucuuuuaacuaccacucauuucugcagaguuacuugucagcucaggcaguuuuuuugguuaucacaguucuaauguuuguaaucuaagguuugaauuguuuugcccuaaaauauaguuucaauaaacuuagacuuuaugcauugcuuccaguucucuuuaggaaaaguaauuaggaacauuguaauuuguauucacauuccuaugaugugauuuaucuuguuuuuuuccucagcaucauucgugaguacccaaauucugggccgcaguugcuugguggaauuuuagcagaugagaugggucuuggaaagacaguggagguuuuggcucugauucugacacauacucgacaagaugucaagcaagaugcucucacucuucccgagguaggaggguauaguagggcuugcaaaagcaggggacauauguucucgaaaagcaucguauguugaacauuugcuuggcacuuaagucaacacuuucuguucacucuguggguaaugauuuauauuagugguuaguuaacuucaagugggcagagagaaugggguguuugugacccagaagguuuauuuuugaaguaauguuggccaacuaggaagagaauuugugaucacuuacugaacuuucuucuaguuggcagagaaacuccuuuacaaaaguacuguugacuccucaaauguuuugucacuaauaaagucuccauauuacuacuaaauauuuuuaagagcuauuuaaaaauguuauacaaaucucauauauauaaaucuuagaaccaaauaauuagaacuuuguuaaagaacaaguagcuuaguaaauagauugcuaaaugaaacaaacuucaaguccuugucccaaaauacauaauuguguuuaaaaauauaaauuuuagaguuacagaaacaaaguccacuaaggcaaauauaguauauagcucauauuuucuaguaaugaaaucugaaaucagcccuuacauuaaaucuugcugaaaugaagucaguaguuaaagguauaauuauaauuaauuaccucuaggacccaccagucucacagcuuuagcauuauguuaucuuucaguagggucaaguuugcagaauuagccuuucagauuugaguagaaaauuuaaaaaaaaaauguuuuuuuuguagacaaaugacuuggaauauauugacuuaacuaucaguaacuucuuucugagauuuccuacucauuacuauuuuaauuccaaguuauuuucauauuauuauaaauucaauggguuaauuuuauauuuaaauauaccuuuaaaaguuaauuucagagguuccacacauaacauuuagguaauuuaagauaauaugcacaauuuuuuaagugauagcuagcuguaaacucagaaauaaaacuguguauguaucuacagcuauuuggcccuuucucuugcaauuuuuuuagaacuguuuugcauuuccauaaagaaggaaaguuaauuucaauaagcaauucagaauacugaaagcaaaacacuguguaacuacugacuguuguuuguaucagggaaaaguggugaauuauuuuauuccgucacauuauuuuggaggaaaacugaaaaagacagaaauccagaauaucgaauuugaaccaaaagaaaaaguucaaugcccucguaaguaagacaucucuuaaaggaaauaccuucuuauagugaucuuugcuagaguucuugcaauccuuagagauaucuuguaauuguuauaaacaauuguuuuuacaguuauauaugcuuuugauaaaugaauucaauuacaagucauaauaucuuaacaaaaguaaagauguauuauuuuguuugacuuggcccagguaguucuugcucagucuguuauauuuaaaucucuuuagcuuacaguuuaaaccaggcuuuauuuaucuuuuaggaaaugaauguuucgcauacuaaugguagcguauacuuaaauaauugugagaguuuucuuuuauaauuuugaaugauuguuuuauaguauuaacaauucaauaugaguaauucuuccuuugauuauuuuuauuacaguaauuuguuucuuaauaugcugagauacauuuuuauuacauauuuuuucaaaauggcacucugcuguaauaaaucuuugauuuauuucuuucuuaacucaguccucaugcagauuaagauuaaccaaguuuuacuuucuuuucauuuuaauuauuuugacugauuuagcauauccuuuuacauuuagcuacacgugugaugauacugacagcugugaaagaaaugaauggaaaaaaaggaguguccauccuuuccaucuauaaguaugucaguucuauauauagauacgauguucaacggaacaggagucuuuugaaacggaugcugaaauguuuaauuuuugaaggucucgugaaacagaucaaaggccaugguuuuucugggacuuuuacauugggaaagaauuacaaggaagaggauauaugugauaaaacaaaaaagcagguaacagagcuuaaguucagcucuauauuaaguacacguaugugauaccuuacugaguacauugacagaucccaccuugaaacugaaacucuuacgaucugaagauaaaaaaauaggaaaaguacuuauaucuguaacuucuacuuucuacuuuguggauauaaacuccgugagaguaacuuuacuuuggcuaucauuaaaccuagagaauaaugcuuggcacguaacaaauacucagauauuuauugagugaauuaaaaaacuaguuggcuaagcguauuauagaguauaaagcaucuucuguauuauuuauuuuuauuauuuuuuuaagacacagggcaucuauugcccuggcuagaaugcaguggucauagcuagcugcagccuugaacuccugugccaagcugucaucuugccuuagcuucccaaguaguugugaguacaggcucaugucaccaugccugguuaauuuuucuuguuuuuuuguagagacgggguucucacuauguugcccaggcaggucuggaacuucuaaauucucauuuucuuuauauuauuaucuuauacaauuucugcauuuuguuagaaaacugcuucuguugggccaguaauuucaauuugcuuuuaggaaaauaguuauaauauuugcaaucauaaauaaagauuaaugacaacaagucaaaauguggagcuaccagcucggccaccaagaaaaagacaaaaaauuuauuuucuggaguagggagucuauauuauccuuggguagcacugaagacagcagugaacugugcuuuugguaauccugcuaccaccaaaacuagaagauuucccucaguuaaugccauugauuacauguugugucuuaacuccccuguucgaccucagcccugauaugccuuggaggaagcugucccuauuaacuaccugccuaucauacucccacuauguuguacaacccucuuagguauucccauagcaucauuuuacuuuuuacuguucucacuuuuccaguagaccccuuugaaaccgggggccaaauauuguucauauuugugucccuagcaucuaacacaacuacuggcacagaauuggcauuuaauaaguaauuguaagagaggacauauguagaaaagggaaggaaagaaggaaucaauuugcuaauugcaguaaccaguggauuaucuuuuacuuucuuuggaugcuauauuuuaguacuugguguuuuuguaguugcccugauuuguauauuuauguacucgaaaaguacuagucuuguauugauuuagguagacuaaaucauaguagguaaauaacaaaauaucaguagcuuccuuuaucuuucuaauuuuucaucucuccaaaucugacacuuguagagccuuccuuuuguuuugagaugaagugaggguccuuacagagggcagauuggaagccacuuaucaggagugauucuccucagggaaaaggguagcaaagacuggcugcuacauaauuauaugaaguacuuacauaaagucaggaguuuaauuucagaaaugcaacuaguugcaaucaauuaauuaaauauuuuuuucauaggcaguagggaguccaaggaaaauucagaaagaaacuagaaaaucagggaacaaggacacagauucugaauacuugccaucagacaccucugaugaugaugaugauccuuacuauuauuauuauaaguccaggagaaaucgcaguaaauugaggaaaaagcuuguuccauccacaaaaaaaggaaaaagucaaccauuuaucaaucccgauucacaaggucacuguccagcuacuagcgacucuggaauaacugauguugcuaugucuaaaaguacauguaucucugaauucaaccaagaacaugaaacagaggacugugcugaaucucuaaaucaugcugauagugauguaccaccuucuaauaccaugagucccuuuaacaccucugauuaccgcuuugaguguauauguggugaacuugaucagauagaucguaagccucguguucaaugccugaagugucaccuguggcaacaugcaaagugugugaauuaugaugagaaaaaucugaagaucaagccuuuuuacugcccccacugccuuguugcaauggaaccagugucaacaagagcaacucugaucaucucuccaaguuccaucugucaccaguggguggaugagaucaacaggcaugugaggucgucaucucuucgagucuugguaaggccacuuggacuaaagagggagaggaaaauguaaaguuuugcuucuucaugauaguuuccuaaucuuuguuucuuugugguuuauccucaaaacuaacugaaugauuuaauaguaauguuaaaucaaagcuuaaagaaaaaaauugagacuaagaacuagaacaguacaauguuauucuuuucuaacaucagaauuucaccaauuaaagcauuuugaguauaaagauguggaagcuuuuuaaaaauucuugaguauguaaaugagaaauucuugguauaagcauuuauagucuucagagagaaaugcaauccaaaggcagcacuguguaauaggagcuacuuaucugaucugccaucucuuagcuccaaaaucauccucuaaagcuucaguuaccucagcuguaaaauaagaauuuacuuauacagcaaaucuuuauugaccacuuauuaugugccaggaacugcugaguuuuaaaaauaguauccagucauuugugaagauaugauuuugucaaguacugggcacauaguaauguuauuguuuccuaauauuaauacccuucacuaauuucauucuuccuucuuuccaugcaaguguuacugaagguuuuuguauuucauccacuuuacauaggcauggagaauacuguaauaagcaaaacaauuuuugcuguuaagaagcucuauucuguguggguaggcaaagcuuugagucuuaguuccaucaguuuugagcaagucacuuuauuuuucuuaugugugggauaggaauauuaacaaccaccaacagaauuauuguugaaguuuggagauaaugcuuagcacaguaucugaaacauaaaaggcauuucauaaauaauagcucuuauuguucuacuuuuucauaccauugugcuuucacauaugcuauugauuccauccuccuaccuacauauagcccuuuucucuuuuugccaccuaugagaaccuuuaagauauaccucagguuuuaacuccucugugauuuuaccuucuccgcuacagaauuggucuuuccacugugaugcugucauguucacauuuauuacaguuuguugcacaucaguuauguaauucaucuuccacacuaaaacaugucuuucuccaaacagguaugggaucugucucauagcaugaaugcuccuaagaaaauagagaggacuuaguaaggguauaaaugagugaauauuucauugccuuuagugagccuuuuugcaauaacugccuguauugauuauuuccuagguauaucaaggagugaagaaagauggcuuuuuacaaccucauuuuuuggcagaacaggauauaguuaucauuaccuaugauguacugcguucagaauuaaauuaugucgauaucccacauagcaauagugaggaugggcgucgccuacggaaccagaagcgcuauauggcuaucccgagcccccugguagcuguggagugguggaggaucugccuugaugaagcucagaugguugagugucccacaguaaaagugagaguuucugcaaaaucuuuugagggcuggggaagaagggugaaaaggaauuaggggaccuugaguaguuuaauaguuuaagcauaguuaaccuguaguacugauauuggucaaaaguuuguuauuaaacacuacuugugcuuuucucuugugcuuugaacuacauaacccuuugaaauuaguucuguacucugugacucauugcucuauaugaaauauauauuuuucaguaagaugucuguuuauauaugaugcagaucaaaguaaacuguguuuaggaacuucuguaagcauuucugcuaacugggagcucaucguguagccucugauagcuuugaaccaaaguugacuuugacagucuuuuaaaucagaggccaaaugguaacagaaaauacuacuuuagaggacagaauuuugauucagccuuugaaugucauaugucuuuauucuguugucuuuggccagucuguaaccugaacugaauguaugaaucaugucuguuaguauaucuggaggauagagugaugcagggcauggaucaguuauucagggggcuuuuucauuuuguacguauuugaacuaccccucuguuuuaggggacugcguggcagccucccacuaaugagaaccacuguacuggaagaugguccauugaauaugacauucaacauugagugugauaacuguuaaauaaaaguagguacaucucaccagaaguguagcuuuuaaugggcuguuuuucaugaguaugccugacuucuguguucuuucugugguuuucuggauuucauuuuuauuucauuuuucccucucaucaggcugcagaaauggcccagcguuugagugggauuaaucgaugguguaucaguggcacuccaguacagagaggauuagaggguaauguaugguuuccucacauauugcaugcauuugaaaagcuucauuuuuuagagagaaaaguauuguuaugcuuaaccuuugcugcagucccuauugaagugaugauucaugucuuuauaguugacuccuaauaguuucaagcauuuaucuuuuuaaaugggacucaggugauuuuucuguuuauguauaugaggaccgauauauauuaagaggucucauugccuuaaguugaacaauuauuguaccugccuaaacagcauagauauaggucugaauuaaaauuagaguuccaaagucauagguagaaaacaaagaaucuaacccaaaaagaaacaaagggugggggggguggggagaggcagaaaaagagagaaagggaauuaauuucaauuaacugugucuaugaaaauggagacuauaauuuuuauugugugaacccaggaauacuagggccauaauuuuaguaauuauauaaguuauuaguagucuuauaaugucacacuauauguauauaccguuauuguuucuaccauuccuuuacuugagcauuuagauugugucuaguuuuuuccuccucuccacacgugcauugaaaugauccuucuaccuuaaucuuauucaauaucacaguagaacggacacugcauuucuaaaaccuuuauucaaguugugaauaucuaaaaugaaaaguuuaaaucuuguuuuauguauuucccuaaaaguuguuauuaaaguguaguuaaauuacaaaauuuaaacauacuuggaguucuguaguaaauacucaucuucaaaacuuaucuuucugaaaauccaaguuuucguauguuuucagcagcauaacucacucugcuaaaacaaaaaucucaguauccauuacuuugaccuuuaaaagcaguguuuuccaaugauuauuuuuaggaggaaaagguuuucuaguaauauuuucuaguauauauuuaaauauuugcaucacuuaaauguuacauuuagauacauauuuauagaauaauauuacguucaguaaaggaccacauuuaguggucuccuuucauguuuggaaacugucgaaauuguaaauguuuaggcguuaauaaggucugagaucuuacccagcucaaaaguuagcugagaggguacagaaaagaguacaugacuaucagaguuacuuuuucucauuuuaauguugagagaguaugagcaauaauuucuuaguuccugggucgguuuuuuuggagauacaagauguuggcaaguguuuugagcaccugucaccauucaacaaauuccuaauuuuuuaaaaaccaacuuuaaugagcuauuuggacuucauugagauauaaaugacauauaacuaaauguuuaaaauaccacauuugaaaaguuuugacauguauuuguagccaugaauauaugugcacaauaaggcaaguuucgucguguuccaagucagcuccaaaagagcuuuuccagacuuucuagaauuuugucuuucuuccucacuuccauaucucucugguaucuuucugauucuugcaauuaaauguuuuuuuucuaguugucacacuaggaauguuagccugcucaugacuuacucuguuguauuuggacauggaagucucauuuguuuucuuuuugugcuaaacuaggguuucucaacauuggccauauugacauuuggggccagauaauucuucuuugggaauuguccuguaugcuuuaggauguuuagcuucuacccacuagaugcugguagcacuccuacaauucugacacccagaaaugucuucagaaauugccagacugaaauaaugucaucuacuugggaugucaaauauggaagaaugcuuccuaacuccuuccacccgccacacccuaugucuacauaauguauucauuuguauaauauagaaagcauuggcuuuggggaauauaaaaacugggguuuacauccggacuuauuaguuguauguccauaaacaaauuccuuaaacauuuaaguccuuauuuuucuuaucuauaaaauaagguguuuuaaagaugaauuaugaugaaguauacaaaggauuuagcacaguaccuaacaaauauuaaauauucaaugaaugauagcugccucuacuucuccuuuuguuguuuuuauuuuccauuuauguagucauuuauuuauuuuaaugucuucgaaaguauugacuuuaacaaguacuuugugaugcauuuauuauuucauuuguuauuauuuauguauuugauuuauuucuuugugagguaggauagaaucucagucagauuuuugcuguuaggauaccacagacuggauaacuacaaagaagggaagucuguuuaacucgcaauucuagaggcuggcgcaucuaagagcaugacacuggcaacuggcgaggaucaucucaugguggaagguggaagggaguacaugagauagagagaagcaccaggggcuggacucgcuuuguaacaaccaacccuugagauaacuaacccgcuccugcaauaaugacaauuaauccacucaugaggguuccacccucaugacugagucacauauaauuaggccccaccuccuaauauuauucacuggaguuuaagcuucuaacacgugaacuuuugggggauacauucaaaccauagcagaugaugagcaaaaguacauacgaucccuuaucuauugagcuuacagcuuagaggagaacauacauuucuuaaaauguuucuuaaauacuuagauaaauauuaaauugcaauugagauaacuuucacaaaugaaaaaaaggaaaauucuaacuauaacagguuucauuaaaaaaauaguuuguucuauaacaucauacaauugggaugcugacaacugagcugugaucugaaacauuaacaugagcuagguaaagaggaaaaggaaaaauccucuauuguagaggaaacagaaaauauuaauguaaauagaucauguggcagaaauagcguggcuagaauguaaagagcuagggagaugaugguggauagagagacuagguagguagagaugggaccauggaggauguuauuugccuuguuaaagaauuuuauuuuuuuucuuaagaguaguaggagcuauugaaacgauuuaaacacagugguugggggucauuuugugguuagauuuguauuucaaaagaucacucuaguugcaguguggagaguggcuuagaagaggguaagaguggauguuaggauauuaauugauugucuauaagaaguaaucuaggcaaguggugcuggcacuuuugauuuggacuagguuuguccuaaagauaacagaaaaaaguggauaaggcaaaauuaacaagccucagugacagaucaggagauaccaagauuucugacuugcauaaauccaugaauggugacugguuuccccagugaauacuaccagaaaagaagcaugggccaguggcucacacuucuaaucccagcacuuugggaggcugaggcggguggaucaucugaggucaggaguuugagaccagccuggccaacaugaugaagccucgucucuacuaaaaauacaaaaauuagcuggacaugguggcagacgccuguaaucccagcuagucgggaggcugaggcaggagaaucgcuugaaccugggaggcagaaguugcagugagcugagauugcaccguugcccuccagccugggcgacagagcaagacucugucucaaaaaaaaaaaaaaaaaaaaaaagaugaagcaugugugcaaaaagauuaugaauuugagauuucggcaaguugaguuugagacggcuuugggaccucaaaaaagagguaacauauagcaauugaauugauuugagcuaaaaauauaaaucuguggaccuuugcauagcagugaugcauugguucuuucagauguugcuaacucccagcaaccaucaagguaacuuaauucaaucuaaauauuuguugaucaucuucagaauaaguguuguaggugugggaaggauauuuuuauuauuauuuuauggcuucugaagagaauauaugcccauugugaaaaaauuugaacuguacauaaaaguauaaagaaaauuacaacccggacaugguggcucacaccuguaaucccagcacuuugggaggcugaggugggaggaucacuugagcccaggaguucaagaucagccugggcaacauagggaagcccugucucuacagaaaauaaaaaaauuagccaggcaugguggcacacaccuaugaucucagcuacuugggaggcugagguaggaucacuugagcccaggaaguugaggcugcagugagcuaagauggugccacugcacucgagccugggcaacagcaagaccuugucucaaaaaaacaaaaagaaaauuacaaaauuacacucauagucuucauuugaagaucuuuucuauauagauguuuauauauuugagcuuauucugcaugcacaauuuuauauuccuuuuuuuuuuuccacuucauauccaaagcaguuuuucauuaaguccucacaaauaaauauauggaaaacuguuuaggguauguuaagugggcagguggaggggaauagaauauaaaauugacugugcccaguaaagagauaaacaagaagucccaugcucuaaagcuaacaaauacaaggcaugcugaaucagaaaagaaaaauaguucuauuuugugggauuacuauaauuuauuuauuugagucauuuuucuacauauuguugcuaugaauaucacuguguaaguaaaucuuaucuauauuuuuauuacucucuuaggcuucuuuucuaggagaauuauuagauaaaggguaugagaaauauugcaucagagaauauucuucaugucaucugugugcuuagaaauucuuuuuuccaauccagcaaaucuugcaucuauugguuucagagcaugguauuucuuauauaugucuuaccaaguacauucaguugagugguuuuuugguuuaacuucugauaacaguuucagauuuuugaauuaaguauaagcuguauguaaugaaugguugcauaaaucuaacauuauuuuagcaccuagcccaaaaccuagggcagaauagaugcucaauaaguauaaauggaauuggaauugaauuucagauuuaagagccuauacagccuguauuuuaauucauggaaaguucuaugugcuguguaaugucuguagaaaagcuucugcaaacuaguaaugaaguaauagaguuauccucaauguauuuuauuuuuucuuuucagaucuuuuuggguuaguggucuuucuugguauugaaccuuacugugucaaacacugguggguucgacuucucuaucggccuuacugcaagaagaauccucagcaucucuacagcuuuauugccaagauacuguggaggucugcaaagaaagaugugauugaccaagucaguacaauaaguuuuuauugauaaagguacuauaagagaaaagaaacaauugggauggaaagauaaauuuuuagaugauaucuuuuuuuuuuuuucugcuccuuuucacagauccaaauaccaccacaaaccgaagaaauacacuggcuccacuuuucuccaguggaaaggcauuucuaucaccgucagcaugaggugugcugccaggauguggugguaaaacucaggaagauuucugacugggcucugaagcucagcagccuagacagaaggacugucaccucuauccuguauccauugcugaggcucagacaggccugcugucacccacaggcuguucguggagaguucuugccacuccaaaaaagguuuuauuaucaacuuuuuuuuaauugcaguugguauaucauaauagacaauauuucaggcccacgguuucauucagagacauguaacugaguugucaguuaucuuuaaugguguagaggguuuucuuugguauggaagcucauuugcaacggagaauuaccagaauuauuuucaugguuuuaagcauuucucuuuugcaguggguaugguguuuuuuuguuguuguuuguuuuuuuuuguuuugagacggggucucacucuuucccaggcuggagugcaguggugugaucauagcucacaguggcagccucaaauuccugggcucaagugauccuccugccucagccucucaaguagcuaagacuacaagugcacacugcuacagccagcuacuuuuuauuuuauuuuauuuuauuuuauuuuauuuuauuuauuuuuugagauggaguuucgcucuuguugcccaggcuggagugcaguggcacaaucucagcucacugcaaucucugccuccuggguuccagcaauucuccugccccaccccuccaaguaccugggauuacagacaugugccaccaagccuggcuaauuuuguauuuuuaguagagacgggguuucaucauguuggucaggcuggucuugaacuccagaccucagguaauccaccccucucagccucgugcugggauuacaggcgugagccaccacgcccggccuguuuuauguuuuuguagagacagggccucgcuauguugccugagcugauccugaacaccuggccccaagcaguccuccugucucacccucucaaacuguugggaugacaggcaugaaccaccacaccuggccuugaacacuucuuuuaaaauuaggauuauuguugagguuuuuuuuaaaauuauuuuguuauuuaggguuuuggcuguacuccagauaugaaaggcuuuugcucuuauuuuauuucauaguucccacaucagggaguuagauuaccguuaaauauuuucuaucucucugauuauucauucugagaacauuaagaaauuuguguucauaauacucuauugucccagaaaguuuuugugaaucagacugcaacucaggaacuggccuuuggcuauaagagauagaaagaggauucaguuuugucuuugcuuuuaagcagguuauagacaaauaagggaaaugaugaaaauuauagauuucuaaaauaugaagugaacauaguaaauuucaaaagauauaugaacaaauugcuguguacaguuagaguccgaaaacaauuuauauaugaaugguuaagguuagacagccuuuugaaggaauggcauuuaaccuuagaggaucuucauuuuuuacugauuaaaaaaauauucaggcucaaagagguuuucuaauuaaguugcagugcugggauucagagucagucuuacauguuaauaccuguaauguuucaaauaugucaugcuguacuuuguacuugaggaagauuuuucuaguuucauucucccuuuacugaaaugggaaaaacuuaaagaaggaugugaucaaauaaagguacuuaugugggaaaaaauaaugguaaaaauugaggcgaaaaaaaaugcuagagauaccacaaaaacugcgagucucauacacucuugaucaugugagauauaacacucccacugaagucacacuugggauuuucuuucuaguuuugaacagucuaccuuuucuuuuagcaccaugacaauggaagagcugcugacaucuuugcagaagaaauguggaacugaaugugaagaagcacaucgacagcuaguuugugcucucaauggcuuagcaggcauucauauuauuaaagguagaaggugauugcuuuaucucugauucuuucaaacacuuccugaggaagguuaauuauagaaaaaauagauuuugauuuuugggggggggauuuuucccccaaaaagauacucucacacacuacugaauauaguuuaaauagguucaacuuaauauagagcaguuucauagaacguuuugaaaaccuucaaaguuuacauaugauuuaaccaaacauuuccauuuuuaguucuuuuuuaaggaaaugaggauacacagauuucccuugaaguuguuaaucuuagacuuuaauaguuuaauaguaaacaacuguaaacagucaaaaugauuagaaauagaaaaaugguuaaauuuugacacauuaaaggaauuauuguucauugguuuaaaaauaauaguuugugggaucauuuuuucagcaaauauuugugugccacaucugaucuagguaacgaugauaugguaaauaaaguaacucugaucuugcagaccuuaaauucuuacagagggugacaaguacacacacacccucccacacacacacacagaacguauauguguaaaguuauaguguuauauauuaugcacaaaauuaaagcagguuagaaagagcaucuuauauuuacauggaagaguauuaguggcuucuccaucucucacggaucacuuuuuuugcauuaggucuaauaucuuacaaacugucauuuuguauauuuugccuguuauuguaguuuuugcagggaagaguaaauccauugucuguuacucuaucuuggcuggaagcaaaguuauauaacuggcacuuuuaauaagcaccauauagacacaccuuuccauauaaauaugagaaacauuaaaacuguauuccauagauucaagagugaagaugaaacauguuaaguagaaaccuugaaaacaugcaaucaaacuucuggaaaucaaaauuucaaugucuaauauagaaaauucacuuaauaaauagaagauuagacaccgccuaagaaaaaaaucaauaaagucaaaguauagaauagcaauagaaacucuccaacaugaaaaacgaagaagacugaaaauuuugaaaagagccucagugagguuguggacaacuucacauggccuaauauaaauguauuggaguccccaaaggaaaaaaaaaaaaaagaaauauauuguggguuuuauaucauguaaauguacaauguguaaaagcaaugauacaaagucuguguggggagacguggauguauaauauuguaagauuauuauccuauauaugaagagguauaauauuauaugaagguagacugugugugacaaggcaaagaaugugcacccuacagccaccacuucaacauacaacaaggaguuagagguaauaauccaaaagaauagauaaaaagaaaaaauaaaaaaucaggccaggcacgguggcuugugccuguaaucccaguacuuugggaagccgaggcaggcagaucacaagguuaggagauggagaccauccuggccaacauggugaaaccccgucucuacuagcugggugugguggcaugcgccuguagucccagcuacuugggaggcugagacaggagaaucacuugaaccccggaggcggagguugcagugagcugagauugcaccacugcaccccagacugggcuacagagcaggacuccaucucaaaaauaauaauaaguaaauaaauaaauaauaaauuaaaaaucuucaaaaaaaagaaaaaagggugcaaaaaacaaaugagaugauuagaaaacaaacagcaagaugguagauuuaaaaacaagcuuaucagugaucacguaaacugaaauggucuaaauaucccaauuaagaggccuggauugucagacuggauuaaaaacaaacaauaaccaucaauauguucucuauaagaaaccuacuuuauauuuaaagaugcaaauguaagaggaugaaaaaagauauguuaacacuaaucaaaagaacgauaaagccacuauauuucuaucaaguaaaacagauuucuuauuaauacugccugcuaacugauuguaccacuggaacuuauaaaguagauuucagagcaaagaauauuaccaaggauaaaggguguuacuuuaucacuagagaaaaaaauucuaaauauuaacguaccuaaaacaagaguuucaaaauaaauacuaaaaacugauagaauuauaacgagaaauaaacaagugcguaauuauugucagagauuucuacaucccucucucaguuauguauagaauaaguaaaaaauaagugagggcauacauaguucaaacaccgcugucaaccaguugaccuaaucaguguuuauugacuacccaaccaaagaggaauauacauuguuuucaaguacacauuaaauguauaugaagauagggcauauucugggcuguaaaacaaggcaguaaauuucaaaggauucaugcuuacagaguguguucuaugcccacagugguagauaccaauaacagaaggaaaacuggaaaguccgcaaaugcugugaauuaaauaacacacuucuaaaccuuuggguuaaaaaauaaaagggaaaguaggagauacuuugaagugaauaaaaaugaaauaucaaaauuugugggaugcagcaaaucaguuauuaaaaagaaauucauagcauuaaacauguacuagaaaagaaaaaaguuucauaucggagacuucagcugcuaccuuaagaaauuuaaaaaaaaagagcaaaugaaguacaaagaaaucaguugcccaaagaaaugugugcuuuuuguagaauauaaaucuucuuacauuaagccucuuugaguagcccgucuguaguuguuagcucuuuagcauaauagaaccagaaauggaaagugucucuuauugugcuagauacuuggguagaguuauaaggauucucagaagcugagcagaaauagcucuagacaagaacugaauagggugggccuacuuacaugcugcaguuggaacccugugaaaugguauauauuguucaagauuuccgaacuucagugucuuugucaauaaaauauuacaggugcuuuacuuaccucaacuauuguucuuaauacaaaauguagaagcacauugaaaacguuauaaaaacagagaugaagaaugauguuauugguuaugguaauaugaagguuaccucagauucuuaccacuuucaaccugcucacaauguaaauucuguuaucaauaucuaauagaaaagggccuauuauuauauauucguguuaaauuguucacauauaguacacguaacuuugugugcaaaucuucccucuagggcauucccuagaaaguccucaauuuagcuagcaguguauuguugauuauuaagagaaauccgccaccagaaaguccauuaauagaggauauguuccuucugaauuguaauuuucaacuuaauuguaauagauuugcugcuuuuaguuuuuauuaacuucauaguaauguguuaaacaauauucauuuuuuaaaguaacauuacauauauaacuuacauaaauuagauucuucuaaugugaagaucagacagugaaggucugacuuuuaaaagaaaucuaaaauuaauuucaaacucuaaaaagauuugcuuauauuauauguaaauaaauacguaugauacauuaauacauauucugagauucuccuugacugguauuaaacacauuuuauuauuccaauuuugaacauuguguuuucugcagaugauuuucggagaaaauuagcuugacaauaucaaauccaccaguuuucuuagaaauguuagcgccaucaaguggcugagaauggguauuuccaaauuugacuuaaaccuuuauaacauugaauauggguuuuuuuuuaaucuuccucagaaagcaugucuuuuuaaaaauaaacaugcaaaaccagguauuauaacgaauagauaaaauucagcugcuuuacauuauaguuuaaucacuauaccuucuuuaaaagguaugguaauuaugaagagaaaauuguuaauugaauuauucucuacaaaugguaguauaaauacugauagaauucauaauguccuuugaaaagcuuuaaucaagacucuuaacuaaaaaaagagaacucacugugaagauaauugaauguuaaugccuacguuauaaaguaacuuuauuauugugaaaauaaucuucucccuuauuuaaagggaauagaaauuggcugacuacaguucuuugauaauguguguuuuagaaagcuuuguauuagcuaacuaauagaacuagauauaaagcaaugguauaagagcuauuguugcaaaauuuauuuuaaauuagguguuuugcacaacacugaauauacauaaugccacugaacuacacacuuaaaaagggcugagaugguaaauuuuauguauauuuuaccaaaaucaagauauguauguaaacuuauauaugagcuaaaaacagaaccaacuucaaaauuuacaaagguuugcauauauauauauaucucauuguaacuaugaacaugguccuaauuacaugauauucauaaaaccagcuugaaguuuuuuuuuaaaagaaaguaugugugauacuuaggaaaaaaacuuucucagcaaauaaaagcuagaacaucuuguaccuuuuuuugguauggauugcaugguuuugccaguguuagguuuuuacuuuaauaguauuuauaauuuaccugucuugaauuuuacaagcagcaguuaagauagauucuauuauucaagccauuaaaaauguucaucucuuacuuuauugagauaucaucaaacuuucuguguaaagaagcagauaauacauaggcauugcaagccauaagaucucugcgcaacuaucagcuuggcuguuguaguacaacagcagccacaggcaguauaaaaacaaaugagcagagcuagguucuaauaaaacuauggacccugaaauuuaauuuucacaugucacgaaauauuuuuuuugaauuuuuuucaacuauuuaagaauguaaaauucauucuaagcugaugugcccaacagauaggcagaggguagaaaugacccaugggccauacuuugccagacugugcuuuaaucgauacuuuuugaauugcuuuauuugaaugaggugcugauuaugaacaguagaaaacagcauacaucucagaccaugauuugugugaccagaagaagagggagaucccugaguuucugacaugaaguuuuuaauugcaaauuauuuggccuaauaccaagaacaauaauagcuaccaagaauacuauauuuuucugaucgcuauguguggguugguuggagugucuuaaauuuuuuuuuuaauaaauaaucuauaauuaccuuaaguuuauccuuaauuucaaacaucauaaugacuacugauugccaccuuuuaacuucagcaagaggaaauuuuuuugucuaaauuaaaaguuuauccaauagcauaaucucaaaacauuacaaacguuugauuauaaacauauuucaguauaauuuuaaaauauuauaaauguaauauaagaacauuauauuccauggaauuaaaaaaggaacuguacucagccuuuuuuaaaacuugggcaaucauauuaauaccaagucaaauuucuuuacuuaaaaaaaguuauaaucauuacauuuuauuuuuacaguauucuuaaauaauggacaacuagaugacauugggaacuaaauaugugacucucguaugcuuuaaauacauuuuaauucuuuaggugaguaugccuuggcagcagaauuguacagagaaguguugcgcuccucggaggaacacaaaggaaaacucaaaacugauucacuucaaguaaguaaagacuaaacaguuucauagguauucuguuuguuuuuuuaacaaaauaauuuuucugaauguuuaagaggauaaaugguaacaaacagucauaaucacugggugaaacuugggauucagucuucucaauaagcauuuuagaugauuuguauguacacuaacauuugagaaucacuacuauuccauucagggaaguuuugggcacaagccugacaagguaagucuauauaagcuacaguuaaaaauagcucaaaguacuuguacuuccaagaguaggucaguuuuaucacuuugacauaugaauaucaacauauuuauucacaugguuuucauuaaaaagaaaaggaacuaagcaauaaaaucuaucuaaugauaauuuuuagaggucuuuagggagauuuggauauuuuaauuauaacacuuauuucucuuucccuucuuggaucugucauugacucauauagacaaggcucucuagcuaaauaagaaguagaaauggguuuauuaauuuuggcaaguuuagguuugagucccagguaagaugucauuaccauucacaauauugaccuugggacugacuaacauguucacaaguaccagaguggauauuuagaggaacauauggaaaaguggagggagaggaaaaauuaaauauaaaucugauauucugcauggauaaggguuacaaaaggcagguccuagaccuuaacacccugcccuugaguaaagaaaacaaaguaguaguacucagauuuuuuuauaggaaaaguauuuggugauaugaucuuaaugugguguuaguguucugugugccauauuaauauuagguucucuucagagucuucugcauugacugucauaauuacugccuuugauauguuuguagagacuucaugcuacccauaacuugauggaauuguugauagccaggcacccagggauaccaccuaccuugcgugauggccgacuugaggaagagguaauuauuuuuuucauucugucuauaaaaguauauuuucuucaaacuuuaugcuccauauaguugauauauccuaggacauacaacauacaaauaaauguaaucauguuuuccuguuacuuugauguuucgaauuuuguugugauuuuggguagcagagaauggcagcaguacguauuauuuggcuucucugcugaucuaccugcaguuaugugauaaaugcuuguuguagauauggcuguugguagccaacagaaugggauguaaauaaaugaguuuuaaaaaagaaacuuugaucucauggcagaucuacaaaagagguagcuuaguaaauauacaaacuuuugcacuuucuccacauuucuguguauuuuuuaaggggguaaauaaagucaaauuuuuggugguaguucucccaaagaaguuuccucuacaaaaagugucgccucuuuuugaaaagaaugacaucgaaaagagugauauuauaaauuauuuuacuauaaauuguuaauagcuuauuaugcagauucuuccagggauuuuugcuguuguuaaacauuaaagagcuaaaaucaaaagaguagguauguuugaaauguauugaaccuguaaguggaggcuuuauuugagucaacaggauaaaaaaugagauuauauaaauaagcacagccuuuuugcacugguuguuuugggggcggaggugcccugguaaacuauuuuaauuaacaaaaauuuuaucuauucaugaguagagacugauguuuugauguauguagacacuagaauagcuaaaucaaacuaaaucaauuaccucuuuauuuuuauugcaugcauguguguguguguguguguguguguguguagugagaacauuuaaaaucuacuuucuuagggcuucagcauaugaauuuuggggaaacaaaauucaguuccuaacaccuguguuacuguguauucucaaggauuauuuuuaaacugcaguaacuaaggaauuuuaauaacuaaauuagccaaauuuuagaaaggugucuuugcuuugccuaucauuugaaauauuacuguucuuuuuuuccccucuuugcuuauucuaacuaaaaaaaaaaauuaaauaagaaauuggcaaacaaauauucgguguuucugaaauuuuguuacuuggacaaguaaauuuuguuaacuuccauauauaaggaauuuuuagcgugacuuuuauguucucuacaguauacuuggacuuuuauguuuaaaugcaguuaaguagcuuuaaauguauaaaaugacccauucuucuugaaacaucauacugaauuauauucuagauugggagugaaaguuuauauucucuguuucaacacaggccaaacagcugcgagagcacuacaugagcaaguguaauacagaaguugcugaagcccagcaagcuuuauauccugugcagcagaccauccaugagcuucaaagaaagguaugccaaaaugcaguguuucuuacuuguauuugccuccagauaucauuuugaguuuugguuuuuugguggggagaaacuugaauuucuuauacauuuugaaauccuuagcaccuagcacauugccugacccacaauacaaguuuauuuuacuguuagcaaugauuuauugguugagugaacagaugcauaaauaagucaacuauuuugaguucucuuucuuuugaacucauggguuuucucuuaccaugaguauauaacaguugucuuuugaagaaaguaaagacuucuauaaccuccuuuuuaucuuguuucugagauguuuuaaaauguuaauacauuagaaccacagguauuuuuccugcagaauauauaccacuugucauuucuaaaauuucaguuuuaugaaaucagcagcaaaaucuaaagagguuacacaaauacacuuuuauuuucaguuuuuaaaucagguguugcaaauuuuugucuuucuaauucauucauuauuuaguauucugggauauaauuuugugaguuauuguggauuauucauuaaguagaaucugguucaguuaguuaaagauuagaaugaaggcuuucuuucuuaugcugauaaagagaccugugaccuuuucacacauauagauugaguauugaauuuucauuuggcguaaacaguuuuuuuaguuacagcuuuguuauauaaaugcauucaauaaauucccauuuauccagaguaguuaggaaauagggguuucucuuuaauuauauuuucaaaagaggaagcgagcauuguacauggaauauguauacucgucuccccucugugauagucccuuugagaauagcauuuauuacuuucuuugaauuuuggcaucacccugcccagugauggaagcuuagugaguacuaaaaaaaauguauuaauugauuaacugcuaccuuuuuuacagauucauucuaauucuccuugguggcuaaaugugauccacagagcaauagaauuuacuauugaugaggagcuaguucagcgagugcgaaaugaaauaaccagcaacuacaagcaacaaacuggcaagcuuucuaugucagagaaguaagaaaacaggaagaaaaaguaucuacucauaauuuuaaaagcaaagaaauccuuguauuuucuaguuucuaauuucucauuauuaccggcuuuuuuucuccauucauaaaccuauacagacacauucauacuucuuuuuugcagccuuuuuuauucacaguuuaucaaaaugguuauagguacuauaauuggguuuaacuccuaacugcgaccuaccuuuguuacuuuaguuacuuuaauauuuuacacuucauaaugugagcacauuaguaacuauugaaauuauacaggaaaagugcuuggcaaagugccucguauauagugcauaauuacagauuuaauuaaguauauauacauauauauauauauucaaccaaggaauauaacucuuagccauuuuucuucuuucuucccaauauucugcuuuuauguuucauccugcaggcaccuccucauauagagcaaggaugucaggaaggcuaucuguagucaggcuuaaaacggaagaauguggcagucguacacuuucaaagauaucugagacagacauacauuuuucaugcucuuuuucaguuccugagcacaggacuaucaaauuuuuuugguaucuuuuacgguagacagcccaauauuauacuuugaauacauucugaaggaaaacucacucaaauguugcuguuaaaaaaaaaaaaaacagcaaacaguuucuuuaacacuuuguuuggcaaccauucucugaauuugaggaaauugaccuauuauucuuuucuuuguauuguguguggugcuggugugggaaucagguuccgugauugcagaggucuucaguucuuacuuacaacacaaauggaagagcuaaauaaaugccagaagcuaguaagagaggcuguaaaaaaccuggagggaccuccaucucguaauguuauugagucugcaacagucugucaccuccgaccagccagacuuccucucaacugguagguaauagaagaaaucauacaaugaaaugguaccauuucuuuaagcuagauuucuuagagaagaaacaauugacucauauaguaaagguuuuuucauuuuaauugagacagaaguagaaagagauguauuaaucuaauuuaaagaaaaauaaagucucaaggacaagguaugaaaaaccaugugauuuguuuuuucuaaaauggcauaucuaguggaaagaaaaaugaagucaaaauauuaagcuucuccuuaaaauuaccagauugcugguuauguuugugaauauuucuguuaaucucuuuuuuuucagcugugucuuuuguaaagcugaugaauuguucacagaguaugaaucaaagcuauuuuccaacacguaaguucucuauuugauuauuacccaucaagaaaaugaaacauuuugcaagacucaguuaugugauauaagacuauguuuucccccacaguaaccuuuauuauauuguuucuuuaauuaaauugauuaguacaccuuugguauuugauuguuuaauaugcccaguuuuaccuauccagaaguuauccccuaaauguucauaguguaguaauauauaauuaauugagaugcaguuuuguggagugguaaaaucccagacucuagaauccaguggauuugaauuauacagauuuugcuagcauuuuacugcuauucaagguagaacucauaauguccggcauaacuucuucaagaauaaagaaugacacaaucaaauauguuauuacuuuaaugaaaccauaaguaaacauugucacaaacaccuggauucucagagggaagcuuguuagaacaauaaauguguccacuuucauccagguguauuacuauucuauuuuaggucaaaucuuuuucuguuauuacugaaguaaauaauacauuucuucauguuucuguccaaauucuguuuauuuaucuccaacagauauaacuucucuaaaauagaaauuuuccucacauauuuccuugccaaacguucacuucugcaugucaaggaagaaaacaagauuuuuguguuguuauggcaaaugaaucaguagcuuucuguuuauuacaguggauauaauagaauuuaaaaaaaaaaaaacuggccaaauuuaugauguuuucagcuuuuucaagguugcuuugguuuuuccaaagacuugcaaacauguucuuuuagaacucacauugaagguugcuuuucacucacugauaccaguuacuguuguuuuguucugguauguuuucagagucaaaggccagacugcaauauuugaggagaugauagaagaugaagaaggacugguggaugaucgagcaccuaccaccacccggggucucugggcaauaagugagacagagcgaucuaugaaagcaauacuaucauuugcaaaaucacauagguuugauguugaauuuguugaugaaggaagcacuucaauggaucucuuugaagcauggaagaaggaauauaagguauaguauuuuaaaacuuccuuccaaaauuaaaaauucuucuuuuuuacaucaauuuuaacugcuacuuuuuucucucuccaguuuuuuaaaaucuucuuuugagauugagguggcauaauuucucuuugccugaaauguaacuguuguaauaaaggauagcaaauaccauaauacucaaagacauucuauuuauuaaauuacuaaaagaaaaucauuauuaaacuggaacuuauaugaaacuuuuuguuuagccgugaaaguguguucauucuauuauuagcuugaucuuccacugcuauuauaugaaauuagaguuuuguuuuuguucugugaauaacaagcaagcaucagcuaccuuaaagauuggggaacauaguaaauacuucuuauccuauaaguuuggaaaccauuccaauaaauaaagcccgauaugcccuuucauauuuguacuuuaaugauuccaucauauuauaccucuguacuugagauuucacaauucauuaauuuucaauuauuguuuuauuuggauuaguuauccauuguacugcuuuacaggugacauagguagaggaaggaaagaaguguuuuuuuauaaugacauuuuuauucaauuucuuuuuuaaaaagucuugcuuuuuaaaguaggauaaaaauuuuuaugcagagagauaguuauuuguacuaucaguucauaugucauaaauuggggaauacauuuauaacaucaaaaucauugguuuauaauaauguuuuucucacacauuacucaugugaauacaaagcacguuaacacaguuaauuacaguaagccuuggaagaaguguuacuuaugauguucaguugccccuguauucuuccuuucgacucaguuuggccacauacccuuuguccagaagagagcuuacugugcaguucucccaggucuugguacauauuuucugcauaacuuugcagaccuuuucacagaagagcaauugaaugagcuccugcuguacauaucuaccagaucuaccucaaaauguaaagucagugaagagagccugucaaaaaauguauacugauugauaccauuucugugaauuucagaaacauauauaacugaauuauuaagaauauguuucacauaguauaaguucaaugaaaaguguagcaggauaaguacaauucagaauagugguugccccaugguuggguacugaaggaggaauaugugaggaaagagugauacaguugagaaagaacacacagagccuuuccaaggaauucauauuauucuuucuucaauuaaaugaugaguacuugauuguauauuuuaguauucuuguugccauuuauacauaguugaauaugugaaauauguuauaauaaaacuauuuuuaaaaaauaaaacaagagauucugucagccuaaaacuggacuuuauaaagauuuuuggucuuagcaagaaaucuuuauauucuguuacugagaaucuaaagaggcaguguccuauagagauuuuuuucauucacauuucauccuaaaaaugaccccaggaacuacuuguacguuagacacauagcgaaaaaguguaagaucucauugaagacuuuugcuuaaggcacaucuuggugguuuuaaccaguuuuaauuacaugcuuuaccacuguguuugucuuuucuauuccuucaguugcuucaugaauauuggauggcucugaggaaucgugugucugcuguugaugaacuugcaauggcuacagaacgacuaagagugcgugauccuagggagccaaagccuaauccgccuguucuucauaucauugaaccacaugagguaauuggcaaguaaaucacagaaaagggaacagcaagcagaugucacagauaucuaagacccauagaaaaggcagaaucagggcacugagcucuacuguaaguguguauuuaaucuccauuuuuaauuugacccauagaaaauugucuuuauagaccaaaaauggucaaagaugagcaauuucauaucuauuacaugcuuaguguucacuauuuuggggcaucuuguuucucuccagguugcgcauucaucuguuuuugaguuuaaaaccuuguaugugcuuaagaccaauagauauucucagucacuuuuuagacauuuuugucaccucaguuuuaucagaacuagaaaaaucuuccuuaaaaacaacugaaaccuuuucuuuugcaguguuucuuuugcuaaugaugaacuaauauuaacaacuuaccuucuaauaacuuugucuuuguaacucagguuuaaaagcauuacuccaccaaucucuuuuauucuccauuaaaagauauuauuuccuuuauaauucauuuuuauuccuuauuuguuuagugccuuaagucuguuucuguacagcuuggagacuguaacuuggaaaaauguagauauauucauuauauacuaucucacuuaaaugugaauucugaagaaguuuuucugagaaaauaaauucgucuuguuugaguguuccuucucugucugcuguauucuaccagggggacagaggaaagaagggcagagaaauucuuuccuggauuucaugaaaucacugaggccagagcaacagaucauuuaacuuuucuuuaucccguguauguauuacugaaaaaaaugguacauaauagaauuugaguuuauuuuuaucugacuucagguacauagggacacuuccuguuuaaaagaacucugcauugaauugugccuuucauaaagcaaaaaaaaaaaaaaaucauuugaaauauauuaucuaguauccauuuugaaaacuuguguuuuagaauguaaauagguuuuuuuuaaaaacaauacauuuguauuacuggagaauuguccauauuuaauauaauuuaacugucuuucugaaagaauaaagaaguuuuuauuuuuauuuucuuuagguagaacaaaaccgaauaaaacuacuaaaugauaaagcuguugcuacaucacagcuucagaaaaaacuugggcagcuucuuuaccuaacuaauuuggagaagguauuguuucuaagacaugcuacuuuuuccuaugcugcauuaucauaaaccacuuuagugacuccuuucauaauuaauggugcaaauuguuguaauuaguauuugguguuauaugagucagaacacuaccuaugucucuacaauagcuucagagaucacaaaagaauauuguaucuauagaaauuuauuaugcagaugauauagaaggcaugcacucgauaguagagaacaauguaaauggacuguaguucaaagccuugaauaguaaaaguauuaaaacauaucucggugaaacuggcauaaugcaauuuauacacaugcauucauucaucaauacaaaaauauguuguaauuuguuauuugaaacugaaguguguuucgaaagcuacuaaaucagaguacaugguaauaaagguagacuucaaauauuaaguaauucaaaacacauguucugaguuaugaucugaguauuauacuggacacugaugaauuggugggucauugauuaaauauaauuucauuuuauugcaggaaucauauuuugcuaguuggcagagaaccuucuaggggcaagauauaguaguaaauauuuggauagggcaagugaggacaagauauagauuugaauucuucuggaaacugguauaacauauacuuaagugaaucaguaaaucucagacaaaaugaaaaguuagacauucauuauagauauagcauggcgacuaagaagguagacuuuggaacuggacagcccaauuuugaaucgugacucaacuguuuucuagauaugugacuuuauuuaaguuauucaccuuuccucgcaucaucaguaaaaugagaaugaugucaacacuacuuuauaguauagggcugucuugaggauugugugaauuaauacauguaaaaugcuagaguaguuucugaucuauuaagcacuuucuagguuuuugcugcuauuaauauuauuaagaucauuauuacuguuaugauuaccaacacuuauucugaaagauaaaaagaagaaaaaaauuaaaaaguuucaugcaaauugcuaacauuaagaagauaacacaggcugggcaugguggcucacgccuguaaucccagcacuuugagaggccgaggaguuugagaccagccuggccaacauggugaaacccugucucuacuaaagauacaaaaaauuagcuggaaugguagcacacgccuguaauccaguucccaggaggcugaggcaggagaaucgcuugaaccugggagacagagguugcagugagcugagauugcgccauugcacuccagccuaggcgacagagcgagauuccaucucaaaaaaaaaagauaacaggaaaaaugucucaacauuccugaacauaaguuuuuuaaauguaagauuucuauacuuuaaauaugauagucaaaauaaaaagacaguuaucuuguacgucauuguuuauauguuaaaauauuuuuuaaaaccuaaaauuuuaaggauauaaauauucuaccuaagaaaauccaauuuggcuguuaauaaaagaaaaagcauuuaaucuauaaugauggaaaaucaaauuacacaggugcuauuuucugccaacaauuaggcacagauuuuuuaaaugauuacacaccccaguggugaaaaaggacagggaauggauacauuuuaugcauuaccaauggaaauauaaauuuauauaagcuuuucuuaaaagcacuuuaacaauaucugucaacaauuuuauguagguugaacaucucaaauccaaaacuggaaaugcuccagugagcauuuccugugagcauugcaucagcacucaaaaaguuuaugauuuuagagcguuuuagauuacagauuuuuggauuuggaaugcucaaccuguaugugaaagaaaggaaaaggaaaacuggacaacauaagaugaacuggaaucuauacaguaggauuaaaugaacauuauagaacugcagaaauacaguaucugaaaucaaaaacucauuggagaccagacacagaaaaagaugggauucaugaacucaaguacaguacaaaugaaaauacccaauuugaaguggcauagauagaaaaagaacaaaauagggcaaaagagauuugagacacaguuguuugaucuagcauacuuguaauuucauagaucuagcauacuuguaauugaaguucaagaagaaaagagaauaggacagaagcuugaagagauaauagcugagaauuuucuaaaacucauaaaauuaugacaaauaucuuaaagauucaagaaguucagaaacacuaagcagaauaaguaaagaaaaaaacaaaauacugccuagauacaucauagucaaacugcuggaaaccaaaaauaaugaaaaauagaaauaaaaaaaguugagagauaaaacauuuaauacuuacaaaggaacacuaauaaaacugguggcuacauagagauguuuuucuuuucaccuuuaaagauguuucgguauuuuccauaguuucucuauguaaccaguugacauuggaacaucuucaaaaugcuaaaagaaaaaaacagccaaccuagaguucuauacuuaaagaaaauuuccuuuuuuuaaaaaaagugaaauaaggauauuuucagacaaacauaaacuggaagaauucaucuccaguaaacacacaucacaauaaauauuaaaggaacuucuuuggauggaaggaaaauuauuucagauugaaggaugcaacuacaguaaggaaugaagaacaaaagcuuaaauauguagauaaauaugcaaggauauugacuauuuaaaagcaacaaugcugucuuauggguuauacaacuuauauagaacuaaaauauaugucaguagcacaaaggaaagagguaagcagaggauuauuaagauuuaauuuaauuuauuuaaauuuauuaaaauuuauuuuauuauaauuguauuauaauauuuauauuuauaauuauauauuuauaauucugccaaaauauauuuauaauuauauuuuauuauaaauuuauuuauaaguuuauuaaaauuuauaaaauuuauuaaaauaauguaauuauuuuaagauaauuuaaucuauuuuaagauuccuucagaggaauggacaagaaaguccguaaggauauugaacauuugaacacuaaugaacaaauaugacccaacugacacagaccauuacacccaacagcuucagaauacauauuuuuuagguguacguggaacauuuaucaaaauagaccuuaugcuaauucaaaaagccgcucuuaaaaguaugugagaguauguuuucugacugaagaggaauuuaaaccagaaaucaguaauggaaagauaacuggauaaaucccuaaaaguuuaauagaaauugacaggauacuucugaauaacccaugggucaaagaagaagucaaaauggaaauuagaaaauacucugaacugagugaaaguaaaaauaugugacagugcuuagaggaaaauuuauaacuucuuuaacuuaaggaucugcaaauuaccaugcaugggaaaaauucagcccgcugccuuuuuucguaaguaaaguuuuauuggaauauggucacacucauucauuuacguauugucuguggcugcauucaugccacauuaguggaauugaguuguuacaacacagaucauauggcccacaaggccuaaaauauuuauaaucucaccauuuauauaaaugucaacucuuuauugacauauuggaaaagaagagcuguugugaauuaugauagauuguuuacaaagugcuacagcaaugacccucccauucuuguugcucuuuggaacuccaugagacuaucucaaaaagccuaguuuacuuucuugagcagcagagcccucagcucagcccagcccucccugcagaccagauagccuaccaacugccaaacaugagcaugaggccaucauagaccauccaaccccagccaacucagcccauccccaaaucaccuguagaaucuugggaaucauauguuuguuuuaagccacuaaauuuguaggugauuuauuauauguaaaaaggaaaaguggacaacauaguaaaaugaauuggaaucuauaugguaagaucaaauggacauuauagaacugcaaauauauacauacauuauugauuuacuuauaaaaaucaauaauuaacagaggaaaagaauaauucauugguucaauuuguuuaaaugccuaaucugaaaaucuguuaccugaaaugcuccagugaacauuuaccuugauugucaugucagcacucaaaaaguuuggauuuuggagcauuucagauuucagauuuuggauuagggauauucaaccugugugauuaaaauuguuuucauuuuuuuguucacuccuugaauaaaugauauuuguaaggaagucucaggaauaaucuuguuagguaauauagagaucgaugggucaucuaaauuguuagauuauguaaauuguaauugccaguauucacuuccauaaaugaguugcaaaacauauaucagguuuuauauguaaaaacguaacuaauauauuuuuuaauucuuuuuuggauagucucaagauaaaacaucgggagguguuaauccagaaccuugcccaaucugugcucgacagcuaggaaaacagguaaaauuaugauaaacaucacaugcauuuauaaaauaccuuacaguuuucaaagguuucuacauaaaaucuuucucucguuuuucucaccacuaguuucuaugaaaggcaaguauuaccauuaucuuaaagauagcacuagagguuaggugacgugcuuaggauuagauguuugagcaaugcuuuucuuaaaugggaagugaaaaaauauuucuagaaugacgccaucuuuuucauuaaagaugcacaguuuugaacauuguuuccagucacaagguuguguccaguaauuugacuucgucagguuaacauaguuauucaauaauuauacagaaauguaauauaacacacauagauuuacuuaagguauuacauuaguauagaaucguaguucuuacuugccaguauuaaugucucauaauacuuguucuucagaguacaaauuaaucucuccuagggaaauuuagaugugauuuugguagaccacuauauuaaauauauuccuuuguggauauuaguauacauaaugucuauaaacaugguagaaccauauucuccucuaggagaacugcaauuuaugaaaauacaaguuucugcuuucuaugauaaaucuauauauauauauaucagacuauucauugcucuugaaaauuugaaagauaagccuauuacuguugaagaaguagaaauagucuuggcuguuuuuuucuauggaacugagaguugaaagguaaauauaugcauuccauauucugaccaguaauaaucaagaagaaaguaccuuuugguuucuaagauugguggagaaggugagaucacaagaauacuuuauuugcuaauacaucuuaaagggagagauacuacauuggaaacugagcaaaauaguacuguacaaaugcugguuacuucugacaaaagucagugaugaaacugauaaaaguugugauaaaaauggaagaaaucaugacauaaaguaguauuuuuugcuuuuaguuuugauaagauuuauacaacuggacugucucagauauuucauuuugucuuaaacauuuucaguuuuuaaaguucuuucauauacauuaguucauuuaauucuagcauaaccuagguuuccugcacuuggaagaccauauuggauuucaauaauaguaauaaaaauacuuuucaagcucuguucauacuuacaauauauaguagccguauuuuuuuuuccuuuuuggauccccaguucuccccccuucuaauuuagggcuauuaaauuagaaucuaucagaguuaacccauauguaccagcugaugcaccuggaggcauugccauuugucucuucuguuugggucagucagcuuccugucacuccuaauggucaggugccagguaucucguugcuucuucuccauugcacauguagguggaccugucuugauguuuaguugguccauuuugagcucuagugagucacaaaacuccuuuccaguagaguaccccaguggcacuagagguacauaaaguacaauauagugcugcucugugucauacaaaaaugcuaguaaaacagcucuucaauuucauuagucucaacuccuguggacucuggcagaggugcagcuagagaacaguaggaauaguauuagcuguuaauaggcaaaauagugguuugaaaaccaagcuuauauaccucaguuuucucuucuuucaaugugaguucuuuuccaaagagcaucuuagaugauccagcaaagaaucucaagugggccagguacgcacuuucuuuccauacauguccaaaucuuaaaaaaaacauagcuuaaggauuuagaagcuuugucacucaaaagacacucaguuuuucuuauuguuuuuaccagaugaaaacgguuaaaacuacauuuguaagaugccauagcuuuuagaacuuacaccuagacuaaaucuauuguucuuacgucucucguugccaaagagggcaaaagucuccaugguauguugcagagauucagagaggauuauuuuauuuuucccgaauaggacaagggguuucuuaaacauuucuuuuuggcugggcgcgguggcucacaccuguaaucccaggccgaaguggauggaucaugaggucaggaguucgagaccagucuggucaguguggugaaaccccucucuacuaaaaauacaaaaauuagcuggucguggcagcaggugcuuguaaucccagcuacucaagaggcugaggcaggaaaauugcuugaauccuggagguggagguugcaagguugcagugagccaagaccgcaucauuugcacuccagucugggcgacagagcaagaaugucuaaaaaauaauaguaauaauaauaauuucuuuuuguuuguaauuuuuuaaauaaccagaaccauuuucaaaauaaauuugagauacuaucccauauuauuuucuauauaagugcuuuaaugugugaaaauauaaaucuguuuuuuaaauuaaauggaacauaucgaguaugauauuaucuccaaauuaauauucuaagucccucuguuauaucuguuguuagagugcugaaggacuaauuuacauucuucccaaauacagaaaugagaacaccaccuuucuacaaaguaguggugacugacuaucauacucacuuuuaggauaaacagaacuaaagauuaugaaaacuuacuuuggaauaaaaaauuaauuugaaggcacaacuuggcuuuaugacaaagaauauuaauguuaugaaaucuuuaggaggaaaaauugcgaaucucuuuuuaauaugcuuauaaauuguaaggcaucuuugauagcacuaaggcuuguucuguuuucuuuuuagugggcgguacugaccuguggucacuguuucuguaaugaaugcauuucuauaauuauugaacaauacagcgugggaucucacagaagcuccauuaagugugcaaucugccgccagaccacaucucacaaagaaaucucguaugucuuuaccucagagaaagcaaaccaggaggaggacaucccugugaagguaaaguaggucaggaacacauagaagcauagguaaggcaauauaauauaggaagcaguaucugauuaagaaagcaugaacaucagaacaagcuugacagugaauagguagacgccacuguugucuguagauacacugccugaaagccucagcuuaaccauguaauuuuuaauuguaggaggaacacagaacacuuauucaaacaugguuagcgauagucauguacacugugacuaaaauguaacaucuuaaaauuacaguuuccuauccucuauaauauuucuauccaccacaaguagacagaggucugguuacauuagagauuuauuuaaagaaagaguuuuccucauucuuuuacacaucccugaauguaaggaaaaaaggaugugucuaacuaaacagaaggauaaaauaaauuggcuaaugaagacagcuacaagaaagaggguaaugugcuuuuuaaacagcauagauugauauuccaggauaaagccaaauuuuggcuuuauuuuccuaauuuuuuuccaugcuucauucagaauuuuaagaaaauuacuauaaugugauauccagacuggaucuguaauuggauuuacugcuuuuaagggguauuuaauaaaaagccaagacuauuuugcucuuucuuuuccuuaaauaugcuuuuuuaauauuuuuuuucuaaccaaacuugaacaaaggacacaucgguaucuaaauuuaguagcaaaugugggcuuuaaggaauagagaaugagaauuagagaaugaugggguugacucuuaagcaagaugaaguauucuuuauuaauuccuucugaguuuuugauacuccucacuuuuaaguaauguguuuuuuaaguagaaucagcuacaaguugaaauucacuaccaguaguuaagcaguuauuaggguacccuucucccaagaaaacuguagcugcauuaaagaacuuuuaauugcucuuuuuucacuguuauuugaguaaaaccugaaaauaucaguuauauugcucuuuagucuguugggauaaacagaauuccacaguuagaauaagcauucauccauucauuccacacauauauauuggacacguacuagcacacaggcagugugcuaggccucauagacacagcauacacauaaauaaaacagauaugguuacuacuuuuguggagauuggugaaggaguuugaguuggggcaggaagcacagauguuaauaaauaauguguuauaauugugauaagcacuacaaaagaacaaagcuggaggcaucaugcuaccugauuucaaacuauacuacaaggcuacaguaaccaaaacagaaugguaccaaaacagacauauaggcgaauggagcagaacagagaccucagaaauaauaccacacaucuacaacugaucuuugacagacccgacaaaaacaaacaauggggaaaggauccuauuggguaaauggggcuggaaaaacuggcuagccauaugcagaaaacugaaaccggaccccuuccuuacaccuuacacaaaaauuaacucaagauagauuaaagacuuaaauguaaaacccaaaacccuaaaaauccgagaagaaaaccuaggcaguaccauucaggacguaggcauggacaaagacuucaugacaaaaaugccaaaagcaauugcaacaaaagccaaaauugacaaagggaaucuaauuaaagagcuucugcagagcaaaagaaauuaucgucgguaaacaggcauccuacagaacgggagaaaauuuuugcaaucaacccaucugacagaggucuaauauccagaauuuacaaggaaugugaacauauuuauaagaaaaaaacaaccccaucaaaaauuggacaaaggacaugaacagacacuucucaaaagaagauauuuacguggccaacaaacaugaaaaaaaguucaucacugaucaucggagaaaugcaaaucagaaccacaaugagauaccaucucacaccagucagaauggcgauuauuaaaaagucaacaaacaauagaugcuggcaaggcugugaagaaauaggaacguuuuuacacuguugguaggaauauaaauuagugcaaccauuguggaagacaguauggcgauuccucaaggaucuagaaacagaaaucccauaggacccagcaaucccauuacugcauauauacccaaaggaauauaaaucauucugcuauaaagacauauacacacaaauguuuacugcagcacuauuuacaauaacaaauauauggaaccaauccaaaugcccaucaaugauagacuagauaaagaaaauauaguacauaugcaccauguaauacuaugcauccauaaaaaggaaugagaucauguccuuugcagggacauggaugaagcuggaagccaucauccucagcaaacuaacacaggaacaaaaaaccaccacauguucucacucguaagugggaguugaacacugagaacacauggacacaaagaagggaacaacacacacaccagggcuuguuggggcaggggaguaaggagagggaacuaagagggcagauaaauaggugcagcaaacuaccauggcacauggauaccuguguaacaagccugcauauucuguacauguauccuguuuuuuuguuuuguuuuguuuuguuuuguuuuuuaaggagaaaaaggaaaaaaagucucugagggaaugacaguuaagcagguaucuaaaggaugaaugaugaauuagucagccugaggagagaauagguuggcucccagacagagaaaaagaaaaccagaagagagccagugcauggaaaagccuaagacaaggacucaaauggaucugaguggcugaaguguagaaagcaaggagaaagcaguugaauaagccuggagaccuaacuaggggaccagauguugaagggccaccugaacauuugagaauuuuauuuuuauuuaaggagaaagccauuaaauauuauaagcagggauguaucaugaucaaauuuggauuucaaaaagaucucucuuguguggaaaacagaugaugaggaacagaauagagcagaagaaauuuggagagagcagcuuaggaggcuacagcaggaguaaugguggcuuugauuuggcugauggcgguagaaauggagagaaguggguauauucuagacauguuuagaauaaaguuagagaauguuggcagcauuagugaaggaaauuucauagaucaccccugguuucugaugugaauaagcagguggguaaugguauagcuaaugauacaagauauuuggaagaggaauacauuuagacauaucauauuuaaggugccuaagacauccaaguagaacuauccagaaaaguguugauauguggagcuggagauacaaaauucggagucacuaauagaaaaguuugcuucagauugaguccuaugaaguccauaacuuuaaaagauugaaucaaguugggagggcuggaaaaugagaaggagcaacuagggacaggcaauccaggcagguacgcuggcaacaaagaccacagggaagcucugcuucggugaggagacaguagugcugaagguggaucaacuacaauguggacuaauuugucuaaugaggucacugaugacuuuagaaggagcucuuuuaauacaaauguagaggcagaaagcagauugggagggauugcgggaugagcaggaagucaacaaguagaaaaaaugcccaacuguuucauaaacuuaacugugagauagaaucagaauuguaaccagaaccuaugaaaacagaaagacaucacuuuuuuguuguuguucuguuuaagacaaaagauucuugagcauguuuagucuccagugaaaaaaggauagacugaagauauaggagaaaggauaauuuguaauacaaguuucuugaaaagaaggagaauguugauguauagaaaguagaguuucauugaagucaaauaacagguauaaauugggcuauugagcacaaaagauauaagcauagguguucuuaucugagaaugggagaucauagucauuccagagaggacaggccugccagaugugacuguagaaguaggugacucaagugagguggagaagaaaagaugcuagaagaugaaacagugagaccugaauuuuggaugagcuguccaagcagacaguauguaauaucuagaguugagguauagaguaaauuaggcaccaaaguucuuuagugaauguaggguaggguucaauaaauuauagcaaaggguagaguugggauaacugggcuucagggggcucaaaaaauggaaguuguuacacaaaugagaacuaaugcucugaaaccugcauuuguggaccagcacucaaaugcaacagucaaauccuucacucaaaagggcugcugagagaccaguaugcuuagaagauagccagguucuaauuaaagcagggaagugaagagcaguauuucuacaagagguagaaaauaugaaacaauuuguuucauaaaauacggguuccagggggcgccagugaaagguccaggagugaaaggagaaaaauuagaggguaaacaagcaggaaggaagugcaggacaguaugggaauaacagaacaggcaaggauacgugaugagagcaucaugaccuaaggaucaucuaguccuguucccucucugugaauccccugaauacauuuuacagucagcccuguguaucuguggauauagccaaccauagaucaaaaauacuuggaaaaagaaaaauuccaugaaguucuaaagagcagaacuugaauuugcagcaugcugaguuuacauugaauccacgcaaaugcaaugauguguagggauuauaugagguaaucuagagaugauuuaaaguauacaggaggauguguguauguuauaugcaaauaugacaucauuuuauauaagggccuugagcauccugggauuuugguauccacagggguuuuggaagcagucagucccucacagauacugagggaggacuauauuuuuaaagcaaauaccaaagaguuauugaaggaagaaguaggugacuuauggugcagcccugaggcauuugacaguuauucuuuauccugccugcacuuaggagcuaugcugcuucccagucccucucucccuuucuucccacuccuauaguuucuccuuuccuuuccauaaagauagucuuucuuagcccuuccuuuuuucucuucuuucucuuccucuggccacagcaucucaagggccacagauggccuuuguggcuaagaagagguggcucacccuuaggugacagcaugcaucacaguacaaggaacuggcauaagaaagaacugcugugucagguuuugcgcagagagguuaaggaagugauugcucuagcuacugguaaacagcacagccucuacgaaacugagucauugagcccaucaaauccaaacaccuguucauuuuauggcagcuuuccuagacacccaggauagagauuggcacaguuacaugugcugugcuguuggagcagggauaucgguauauaaauacuguuuauugugcucucacuucucgcugucuuucaugaguauugauuaacacgugaauuaacugaagcaucuuuuaaaaaaaauuaaguuuauagaauuuacuaaagauaauuucccuuuuuaucauagaugcacauguaauuacauuuccuuuucuuaaacauaagacuauuguaccauugugcgggcaaauuuuaucccuccucgacguugucacacugcuucacgccauguuuagguuggcucuucacugcuuuuucuguuaccauuugugucugccacauuugccuugugcuuccugucucuucuucugacuucugucacauuucuggccugcugucugucacuuccuccuugaaacaucagcuuauuguauucugagacuucaccccucucuugugacucuuugaaacuuccacauaaaugaucauauugccuauuuuggauuaguauguaaauaaagauggcuuuguguaaauaauuaaggcauuauuuucaaauuuuagaaacuacuaguuccaauuauuucuaaaccuaguuuuuuucuuuauauuacuguugauuaucaaaucguuguucuuuaacaagcaauacugacaaguaauuuuuuauuuaauugaaauguuuauauuaucugaaauauaaaauuuauuucugaaaugauuauuucacuguauuuaugucaagauucucagacauagcaaaccauauaucguacagaaugcuuaaucauauagcuuuuuuguggauaaaagauauuuggaaagcauaaaacuauuauuuauuaguaguagacauuuuuaaguaguauuucuuggaaauaagagauuuuacaauguaaggaaugcuguugauugaccauagauauaaaaugaauacugggaucacaaauguccuguucgguggaugcacuuaaguugaagaccauuucuucccuagcaacagugugaugguauuccuaaaugaccuuuggaaccuacugggcaucucacaaaguaaacaaaauuccccuugcaaguucugacaacugccaggcauuuuggauggugaaguaggccuccuggcagaacauauggcccacaugucuuguucccugugucuuacauuuggcuagguuuuauacaaagcauuuugccaguggaaacccugacccuauauacuggucaagagucuuagauaauaagaaauuucuguccgggagaaaauagauacagccacuacauagauauagugacagcaauacaguacccuucccacccaccacaugcuacacaauugcuuuuuuugucaaacuuuuaaguaugugaccaucaacuggccugcuuuuuaaaauaaauauuuuuguucaggcucugucuccauaaacuuugacucauuagaccugggaugugguccagaaaucugcauuuuuagcaagcauaucucuugauaauagagauaucuuauacagccuuuuuguagagaaaaaaacucuguaucucuacauuccaacucacagagaagccuagccauacuauguguagaauucuacauguggaauucuauucuguuuuuuuuuuauuugaauuuuuguucauuuaauuuaaagaucauuugugacaucugucucacacuuuuaaaauauaauuaaaauaaacaucugagugaaaaaaacugauuaugaaauucugaguuuaaaauaggaauaaaauaauuugguaaauauaauccagaagugauuauauuuaaauauauuuaucuaaauauucuuauauaaguuuuauauaacaugaacauuaacugguaaauuuggaaugcaguuguauauuuuuuguuaaaauaugucaugacuaaauauaauugcaaaaaaaauaccauuucuauuucuguucaccggccaaguuaauacuuguaauucugaacuguuagccucauguuaaaguuagccauagcuugcaguaaauugaacacacaguagagacuucuaagauauaaacuaaaacuuaucuuuaugaaaaaaucauuuguugaguguaaacuccauuaaaagguagaggacuuguucaugagguagggauguuguuuuauucacuauuuuguaugaggcauuuggaacaauaccuggcauauaauaggcacucaguaaguauuugaaugcauggauggauaacaauugaauagucuguguaaacaauugaauagucuagaguaaagccaagcuacaguguaucuuucuacaccaauacucagauuuuuaccauuaauauugcgcccucuuuuuuccccaauaauaagucuucagugcaugaaaagcacuuccucccucugaaauuacaucgguaaaauaggucaucucauucuggaggggagaggauuaaaaucuagaucagaugcuacuugguugguuuauuagaagaauuuuuuucagucuacugaauuuauggcaaagaaacaaaacugaauuuucugucauuuuaacacauuuaacaacuuguaauucaaaguuuagguucuccacauuuuacaacaggaggcugcaacuauagaacaccuuauuccaaucagauuuaacucugugauaaaaauaaguuaguggcaccuguuagagcagauaagccacaugacauuucugaucuugaguuguguuacuaagugacuuccaggccaaacuucauuagaaauauucuuuauuggccuuuggugcuagugggucucuacucuuuuuucaguguguugacuuccugccccaaauucuggagcuuuuaacuuuguacuuuauuuuccagaaaguggaagacuucacuuuacuucacuucuuuauuuuuaaacauuuuaauucuccuggcugcugacuugagcagaaaaccaggagagauaacagccuugcgcugacugguaacacuuuguaugucucccauccgaguucucuaguugaccuuagagagaauuagugccuuagagagaagaauggcaaagauacagucagugaggguaaaggacagaagcugugucguuauuccaaagcuggaccuuggucauuaauguuucagaaacaugaaggaaaaccaagcaauaagcacaaaguuaggauuagggugugugugugugcugaagagacuaaggagaaaggaugggaguaaggaaagggacaguaaugucagaagaggacagaggugcuuauaguuaaguacaacuuuaucaaccuaauauauuaagagauuaucuagcaguuguaugggauuucuguucccauguacagucuucccuaaugcauaacauuccagcuuaacuuugcaucuguuuacugcuguagcuaaauaaugaguuugccagaggcuaccaguuuaccugucuugagaauguucauacuguguuaacagcuugcacaggaauagauugguauccacauuuccuuuuguuacuuuuuugcuuuuuugcaagcagccuugccuauauguaacccauucccuuuuuccuguuuuaaucuuaucuuuuuuuaacaaugugaauauuugcuuucuauagcaguaacuacauugaauagucuucucagaagcuggcagauuugaacccaaguuuauuuacauauuuaagauagaagaaacaugaaaaagagcaguagaauguguguagugcucauuaaggcgguauaaaacauucauuucaauugccaaaccagcagauaaaccauccuuuuauguuuuucuccauauucugcaacacgcguuagaguguuauguauuuggagacaagggaguguauuuuuucaucuuuguauauccaguuccucauaugguucuuuguuaacugucaaaugaaauauuguauauauuuaugguaguauacaacaugauguuuuaauauauguagauauuauggaaggauugaaucaagcuaauuaacauacccaucacuucacauacuuaaccaauuuuugugauaagaaaauuuaaaaucugcccucuuagcaguuuucaaguauaguuggccccccacauuugcagauucugcaucagcagauucaguuaaccacggauaaaaaauacucaagaaaaacccagcaacaauaaaaaaucacaauacagcauauuuaaaaaacacaaauuuuuaaaagacacuauaauaauuuacguaagauuuacauuguauucaguauuguaaguaauacagagaugauuuuaaaguauacagaaggauguguguaggcuauauguaaauacuaucauuuuauguaaggcacuuagcaucugcagaucuugauauccaauggggauccuagaacuccccaugaauaccaagggacaaugguauacaauacauuauuauguacuguagucaccaugcuguauaauagaucuuuagaucuguuccuucugucuaacuaaaacuuugcaccauuuaacccacucccuucccccacaaacuccagccucugguaaccgccauucugcucucugcuucugugaguuaaauguuuuuagauaucccauauaagugagaucaugcaguaucugucuuuucugugccugguuuauuucaguuagcauggugucuuucagguacauagauguuaucucaccugacaggauugauuuacugucagguaaaaacauauuccgugguguauauauaaccuguuuuaaaauuuauucaucaauggauggacacuuacauugauuccaugucuuggcuaccaugaauaaugcugaaauuaacuugagauugcagauaucucuuccacaugcugauuuaauuuccccuggauauauacccagaaauagaacugcuggauugugugguaguucuauuuuuaauauauugagaaaccucuuuacuauuuuccaaaauggcucuacuaauuuguauugccaccaaugguguacaaggguuuccuuuuucuccaccuucucaccaauacuuaucucuugucuuuuuuauaauagucauucuaacaggaaugaggugguguaucucagugugguuuuaauuuguauuucccugaugauuagggucguugagcaccuuuuccuagaccuguuaccuauuuguaugucuucuuuugaguaauaucuuuucagguccuuugcccauuuuuuacucagguuguuuucuugcuguugaguuguuugaguuucugguauauuuuggauaauaacuccuuaucacaugugugguuugcagauauuuucuccuuugcuguagauugucuuuguugauuauuuccuuugcugugcagaagcuuguuaacuuuaaugcgauccuauuuaucuuuuugcuuuucuugccugaguuuuuugggucauauccaaaaagucuuuaccaagaucauugucaaguaguuuguaguuuugggucuuauauuuaagucuuuaauccauuuugagaugauuuuuguauaugcggugagauaaggguccaguuuuauucuuuugcauguggauaacuaguuuuuucagcacaguuuauugaagagacuguuuuuuccccauugugugaucuucuuaucuuuguuaaagauugguugacuguguauguguggguuuauuucugggcucucuccuguuccauuggucuguaugucuguuuuuauuucaguagcguacuauuuuuauuacuguaguuuuaaaauguguuuuagaaucagggagugugguaucucuagcuuuuugcucaagauugcuuugguuauccaaggucuuuugugguuccauaugaguuuuagaauuguuuuuccuauuuuucuuugucuguuuuauguugccguaacagaauauuugaggcuggguaauuuauaaauaaaaggaguuacggccagaugcagugacucaugccuauaaucucagugccuugggaggccaaggcaggaggaucacucgaggccaggaguucaagaccagccugggcaacauaauaagacucugucuuuaccaaaaaaaauuuaaaaguagccaggugugguggugcacaccuguagucccagcuacucgggagacugaggugggaggaucacuugcgcccaggaguucaggguugcagugagcuguaauuacaccacugcacuccaacuagggcgacagcacaagacccugucucaaaaagaaaaaagaggauuauuuaacuccuuuuucuguaggcagggaaguucaaggagauggcccuucuggugagggcuuccuuguugcaugauaacauggcggaggucauagggguagcagacagguacaaagagagagcaacaaaaaggaggaggaaacuuauaacagccugcccucauaggagccaauucaucuugcacaagagagaauuuacucacuaccaagagaauggcaccaagucauucauaaaggauccacccccaugacucagaacaccugccacuaggccccacuucccaaaaccuccacgcuggguaucaaauuucagcaugaguauugcugaggacaaacucaaaucauagcacuauuucugugaaaaaugucaucagaauuuuaauagggauugcauugagucuauagauuauguuauauaauauuuauguaacaauauuaguucaguucaugaacauaugucuuuccauuuguguucucuuuaauuuuuuuauuaauguuucauaguuuucaguguacaggucucucaccuugauuaaauuuacuccuaagcauuuuuuuaugacauuauaaaauauuuuuucuugacguccuuuuuggauaauugauuguuagguauagaaaugcuacugauuuuuguguuucuauuguauccugaaacuucacuaaauucauugcuuuuaacagauuuuugguggaaucuuuaggauuuuguauauauaagaucaugucaucugcaaacaguuuaacuuccuccuuugcaauuugaaugccuuuuauuucuuuuucuugccuaauugcucuagcuaagacuuccaauacuauguugaauaacaguggcaagagugggcauuuguguuuugcugaucuuaaaggaaaagcuuugagcuuuucaccauugaauaugaugcuaucugguaggcuugucauuuauggccuuuacuguguugagguacauuccuucuauaccuaaguuguugagaguuuauugaaguauguugaauuuuaucagauauuuuuucugcauauauugagaugaucauuuuuuuccuuuauucugugguguaucacauuuauugguuugcauacguuaaaccauccuugcaugccagagguaaaucccuguugaucauggugagugaucccuuuuaauguguuguggaauuuggcuuccuaguauuuuguugaggauuuuugcauguuuucaucagagacacuggccuguaauuguuuucuuauaguguucuugucugauuuugauaucagaguacuucuggucuuguaaaaugaauuaagaauauuuucucuucaguuuuuuauaaaaguucaagaaagauugguauuaguucuucuuuaaaugauuguuuaacuuuaccagugaaaccacuaguuccuaugcuuuucuuugaggggagacuuuuuauuacugacucaaucuuguuacuacauacuggucuuuucagauuuucuguuucuuugugauucagucuugguagauuguauguuucugggaauuuauccauuucuucuagauuuucugauuucuuggcguauaguuguucauaagucucaugauucucuguauuucugugguaucaguuuuaaugucucuacuuucauuuauaauuuuuuaaauuuuacucuuauuuuuucuuagucuaccuaaaggguuguccauuguguuuauguuuucaaauaaccaacuaagaauuucauuagucuuuucuguaauuuuuuuucugaucucuauuuuauuuauuucugcucugauuuuuauuauaucuuuccuucugcugacuuucggcuuacuuugcucuucuuuuuccaguuccuuguggugcaacauuaguuguuuauuuagaacauuucucuuuuuuuauguaguuguuuauuucuauaagcuucauuauuagaacugcuuuugcugaauucccauaccuuuuguuauguuguauuuccauuuucauuugucucaagauauuuuuaauuuuuccuuuuaauugcuucauugacccaaugaauguucaagagcauguuauuuaauuucuauauuuuuguuaauuccaaaauuccuccuauuauggguuucuaguuucauuccauugucagagaagauacuugauguaauuucagucuugauuucggacuuguuuuguauccuaacauauucugcuaggaaaguaggaaguaacuagauugggacaaaaugguucagaacuguagugguuggaagggaucauugagcacuaccacugaacuggccagucuuugauaaaagcaaaugcucuguucuuuuccuacguagaguuagcacuacgguacuagaaauguugauuauaaaaaauuuauucuacauuuuuuuugaacuuuuaguaagaaacguauuaaucaguggaaggauucauaguuuuccugguauuucacuugaaauaguuuuaaaaguaagaccuugcaaggaacauggauguuuuugucuaaauucugaaaugaucaccuuuacacuaauuuccuauuuucucuucgcucuuguuugagauaauuauuagacugaaauagguucuuuguaguacauuucuaaucuugcaaguacacuugaaagucuacauacccagagaaaauaaguguagaaucaugauuuuagcaugaggauuuuaaaacuuuuuccauuauucuaucuugcuggcuuaaaauuaguacagcuuucuuucuuguuuuguuuauauuuuuaccuuugaauguuucuucauguaaaaguguguugagaggauugagggagaggguuuaugcugcuguggaaauauuuuuccuucuuuuugguuaaaucugcucccccuugugguauaaucuaggucauuauagugcucauauuuaauaucucagaaagauaauaaguucuugaguguuuacuccuuaccagauguuaggcuaaaugcuucguauacauuuucucauucaaucaucacagccaccuuuggaaagagauauaauuaucauucagcccuauuggauagaugaggaaacacaggauuagaaacuauaacuagugaguuguagaacuaugaguugaacuuaaauuugucucauucaaaaucccauaaccuuaauuucucugucauaccaucuccaagagcacuccagaaggaaaacuuucucauugagggcuacagaaauacuugcacuauuuuccucauuuucuuauuucuccauuuuaaaaaucauuuuuucacuuucauccucaucugauagaaaugguuauggaagaugcaaaaaaaaaaaaacacacaguuuuaagugucuagcuuuguaugaaucugccucauucuaagugagcaucauuuguaccucugucauuguuuuugguaauacccuugcaagaaaacauucuccauugguuggauccuucacuguuugcuuacauugggaguuuugauucauuguauucuuaacauuucuaaugacauaauaucugaagaaagggagaauaaaugaagaguguuuuaaaauaucauuucugcuaaucuaauguaacaaaauuuuguaacuauaaaaccugacuacuuaacuaaaagauccuauguucagggucauagcacuuaaugacuuucuggcaugcuuuuacauucaaaugucuggguguaaauuuaaugacuucuacauuucgaggcuaaagaaaauuuccagcaaacacaaaaugaaaaagaguaaacacauaugcaccugauaauuuguuuugaugcauuuauaguuuugauaauaaaaaguacuuuguauugcuuuucuauucuguucuuaacuagauuuuuuaguaguaauguguauuuuguguguguguucaaagggcagccauucuacaaaaguggaagcuguggucagaacucugaugaaaauacagcuuagagauccaggggccaaagcacucguuuucucaacgguauaaucaacauuuucauccucaauauuaauucgaacugauuuucccucucuaaucaguuuacagcugagaacuaauuuuugauguuuacucuuagauuuuuuuucccaaauccauaagauagaauuauuuuuagagaagauagaauuauuuuuagagaaaugugaugauguuucacaaggcaauuuguauagcuauauuucaugacuuuuuauuaguuucauuuaaggauuuucuuaguuuaauauuuuuaaaauuggaauuucugacuuugaaagucucauuucacaaaaauuuggguugaaaaagacaaucuacuuuauaaaguguugaguaaaacccuuaguuuucauuuucgaaaacuaaguaacuauauuccaguaugcacuccauuauguauuuucuacuguuuguuuaucuuaauuacauuuucaaaaccagcauuugaugcaaaaaaaaaaaaacaaacaaaauuacuauuucagauagagcuaaauaauauggaugguacuacauuugaggguuuugguuuugguuuuauuuucuuaacuccaguauaaaagucauuuugauuuauuuccuuuucagauacccuuagauaaaggcuacguguaaauauugguuuucuuauuguuuuauguguucuaguggcaagauguauuagauauuauuucaaaagcucuuacugacaacaacauggaauuugcacaaaucagucguguuaagacauuucagguauguuaagauuuuacuccgguuuuuguaguggauacaguugcaaauuuaaacugcuguuaacuagcuuacuuacauuuauugucucaugccauauaagccacauaaacagggucugaguucuugauuaauuauaaagugaacauuuaaaagcagagacugcagguauuuucaguauauaacaagaccauugguuuuuuaaagaucucccaacuugagguucuuuuuuuuuuuuaguacaggaaaagauugccuaugauauaccuuuugaauggacaggggccucacaccccaaggauuaguuucuaaagucacugucaggcagaacugcauguggucacaguuauccuuacaucaugcucagcacagugacaggcguaugaccucaggcacacacagagaccaaaugaaaauuuagcagauucaugucucuuaucucacauucacucuagcacauucuuuuucucuuuuuccucuaaccucauguaguuuaauuugcaugcauuacaugcaucugucuugugauuccucuagauauuacgaagaacaagagagcuuauaugauacuuuucuucauaauuaaaaucaagcgacaaguuuacauuuucuaaaguugguaauuuugcauuuaaguuucuuagcuguuaccuuucacaauaguaauagauagcauuagacaucuuuaaagugagcuauuacauacugcucuuauuuuaacugaucgagcuaaaauuaaaauguaccuuucuuuuuuaggagaaccuuucagcauuuaaacgugauccccaaaucaauauuuugcugcugccccugcacacagguucuaauggauuaacuaucauugaagcaacucauguucucuugguggagcccauauugaacccugcccaugagcuucaggccauagggagggugcaccgaauuggacagacaaaguaaggacuaaaauuagaaucagucacauuugcuucaguuuucugagaaaccaaaucaguauuuaaacucuucauuuauguucaucauagcguacuuguuuuuaauuacuuccuuagauacuacauuuuuuaauuauuuauuuuauaacuuauuuauuuauaacuuuuuaauuauuuaauugaaaggcaugagauuuccaacccucccuucucuccaagaagcaaacccccaaauugucccaauuuuuuucuucccucccacaaaaaccuuaucacuuuauccaaaaaaaagcuuguuagaaauacuuaagacagcuacaaaguugaaggcauccaucaugccuuugaggagaauggaguuuugauugucuaaaguagucccguguuuaaaagaagacauaccuuguacaugacugaaaauaaauggcuccuuuuaaaauucuuaacauuaggaaaagacacccccuaggucagcuccaagagaucauuagauucaguuuaaggcccaaagcaaaccuaauaaugaauauuauuauauggcauguauuaccuuuauucauauaucagaauagacaguuaucuuugauaaggccugcuaaauguauuaccuucuggauguuagaagucuuugauguuuaaaaaaggaaaaaaaaacacauccauaauaagcacuuacuaaaucaguauuuauugagcaccuacuguaugucaggcauuauucuaaauacugaagauucaaauugaaugauacauaauuuauuuccccaaggaggucacuguguaguacaggaagcaugacuuaaaguguugggguagaaugugcaaaaguauaauaauaaaaggacuguguuaacaaaagaagauaaugaucacucgggcccuacagagucaggaaagacuuuaugguguuaagucuugaaggaauaauuauuucaaaguuggcuggaaaaggguauucacacagccaaagagaguuauauaugcaaaaauacaauggugggaaaugacaugacauuucuagggacuguaaggaguuuggaauuguugcaguauaaaguaugagaaagagaucaucggcaggagaugaagucuucugugucauacucagaaauguagacugccccguaagaaguagcggggagagaaaauaaagggcuuacuugaaaacaggaaagagacauguuuauuaaaccucuuaacaaauagggcaaaguaacuguaauaaaugcgggcuuguucuaacauaccaccaaguggcauuuaaaaugcagucaugucuuacuuguuuuuuguugguuuucuucuguguuuuuaaauauugauuuuuuguccuaccaauguucuuuuaaagcauaggcuggacuagucucauauuuaaaaccacgaguccaaaaggccauucagcauuacccaacaaucuuacuaugccucgcaagucaauauguuuuuuucuacuuucugaggagucugucuuaagugugucuucuuccuccccauggcgaucuugccucauacaggggaaacauauacaaucagauuagaaguaccucaucuuuccaucaucaacuugaacagucugccugcaucaguacucacauacuuuuugguagauuuuuauugaguaucuucugugugccaggcacuguuuuaggaacaugagauguccucauggagugcgauucuagcuguaaugggguugguagacagaaaggugguaaacaauaaacuaaguacaaucuggacuauguuaggagcuggaaaaguagagcagggugaggaaguaaaagugcaauguuugggcaggaaggcaugcaaggccuuauugagaaagucugagcaaggacuugaaagaaaugggaaaaugggaaaguuagucaugcagcuaucuugugaaagaauguucaaguaaacagugcuuucggugcaaaggcccuaaaucaggagugugguauguuagaagaauagcaaggagcuacaguugcuaaaagggagagaagcaggaguugaagugaaugggcucaguggggagagggauuacauugggcccaggaagccacugugaggauggugcuuuugcccugugugaaaucgggagccauuggaaggcuuugaacagaggcuuggcauaucucacuuaaguuuuaaaagaaucauucugagugcugugauagggugggagugaaggggagcaaggaagaguagaagcagggagagucuuggaggcuauugcagucauccuggugagagcugaaggugaccugaccauggcaguagcagugcacaugaugaggaguggucagguucuggauauauuuugaagauagaacugauaguacuuuuggacagacuagacaugggguaugagagggucaaggauaacaccauggguuuuggcuuggacaacuagaaggaugaaguaaccuucaacugagcuggagaagucuacaggguagagcagauuugguaagggaagaacagacauccaaauggagauuucuauucuguaacuagauguacaaguccauuaagucacgagacugaaugagauuaccuaggagugaguuuagauagagacagaguuuagauagaggaccauggacugaacuccagggcaccaaaguucagcuguucuaggagaggagaaggaagcagcaaagguaacaaauaaagaucaaacagugaguuaggaagaaaaccagaagacaggaguguccuaggaaccaagugaaaaauguaccucaaagaagagguuauggucaccuguuucaagugcuaugaaaaaugucaaggaagauaaggauugagaauugaucauuagauuuagcaacauggagaucaaaaccagguuaagugguagaggugacagccugacuuuaguuuuggagaaaaugggauuuuguguauuucuuauuuaacaaauauuuguauaacaaagagagguuagguaacuugcccauagucaggcagcuaguagaagcaguggcagauuucaggcacagccauucugccuucacaguacaagcuuuaaccacagugcacugcugcuucuguguggcugguaaggccaguauuuugaggaguuuugcugcagagaaaaggaagagaaugagaucaagagagguuuuuguuuuccuuucaaaugggagaauuaguaagaaaaugauucauuagagacaacaaaaacuagugaaggagaacagggagaaugcuugacaauguccuugaguaggcaagaggauaugggaucaaacacugaaguggaggaagggguugguaguaggcagaagcauggauaugucauccaguaauaagcaggaaaguaccucauaugccuucccuuuuauuacagcagaagugucccuuuucuuucaaaagccauccauucauuuguccuggacuccauucuuucucauuuuucaaggacagguguacauuucccuuguacagguugagcaucccuuaacugaaaugcuucaaguguuuugccuguaggauuuuuucagauuuuagaauauuugcauauacauagugagauaucuuaggaaugaaaccccagucuaaacaugaaauuuauuuauguuucauauacaaauucuacucauagccugaaggugauuuuauauaauauuuuaaauaauuuugugcacaaaacaacguuuuuaauguguuuugacugugacucaucacgugaagucagguguugaauccuccacuugucacguuggcacucaaaaaguuuuggauuuuggguuuuugguuagggauacucaaccugucauauauuaccccauaaauaugucuuaauauuauccaucuuuagaaagaaaaaaacacucugauacauccuaccuccaucucuacuuuuuuaucccccauucucugucaaccugucugguugauuuucuccccaccauaucacugaagugagacuuauaacauuucuagugaccuacuucuugccaguggucugaggguucuuugucuacaccccuucgaugaauuuuuccagucuuagggcuuuagguagcuuuuacagguugaugacucucagguguauaucccccagcccagacaugcccauauagcuccugucccaggugcauauauccaguucuagcucugcacacauaucucuggacucaccuuggauaccugucuaauagguaucugauagguuucacauggacaaaacaaaacuguguugcuucugcacucucacucccacccugagcuuuccccaucuuauaauguggcacugucaucuguuccugcccagaucagaaaucucggacucuucuauauuuuucuuuucacaucucacaugccagucaucuuuuaaguuuugucagcucuaccuccaaaagauauuccaaaucuacuugacugcuaucuccacugacacaaccauagugcauccacccuuacuuacccagaugacuacaggacuucuuaacuggcuucucuggugcucuucuugcugagcaagaaguacauccuccacacgguugccaaagggauuucuaaaguacagucagguauacaucaaaucaugcauacaaacccaccaagggcuucccauuauaaccacgauaaaauucaaaugcuuggucacauccuggaaggcccugugugaccuggccccugcacaucucuccacccuuauuuucaccucucucccucgcuuacaggaugcuucugccaugccagccuucuuuuggccucuugaacauguuaggcuuguuccaggcauauucccuucccggggacuguguauguaugugcuguuucuucuguuuggauauucuuccuacuccuccuuugccuacuggccucauucccaucacucuuuuuucaguuugcaugucagccuguucucccagcauuauauuuaccugaaaccgucuuacucuuuuauguguuuauugucugucucucauuagaaugucagcucauggagauuaaauaguucauuuuauucgcugcugaaccccucccagcaccugccacaagugggcaccaacugacugaugaauauagcauauaaaaugugaagucgguuuguacugauuuguuuuacuauguuuuuaagcuuaaaauucuucuguaccuuuuagaccuacuauuguacacagauucuuaauuaaagcaacaauagaagaaagaaugcaggcaaugcugaaaacugcugagagaagguagguaauaauuuaccacaaguagaagggggaagguuuuccuguuaaaaguuuguaucuuuagaacuucuucacuuagaugacaacgaaaaauauagcacaaauacguuuuuaaaagcaaagucugacguuuugccuuuucacuguuucccagucagugcuccagacuuuguauauuugaauuaauuuauuaauuguaacauguaaauauaaacuauacuacauuccuuugccacauuggaucacuuucugaggcugggaguucgaaaccagccuggccaacauggugaaaccccaucucuacuaaaaacacaaaaauuagccaggcauggugacacgcaccauagucuuagcuagucgggaggcugaagcaggagaaucgcuugaaccccggagguggagguugcagugagccaagaucgugccacugcacuccagccugggcaacagaacgagucugugucucaaaaaaaaaaaaaaaaaaaacaaacuuguuaagguuaauuguggugucaauccaaagacaaaacaaaagcagagagacuaaaccagucuuaauuuuaaaagcuugacucuggaaucauagaacuuucuaauauuuaugguauaauuuauuuaaaucuuuuugaaaacauaaaucuuucuacaucuuuaggagguagguaggauuggaugguacccaaggaagagauuauugccuuagaagggauugucacauagcaaagaagcaauuugaaacuagaaauuuucuuccauugaugguuucugggaaggaaagaggcuuccacaagggccuuuuuaccuaaaacaugaaggcuuuuuaaaguucuuguuuuccuuguguaucagacuucagugauuuuuauuuagguuguuuuaauaaaauagcaguuaugaguuguuugaaauucucuugaaacaaauuaacuucaggugguaagaagguaauuuguaaggugagagccuuaguagcaguagucaagaguuuuauucuuuguucuauuaauugcacagagaaaaaacacuuugacaaacacuaaaaguaauauauagaaaucuucacuuugacaagguauaacaaagauuuuaucacuugcuuuccucugggaguuucuuauaucccaauuacaaaaacuuaagaaaaaauaugugucuaguucguauuacuacaaauauaaucgcugauggcuugggguuucuuucugacugugcucauuugggaaaccuugcagucacacgaacucaucagcaaagcauucagaggccucugucuugacuguggcugaccuggcagaccuauuuaccaaagaaacugaagagcuugaaugaacuacacuugauucauuccauggacuuuaguguauuaauaaacuuucauagcuguagagcaaaguuacaaguuuuaaaaacccaguagauaacaguaacacuguuccuaguugaaugaauuuguuuauuguucugguuauacaguggcuuaguacuuauugaguccuuuucaauauacuguuuccaaaagaucuauaaagauucuuaauuuuacacuccuaauaaaacauuuauuuuuugucccaaauaguaucuauaucugaugaugcaagggaauuaagagagguaauguguacuuuucuuaugauaagaucacucauaaaacaguuggaauaagaaaguaaacuagucuaguuuuauaugaccugguauauugaacaaacauagaucucaguuuuggaagggccuucaguaucuuuagcacaugauucaccaauaucuuguuaguaauauuuuaaguagauggugaauuauauuaacccauuuuuugaguaggcuuauaccauaacuuuacaccuaguaauuuugcaguaauacaacuccuuacaauaaguuaauguuagacaguuauuuguuucuucugcaucuugcuacugaaaacaaaaacaaugaaaauauucauauuucuauuauguguaaagugguguuaguguaaacaguuaacuccaaauagauuuuuuaauguauuaaugauuaccuuaaaauuaucugcuuucccuacucuuaauuuuucuuauuguuaaaguuuuuauauguuguaagauugauguaucuguaaauauugcaguuuuuaugauuuuguuuuauuauaacauggaaauauggcaggguuuuuuuuuuaaucauuauuauacugaugucuuggauucuuuuucuuucccauguucuuguguaacuagacuuuuuagccagugauaucugaauucaugguagaguuguuauuucacuccaguuguuccucccuuaagcacgagucuuugaccuuuugaacaagagaaugccauguucacauaagcaaaucguugcaagugauaauaacgaaguguuucuucuucugugaggaauuaauggacuuugaaauugcugaauaaggaguagcuuguuacauccuagccauuugauguaauacaaauguucuuauuuggcuuccuuuucuuugagccuucagaguuuuaaaggacccucuuugacccucaggacuuauuagcucccaguuagcugccuggaaaacucauagaaccauucccuagaucccauuuguccgagaggcuuuggugcuuaguuaaggugcauuuucuuacucuagguuuauagagugauguaauucaacugaagaaaacacacacaugcuuuuggugcuuauucuucaguuaaaaggagguauccauugauucuuuuauaugaaauuaaaucaaacuguuauuuuuauagcucuucacauauuaaaaagagcuuucauguacauuuacguguuuaauuuacccaacaaucuugugaaguugauauaauuaauaucuuuacuguuuuaaagguagagaacugaaguucagauauauugaaacuuucuuaggacauguagcaaguaaacaguggagcccagguccccugacuccauaucuuacauucuuuuacuaauaacaugucaugcugagauucagaaggcccaugcuuauaauuuaaaaaugagacuauuucaguauuucuuuguguuuguuuucuacuauuccuuucugagcuauguuuuagagaaaacaauuugauaugcuucaauuuuguaaaaucaaauuacauauauauaaaaaaaccuaucuguauuagacaaaaacuguuuuuauuuauuucuguaagauauccauuaaauaaauauuuuaguggaaaugaaa

SEQ ID NO: 21466 - RNA, 68009 nt, Homo sapiens
auugcaagauuugaaaaguuuauuauauguaagauauauguuuacggaaaagccucuaaaaacauaagacaauggagcuuuaaaaaagguuagguuuuacaucuuuaaaacucauuaauaagauaccaaauucaagagauuauaguuacauuguaaaacguaaucuucuuuuaauaaaagcuaauaaugacugaugaauuacaaaugcacuuauuuauuggugauuacaaacaauacuuaagaacuuaagcagcuugaguaguaguuuaagcuagacagagcaaagaaaauucuuguuuaauauauauauauuuuuaauuccaguaauauuuucuuaaauuccuguuaaaaauauaaucaauauuaaagucagcaaaaugccuuugacugacgccuggauuauuuuaccacuuaaccugguuacacagugauuuuuuuuuuuuuucugucagauguaacugacaaccaguuuagucuuucuuuaagauaaaugaagugauaacucacauugcagcaucuuguggaaaauauucaaacuacauuuaaaaugcuucuguaaaauggagaacucuauugcuccacaagaaaauguauauguaaaacuacagguuggcuaugguaauaguaacuaaacuacauccaacccugaagguagaaaaaucccugaaaagaaauacacagccuagucauaguauaucauauaaagguuauuuucuuauuuugaaaauucucccagauuuggagaaauccaaaccuuuccauaguucccuuacuaggcagugccacauaaaguuauuuaguuaacauuaugaucauggcuuacgauuaaauuccauaugacaaacacuuauauauagcagccgucauuuuggauguugguuaugacaauauuugcaguuugauuacagaacacgcguucauuaaauuugguacaaagcaugaacacucaggacagauuggcacaauacaugcaguucgagaauucucuuaucaucucaagccagucaucacugaauaagccauagucccagucucguuuuccaaaucuuucucauauuguaacugacauuuaaaaugcuucuuaaaacaucuuccagaauacgaaaaauacacuuuaaaaaucaauuaucugaaugcaugauggaaaugaggcaggauggcagagccagugccagcugagaacacaugagggauggggggcagggggagcuggcccaggcucacagugcccauggcaaguggggguucuugcugcugcugccccagacagcuuaaccuguggggcaaagauuccccaggccccagggcaagagugcuauucccaaagguauuuuggguagcaggagggggcagcugccagaagcccaacaggggggacagguccagagaggcagguauuguuagguucacagcaucugcaggcagcuccuugggcagguuuacuuuaccagcauuucccuuagccagaucaaaaccuggguugagcuuuugaggugacugaggcucuugcagaggcaaguccucaaacaaacugauauugcaaaaaccuuuaguaucugcuuugaggggcaggcuugcaaguggggaguaugagguagaagugguguuguacuugugauugggaagggguggcggaggagagccaggggauaccgagggguggagggaggccagggacucuggcagcggcugcauaggcugggcggcuuguucugggggacugagggugaggcuauggaccucagcuggcaagcuacuugcaagcccguucugggcagaagcuccuaaagggaaaggaggcaaggcagcagccuucaguuggaaugaaggcgagaugguguggaaggugcucagaaggucuccggucugcaagcucucuuucaucagcuccugugagugggucuucuugguaugccgggugaggugauccuugcgcccaaaucucugggcacagaacuggcacaggaaguccuugcauccuguguggaccaccagguggcgucgcacauccuuccggguguagaagcaucuuucacaguggucgcacuggugcuucuuuuccuugguuccgcuagggggcuucucuuccgcaugggcuuugaggugguccaguagcaccucggugcucccuagcuccagggcacagaccccacaggugagguccccacugcuggccgcauggagggccaggugccucuuauagcccagcaugguguuguacuucuucccacacuccucacacccaaaggccauuuuguuggggucgugggucuggaggugguuuuucagguggucuuuccgguugaacgucuucucacagugagcacacuggugagauuucuggggagaauggguagccauaugccuaggagcagaaggagaaauuucacaauagagaguuguuuuaagagcugaagaaagguguagcaacaauauuauaucaaaauguuaauaguuuucucugggucuugguauaauuuucaaaauucuuucauauauuuuccaaauauauaaacuuuuauaauuaagaaaagcaagcaauacuaaagccauaauacauuuuucacaccuauaaaacguuuuuugagacaggaucugacucuuuugcccaggcuggagugcaguggcacgaucauggcucacugcagccucaacguccugggcucaagcaaucuucccaccuuagccucucaaauagcugaacuacaggcacacaccaccaggccuggcuaauuuuuuuuuuuuuuuuuuugagacaaggucucacuauacccacgcuggucucaaacuccugggcucaagugauccucccgccuuggccuccaaaaguguugggauuacagacaagagucaccgugccuggccagaauauucuuaaagagaacauguuuuuuuaauguauacagauuucugaacaaaguaugcaaguacuuaaaaauaccugaccaugaaaaaucuuuuucaggaagggguuaaaggggucuuuuguacucuggaaauucaagugacucaauuugucugcuacccagaaccacauaaagccccaguuuuagguuauuguuccuaguuccuauguuucuguuguuugagacaaaaaguucaagccauggacauguaacucuuaggagccucuuaaaaaguccauccuuaaccucagaaaagugucuaauaggacccugaacaucagcccacugccuugcuuucagccucagccucugccugccgugagaucucaccacugucuugauuuccuucauucaaugcuugacuaucagcucuuaucucugaugcugcugccugucucuguuacuucaaauuuucccucuaagacaccuuugacuuacuucuuaaaggucacugguaauuuaauuggcaaaauucaaaaagacuuucuucuuuaaauaugaagcugcuacuucuaauaagaguuguaaguuugucuucaacaauggcuucagggacaagccguagucugucuagucaauuuggaauuucaaaauagcucuuuuauauuugugaagcagaaauuaguuauggaaagccaucacaauuccaucuuuuucauaguuccacugaauugcuaacaucuaaacucaccacuggcuuuuaaaaacucagugguauaaggaaacccugaguuugucauccuuaagcuuuaaaaagguucauuuuaauaacuaaaaugcagagcauuacauguuagcauguccuaugaaacagaauccuucauuacaacuuguagcuucauaucccucagggcagauaccuccuuuagggguuuugucacgagagguuaaagcuuguccuaacugacaauuuaagugcaguuguacccugugagcuuucacguuagauacagaagauuuucuaacaacucauuccguaaaagagauaggaucucuuuaagacaguauguuuaagucaaaaguauacuuaauuacaccuuucagccaacaucugcccuauacuguuuauuccugccccuuuuguggagccagaauuggggaggggucuacaauagcagccguugaguggaggcccccaccuagaggccaacuggaagccaguucaaaaaauauaaagcuaaucugaaucgaacugucauuuucuuaaaaauaaaguacaaccucauaccuccuuccucugucacaaaacaaacaaacaaaaacaaaaaaggccugcugugugcaucccuucccuucccuccaguacaccacagcuuguuugcacauaaaugauaacaugauggguaccguaaggcagggacaggaaccaauacgaugggcaucugagaaaccagauugugcugguguuuccacguucuaggucuaucuaaauaaaugcacagguuggagaaaggguuuuuagagcauguuagagggcaaauagccauguuguucugcaggauauccauauguauauauauauauaucgcaggaauacauaugaaggggggagcuggcuuacacacucaguauuuaaaccuuuuuuuuuuuuuuucuggcccaguacuggugaacaggaucccauagcucuugggucaguuugugccucucucuuuucuuucauuauagaggacuuucaucugauuugauuucauuuaucacccauggguagaucaauaccagguuaacgacugcaccugguuauuuccuacgcacucuuuccuguccuacaccuguacuaccuguaaguggggcacagucugacaccccaguaguacuugagcaagaccacugccuuccagacuucacuagcucccacauuucugaauuucuugacucuuucccuugccuggcaucuacuucuuucccuuuuaauuuaucccuuacuuacucaacaauccugaucuagaacauucucauccuauagcugaaauuacuucaacgacuuguuucuuucccucaguuuuucaucuuaccuuauaacccaugaaaacagcuuuaguauguccuagagucaguacccaaugccaccaucuuuggguaucaucuggaucaugucagugauuuuagaauuauuuagagguugauugcucacauuaggaccuccaaccuugccaaaucaucuuuucuugccuguuauugucucuaacugguuucauuauaugcuguacugggacccacauucuguuuucugguuaagcaagucaguuauuuuuuccuucaaccucuguugccucaucauccuuuuuuugagaugcagucccacccugucaccaggcugaagugcaguggcucgaugucagcucacugcaaccucugccucccggguucaagugauccuccuaccucagccucccgaguagcugggauuacaggcguguaccaccacgcccagcuaauuuuuuguauuuuuaguagagacgggguuucaccaugguggccaggauuaucucgaucuguugaccucaugauccacccaccucggccucccaaagugcugggauuacaggcaucaucuuuuuuuuaaaagcaaaaccgaaagcauccugccaucucacacucuuccaguccuuuacuauaucacugcuucaggcaagagaggcgagaggcaagaaaugcugggggcugaggcagggaaggcgguucuugcauaaaguacacugacagcuucccuuuuugccucucuuuacacccuuaacugaacaagccauuuuccuugcuaagaacaacuaccuucuaaacaugacuuaagacuucuuuuucagcgcaguuuaccauaguaaauuauuucucggaacaugcgggguacugauucuaccccugucauacccaaauacacauauacucagguccugcgguccacccuguggaccacauguguaugaaaagucagccuucgguauacacagguuucacacccugcaaauacuguacuuucaaucugcaucugguugaaaaauauuuguguauaagcggacccgugcagcucaaacucauguuguucaagggucaacuguaaucccaauaguucuacuccacuaauucuucuuuucuaaacauugaucucuucuaugugucucagucuuuaucugcaguuuuaguguccucacugugacucaguugcagccagcgcugcucucauguuuggguaaggacgcuuacccuccgcacacgcaagaagcuucaugcaaaacagggagccucugcaacaaacucaugcacgugaucagcauucaauacuucuacucgugacagcuagagggaggcccauguauagaagacauuugaauuuuaaaauauguaagcauuugcaggcuaauuuuuaaaaccaacuuauuacauuacauuauguauaacagugguauucuuaagggccaggagcauaauuuccaucuuuucaauucuuucaagugccuuccuccagggucacuccaagauuucauaauguggucuaugguaauaccagucagauggaaaaucucacuugcuaaagccuggcucucuccaggcguuuguaugugaacagucaaaguugaaacuucaaaguuuauuucaugaaauuaagggcaaauggugcauuucccuuaaccaaguaucaaaagcagcacgugugaguggacgcacuauguguguggcucugagugugcacagacacaacacacaccaugcucauuaccagucccaguaccgugcagcacagccacugcauguacauggagucuuuccugugauauuaaaaagauccacuggcggcagaaacgauaucuaauguauucauuucccucauggaaguagguaccuaacaggcacucaauaaauaacuuagacuaaauguaauuuuuuaaaaagacucaucugcuaaaacagugcuuuuuauccuuuggugugucaugggugccuuuaaaacugaucaaaugcacaugcugcucaucugcauacccaccugaacuccacuuacuaggguggcuuuccacccaaguugagaaacuguguuccaaacauuuaaacuuggagaugucuccuccuagcuuuacucucaggaccuggaucagcccccacauuucaucccuggacucugagagcagguuucaaaucagccuuccugccacuucuucaaauuauuaucugaguccucuuucuaggauacuaaacgaaucauauuucuucacuacuuauacaccugaaugagacaaacccucucagacagagguaaggccugcuauacguggcuuccuuccugccugcacuuuuagccucaucugcuccuccucggauaguacccucugcacaugggugcuuuaaggccaagacuuauggcuuucccagaaccuccucucugccuccuccucuuucauugugucacagcuuaaagauuguccccaucugagaagccgucccagguuucaucaggcagugaagaacaacuucuaccaccuguauagcucugucaaagcagugagguugcauuuuaauugucuuuuccuauuucuccagccauggggagaggccugguauauuguaggugcauaaaaaaucucuguugaaagaaugaacugacacugcacaacaagacggucacauaaaaccacaggaaucacuggaugcagauuucaagaaucccucaaaggcuaaaaugcauccauauccugugucccuuuccccuugcaucguguggucugagggcuagaaaagccauuuaaacguacuucuaaaagugcauaccuuugccaaagccucucaccucaucaauuuauaucuggaaacaaaggcuuugccacagucaggcugcacacacuuguacggccgcucccuggagugggaauaauugugaaucgugaacuucuccagggugaggaacgucuugccacauaacuggcaggggaacguggccaugggcuuugcuucucacaccuuccuuuucagaugugcugaccaaaugcugugccauuuaagcacaaacagaacgauggugcugggcacaucagcagagucccugcagcugaacuccagaccacgggagaggcagcaucgugggccugguucuacccagacauggaccucucagcugucacuagcuuugcuuccugcuuucacacaucccaguuuacaugcagucucaagcugaggggagaaagucugaggcacaggugcgauucaggagcagaaagguaaucugcaucacuauagcuggggcauguccugggucccccggauuggcuguggagagaagaggaacaguuuucuugcauuagccauuugaaaacaaugcuuuuccucccugaccgcuucagaaucaacuacccacaaucaacacguuccuuuaaauggugcucauggaacacaguucuccaugugagagggccaucugcauacaagucuacacuuuuggcuucucagagggugaggagucaagcacugauggccaguggagcacacuuucccucugguaaggagaguucuuuccacggauccaguauuaucuauuucaggucagugugaagcuccauugaccaaagagaaaaacaacaacaacaacaacaacaacaacaaacaaaaaccucccucccucaguguguucaaguguuuuuacugguccauaaacaaaaaucacccacacuuacucaaaccacgggcucuuccucaucacucauuguuggcauaacauuaguugcuuaucacaccuguuuaaacuuccagaggauaagaaauaauuuguauacaccuaagucaauuuguuuguaagauuacucugcagaagggcugauauaaacagaaugugcaugaagcuagucuagucuaguugcacugaugugguggcacaaagcugauagcucaggaaccagcccaggccacguucagauuuguaggcaccauccucuaguaaguucuacuaaucucuuccuuuuuuguuuauggaccuuucuucauucccuggcccuacccuggagggcccauccagcuaccugcugguaggccaccuccaggagaugggccuacugccuccucaaacccaacuugucucaaacccaaaucauuaucauccuucugacucagccagagucaccaaaaaccagguucuucuuuuucuaccaauuggccaucauuggaggaaccugaagugucugagccugcaucaugaacaauacuccacuuacuaggguggcuuuccacccaagcugagaaacuguguuccaaaaauuuacacuuggagaugucuccuccuagcuucacucucaggaccuggaccaaccccccacauuucaucccuggacucugacagcagguuucaaaucggccucuaccugccacuaccugccaggguaaagcccuggaucacuaccacccugugcuauucuagagagagauuuucaggugggcaaaugcucaccuuucaagugccaauacuuaaaaaaauuaagaguacuguaugcuuaggugaaguacacuugaguagcuuuuguccacaggccagcauuugcugaacuuugccaguaagcagggcacuucaugguaaacugaccaauugcagugagucuuuaaagcccucccugcuccuugcagucauuuauugccaugucucuagaguugcucuuuauuguuaaaaguuaauuuuuacuuaccuuuuugguuacuuucagaucagaaaguaugagucuaacuagaugaaacuuuauuguaauaacaguuuaaacauguuuaaauauagcauuauguagcacacggacauaaccaaacacauauuccuuuucuaaccagcaaaaauuccaggaaacuuguagaguuccucaucuucuguuguagauguuuucagugucuggacagaguucgcgguaccaagcaaauaccccucaccauccugccucacccacuuggaaacgugaaagcugacucgggcacuuuuggucagcgcuaauccaaaccaggggacacacaggaguccucggccagcaccuuggcaccacaccuucuuugugacggcugugauucuagcagcacacacaaccucugcaauuaugugugacuuuaacuaauuaccugucccggcucugcccaaaccccuuucccccaaccccugguucccuuccaguauucuaguucaugccugaggcccuaucuugaggaauccucaacagcccuggucacaaacaaaauaacuccuucuaggaauucuauuccgccugccgaguuugcucugcuagguaucaugaucuguucuacuucucacccagccuaaguuuggccauaauaccggcccagcuauaaaacacacucauucacuuagaauugcucuguguucuuucuagguuuauuaaaaaagacuaacacacacagaguaugaaguuugaaaaugcaucuuuuucucauucccuuuauagcugaacucaaaauagcacucgucccacucgccccuucagagaaggagcugcuuuguuggggaagguuuuacauuucucucaccuacuuaacacccugcauauacacuuuucucaacuuaucucaguaaguugauucuccccaauucuugcuuuaugagaugacuggcauguccaacagaacuuucugcaaugauggaaauguuacagaugugauggcuacugagcacucaaaaugugccucugagaaacugaaacuuuuacuuuauuuaacuuuaauuuaaauugccacauagugccaguggcugcuguccuggacggcacaggcagacucuugguauucccaucaaaggagaggaaggcaaggcugugcuuuccuuggacacaacugugcuacugauugagccucagguguuuacccugaagcuauaaauccaggcacuuguucugugaauccaguggaaagauuccccaguucaaauuccaacuuacccauguuaucugugucgaguuucaguuuccucauuugugauaguuaccugauguauguaaacaggcugcugggacaaucgacugagacaaaauggaucugaaagcacacuguaaccuaaauaaacacccuacaaauaggcaguauuuaugaaacacuggaauuaaaaguacuauagaaccaugugucaauguacagcucauguucuaaccauuuagcuauggauguaaugggaaagagacacauucucucccuauggauacuacaccauaucaauuauacuggaaagaaguggcaguguggacaacacacguguagaaaggacacaagagguggcaaguaaaacgccugcauucuuucucagcagauguaaaccuugacucauugcuuaccaaacacacuaggaguacaaagaaaaaaauaaagcuuauucaauugaaaaacuugcccuuuggcacugaaugagguuuuccagaucucuuuccagccacuucuucccaagauucaaaaggccagcagucauggacaucacccaugccuacauuuccccugagcccucaaagaugaaugggacaaucugagcauuagacauggccaugguuuaaaggugaggcacauuuccuccaacuucaaguuucccucaaagacuaaaacacaaagucucucguuuuuaugcuuauuucaugaauaucuuuucccaaggcuuugaguuccaggucuguguguuuaauauaccuagccuaauacuaauugcaaaguugguccucagaacuaaguuaguuauauaauagugaacauucuuuaauuucuucagagaguccuuaaugaacucaaauucauaauuuuuaaucaccguaacuauguauuucuuccauaugggccuuagaauacaaauauuuguuuucaugauauaauaauaaacuucuguaaaaacaagacugucuaccccaacagacuauaaacgcuuuguggcugagggucaaagcuuagcuauuaaaaaacgacaacaacaacaacaacaacuguggguauauacaacaucucucaucaccacgcacuugaucaguucaaaggcuguuuacugaugaguccaaucuuugguugaaacccaaugcacuuucuggccacauccuuaaaacaauuuaugacaacuuucuauuaucuggcaggccaccaacgauccuaacagaacuuacagagcaaugguccugaugcgagucauucuguucugugacuugacauagaaauugcauuugagucuuaaauacggugcuauuucaacaccugucacccuagaaagauaguaagucuuaccccaaaacaucucaggacauaauuuucaguccccuugauucuaaaaauacugagugauacagaucugccaguaugccaaagaaggcuugugccaucugcuucguucugcucauguugauuauuuuggggaugagagaggaucagacgggaagaagaacauauauauaugguaacagccaggaaagacuguguucccaggggacagggguauacgaggguggaggggggagucagaacacaacuguaguuccaggacuucuccagugcuacauaacacaucaucuaauggggcacaacugcuuuacaacauucuuaaaauaaacugugacuucuggcaucuauuuccauuguccucagugacacaaucaaugcaaggcccauuucugagaggaaagugaauuuccacuuuuggucuuccaacaaggguguuuuucucaauaucaguucuuugaaggacuuugguagcagucucuaucaaauuuaaaaaagcuauuuagaaaugucaucaggagaaagaugauauccagaaccuccagguagucauggcugccauggcugcagaccucacucccaucauggccggaaggcaaggccaaggaucacuccacuugcuguuuccuuaaagugcuacuuucucucacgcuucuggcuuucucccuccuggaauguccugggaacccuugucuaccuggcaaacuucuacuuuucucugucacugccaggcagaggcacgaguuccuccuccacacggugagguguuuacucaauggcccaguagagaucuccaccuuaauauguuugaagagcuuucacucuaguuuauccucauuguaggaagcacuaccugcccuucuauucugcucugagagagccaccugcugagccaucagguuuguugccuauagauucuuuucagcugucaccuugaaagacugaauuuuguuaacccagugacuaagcucuuacuuucuaagaaaugaggcuuaagauaaacaagaaagacaaagugaauuauuucucuaauauucagggaaaaaauugagaaagcuguccagaugauuaugcuacagcuuuggaacaucaaauccacauccuagccagaacaucugaaaagggacaggguguguucuguuuacaaauaguguaauauuugguuaaagauggccaacugaauaaaagcauguagcuccagucucucugaaaauucuacuaaaacaguaauagugggauuuuucuaaaacacagccuaauauaaaagggagaaaacaacaaauuuuggaagcugaaaagcagguaaacaagcagugaucgacuuggccauccuaagaaagcuaaaguuuaagccagcauuaagaggcaacaaaacaaccugcuauacccugaagcaucuaccauaugucucugcaauuugguacaguagguacuucuggaagugaggauggaaacagguaugaaagcagcaggugaaagucuguuagugaagcacugagcccuccugaccucuccugaugccugcaguggggugccugcccuuccuuccccuagcacaagugcucgcuauggagacuguaugaaagugggggaguagccugacacagggugaauguccucucucucagggcaggaggauggaggagucuucccugggaagcugaccagcccaagagaaaagagcaaaccauaaggacaaaggggguuuccuccaggggucgccaccuuacccuauacaaggccccagcugacaagccccaccuaaguauacaaagcucccaucagcucuuuacuggcuugacucacaaauuaguaggccaaggaucaccagaaaucagaggaaggcacuuaauagggaaaacugacacaaaaaguaacggggaaaaaaagacuacggggggaaggaaacuucaaaaauaauaaucauuaauauccuagagagaacagagguccuuaaaagaagagcaggauauuauuuuuuaaagaggacaacaccaacaaaaaggcaguggcagugcaagaccccaggggcugggacaggcauuugagucaaacuugcaaggggaacacuugagaacccagagagcaucugagagucaacaccaugaggcagccucuuauaacucagcuaauauaauccagagacuaacauucauugacuaaaugguuaaaauauguaucauuucaccaagaaacaugaaaggagaggagaugauuuuuaaacuaacaaaacagaguauacuaucuucaucacaugacaaaguuaccuauuaucauugcuugcaugaaacauucauguauuagaagucauggauaauacgauacaguaagacaauaaacuaaugaaaggcauaaaauuggaauggaauaauuauuuauuugcagaggaaugucgauauagaaaaucccaaagaauccacacacaagauuagaaagccuggcaagguguuugauuauaaaaaucaaacuacacaaacagcugcauuucuaaauauccacaaacagaaauauaguuuaaauaccaucauauuagccagaaaauaaagacagguaacuagugcccagccaaagggaaagagacaauaugcaagacuggaaucauggacaggauauauucaaagauguguuuccucaggaaugaauggacagaauacaauuacauugcucuauaaugacauaugcaugaaaacagauaaauagaagugaaaaucauuacuaaaacuugagguggugguugucuaggcagugaccaucucuugcuugggagaucaagaaaggugucacagagaaguaaaaguugaagcuagcguagaaguuuacaacguguucaagagggagguggucuauuucaggccaagggaaugaauccaaccaccuggagaauaagugguucaguaagacuggaauacaggugcagaugugggcaaaggagaaaacaggcuagagagauggagaaucgugaaggguccacucuacaaggggaaggugggcuuuuuugucauaaauuguuuuuagcagauugaucuauuuagucaaguccagccacaaacucuugaauuuauguggagaugcagugaggagggcgggaagagaagagguagaaauagguagagaaugccaauaaaaugcugugaggaaugggaagaggcaguggggaaagccucagccugugauugugagccucaaagggccacagaaaacugacaaaaccaaacuaccaaggggaaaggacgacccaggcgcucaccaccagggagcugggcaauggggaccgaucagaagcaguggacuugccaccagauuucacuuuuugaugguaacucuggcagggacguauaagacaugcuggaggguggugggcuggauaaugagaucauuuaggcuucugccagaucucagaagagagaacacaggccugcacaaggagagagggcagguuccagugacacucuguaaacagaauaacuggauuaggacugagguuaggggaaagagggaauggugguggcagagagagguuuucuucugcaucccagaagaaaaacucagcaaaaaauaagcguuaggaguucauuuuuagacaugcugggcuuaauggugccuaaugggcauucgggccagcaaggagacgugaagcguggaguggcucaggagcucuucuagucuagggaagcggaugccuuucugaaccuaacuuauacaggcgauuuuauaaguuacucugagcuuuccauggguggccucauauccugucagugacucacguguucaaccuugaucaccaauguuuuccuccuagagugguuuggucaagugggcuagcccuggggguaaggaggaauuuguuuucuuuauggcaggcugcagcuagacugagacucccuuaggucaucuacucugcacuguagcccggauggaagcagccuugugggggcauggaauucucagagcuccaaagacagaagcagccuucugccucaaaauccccccagcuccucuuggauaagauggucuacugauaggccuauggugauaaaaaugagcaaaaugagaauuaagucugaguucaaaaacuugauguugguaaauaacuucuagauggugauaguacaaacaagauccuaauaaacaaacaaacaaacaaacccaaaacaaaaaucuuuugguuaucucuucuacuagaagaagguaggcuuuuuauagaugggagcuuuucuuugcuauauuuagcagauugaagauaucuaaccuauugagucaagccuagccccugacugcaucuacauggagauggagugaggugguagagguagaggaugccaauaaaacguucucaacugaaacaggaagaaguccagagaagcuauggaaaaggcaaaagccaaugaaugugagccuuggagagccacagaggacugagagaugcugaacuaccaagggggaagggaugacucugaugagcagggagcugggaucugucaccccagaagugcuucaucucucacaggucuggggccccuuccaccacuggccuuccucauccauauagcacggaagcaaggggcugggacagccaggauccccacgaaagggccaaaggccuucuuccagaugggucauccaguauaguacccaccagggggaacggaggaaaagaaauauuguugcagacucuuggaucuuugacaggccuccucaccucuccccaccauaugcauuguauuuuuaaauagaaacagucacaaaaaaauagacaaaugucuacaaguaaaauagaugugugcauugagaaaggcaaggguuaaguccaggccugguucucaagcugagaugggacugccuuguuugaagaggacuauuuaugaaugaagacucucaggagucuggugggggggugagggguggagagcaacucccaaaauccagacaagagccuuugguauuaggggaagauuuucuaauuguuacagucaggaauggggaucauuccuuuaugauagcugaaaauacaucccccuccucacucccuagaaacccuugagucucgccuuuaggcccuuuuagggucugcuucuauagcugauggcggugaucucuuuuccugggacucuuaaguguaggacauggaggaaccagaacucuaauuagcagcaggaccuauuauuuuuccaauaagguuaacauucaagggaaagaaaagccucuuucuuucucaggaagugugugaggauauaggcucacauugagaagagaaaugugaaaagcauauuaguuacauugaccaugggaugccugguuugugagugaaaaucaccggaaugaccuugaaggaucugagaucuagaaaggaugcucaagacuuggguggacuguuugauccuaaaauaacauaucacuaaauaaacagaaaaaggccuugaaguacagauaacuacaugggagcaggguaucuugacacuggauuuauagaugaccucauuguuuauuuuuugaauaucugcacuuucuaaaguuugauaaugacuacuuaggcugagucuaggaguauacccgguugacaaauggaggaggcauauugcagaggcagaggggagaacagagaagagcucggagucaugaagcagcauagggcaauguggaacacguggugcagccuggcugggaugggcaggagaggggccugugucagaaaaccaauaacagggauagugcaccuggcaggggacacuggguuuauccuacagggaacugggagccagugaaagugaggaugucccaucuacagaugaauugcagagaggaaaaaguuacauauaaucacuuaucccucccccauggguaacucaguuaccuggagagaacagcagauugaaagguacuguucugaaaugcuaacugguucuuuuuacaugagaugaacccaagaccaaaucggauuacccuagacacaaauuugaugggcaguuuuaaaguaacgugcaguaacuuuucaagcucgauguagaaauauccagaacuuauaguaaacuguguacaugcaugguuaugugagaaaagugaagcugcugcaccuguucccaagcucacuccacuuccuccagaagcaugccugucugccucucgggacacaggccguacuuuauuagacacaauuauuucaagaagcuugagaauuuucucuuugccuuuccaugucauguccaauaaauucaaaggaugcaaagcaaauuguucauccaggaauaguuaauuugagaaauaaaaauauuuaucacugguccuuuaagauuauccugauucuugauuuuuucuuuuuaaacugauuaacauuucaucagguuuccauuuuaaaagaaaauggcacugaagagacaaggcaaguuuuccaagcgacaacacuggcuuuucugaaaggggaaaggaauguuaaggaaaugggggagaaagcuuaaaaagaguggaacacuagcaagcagggccucuucuccuuuucaccuuaagucuuuuuucucucccauucacagcuuuagguccuuuguuuguuuaacaaaccauuacaaucauacccaguucaaugggggaggaaugugaacucucugaguagcuguccuugcaauccacaugugugguccaucccccagcucauccgcaggcagcuuucaugugcugcucugcgcuccccgucgccccggaggccggcaccuugcucacaauaagccucaauuucccaccgcugccugcucgcagcuccuccccagcagcugagagcaaugucucaaguggcucuuccuccccugcuugccuugcaaucauacuguccacccugcuuuggcuggcccccuucagcuccugagacagacaaggccugcuguguuagccacaccccaccuguucgcagcccauggacucgccacugaauacuucggcagacacauuccaggaucuuccuggcuagcacuccuagucuucuaaugucaggcacacuguaaacagaagauacaggcaagacgcucccccaccccaccccaacucccagcccuaacuagaacugcuagguccuaguagauauguuggcccuguugggauuaauuucaauuucuuggucaauaaauccaaauauuuagugacaauauuguauuucaguaggagucggaauacuauuuaauaaacuauuucaguugagcucauaaagcucucucaugcuauuccaauaauuuccaucucauagcccuaagagauagguagaagggcaucauuguccccauuucacaaaugaggaaacugaggcucagaggauuuaaguuuacugcccaucagcauggacuaaugacauacugcaaguaauacacuguccuaagcaaaacgccuagcacagagugagugccccaaaggcauuagcuucuauuaauaucauuacuggugaugaugauaaugaugaugaacagagguugcucccagguguucugaacuaagccaagugcucuuucaaccuacgcuuugccaucccuucuagccacacugucuacaugagcagugaaguucagcaacugcuuuacaacagcguuuucaaauaaagccucaggaaguauggcuggauugccucauguggcugggaugcgaccagcaucuuucccaggcuuaucuuucagucgacaucugccacaaagacaggacaaccucuuacacaucuuauguacacaaguuaggaguguuggcaggggcagcuuucuucuuuugaacugacaggguugucagcagaaaauuccauagaucuauguguauuacuaggcuguggaugugggacagcagaggucaugaaaaguugcuaacugcaucauccaauucccugaaacacaugugcacugagcuuuaaaaaaugaaagggcuaaaagaacccuguucucggguauucugcaguuuguggaggaaauguguuuauuuuccacuagaaccuuuuugaaguacccugaaccuccagcauguucuugccuaugauguguuuccaagcaaucguuaauaaacaugcccaacuagaaauaaucuuaaaacaugcgcaccuacugagugacagggaacaucugcugcgaggcagggaccgaguccucccagaaguuugucugaagauucaaaccugugagaagagaccuuguacaucgucagggaaugaagcuaggaaaacauuccuccauuauguuacccccugaacuucacuucuagagcacacacacgacuggcgaugugcacaggagauuuucuaguguuuuuucaugcauuuuaauagaugaucuuuaaacacucauauccuuuguccuacuugcaacuggauuaagaaaaacucucaacuuuuccccugcuuuaugcaaguggaaaaaaaagaacacacaaaauugcuuacauaauauauucagaacagcacucagaggaaaugguauuuuuuaaaaccaacaguauuaaaauaccauaaaacagguaugcaaaucuaugcaauaacagaaccuaaaacaaauucugaauugaaagaaagucagcaaauaaccaguuggcacucaacaaaggagauucauauaaacaaagauuuaucaaauuugcagugcaagaagguugaagucucuaaguugaauacugaauuaaaugguuacuaaaccuggcuaugcauuagaaucagcauggaaaacuuuuaaaaauacagauuccuggguggccacagggcaaaucaguacagacuaaaacagcaucacugggaccccaggaauuuacguuuuuaccaaaucuacagaagccaagucuacagccagcuuugugccacugaacccugaugagcauuuggaaaccagcauuuccguucaccaaguaauuaucaaacuuggcuucuuccuaccaaggcuauuccaaccaacugauccucuuacagggaaagcuuuucaggauuuucuuaacuaguacaaaggcaaaucugcuauggaacaaagccaauuuauaucucgccuaagugauuuauucacuugccuauuuucuucugugaauuugaucaaaaaggcuauguccauuuauuuuguaugagaacauccuuuuaaguuaaaaauggaaaaaccaaggccauuuugggacaacuguuuuuaacguuaaugcaucacaauacaggaaaauacuggaggugagcagguuauuugccugagucauuuagggaaauuguuuccaacauauuccuuguuuugcuuguauaaacacuuuacaaaucaucuuuaugguccaucucuuuccucaaaaugcucaacauuuauugugcugguuuaauuggguggucuccaaaggcuuguauaaaauuuuuuuugaaagagcuuuaaaaagacauuaaagcaaaagaguaaaauucuuccggaugauucuuccuuugcaccuacccaucucacaaacggacaauaccaauuuauguauucaaagaggcagggguucuucugcuucccaggaaagggugcacauaacgugagguacgcaaaccaggcagugaaguagcuuagcuucauugucaaaauauucaaauuaucacaaaaagaaagcgauuccuuucugaauucaacaauacuccuuggccuccaagggcucacacaggagcuuauucuuaagcuguucaauguaagcagcacucgugaaagaggagaacucuggcagggaggagaucaaaucccucagcuuuucccaccugccaucucugcgccagucuaaugcuuaaauaguuaacaaugcaacagagagcccaaggcaggccuggucuggggggaaaaucaugugcaguauaugacgauuuaauaaagcagagaacagacaggaaaaauaacacaucucaguuugacaggaugcuacuugcagauugcuuuucaggucagaauuuagauuucuaaagcagagggaaaaaaggguuuucauacgucaauuauucuuuuuuaaguaugugguuaaaaaugacccuauaaaauuaaacaauccuaaagauaaauguuuccgaguuccagaguaacaagaagaaucacauuuuugugggagugaagacuggcagaugguaaacagauuaguuaauuguuuuaaaugaagggggaaauauuuuuuggaaaguuuguuuauucguugaugacaaaaaccaaaguuucauagaguguaugaguuccaggauguguuuuugcugucacaauauguuuuucuaggcauuugcuucugagaacagcauuuaagaacccgucuuuuucucucuuaaugaacugguuuagccgccugcugggcauucacugaaacccacauugaacaaagggauuuccuuccaguuucagcucauucacuucuagcgacuccugguuuuacuuaagcaaauucuccaaacugacuuuuuuauuucuaaugauuugagugggaaagaauugggcaacccucaaacacugggaagucugcccugguuuucagugaaagaauccucuaggcugaagauguacaagguuuguuuuugaaaagccucucgaauauguuuuauuuuauuuuccagauggaaaggagcccaccugauuugguagauuacagacaacuaaaucuuauuucagcaagauggaucauggugaacaaugagauuauuucuuugaaaugaagccugagugggauauucagauucaccuccaggcaaugaugucauuuuaaaggugacacuggggggcaugguaugaagggguugcuggaaguuggaauagauuugugggccuggcagcuggucuucuaccuucucacauuaauacaugaucucccugggggaccccaugcacaacccaagguuacaauuacuccuugaagucagaagccucccaaaucucuaucuucaauccugaacuuucuuucaaauuccagacuaauacaucuaccucccucccgcagcucucgggauaccuugcagugccccuucaaggucacaugguggggcuucaaacguuaacccacagacuugcuccuccuccagcacugccuguucuagcuaauggcaccgcuaugcaauagccaucagagcucccggauccucaccaggugauggcuacuguuuuaagaacuuuaccuaauaccuucaacaaccgcaugaguagguagcauuaacccuauuugauuaauggggaaaguaaggcuuagaaguuaugcugauuugcccaugauccuacagccagcaagcaguuaagcuugcuguagaauccagggugcgugucaaaagucaaccucuucccaugucacuucccagccucuccaaacuuagaagcucugcagucuagauuguucucagagauuaagcuuuacaacuuuauugucucucaaaucuauuuccuucucuuaauucccauagcuaccugcuguuugggugauguuuugcuuuuauuagggccuccaaaucagcauagcacaacaacuccagaauuuuacuuuguuugaauucccaaugauucuccuuucuagcucauuuaaaacagguggcaggcuuuguaaucccuuguauuuucauccagcugaagacagaagcauucugaagaagucugucuuuguuaacaauaucuaaacccagagaagaaauucugcuggacuucugggaggcgagaaggagaagcagaggagaagcugccaaaaugacacucucccuuccauccccccauggccaaccccccaucccagggccugauaaggagguaugucaguccccagcaauagaggcccuggcaccccucuguucccuaaggcaaugaguagaauccuugagaagacagcuacgugaagagugugccucgggaggccagaccugaggcaggagguuuccagcccucacuggcggcccuggggcagacagcuacaaggauucaauaaaucacuacuuugauaaacugaaggucagagguggguuccucaucuuccagaggccaugaaaaucuccagguccuaggacacacuccaugggggaaggggaagcaccuaaaucuuacugacaugaaauuuuccucuagguuggcagaauggggacuggaguccguuuucauuauggggaaugaaaacaguaaugcuucuugcauaguugacacucugaggugaaaugcagacuuguggggcaccucaauaaagugcagaaucuuagaacagugcacaucugugcuauagacuagcuacaacugcuggaacuggagccaaucuaguuuucaaaaaaggccaccgcuucguuagagagaggaccauggacucugcauacgcucuggugaccuaggguggaggggcgggguggcggggagggcagcaggcuuaugcuuuaaaccccugaggcagauagagaaggaaggaaggaaacaagggcagauguuagaguauacucacaagauuaacuccucugauuccuaugcaaauaccuagaaagggagagacacacaaaguuaucuuuaaggucuuuaucuugagcucugaauugcuaaaacaaacaaaaacacccaaguggggggggaacggaagucuacuuggaagaggaaagagagcagcuggugcugcuggagucaugagauccaggacacccccguuucccaagccuggaugugccucccaggguagcaugcuggcacggagcgggauggcugauuuccauaagauggaaaugauugcaugcuggaaacugagaugcuuuaggggagagaagauccuaacccaaaagaaaggauauaaaucuuuaaugugucaaauuuguugacuguaagauguuguaguaauggucaguacuugcagcaccaaaugggcacgucuaagggguccgggcuuugaaaucagucacguuauccaaacaaauuccacuugaguuccguggcugaaugucugagaccuucagaagaagcuuauaaagacccugcuggaaacugaagaggauuuuagauacgccaaagauaugccggccauuacgcagagacuagaacuuuuagugcugagagcucuggcugggagaaccucacauuccuaagaaucagcaaccaagggaccccauuuuucugccaaauaggcacacuauuaaaucugaugggcaugucaagggagaagaugaccugggaaaggaguugcccagggagcaagugcccuguugcagaggcagagauugccaagauggucuccuugggguuugaggcacaaagcccccucuagcuauuuuaguuauaaggaggugggaacgcuguguuaaauuguacccaagaagauaacucacaaggcaaggaacacggaagcuaggguguguugggcaaguaagcagagguugcuugcuuuaccgaaaguggggcugcucuggucucacaagggucuagccuugguuggcacaugcuucccuugucacaccagacaggugagaccaagaagggaagacagaaagagaccccaccacuuaacaugggcaaauaccuacaggaggcuacuuuccaaucuguggugcccagaaacuuggcagggauagggugguugcauggggagggaugcuagagaauggagaacgaguucacucuauuggcccaaacucaauuuucauguggcuuccuuuaaacaaaccacaagcuuagugagucaguuaggucaguguagagagauauuuccgcaugcuagaggcagauccauauugguuccccagucuguuuuuggacgguuccccuucauucuaaucacaaugcugcugccaggcugauucuucuaacaugcaaauauguuccugucacuugccuguuuggaauucuucaauggucccauuagguuucugucgacugcaacgaaaagucuugucuaaucagaaccacugaaaguuguuaaucaggagagcaauauguucaggcuuguguuauagaaagaaacugagagagcagacauacagauuauccuccuggauuuaucaguuauauacauuaaaauggccaaacaguaauucaaauagcaaaacaaacaaaaaacccaacugugcacacacacacaccaaaaaauaaguacaauaacugaacucugaaguucaguauaaaacuguucacagagcauucuaaaucuucccugacucagcacaacaucuuugugcacucugauuugaauauguggggcaaaugagaaccauuuuagggaaacaacauaagaugacuaugaucuuaaugcgguuucaauuuacauggugauuguguguuuuaugaaccaccucuaauuccuacugcuggaacaaaaagggaaaaauuaccuugguaaaugccacaucauggaucaauuaaguuauuccccaaauaaaguauucuuuguuauaguauaagcaugcauaauuucuagcauuuuaaacauugauagagaaauuauuuucuuuucuaauuuuaauauuuaacacuccuauguuaugauccccgccucccuucaucccccacugcuuucauuuuaauuuuuuguuuguucauggagggaaguaaggaaauuuuaaugauauuccuuagauaauacauuuucuuaccuaaaagugguacaauaauggguuuuacucuaccucaguccacuaugcagcaugcauacucuacuuaauacuagguuguguuccuacaguuaguuaaaaaaccaaccagcugguaguauuuuuuuagauccaaccuaagaaagacaguguggucuaguguagagggcacuggcuuuggagucagaugggucuaaguucgaaugcuggcucugcugcuuggaagguguguaacuuuagguaaguugcauaacuucucuaagccucagucuccgucaccauaaaauggggauaucuauguaucuugcagagcugauauacgguuaugcguuacacguguacauacagaggcaaaguacauguacgaaguagauguggccugugaauaaguguuagggccaauuuuacacgauggguaagcucacaauuaggaaacaugaauaacuucuuuuggaguaauauauauauauaauggaaagucagaguauaaauaauggauucacuucaaucauguuucuuuaauguggaucaucaugacacaauuccaucuccuagcauguguuuauaaaauaaauuucuauuaucccugugcuuucacauuuucucauauauuugagaaauuccuagauucuuaagcaguguaauccuauuuaaugugcuguuaauggcaauaucauguuuaacuagagaaaacaguuacaaaugggccuggcaugaacuaguccuacaggugccauaaagcuacccaaaugguauaaugaagugaugagggcauuuggggauucugcuacauuuuuuuccuucugaacguguugguggggguaguggacuaguuuuaauuagaaucguuuggagaacaggaauccaagcacacgaccuaauauucuccuaguuagccuucggccugaggcagcuguggacagccuuccuagaagucagucucaagacaaagaauagagcgggaagugguuuaucuagugggagguuugcagggggaauugaauguaagaugggauauaagaaaacuuacaaaaacaacuggaauuuuuaaaaaauacaccauuaugaccaucaaggacauuuugcaaaaaaaaaaaaaaaaaaaaacagucuggagagaggccaagaguuaugguuaagcaacagcacugcagcugcaaaagaagugagggcugcuuuagggugacauggccuugaaccuagaauuaauguaugggacagggaaaaacaacaaacauguuagauaugaaauuuaaggcugggauuuggaaucauuaucuugaaauaggcaguucaaacaaauccuaaucuuuacaugagugauagaaaauaagaaauaaaaacuucugauguauaauggggacccugccaaccaugaauucccucaaauaaacacugguugagugacauaaccuauuucacaacucuagaaaauuuggcaagcugagaaucaucucauauuaugauuuuaggagagugguuuagagacucugaauuguaacauacguuacauucuagauaucugauucuaaaugguggacccuaccucaguuuuuuuuuuccuaauauuucuuuaagauaaaaccauuuaaaaacaucuuuuuaaaauauaacagaaagagaucacgaaguuucuagugagcaagucaugauaaguaaaaaucaacuguacaaugcccaugauuucuaauuuaagacagauaaauagcaaugaucguucuuagcguguccucuugaauuuuuagagugaaaaacaggcuuucauuaaguccacaucuuaaucccccaaccuuauuuucccccucaaggccugaaguuccucaaauguaaauucucucacaaagucuuuucugggacauaagccccucuaccauggaggaggcgaaggcucugguuugugcuguaaugcgaggagagaauaagaauacagagccaugacugauggcaggagcacuggggggcaggaguuggaggguuccgcauagacguauuuaccuuucuaagugagguacagaugaguuucagaugugacacgaggcagcagccacauuagacgugacagcaauccuaaaggaaaaacaauaucaaaaguuuaaaaaaaaaaaaagcaucaagaaaaaacacauugguacuaugaaugcugacauuuaccuaaucagaauaugaguucaaggauaccaggggucaaaaaucucucuccaucgacaugcuaugcuauaaugccauaucccagcauuccagaggcacccauuugaguccuuaagggaucuuuaguuuuagagaggcuauacagugaugugguuaagaccacaguauggugccagaaagcuuagauuccaaucuuggugccaccuggagccacuuagagaccucaugcaauugguuuucucucucuaccucagcuuccuguccuguaaaauggagauaacgauuacacccacaucacaagacccuuuugagaauuaaauaaacuaauuugagauaaaugcuugacacugucugguaagcagggaguauucauguauuuguauuuauuuuucagagaccccaaguaaaaauacagccucaagcagaaauuacaaaauacucauggcugggcacaguggcucacacuuguaaucccagcauuuugagaggccaaggcaagaggaaugcuugagggcaggaguuugagaccagccugggcaacauagcaggacucaaucucuaccaaaaaaaaaaaaauuuuuuuuuuaagucagaaccuuuuuaagagcgucaacuaagaagaacacuauuccuuuggguaagggaaacaagaaccucagcagggaugagggugaagagggggagggaagaaaaagccacuaaaaggcaaaauaugggggaaaaaaacaccccacuuuggcuuaacuucaauuuuuuuuuuuuaaagucaagaccacuauuaucagcagaggccuggagaaaagaauuugcugugcagacccaaucauucaccuugagauaaggaaaaggacagaaacuggacagcaaaugaugagagggcagcagcaaaauguuuacagacugaaaagagauggaaauauagcuuucagugaaaauaaugaagacaggaaauagaucaauaacuuaaacccaucaacccucaccuccacagauauaaauucauuacugauuagcagugcaauccaauuggaugaauacuugagcaccaacccuaaguaaccuccuucucugaguagcccacauuugugccuugaccaaaaaggcugcuguuguauguguuuuuaaaauaacgaaaccauaucaauuugaaucuuacuaaugcaaaaggcauaaacuuuuagguauaagcugaguuuggguuuuuccuccugaauugagguuuuuccuugcagaaaaaugucucacuaaagaaggcaauauguaauguugcaaaguaaacauuuaaacuacugaaaauauacuaaguauuuuaacaaccucauuaacauacaaaugauuaacuacaaaugauuagguaucuaauuauuacagaugaucuuuauaauagucauaucugaucuuauacaacugacacauuauuuaauuuuagauaguucuguauuucagaauagcuuucuugcaacuaaaucuaguggguaaggaggaugucuuguuuucaacggcuagauaaacguuuauuagggcugcuuuauuuggucagucuggguggacgggaaacugucuaagagggaaauaucugguauuuuucuacuaggaaguuagcuuacguagauuaacacacauguaaacacagagacauaacauauguccauccccaaaccuauuuugaggguuucucuuaaguuacuugaaauucuucuucuuggauauuacagcagucuucagucugaagaaaaaggcucuuuucugaagaaucacauaguugaaguuaucugauucuauaagcauagcaagaccacaauuuuuaacugcaguuacuucccuggccugucuguaguucuuuuuuauuaauguagacaaagauaugccucacugcugaaagcugaaacaucaaauggaaaagugcaguuugauuuccuacauuucccuccacucucugccucucccuacuuugguauuaugucacacaaaauuacuuccagaaacugggaggguugagcagccaaguuaugaaaucuaagugcuaugcuuaaugcuuuuuuuuuuuaucuucaaguuaauacuuaugagggugagagucuaccaaugaucaaagucaugguaauuuuucuguuucaugagaaaucuaaaaucucagaaucacaucccgcugacccgacguuauuuguacaacccauacaaaugccccuuccucuacgagauuccucccgcaauucacaaauguguaaaccucuauuuuaaauuuuaccucuaccauuaaucaaaacagaagugcaaauaaguuuccuuaaaaauaaucuugguagugaacauaaaacaaaaauaacauggagaguaaaguauuagcccguuccuguacuugucugcuuacuuacucccuccuacaacacuuucuaaaaauuuccauuaugauuuuaagauguuauuuucccaauaaauguugacaacaauuucccacuuccagcucuggcuuuaaaaagaaauagguuauaaguugagaauagcuaagaaauuggguuugucccaguguucugugaaaucagacuagucagugcuucagaaucaaaauuucccuuagacuuuucacuaagaagcaaagcuguuuguuugccuuuucugauaaggaauucaaaacaugcaaugguaguaaaucugguuaaagaaauugucaagggagguuuugacuuuugcuauuauuuaacauuacaucauagaauuaaaucauguaaaauggcagccuuauccaucucaaucacuaaauucggucaaguaaaagucuacaaaauucuaaaugaaaaguuuuuucaucucauuaauggaaauaucuaaacauuacguugugguuuauuuuuaggaaagaauaacagagaagagagcuuggaucugaaaagaaaaaugccacacacuggugaugcuuccuucuagaggcuguggacugccugacaaacuugcuaaagcaaaaaagggcauaauaguucucugcagaggaagaauuuuaaaaagcaauagcaacaaucagguaacagcagaccaaucagguucucccaaaauuuaguauuugcaguugaaacugugauaaguaauuacuuucaaaggaauguagacagagccaucaauccccauucauucagcucgcauuuaccgagccaagagcucugcuaggcuugagauauaaaaaugaauacaacacagcugcuuuacuuccagcuaaaagaauacaccuaaauaaagagcuacagggccauguguuaagugccauaauagagguguacacaaagggcugggggccaaaggaagaagccauaaauucuuccugggaaaucaagcaagugaggggagaugugaaagaagguaucucagagauguuuccuugugauaaucucaagacuuuuucuuuaguguguucuaaaaaggugguaauuuuaagauuuaucaacuauuauaaugucaggcgcuaaucuuggucugcuagccaguuucuguuugacacacacuuccaguuacaauaucccaagaauauaaauauuuuaaaauaaauauauuauuguaauauucccaugcaauacacacaauccagaauggcaugaaucacuggcuugaguggaacguagcuuccaaguucaaagauguuuuaaaauauaaugaaugaaagauggauuuuagagaguuucauauaauaucaauaaugcuuacuguaucacuguuuucuuuccucucaaggcaaaaauaaaagaaucaccugauuguaucaugguuaauauuuguuuuacucuacuucuguguuuaaaaaaagagggcggguggagaaucaacuucuacuuaacaucauuuauuaugcagaccauauuccuacuuauaacauaguugugacaaaaccuccauuguucauuacacacuagccccaaacuugaguaauucuaauguaagcaugagaaacucccgucuccuuuggggugaauuucccaauuccucuguguuaaauugaggucuaauuuucccugugccugguuuucacaagaagguccauuccaccccaugugcuccuuuucagcugucaauaaacagaggcagugaauuccccacggcuucacaaagcuaguuaggcagagccauucauuccuucaggaaaacagggcauugauuucagcgaguucccagggagcagcugcaacaaagagaucaaaggcccaccucucuuucccuccauugcuuucauuaggcccagcccagacaaacagcgacagguuuccuugagacaaggagagggcucagcagaccaccucaugguuuaauucaaauucauccguuuccuacauuccagugacaguucagaaugcuaaccaugacaaaccagcacaaucacccagcauaauauacugcucgcuaguucauccaaggucagagggagaaaacaagcacggggggaaguccucugcuucuagggccugcugagcuucaauggcccccugacauuccauaaauaaacuucucccucucacucucccuuucuuccuccauccuacaacccuacaagcgauagucucacugaacaaucugcaacuucuuucaugucaccguacccaaacuauauggaaacuuuauucucaaucgaaugguucguucuaauagccagaggaagauggcuauacacgcagccucuauuaguucacugcugugcuaaagccagucggcuacacccaauaagcuacuacaacgugaugaauucagagcugcaguuucuaggguuaccuuaguaaggggugaucuccagagcugcaguuucuaggguuacccuaaggggugaucuccagagaaagcaacacaacuuaaagauggaguuaguuugcauaaauucuguuuguacaacaaaagugugaacagagauauaacagguuuuuuuggauccagguaaucacccaaacuggguaauccaagcuccuguguauaaaugaguuguguguuuguuggggugaggaugguuagucaaggagagaggagagagcaagagggacuaugaaagaaaaugaauuacucugacugguuaccuacacggaacaaauauaacuaagagguuuccaaauucaccauugaauucugaauugcuuauuucacaccuucauggaacccuauaacaaaaugccuucauuucauugugcuccguuccauuugucacuaauccugaguacacaugggaaucgauggguuaaguuucaaaauugugaaaccaaaaagaaaauaaacaauauuggaacgaaagguaugaacccacucggugaggcagaacacaaccuucccacgugcccacaggcaucaguacugaucucgguggugggguugcgggggaggucaccagugaccuccagggccaucuauucaccaauuacucaccuuggacugucaaagaugcuauuuuguauagagagcugaacagcccucaaggagaaaagacauucccuuauauucaaauuaggacagaaauggacuuugcauauacagaacucucaacugcacaggaaagguagcuugugacaaaaauggugugacaauuaauuaggaaccuuaaagcuaacucuggcauugacuugcuuugggccuaggggacacauuuaaccccucugucuucccacucuuccaaaaucacgacagaaauaucugugaauuccuugacgcaguacuaugaaauaaccauuccucaaaaacuauguaucucaucaaagaaaccuaggcuuaugaguagaacuuccuuauauaaugaucacccuguaacucaguagagguucucuggaaacuugcuacauuucuauaaaucaaauuguuuuuuaaaagcacucaggaaaaauacuacugaaagaaagucuuuggcaaaugaccaaaaacacuuaucaauccauuuacguaucuuucaaaagcauuuacaaaacacugagaaacauuauccauuggaucucugccacaaccaccugagagagaugguuuuauuaaucuauuuuugaaugaggagauaauaggcucaagagagguaaauugacuugccaaagucauagaacuaauaaucagcaguuaaaacuuuaaauucaaguauucuaucuuugagucucaugcuguuuccauuacaccagcuaccauguacuggggauauaaucauucacuggaguucucucaccaagguuauauuaaauaagucauccuaguuuuugaggccaauggguuguaccacuuccauucaaugagguaguugcuuaagaguauggacucuggagucagaucuguauuuaaauuuuagugucacuuuguaauaauuuuauaaauuaagcaauuaacaauauuuuuggaaccuuaguuucccuauuuguaaaagaggaauaauaaccucacaggguuuguggaggaucaaauuagauaacuaauauaaagcuccuaaaacagcauuggcauacagugaaagaucaauaauuauagcuauuaucaaugcugaaaaucaaaacaguguaaacuuguuaaaaggaaaaauuucuuuuaaagaaaaagacauaaaauuuaacauucagucucuagauugcaugauuccuugcauuaaaaguuuagccuucaaaucuaggauuuuaugggggacaacuaaugaaccaagaucaaacuauuauaaaagagaaagaagcuacuuuacaaaacagaaacacuaauugaagugucguuuuaaaaggcuaauugaggcaaauccuugcuacuauaaagcagcagugugguuuuucugcacaauucagcuuuacuucuugccacuuagccauuucgaguagaaauguauugguaaaagaagaaauucacagacuguuaccacuugaagagaaaaauacacacagggauaucuguugucuguagauagugcuuucauguuuucaaagaacuaacacauaucuuacuucguugacccucacauuacuaagagaaaacagauuaauuauguagcacaagagaagacugccagugguaaacagcaaaccuuauuuuuuauuccuugucucauuuuuucaugacacccuauuacugggcgguggcauagagaugccacaguacagaguguacagaauacugugggaagacagaggccacuaagacugagagaaccagaaaaggcuuugcagagaaggugacauuuauccaaccuuuuaucuaguacagacguacuucuggaauauuccuggucgcccuugagccugagauuucuuuucuuuuuuuuuuuuuuuuuggugaauucugaauaucucacuuagugauuuaguucuccuuauacugcuuuuuguucacuugaaaaccuaaauggauguccucaccuccuuuuaaaaauuucauccaaggccuugauauuaaagaggcaggagcugaagccacucuuguuugacuuaauaauaucaauaccuaaggcaccuucucauucuacaguucugugacuuuuaaaauuacugcuuauucuuauauugcauuaccuacuauacaacacaucacuugaaaugugcaauuuacuuccuguuaauauuuuaaaauauuuucuucauuaccauuuauaucagaaacaguuuaaaagaacucuuaugaauaucuaaaggaauaugucuugcuaaagaaacucagccuagagcuggugaaguaugacaauuguuucuauccuaagagccggguuccuuuuuguaaguaaccaccccuaauucuaucuucucucacaacaugaaagaaacacauuuuuuaaugaaagauguucagacauuuugaagaugauuaugacaaucucugaugaguuauuaauuugagaccauucuucucuucuaacauagacauguagugcuacaaauuccugucuaagcauugcuauaaguugcaucuuagucacuugaaaauaugguuucauuuucauucaguucaaaauauuuucuaauuuccuguucgauuuuuuuaaaauaggcuacuuuuuagagaaguuuauguucacagcaaaauugagccuguuacagcaauuucccauauacucccuuccccccccccaacacacuuagccuucuccauuaucgacaucccccacuagagugguacauuuguuacaacugauaaacuuccauugacacaucauuaucacccagaauccaugguuuagaguucacucuugguguuguacauucuauggguuugaaaaaauuuaugacaguucuccaucauuauaacaucauacagagaaguuuugccgaucuuuuuacugucuaguuuugcauuuucuaaaaugucauauaguugaaauuauauaguaugcagccuuuugagacuggcuucuuuuacuuuaguaauacacauuuaauuuucuuccaugccuuuucauggcuugauagcucacuucuuuuuuuuuuauuuuuuucuucuucuucuucuuuuuuuuuuuuuuuuuuuuugagauggagucuggcucaaucgcccagacuggggugcaguagggcaaucucggcucacuguaaccuccaccucccagguuaaagcaauucuccaccucagccucccgaguagcugggacuacagguauagucuguauaccugagauuacaggcgcccaccaucaugccaggcuaauuuuuguauuuuuaguagagacacaguuucaccauguuggccaggcuggucucgaacucccaacuuucagugauccacccaucucggccuccaaaggugcugggguuauaggugugagccacugcacccggccagcucauuucuuuuuggugcugauugauuucguuugugucacacuggcuggcugguagaauucaccaguacaaccaucugggucugcugucuagaagcuguuuuaaguuuauauguguauuucaaggaacuagucuauuuuaucuaauuuaucaaauaugugagugagagcuuauuuauacuauucucuuacuaauccuguauuuuauccaugggauuagcagaauaacaccucuuucauuccuaauauuggcaauugguguacucauuuuuccuugguugccuggcuagagauuuaucauuuuacugaucuuuucaaagaaccagcuuuuuauuuuguugauuuucuccauuguuuuccuguuuucaacuuuguugauuuccgcucuaauuuucaguauuuacuuucuucugcucacugcagguuuaauuuguuucucuuuuucuaguuuccaaagguggaaacugagguuauugauuuuagguucuuuuucuuuucuaauacaucauuuaaugcuacaaauuuugaagcacuguuucagcuguaucccacaugguuucauaaacuguauuuucauuaaaauuaaaaauauuuaaacauuuuucuugagauuuuucuuugauccauggguuauuuagaagcauacuguuuaauuuccaaauauuuggaaaauuuccagcacuuuuuucaguauuaacuuuuaguuuaauucuguagucucagaaaguauuuuguaugguuucuauucuuuuaaauuuguuaagauguuuucaaugucucaggaugugccccuggguuauuuggaagugugauguucaguuacaagauauuuuuccagauuccuuucuaauuuaauuccauuauggucagugaacacucuuuguaugauuuaaauccuucagaauuaauugacuuauuuucccacccagaauauggucuaucuugaaaaauguucuggcuaugcuuggaaaaagugugcaguuugcuguugaguagcguucuauaaacgccaauuaagucaaugugguugauagcacuguucaagucuucuauagccuucuugguuuuccaacuacuugaucuauuaucuauugaaggaagggugcugaaaucugaccacaauugugaauuugucuauuucuucccauguauacugaaauuauuuuacuaggugcauaaacauuuaagaucauuuauucuugaugaguucaccacuuuaucauuaugaaacaacucuauuuaucccugguaauauucuuuguucuaauuucuacuuugucuaauaugaauacagucaccacaguuuuaaaaaaucagugcuaaaaaugauauuuuuuucauccguuagcuuauaaucuauuugugucuuuacacaugaagugcauuuuuuuguaggcagcauauaguuaguucucaaagcguuuuguauguauuaaaucugacugugaacaaucaauugagguaacucauuaccuucagacuggccaauauguguauuaaaucugacauucuuugccuuuuaauuaugacaguuagaccauuuaugcuuaacaugcuuacugacaugauuaggcugaaauguacgaucuuguuauuuguugucuaauugccucaauuauucuuuguuccuuuucuuucuucuuuugaauugauuauuuuucucuaguuuuaucuccuuuggcuuauaacuauguuuugauaucuucgugguugcuguagaguuuauaguuauaucuuuaacuuaccaugguguacuuccaagggauauaccaguucauguagaguauaaaaacuuuauaguuauauuuuuccucaccugaccuuugugcaauuauuguuguaacuuuugcuuuuauauguuauauaccccauuugcuauuuuuguuuaaaccaucuuuuaaaaaauauuaauaauaaucaucaucguauguauuuauuuaccuaggugguugccauuucuggugcucuuuacugcuaucuggcauuauuuuccuucuuuauuaaaucaacugacaauaaaugugagaguuuaaaaaaaaagauuuccuuuaguauuucuuacacugugggucuacuggugauuaauucuuucagcuuuaguacaucugaaaaagucuuuauuucaccuguuauuuuccuaccaaagaaagugcuugcauguuucaccuuuuuugaaagauauugucacaacuauagauuucuagauuaacaguuuuagcuuucacuacuuggaaggugucuuuccacugucuucuggauuacauuccuucugacaggaagccuucugucauguuuguuccucugaauguauaguuuuuucuucucugcuuuaaaaucugucuuuacuacugguuuuaaacuauuugauuacggugucccuugguguaguuuucuucauguuuuugugcuugcuugauauuuauuuaacuuagauuuguggauuuauuguuuucaucaaauuuggcaaggcuucagccauuauaucuuuauuuucuguccucucccuccuuuggggacuccaauuacauacauauuuggucauuucaaguugucccacagcucacugaugugcuauucacuuuuuucuaguuuuuuuuuuuuuuuuuccauucaguaucucauuuuguauaauugcuaugcaguguauuuugggauuuuaauccuauccaguguauuuuucaacucagguguuuauaaaaugucuagaggucuagaaguucaauuuaggucuuuuuauagcuuccaucuuuucuuaaccaccuuaugcuuuccacuaccaucuugaguauauggaacauaguaacaauaacuauuugaauauccuuauuaaaucuauuuaauuuauuuuaguaccuccacuuauuagaugugugucacuucugggucuguuucuauugauugaguuuucucuucacuguugaauuuuccugcuucucugcacaucugguaaauucugacugaaugcuacauauugcauacuuuauuaaugggugcuggauauuuuguauuuccuuaaauauccuugagcuuuguucugggauacaguuaagcuacuucaaacaauuugauccuucaaaccaagugucugcaaacuaggcccacaggccaaaucuggaccacugccuauuucuauaaauaaaauuuuauuggaauacauucugauacauguaaauacauuugcuuacaaauuguuuauggcuguuuuaacacuagaagggcagaagugaguaguuaaaacagagacuacauggcccacauauccuaaaauauuuuccaucuggcccuuuacaaaacaguuuuaugaccugucuugaauggcuuacuuuuaagauuuuuuaggcaggaucagauuagacuagucuagggcuaauuuugccucaucgcugaagcauuagucuucugaguacaccaucuaaucccacuuauauacaagguuuuuccacucugaaugguggggguggggugggggggacacacucuucacugccuuauaugagcuacuuucuucuucccagugccucuuuccucauccauggguaguucucuuaugcauaugcacuaaucagcacucggcugaagccuccaggagagcccucugaagaucucuggagcucacucucuguguaacuaacucucucuucucugguacucuguccuucaaauucuagcugccucagccucccagaauuccuaacuccaucaucucaaccuaggauaagcuguguuuggguucugccuuccugcacugcagccuggggcaaaucauuuguuuuuuccuucucucaggguucacugucucgugccacuuguccaaugucggaaugccuuuguuucauauguuuuaugggcuuuuugugugugucgguuuguuaggcuauuuuaggcgagagaauaacuccaguuccuguuauuacaagauggcuggaagcagagguccucucaguacgaaguuccaauccuuuauauuugccuuagugcuuuauauuuacaauaaauugucccagcucaagccauuuacccaauucuaugaucagucagcaacuagagaaggguguaauaagcaaagucaaacuacuauagcaucccuuuccccaaucccacuuuccuaucuuugugggauauauaugguggacuugguuuuuaagauuuuucuuuuucauuaaaccagcauuuauugagugguuguuuuuccuggcauuguucuaggugcuggggauucaccacugugaacaaaacacgcaaaaauuccuacccuugugaagcgcaccaaugaauuaagcuuaucuuugaauuaauuguuucuaguagcuuaacuguaucccauaacaaagcucaaguaaaauauguaucagauggugauuuuaaaaaaaaaaguaaugaagagacaggaagugcuaagagauuuagcagugaaaacagugucaauuuaaaacaggcuggucagggaaaaaggcaugggugagaggaugacaauuuagggaggaucugaaggagguaaggauguaagucauguggcuauuucuggguacaauaauugcaaaacucgaugcagaaacaagaaaacugguauggcuaaagcagucagugaagggaagcgguaaaagauuaggccagaaguaaugggacccauagcacauaggagaugauaagccuccguaagcgagaugggaaggacuggagacacuggagcagaaaaguaacacgaucagacuuaacaguuuuaaauaauuuaucgggcuguuguguggagagugaauucuaggggagaaaguaugaaaccagggagaccaguuagaaggcuacucuuauaaagagaugaugaaggcgugcaccagugcaguagcagaagagcuggggagaaguggucaccuucuggauuuauggaagguggggcugacaguaucuccugacagcugaauguguagagggugagagagacgaaaugaggaugcugcaaaggcaccuggccugugcaacuggaagaagagucuuccucaucucgguaaauggcuacuuaggaugaaggaaguuugguugggaacagagaagaacucaggagcucaggugcagacauguuagguuugauaugccuauuagacauccagcaauuggauauuuuaaucuggaguuuagagaagagguccauacuggagacaauuuaguagcugccagcauauauguauuuaaagccauaaaaaugaaugggagcagcuagggagugagaaucgacagaggacaaguacagagacugugcucagggacagccaauguuuggaggucaggacaaugaggauguaacugcaagaaagauaagaguagucacaugcaauaggaaggcaguugggaaagugugcagacucagaagacaagagaagaacauacuucacagagcagcaugaucaguggggucagugcuucugacaggucaaggaagauacagacugagaauuaaugguugaguuugcaauaugaaggucgcuggugacacuugagaacuuugguggaaugcccagacagaacugagaaauuguguaaaaggaagcagggacauuaaaugggguaguaaguagagaggaaugggaguuaaauaauuuuuuuaaguaaagcagggaggugggaaugcaugaugcaggagagagaagggacaacuacuguagcuauauccuugagcaggugagaggagaugggacuaagaauauaaguacaaggguaagcuuuaaauugagcauggcuggguaucuuucuccagcuacguucagcugcacugcugcaggcauggaaucagcaaacaaaggcacugggauauagauggcuaaguacaacaaagcaaaggggagggacagagaagaugaguggaugagugauuuuaaugagaggguaggcuauugacguugaguaagggaggaugugagauaugaaggaagugugcugcaguguaaaaguuguaugucuagguggaguuaaaaauguguuggagugggaggacagauggagaauggggugcugggacucaagaucauggagugagagcaguucuuauuaaugacuaggcccacaguaugacuaugggagaaaguugcuaaugugguuuggaagacaaggucauugaaggagaggaaaucaagaaaccgagaagccaggcuguuaagacucuacgaagccugaaaaucaccaagaauuaggacacauuagucuuacagggaaggacagcuccugaaucuucaaggaauaaggaacaaugauguauuuuuacuuuccagauuuuaaauuuuuauguugucuuauaacuauauuuauaauaaugauuuaggccuaacuccaagucagcuguuuuaagcuaauccaacuguccuuuuaugguccaacuugcguucugcucaaauguccuucuucucuuucacuaucauucugaaaaauguacaauuaauucugucauuuauaucaguuuccuaaauucuaaagcaaaauuucucaaacuuuucuguggagcaccaguucaaugguauauuuggugagguagggguuguauggugaaauaugcuggagaaacaccacagaccaaaggccaucgauaaucacuuguuggaaacaaacaagucuaauuugauuuuaacucagcuuuuuucccaaauuuaaaugaccauaugcucauuuuccauauaauaucaguuaacauccuaaggaaugaguaugccaagguagguacuaucgggaagacuguauuagaggugcgugucuucuugguggcuucaaaagaggugaaacagaaccugcuagaacaagauucaagauacagacuuagaaucugucagagaaugcaaauccuuguuaaguuacuuuguaacaauauucuccucuccugcuaagaugaugaaaaacaaaaccaucucagaaaauaacuucucaaagauguauuuaaaauugguuuaguauauuucaauucuccuccguaaaaaugacacuucauagacuauuuaaaaacaaagauacauaaauauguuuuggaggaagacuaaugcccaacaggacgucugcaucuauauacaaccucagcucugcccuuugcucccacuaaccauaacucugauaagaagucacuauaaggaaacaaaugccccuaggccaagacauguacuucaaaaaucauuaucaaaauaacuauuaucuaagaguaccagaaaaagugagacagacuuuaaaauaauuuaagaaccaaauaacaaaaaaguuuugcuccaauuuuugcucuaggagcucuaaaaaaccauuaucaaguuauuagagaagacaagguauugggggaagaggauaaaagaaacugaaauaucagcuuacaaaagccaaucacgauguuuaugaaucaggcaggaacaaucugcaaacaaaaauaaaaauuacuaguuuuguauaauauuugcacaugcauuuguuaauuauaauuuugagaucacuguagguucauaugcaauuuuaaaagaggcuuuacucagucucccacaauaguaacauuucacaaaacaacaguacaauaucacaaccgauauguuuauauuaauaccaucuacuagucuaucgcgauuucccauuuaauuguauuaguguguuuuauaguuuuaucacauguguaggcucacauaucuaccacuagucaaaauauugaacaguuccaucacaaggauccaucauguugcccuuuuacaaucacacaccaccuccuuugccaaaaucucuuucugccccugacccauugcacaucuauuuuuaacacuaaaauaauaacagccauuuacaaaaaguauuucauuccuuguccauaguucuaugucuacuacuacuacuacuacuuccuauaugucaaaucuugaaugaauacuuuuaguuuucugcauuaaagguuuaguuuaaggaauaccuucuccagggagaaguuuuucucauuguuagcauggcauagaucacucauuucaaaaaucaaaacgcaaaaaguaagggagucagaaauguugucugcacucacagauuccauauuuucaauauauuacuaacaagaaaccucugagugcuuaccaucggccaagcuacauauuauauauuauuauguguguguguguguguguguauacacacacauauauauaaaagauauauauacacauauauaucaaauuauauauauauaaaauuauauauauauauauauauauauauauaucauuuaauccuuuuaccaaaccuuugauguaugcacauugacccuguuuggcccaggagaaaauugaggcaccaagagguuuacaaguugccugaagucaaacaacuagcaaguggcaaauccuggaaccugggaccagacucugggcacccagacucuaccaucccucaaggaaacccaugauaaagucaagauguuuugaugucaucauucauugcuaugacaaauaaaucaccuaauuauugguaagcuucauuuuaacauaccagaauucaacaaggaaaauguccaaagcaaugauguguaaaauggaaggaguauuuuauucaagcaugaaaucauaggaaauugccaaaaacaaagguugggacaugcagaaaagacuuuauauuauagcaacaaacuguucaccagcccuaaaaagauagucuuaacauucguuggggauugacaggcagcaguuuauacauagucaagauuacucuugaaaaagacauauucaauugagcagagaugaugaugggagaacugaaauuuuugaacagauaaaagcuucaaaauuaggcucuucagccaauagagacaucuaaaacuccaaagaucauguucagauuauaguaauuugacagacaccuauugugacaaacuuucuguagguuuauuagcuuaauaauauagcauuauuacugaggacuaauauucucuucugugaaacuacacagcacauuuaugcauagcugugacaguuuugccuaucauucaacagugcuuaaaaggcgccugcucaauaagccauugauaugcugccccaaauacccuggcgaggcuuucuuuacagugcuaauuuuacagacgucuccuggaugaucuaaguucaagaggcagccaggggaggagaaugcauuauuagcaugguuuggugugcguauaaccaaguuauacauaggaacuagggaaauggagcucugaaguucaucuuccacaggaagauacaugcuauuauucuugacuuucugggagggaaguuaauucauuacuucguuaacacugaaauauauuaaaaacauuuucaguuaaaagguagcuaaaaagaaaccuuuaaauuaaaaugcuuacaucuuacgagauuucuagaaaucacuauuaauugauuuuaacuagcuuuauaaucucccccaguuacucaaggcuuuuauuuauuuauuuauuuauuuagagacagggucucugucacccagacugaaguguggugacgugaucaagguucacugcaaccuugaucucgugggcuuaauugauccucccaccucagccuccgaacacagcagaguuaauggcagguuggcucuacuucaucagagguucuggaggaggaaaccaagaucuucccugaaaggcaagaucuggcaugugccaccacacuggcuuuuuuuuuuuuuuuuuuuuuuugguagagacaaggugucacuauauugcccaggcuagucuugaauuccugggcccaagagauucucccaccuuggccucccaaaguaaaaacucacauuuucuuaaagguggguaagcaaaagaucagggugaaggaaacccucuccuuuucagacaccacccuacgaugccuguuugcccuucuucaccaagaagccagcuguccguggcugggccagcgugacagacucaggggacauuggauacagcucucuuuucaauggcuccuagaguuaagacuuuuauaagcauuauuauuucaagaaaacacuguguccuggucuucuuaaguaaauacaaggcagaugguaaccuuaauuuucucugaaaacucugucuaaaacaugggacaaaauagaugucaacguucuaagaaugaagaaaaaucagaauuccucauuuaucuccaauucuucucccagggaaauacauauacaaagccuccuugaaguuuaacaugacuuguuucucauaucuuucuaaaagcauauuguuuauuuagaauaaccuuucuaucuugucugccaagcuuuucccauacauauaagauaaaaacugagaaacacuuuuccauucccagugauguuuguccaguaagucuugguaaguaauaacgauuaugccuaaacuaacaucacucuuccucugcggcuaaacacagucaucuggugguguacgguaugaccuguaugguuccucagugguucaccauucuagaacauccuacaagauuaacuaaauuuuucaaguuuguguaucaccucagcuguaacauuuauguuuaugucacuguuuuuaaguuguuaaauucuuagaggauaaagacuauaucuguauaacuuaguuuacaaauaauagccaugcacgaacaucccauaaaugcccuuggcagugaugaguacaaucacagcagaguuaaugguagguuggcuccacuucaucagagguucuggaggaggaaaccaagaucuucccugaaaggcaagaccuggcaucaggggcuacugugggcacuuuccuuugaauugcauuuaucugccaggaagaugauauccuuuauuguuuuacaugaaagcauuugaaaauucuaaaaacugaccaugccugccuuggucaguucagguuguaauaacaaagugccauagacuggauggcugacacauuuauuuuucacaguucuggaggggagaagucugagaucauggugccagcaugggcagguuuuggugaggaaccuccuccaacugucuacugcuggcucuccuauccucacaagguaggaagaaaagccagcuaguucucuguccuuuucuuauaaaggcacuaaucccauuccugagggcuccacccuuauggcccaauuucuucccuaaggccccaccuucaaauaccauuucauuaggauuaggguuucaacacauggcuuuuggggggacacacacauucaguucauugcaaugcccuuacauagacaugaagacaggucacguauguuugaaauaacucauggucugcaaaaucucacaccaaaaauaacagagggagaaaaauucagaguagaccacucaaaaccuaugcacuuuuguaaucacagcgcuaaccaaauaauaaugcauaccucagggauaacuuggaaagcccagauaggcagcucagugugucugggggugccccaggggacauuaaaaacgcacagaaacaauagaguggaaaggcuacuacaguagaaaugcagggaggacucagagaugaguucucaucccuggagagugugauaugacagugaauugugucaacgugacugugccacaagugccagguuaaacauuauuucuggcuacguccaugcagguauuucuggaugaaaucaacacuuguguugguggaguucggagcauaccacccucccaaauaugggcuggcaucauccaauccacugagggcccgaauagaacaaaaagguggaaggaggaggaauucacccccuuuucuuccugccugccugagcugggacaucagucuccuccuguccuuggacugggauuuauaccccugguuccucugcuucucaggcguucagccuuggaccagaaucacaccaccagcuuucccgagucuccagcuugcagacaguugacugugggauuucucagccuucauaaucaucagggucaauucuuuguaaucaaucucucuuucucucuccauauauguauccauggguaaacauacauacacucuaacucugccaacucaaauucacuuggguucuagaaacugcccaacaauuaugcaacauuucccuaaucuuuggucauuucauuucacaccuucucuccuaucuuccaauugccuuccccacuccuaauacuuaacacauaacaucucucuguuaacaucccuacuuaaugcuucugugagaaaacaaaagcuguuggauagggcaucucugccuucuaucucuaaacucagaaacuuccccauauccacaggaggaugcacccucccuaaaaccagaggccaacuccaccucucuauucaaaauuucuuauacauuaucuucucccuuuuuacuaaagauacuugucaucgacacauacuaugcucugauauuccccaauuuuuuuuuuuuucuuuuuugagauggagucucgcucuguugccagacuggagugcaguggcaugaucucagcucacugcaaccuccgccuaccggguucaagcgauuaucuugcuucagcuucccaaguagcugggauuacaggcaugugccaccaugcccagcuaauuuuuguauuuuuauuagagacgggguuucaacauguuggccaggauggucuccauccccugaccucgggauccgcccgccuuggccucccaaagugcagggauuacaggugugagccaucgugcccggcugauauuccucaauuuuuaaagaacaaaaccuucauugaccuccuggucccacuauacucccacccuuucucagacaaacuucugaaaagaacagaaaacuuagauaauccccauuuccuuaccucccacucacuuuccaacccauuccccaggcucuuaucucuaccacucuaucaaaagaucuuuaucaaggucaucaaagcaauucuuauuauccucauuuuaaaaaccaggacacugaggcucaagagagauuacuagguugagauaguaaaaacguaccuucccuucaagauaugcaagagcccagagcugccccaaggcacucuuuucaggauauuaaagacuucaucuucccgggacccaaccccucuuuccucccuugugucaugccgcugcauuauauaucagacacauuccuuagaauaucucauuguuuuucauuauuuuuaauugagaaaaaggaccuugcuuugccuaugaauguuuucuguguugaccacuuggugucaauuauuuaauuguuccaaccacaugagaauagguggcuuuagccccuuuguacaaauaagaaaauuguggcggagaaagaauaaaaccuuucccaacaucagacagauaauaagcauuucauuguuucuuaguuguuuccauuagaugauggcaagauaggggcaucacucugacagaugugacauugucccauuauguccacaagguuggaaaaccuagaacugaugcaaauuugcuaugaagaaacaccucagaaacugacuuauauaucauaauggaacuuuaugaugaggauuuuaauuuaccauacaucuaaauauuuauguuauaaauuaugcagaccaacuaaguucaaagcuaaccaaccaaguccaaaauauaucuuuccuugaccaauuuaccucauauuuccuggaaaaccauguuugaauguggacuucuuggagucuguaccucuagaacauggcacuggggggccgugauacugaauuuuggugauuagggcaucuucccucccuaguucuaccauggaagccaaauuggugagcaugaggugcggaacagaguuaugugcuuaucccauaaccugucugguuuucuagguauucagacauugcacucgcucagcacugcccuuaacccaggugaguggagcucugccuuaggauccauguuccauucuggccuuucucuagcugcaccauuuccuuuaucaugaggaguccaaaggccuaaggggaaggugcccacccaggccuacacucccucuccuaggcuaugcuccugguucccagaaccauggcauuccuuguccaaagagcuucaagccugcuaaccaggaacugcacaggcucuuuccuagaucuguguuuuuaagggcagacugugcccuguuauaugcaguaccuagacccaagggguggccaaggggugucuguuugcaggagauguggacauagugggcagagugaucccagaacauuaagagaagggaagacaggccagggccuaguagccagcuugcucuccagugccauguucuagagguacaggcuccaaaaaguccacauucaaacaugguuuuccaggaaauaugagguaaaguggucaaggaaagauauauuuuggacuucguugguuagcuuugaacuuaguuggucugcauaacuuauaacuuauaaauauuuagauguaugguaaaaguguuucuauuuauauccuggcuugaacucuacccccguauaguuaggaggggcaugagauuaguucuagacuuuaauaaaaaguugauuacugaggaaaaaccauugaauauucuuuuuuugaaccacaguggcugagaaggccaaguguuccagaaaguguacaaugacaaaggugguacaaucacaggcuugagucuuucugugugaagcauagucuucugcaaguccacaguggauguuuauuguaagcaaaaaauaaacuguuuuugaaugaagccacugagguuuggggauggcuuguuagcacaacauaauguuagcccauccugacuacauagaaauugguaccagaaguaggauguuuuagcaaaaaccuaaaauauaugaccuugguuuagcggucagcagguagcaaggaaagugaucucaagggccagaaagauagugauguguuuuauacaguggcaacauaucugguaaaacauuugccucugcuaguucaggaggcagaucuccugucaaauuuacuuguagcucuaggagaagagguaagaaaaaacaauugaaauaugguugggcgagguggcucauagcaccuugggaggccaaggcagguggaucacuugaggucaggaguucaagaccagccuggccaacauggugaaaccucaucucuacuaaaaacacaaaaauuagcugggugugguggcgcgugccuguaaucccagcuacucgggaagcugaggcagaagaaucacuugaaccugggagguggagguugcagugagccgagauccugccaccgcacuccagccugggugacagagugagugagacuccaucucaaaaaaacaaacaaacaaacacacacacagaaaaaaacagaaaacggccgggugcgguggcucacgcuuguaaucccagcacuuugggaggccaaggcgggaggaucaugaggucaggaguucgaguccagccuggccaacacagugaaaccccaccucuacuaaaaauagaaaaauuagcuggguguggugggugccuguaaucccagcuacucaggaggcuggggcaggagaauugcuuggaccagggaggcagaguuugcagugagccaagaucgcgccacugcacuccagccuaggugacagagcuagacucugucugaaaacaaaaaaacaaaaaacaaaacaaaacacacacacacacacacacacacacacacacacacacaauugacauguguauugguuauuauuggcuucauuugacaaaguauuucaagaaagagcugagcuuagaaaagaacuauccgguuuccaggaagugaaagggagugaggagacggcagacauuucagauuuugcaacuacaaaaacuaacuucuucuccaccccuacacuaacaguuaaagguaagacuuugaagaucauuagccaaggaaaacuuuuuuuuaaaaaaacuaaauugucucaggacaaggauagauaauauauccguuaaaucuuuucauguggauaaaaugacugagagaauagaucagauuaaaaguaaagcuuuccaauagaagccagccagucccaagauaacuuccuuuaggaccagaaagacagcuaugggagugagaaugcaaaucaauguagcaaaucugaaaaccaggacucaugcaugacaaaagaaaauucuagggcuguguuuacuagcacacagaauugacuggagacaaacagauaagaaagcuuccaaauuuuggagagcacugugcugccgaaaagaauaagacuaucagcugaagucuuaaaacgauccuuuggcccccaguacucuauaugcaggauagaaagguuugcucaguucccaacuagggcaaauucucaaauguucacuucauauauggcuaaggaaaaaaaaaaaaagaaaagaacucccuaggggcaaggccaguacuucugaaaaugaugaacaagaagguagaaucagggccuaaucaagaagcauuuuacucuccagguuuugaaggauuucaaaauuguuauggaccagggacucccuaaaguauacucgugaaauuuauaacuuacaaugugggaaauacuagguuuggaucuguauuauuuuaauaaucucagaaaggugucagaaaaacgaggaauuuuccuauauauuguaaauuuuaagacuucacagugcaugggauguccacauguucugcacugugucaucugagaauaugaacaucuuuccuccgcuguuuaaaagcaauuuucuagauugcaguuuuaaacaucucugaaugugacaagguauuaccauuaaagcguaugacacugauuuuacacucugcagaagugcggacagauuuaacaaggcagcccuacuucacaguagcucuugaaaucucaaguaggaacgaaaugaaacuaauggcauuauaaauacuacuauuauucgcaaaaaaauguauggaagaugaugagagacagcagugugaccacuggagcagcucauauucggucccaacauuuuauuccugcuugcguuucuggaaaauccacuguuacagauucaaauguguccucaaaauucaaauguugaaaacccaaacccuaaugugacuguauuuggagauagggccaucagggagguaauuaagguuaaaugaugucuuaagaguggggcuuuaauccaauuaaaauucucauuauaauacaugucaguuucugauguguuugcucuuagcaaauuugcauuaauuucagauuuucugaacucacggagguaauuggacuaugucacaucucucagugaugccucuaucuugucaucaucuaaugggaacaauuaagagacaauaagauagaaccaucacaaagagcaggcacccugugcucagaauccaaguaaucagaggucaaaugcuugcuguauuacuuauuaacugucugauauugggaaaggcuucauucuuucucagccaaaauuuucuuauuuguacaaaggagauaaaacuauucucagguuguuggaacaauuaaauaaaaugauucacaacaaguggucaacacagaaaauauucacaauaaagcaaggucccuuucaauuuauccuuaaaguuaauuaauaaaaagcuuaaacuucaguauuaugcagauuauuuguaugcacguaucaagcuacccuuuucauaucauucaauaaaugaugcauaauuuuuggcuuuuguuguuuuguuguuaugguuuuuuggggguuuuuuugcuuugcuuuggaaaggggauaaauguuaaacuaauuugaggaauaaguuaagccaaggaaacaugauucuaaacuacauaauuuaaacagauuucuauacuuuguauuuaggugcgaaccauuuuagucaaaguuugaaauuauguuuaccuccuauaaauauuuguugaauaaauuuaugaauguuuucuaaguuaaauagcuuuaaaagcuauacugucauaagauacucauaccacuuaaaauucaaacacuauuaugauauauaugcuuauauaaaauguuucaaaucugaaauauaaggauuuuuuuuuuccugaagacuaaaggaagaaagaucacccuuucuacauguuucauaauauauuuuccagggaugaaagagaaaauuuaacacuugaugggcucaaaucuuaauuauaaaacagagguuuuuguuucaaagcccaguaauaauaaguauuuccauaaaauaccuacauuacuggcuauauuaaugguggccagccauaaaguuaaagcaaagagaagaacugaaaucuagaccucuaaucuuuuuuccaaaaauaucaaggauaaaggauggucaggagcucaaccaaaaccaaaaacgguuuaaccuggucacccucccaccaucguccacucuauuuugugaccugcugagccacaucgugcuuuaaauuuucuugauuuagggucucauuuucucugaacuguuaugaucacaauggugucacauaaagaagaaacauggggugauuugagagaacuuuaacaaggucuggacauuucucucacuaggaaguagcugaccccauuacuacagggcacgcuucuuauuagguggaucugggagaauccuaucacagagcugcgaugucugcauguaugauuacaagcaaaaguugaccaagaaggcuucaaugagaaguagaugaaauugaaucaaaugaacguuuauuaagcaccuacaaagcgcuuguaaacagaaaguauggcaaagacugccaauuuucucugauauccauucuuccuuucuuucuuuguaauauaaucucugaauuuuaaaugggcacaugacuccccagaaugaaaacauuuuccaaugucccuugaagauaaagguugucacguuacugacaagauguaggcagaaaugucaugugcaaauucugggaauuguccuugaagcaggagcagagucuuauuuauucccuuuuuuuuuuuuuuuuuucugacugaaauacagacaucauagcuagaacuuggcuagccaucuucgaucaugagguagacgaacagaacaaggauauagaacuuagaguucaaaaacagacacacauacucaggcacuugauuuucaacaagggcaccaugcaauucaauggagggaaagaaaaauuccucaaaagauucuagagcaauuaaaucucgauccugaaaaaaauuaaccuugacccuuaucucacaucauacagaaauuaauuugagauagaugauggaaugggucacagaucuaaauguaaaaauaaaauugauaucuucaugauugagggauagacaaagauuucuuaaacaggacaaaagacaaaccacuaaaaacccgauaaacuggauuucauuaagacaccaaaagacagcauuaaaagauacauagaaaagucaugaaaucaucaaggaaaugcacaugaaaaccaugagaccaugaagccaugagauaucaccucaaacccaccagagggcuuaaagcgaaaaagacuaauaucaagugcugaugaaaaugugcacuccaacuacaacucuauugcuagcaaaaguguacacauaugcauucaguuuuguaaacuguuuggcuccccuauggccuaacaauucuagucucagauuuguuccuuggcaaaauacugcaaauguccaccaaaagacuugugaaugaguauucacagcaggucuauuuguaagaacccaaacuagaacacacccacauagcuauuuacaaaauggauaaacaaauugugguaauggaguccuacucagaaaaaauacaaaaagaacuaccuauugauagaugcaucaacacagaugacucuaaaaaauuuacgcugaauaaaagccagacacaaaagaguacauccuguuugguuauacuuaaaauucaagaauagacaaaacagggaggcucaggugggaggaucgcuugagccugggagguugaggcugcugugaacugucauccugucaucaugcaaucacacuccagccuggguggcagagugagauaccaucuuggggcggagggggcuggcggggaaggaauagauaaaacuaaucuacagugauggacaucagaagagugugauccauaggggagguguugaccaggagguaaaugagagaauuuuauccucgauggauguaauauugucuagcuugcucuugaaugugguuacacaggugugcguauguguguguguguauaaacucaucaagcuauauacuuaagaauggcagauuucauauguuuuucuuccccauguauuuuaggccucaacagaagcagagaaaaaguacuuuaugaaagauaauuagacucuuuuuaccuuauccauugcccagcaaagguuauuaggcaaauguaaaauuuucuacuuaaaauaaaacaaacaccaagcaaaguguggcuaaacuuuacaguuuuucuuacccccaaauaagccaaaauuagaauauucaaaccuuauucauuaguaucaacaaaaacuuggaaggaaaguccaaagaaaauaggaguacaccaguuaauccauagcaacuaucauggucaccaaagugaagauucuauaguauauuggcaaugaaagcaaagcuuucacuguguaugucauuuucaguguguguuuuaccauaaaugcuucuguucauaauuuuauuuaauuauuucuucauuuuuagcacaagggcaguauggcauagaagaaagagcaagagcuuugauucagacaaaccaguuuugccacuuacuaacuauaugguguuaggaaaguuuccuaaucucuuugauacuaaguuucuucacaauuuaaaagagauaauaauacuuacuuugcaaaauuguagcacaauuauaguagguacuuaguagugguagcuauuuggcaauagcucuuuguaugcaaaguaucaugucagccacuugaacccuaucuaagaaccugaccaucuggaaaagacauuuagauauaaagauuggugacgaaagguaagaauuuaacaagggcuauagauuauaaauuauaggguuucuauguagcuaguaggguuguagagugaguauucucugaacagagcuugaaaaaaaaugguugaaaauuaguuggggagaaaacauuuaaggcaggggaaauggcacaaauaagaacacagcugcaaaagcaggagagugaaaccuuuaggggcugaugcgugguuaggaccaccugugccacuggauuaguuuugagaaaucggagaaggccaguaaaguaaguuaggaccagacaaaaaaaaggaccauugucaugcuaagaagccaagaaucuuguaaguauugggaugccacuaaaggacuuuuucagggaacugaccccaguggucacuacacaugauaggaagggaagaaaagucaauacagggaaaaauagcauagggugacaagggccuaaaccaaggugcugaggggagugaaagaagcaggaaggaaagauauuagaaaguucaaauuuuuuuccuguauuucagaaugcaaauggaagagaaaguucaauuuuauuaauuuaaaaaaaaugaucacugaguuucccugaaugauauaaauaggccugccuucaacuucaggauugauccuaauugaccccuaaguuccucgagagcaaacauaagcccccaagccaacaaaacacauugccuggcacauagaaagugcucaguacaucauuggugaaugacucuccaaauauuccaaauauggaaaucuccauacacaaauaauacaauguauuaaugaugcaauauaaaacacgcagaaaagcuaaaaucacuuuuccuuuuuguuuagugaccauuuuccacaauaugccaaguucugaauuugcucaugcaagagcuaucucuaucuccagcuuaucaaaagacucagauauaaaucgcuccagaaaguugggaauguugccaccucaguugcuaagcucuuguguaauguuguucuaggaauccaucauucuuugcuauagcaaaagaacagucacuuuaugacucaugaauauuacaugaaaaaauuaaaacaguaaauuaaauccaaaucaugugaauaaauauguguaagguuacuuucgagugcaagaugauuuaguaauuaauuuacuuauuaugauaauuuaaauuaaaauaaccuaacacuaaguaaugaagaaaaaaacgaguacuuccuagggcuaagcacaauucuuaccccuuuuuauguauuaacucauuuaauccucucaacaaccuuauaugguagacaguuguaccuaaauuuaaagaugagaaaauugagauacagagaaguaacugcccaagauuauacuacauggcagcagaggagcagaacuaggaauugaaugcaagcaaucuggcuucacaguccaauagauucagaaaaaauacuuaauaaaauccaauacaauucaugauauaaaacucuuagagaacuagaagaagagaacuuuaaauaucccgcaacaacaucacacuaagcuucagugcuacaaaagcauucuuauguaagucagaagcaaaauaagaaugcccaugaucaguaccacuauucuucauuguacugguuguccuagccagugaaauuagacauaaacaaaagaauaagagauuugaagaucagaaggaaaagaaaaaaaucauuucuugcaaauuauguauuuauguaaauggaaauauaauguuauuuaugaaguaguaacuagcugguuagaaaauaagaaacuaagagaaacuauucacaguagcaacaaaaaucaucaggaucuagaaauaaauguaacaaaauauguacaaguccuuuauuuauaucauaucauugaaggacacaaaaaggacaugugagauaaaugaaaaaauugaguauugcaaauauacccauucuucucauauugaucuauaaauucaaagccauuucuauaaaaaucccaacaggacuuuucaagaaacuucauaaacagguacuaaaacucauauggaaugggaaaggucuaaaauugccaaacaauucagcagaaaaacaaaagaaggcuucugcucuaugacauaucaaaaucauuagaguuaucuuaggaagauuuguucaggaaauauggagagcuagacauucuaaaacaaaccuuuuaauacuugcaaaguucuaagaaauacuggaaaaacauccuuuaaaaugucagauauuuguaauucuucaugucaucaaacuaagaaaagucauaaucucaauagaugcagaaaaagcauuugacaaaauuaaaaauagaguauacguacauauaacuccuagcucuguccacagagggccaagaaacaguaucaucucaauagaagcaaggacaccuagcacacagauuuugguuucuaauaccauccuccaauaaaaggaaucaagacauuuuggagaaauggcugauucuaagguuggggaagggaaaauacuaaaugagccuggagcaucucauagugccagacaguaaggaaaugauaaaaaaaaaaaaauaaaaauuuuuaauggggacauuucaaaaggacaaaaguaccaaccugaaaaaaucccaaugccaaagcuggaacaauuuaagcaauauaaaaaugguauuagauaauagcucaaagacuaaauaaauauccaucaauauacauggauauaaauaacugacucaauaauaaaucaaugggaaaaaagggaccaaucuuucuuagagaagaauuucuauuaauaaauguagaaagaaggaaggaaauggaaaaucaccauuagaauaccacaauaauaauugcugcaggcaagauccauugaacacuaaaauuauuggacaaaacuuuaaagagaaauagaauauuuguacuaccucaaaaauauuuauuaaucacuguggugguuuuaacauaugaccacaaauuauuugauaucccucccuuccuuugacuguggacuuucuccuaacaaauagaccauggaaagggggaaaaaguaacauuacaauaagaaaccuugccagacaccaucuugccaugugaucaaaguuaucaucaguugauguggcuaucauaugcugccauaugugauacaaugagaagggcacaacagcucugcgauauucuucucucaaaauccauaaucucagucuaauugugagaaaacaucagauaaauccaaauugagaugcauuuuacaaaacacauaaccaguacucuucaaaagugacaagauaugaaagacugagaaacugucacagauuggaguaaacgagggaggcaugaaaacuaaacaccaugugguauaugggguggauccugaaauuaaaaaaaaagaacauuagagggaaaacugugguaaucugaauaaaguguauaguuucauuaauacuauugugccaauguuaauuucuuaacuuugguacuuuacaaggguuauguaagauguuaacaugagaggaagcugggugaaggguauacaaaaacacugcacuaucuuugcaauucuuguaaauuuaaaauuauuucagaauaaaaugaauuugaaaauucaauacucauuugcgaaagcaauucucagugaacuagaaacagaagaaaauuuccucaaucugguaaagaacaucuacaaaaaaaguacaguaaacaucacccuuaauagugaaauauugagguauucuccccuuaagaugaggaaaaggcaaggauauccuuuguuaauacuucuguuaaauauuguucuagaggucccagccagugcaauaaggcaagaaaaggcgaaaaagagaauagaauuguaaaggcauauuuaaaccauuuuuuuuccagauggcaugacagcacauuaaaaacaaaaacaaaaacaaaaacaaaucugcauacugccaaaacuauaagugaauuuagcaagcgcacaaaauacaagaucaauauauaaaaauaaauuuuguuuccauacacuaggcaagauguuuggaaaauaaaacugggggaaaaaaaaaacuccaccacuuacaacagcaucaaaaaaacauuaaaugucuagaaauaaauugaacaauguguaaguccucuauacugaauauacaaaacaauguugaaaguaacuguagaagaacuuaugcaaugaagggaaagacucaauucuguuaaaauguucacuuucccaaaguugcucuguagagucaaugcaaucccaaucaaaauucugguaggcuuuuuuuuuuuuuuuuaauggacauugacaagcacauuugaaaauuuauauggaaauguaaagcacuuaaauagucaaaacauuuguuuaaaagaacaaaacuggaggguuuacaauaccaugucaagacuuaccauaaacuacaguaauuaaaaaaguaugguacugaugcaagaauggauaauuaguccaaguggaaagaacagaguccagaaacagacccaaauauaugaccauucauuuauuaacaaaguccccacgcaauucaaugggaaaagaaagguguuguuuuuuucaauaaauguguagaguagauggauguccauauacaaaauaaaucuugaucccccccucacaccauacacaaaaaucaacuggugauaaucacagauccaacagcuaaaacuauaaaguuucuggaggaaaacaaaggcaaaugucuucaaaaucuugagagugggcugggcgcgguggcucacaccuguaaucccagcacuuugggaggccaaggcggguggaucacgaggucaggagaucaagaccauccuggccaacgcggugaaaccccgucuguacuaaaaauacaaaaaauuauccaggcauaguggugggugccuguagucccagcuacucgggaggcugaggcaggagaauggcaugaaccugggaggcggaguuugcagugagccgaggucgugccacugcacuccagccugggugauaaagugagacuccaucucaaaaaaaaaaaaaaaagagaauaaauaggcaaacuucaggguagaaaauuccugcaaacauauacccaagaaagauucccuauccagauuauauuaggaacuaaaaaucauuaacaaaaagguaaccuaauuuuuaaaaaaugggcaaaauauuucaauaggcaggugauaaaggaaaucuaaauagcugauuaagauauuuuaagauguucaacauuauuaguguuuauggaaaugcaaccaaccuaccaaaaaccaucaauucaacuccuugguauauagcugagagauauaugucuaccaacggaaguuggaagaacauuccucacaauucaauucuuaauggcccaacaaugaaaacaacucaaauguuaaucgacaagaaaaugaauaaguaaauugcucauauuauauauccacauaauguaauaccguagaagaggugucaauaaauuuuuuucuguaaauggccacgugguaaauaguuuaggcuuugugggccauauggccucuauaacaacuacucaacucugccaaauggggauaacuauguuccaguaauuuuuuuuuuuuuuaagauggggucaucucacugucacccaggcugcagugcaguggcaugaucguaguucacuguaagcucgaacuccugagcucaagagauucuccugccucagccucuugacuggcuggaauuauagacaggagccauggaacacagcccaauaaaauuuuauaaacagaaacaugcaguggguuggaauuggcccacaggccauaguuugccaacccuugauacaaagcaaaaauaaaaaacaaacaaaaauucuuauacaugcaacauggaugaauacaaugugaacaaaagaauaaacuguaugacuccguuuauaugaaguuuaaaaacauuugaaaauaauacauggucauagaaaucgggacaguaguugacugggggaagcgaguggcuccauugauaggaaggggcagaaggaaugaaaauguuuuauauguuuaucuggguaguaaucacaaagguauacacauauguaaauuucaccaagcuacacacuuuuuuuuguuguacauaaauuauagaacuaaaaaacauauguagaauucaacauggauaaaaaauauauuaaauacauuaaaucuaccuuaaaagaugugggugauagagugaggaagucuaacagaagucuaaucauagcuccuaaagaauaggacaaaaaugugugaaaauaaagagauaaaagacaaaacuuuccugaauuaaugaaacauaaaccuuagagacaggagauuuuauucauauauauauauacauuuauauaaauauauuuaauuuuuauauaaacucuacagagagauuauauauaaucuauauauaaaguguauguguauauauuauauauauacacacaccuacauacauugccucaaaagucugugaguacaaauuauucuugaugauacaaggagcaguuaaaaccauaaagcaauucucgaauuucaaagaauuguuggccuugacacguaugcuaacuacagugcaaauuagaaaucaguaacaaaaggauaacucacaaaaccuuccacauuggaacuagacuacuuucuacaaaucucuuaggggaagaaaaaauaucacaaugaaaaaaucuuaaauucuuagaacugaacaauauacuacauagaaagcagcaguaaaugaaaaucugcaguauuuucaaaugacaaauaaaccaggauuaacagccuggaaauaagcccaaacauaucuggguacuguaugugacagaaguggcacugcuaaucacugauauugggacaauuaccuuuucaugugggaaucugaaaauuaauuaagcuugaucucauaacauaaaauauauacaucucaauauauacaugucucagguaaauuaaagaacaaaauguggacaaaacauaaacuuaaaaauucuuagaaaaauauucagaauacauuucauuaauaguagaguaucuuaagacaaaaagcauaaggauuaaugucuacaguuuaauaucugcaaguauauaacaaauauuuguauccagaauguuuuccaauauaaauuucugcaaugauggaaauauucuguucuauaauguauaauguaaaauauauaacauaauaaaauauaauaaaauauuaaagucauaugaggcuauugagcacuaaaaauguggccugaaagaacugaggaacagaaauuauugagguaaauacaauauguuagcauuuuaaaacgcugaaagucuguaaaguucugugauuuuuauauacuuuuuaguauuucguuuuucauaacaaaauuugauuuuagcuaaaauuacuauauaaaauauuccaguuguguacaaaacauguaaaugugacuuuugggaaagcaaacacaccaaaugauguuuucuccuaaaugcuuuuugaaauauuauaaauuaaguuauaagaauacauaaagaauaauuuaaugaauacugguauguccaccauggaauuuaugaaauaaaacauuacugauaaauucccuagguacuccucccugagcaagauuuuuuuuuucuaaaaagaagccaggaaauaagaauaacagacggagagcccuagacucaggcuucuucaguuugcaacacccauauuuuaacauauuuggggggaaauguaacauucaaacccaguguguaucauuuaacaaagaguuacaaagcaaacacccauguaaccauugcacaggucaggcgauaaagcauuuccagcaucucugagccccugacccucuccuccccacuaggagaugaccauuagcuugacuuuuuuucuuuacuacuuuuaaugccuauacaugcaucccuaaacaacagcuuugcuccaccagguucugaauuuuacauagaagauaucacacagcauucuccggcaacuuuuuuuuuuuuugguucaacacugaaaggcauuuguguugaaacacaaaaauacuucauuggccacuguacagugugcccuuuuuaugagugguguauaauuuaucuuucuccuucagguaggcaugaaggcggcauccaguuuucugccauuacagucaaccuucuuguacacgucugcuuguggacauguauuaaaauuuaucuagggcaguggcuuucaaacuuuuuuguccaugacucauacuaaggaaugacguuuuacaucaugacacacauuuguguauguaugaaacugaggagggggagagagauucauaaagcgaacaccccuaugaccugagagacacugauguucuauucuccgucuguguuuuacaaauucugaucauccauuuaaaugacuuuacgacccacuaaaauggacuucaaauucugaaaaacauuguucuuaaggaugaauacccaggcgugcaacugcuggaucaggaaacacggacaucggacgucgucaacuuuuccagauccuuaacuguuaaauguucuuaucuaagcgcauauaaauuuaccacuauuuaacuucagagcgaaaagcgugaaacaucagagaacauuuuaucuuuucccucggucauuaaacaguauuaaucacuuaccaugugcuaaguaagcaaucucugagcccagcgagaccgguggguuaauacgcggaggggcugcgggggaggacuuaggggaccaggaccucagugaggccccagaaagcacccgggaggggccuccgauccugccugggagggagggguuagaggaggauuccuggaagaaggaggaccuaagcuggguguuucuauuuuugauuuuuauugguuuccuaaaacaugaaaguaacacauuugaugagaaaaaauauucaaaauuacaggaguauauucaguaaaagguagaaauccccauuccgcccugaaaguuggaugcggagacuaacagaagucgcauuaucagcugucccgaucuaggaaauuuuuaggaccccacguuuuuaaauacuuuuaagaguaugucugauacagucuguaauacuaaagcaucaaaauaaucauauuuuccauaagagacgaaagugcaaacaguuacugucuagucccauuauuacuuggaacagacuuuuucuucuuuuccuuguucuguuuuuuuccuggcccguuggcgagguuagagcgccagguuguaagaaucgggucuguggaccucauaccagauaggcgcgaacgccucuggcagcggcguccaggggguccggcggcacucgcgguggggcugccuggguugcgggugacgaucugcggggucccgcacccggccccgcggagcccggacccgcacguaggcggcgcggcaaaggcacacccuccucgcggccgcgaacccagcgccguccucgcagcgcggcaaugcacggccaccgcugcccccagcccgcccgccgcagccgcgagcacccaaacaccuacccugcggggcgacgacccccggagcucaggcgaggccgcucgggcgugccaccuccgcggccaugacggcgacccggggaagcgccccgcgcgccaaggccccgcgcugcugagcugugagcacggcugccccguccguccguccguccagcacccgcccggagagugaggccagagcacgccccagccgugucuaaaucaaggcucggggcgguacc

SEQ ID NO: 21467 - RNA, 44191 nt, Homo sapiens
aaaacaagccggagacccgccuuuucccuccggcucgggagcgucucgcuugcgccccgggcccgcggcgcccgcgcggcugcgagccucggguggccgcgugccggcuccaggaagccggagagggcgcggcggccaggauggcgcggcacgggccgugcggcuagacgggagccgagggaaccgccggcucgcgcccuccguucuuucccggagccggcuucacgcagggccgggaacggccgugccucugggauccgccuucgcugacgccgggcaccuaccuggacgcgagcgagcgagaugcccaaccccaaaaacagcaaaggcggccgcaaaaacaagcgcgccaacagcagcggcgacgagcaggaaaauggagccggggcccuggcagcggcgggcgcggcgggagcggcggccgggggggcccuggcggcggcggccgguugcggggcggcggcggcgggcgcgccgggcgccggaggcgcggcgggcgccggaggcgcggggacuggcgccgcgaacgcugcggccgccgcgggggcugcggccgcgggcgaugccaaaaacgguaagacggggcuggcggggcgagcgccaacuuccuccccgacggggacggcgcgguggcggggcccuggguggcgcgggcggugcguggacaaugcgagagucaggaagugcucaccccgccccuccgccccgccgcggcugccccuucgcgguccccacgccuggcggcggggacagaucugcggccccugcccgguguccgcgcggggggcagcccgcgccccacacucugaggggcucccggcugcggcagcgcugcccucgggcccagccugcugcccgcgcuggcacugccccgccgugugugccgggccgaagggaggaaggaagggaggaaagagccgcccaaguugagaagaaugauccgauugaaaacuuaggcaccgguuaauucuucccggugcuccaaggccacccguaacccccggaaugaaggagagagagccucaauucuuagcacacccaggcuugcugcgucgaucgccacaggugaagaggccucgagacauuuagggccucuguguuugcucuuuaauuuuuuggcuugcuugaggaaggaagagaaucugaacuugacuuccguucucagcccggaguuaaaaaaaaaaaaaaaaaaagaaaagaaagaaaagaaaaaucauucucuaugucauugugcuuaacauuuucagaaggaagccucauaaucuuagguagugccugaauguuccuuuugaggggacacuuaggaacuggcccagaugugacaggauuucuguucucauuacagagccaugguuuucguuauaaggugcugggcaaacacuuacuuauuuggacaguucuuugaauuccucuagucaggcacuuuuuccaggaagacaacguagguauuuuaaugaagggagauuugaauuguuauaucuggcuuuuaauuuauagcgucagcuuuugaagccauucuuuauguagaucaggcacuuuuuuguuuuguuuuuuuuuuuuuagacggaguuugcaauuucgcccaggcuggagcguaguggcgcaaucucggcucacugcaaccaccgucuuccggucugaagcgauucuccugccucagccucccgaguagcugggauuacaggcgcccgccaccacgcccggcuaauuuuuguuauuuuuaguagagacaggguuucaccauauuggucaggcuggucucgaacuccugaccucgugauccgcccgucucggccucccaaagugcugagauuacaggcgugagucaccacgcccagccagaucaggcacuuuuuaaacagggcaccugcucuuacaagcagcguacagugcucugaacauaggcggcugaaugucgccuguuagaacuguaggccccguuggcugugucucugcaauauugaaauaggaagauuuauuuauuuauuuucagaaacaaacuuaccccguuugugaauguuucagaauacuaguuuuggguagccuguguucuucauguucuuuuguuuuucuccuggcuuuaaccuucauuuugguauugauguggcagagagaaaggugcucagacucuggguaggacagacuccuagcucagccauuuagagcuucaucaucuuggaaaggucagucuuccagagccucaauuuccucauguguaaacuugaaaaaaaauuacccuggcucccuccuaguguuauugagaggcucagagugccccuucccuauuaugcucccaguucuuguuauuuuaaagguuacauauauaaugagcuuaaaguuucucacaaagagugcaugaacaaugaugacagcuuucguuuauucauuuaaaaaagauuaccugcaguguugcaaguaccguguucaauacuaagggauccagcgguaaucaagacgagacaucccgguccucagggagcuugcauuccuguucugguggugguuuugguuugcucugcccaccccccuaccagcuccuuuuuuuuuuuuuuuuuggccuauguggaagcuucaaguucacaguuuccuuuuuuuucuugcuccaaaagauuaguccaauuuaagguggcaugaggaaauuuuuuucuuaggcuacuuguaccuccuaguuuguacauaacaaacugguuaaggggccccuauuauuauucucugaaguggcagacucaaguauauuuagcagcacaguguaugugaagagcuguuucugauuaggagcuuauuuuauuaagugaaaggcggggagaaaaaggaaugggccaacauucccauagucagggucagaggauguaacuuauauuagaggagugagccaaauuuuaugaugccugauucuuguuucugaagugaugugaagucuucgugaaugauucaccuuaaugugaggaacccccccucaguucugcaguugaugauaacugaacuuggaugcugaggacuccugggugcaaaaucaaaugcuuuuuucuuuucuuuucuuucuuucuuuguuuuuuucuuuguuauuuaaagcuauaguuuauaagguagggguuugggagaggcguuacuggugaauuuuuaaagaggaaggggcaagagaugcguaaauucucaaaaucaacuaaggaccaauauuuggauuuuuaauguuaaaguuauuaucgguaguaguuuuaaguguauuucaauuuuuuacuuaacugugacauuagauuuuguaauuacagaaauuacaaaucaaguaauuauuacaagaaaggagguacuugauauucuuugaaacuuguaaauaguuuuucacuguucaagucagcuaucuacaucugcaaacaugcaaacuuaaugacuucgcuuaaaauuaauaguguuuauuuguaguuguuuggaguuuauagaaugguuuugugucuuguagcucuugggcagugcggccaccagagcagggcaauauuagcuuuuaguuguucaguuugucaagugggcauaaauaaauacuuauucuguaaaggaagauuacuaguuacggagagcuuggggaagccgcgguauaguugugguuggagaagaugaacuggcugcaguugugcaucuugaguaaguuuaauauuaauucuuaggauaucauaccgcuaauaagacauuuauuagauacuaauuuuaagauacuaguuuaugaggcuuauuuuucagggauugguguaaaagaccaccccaucuuuuuccuacauaguaaucugucugcacauaccauuugcauuuucauugcagguauacaagauuaccaaugguuauauuuagaaucuaguuaucaaaagguagauacguaguuucauucugguuccauuaggccucuacauuuuuauaucaggccuaaaaauauuugaaaccuugaucauaguauaucuaguuuucauugggccuggaucuuaaguacuuuuauaaauuccuguuauuggaugaccaugguucaucacuccacucauuccuuacugccucuagaacccgugggcagcagagucugccuuaauucauggaacuguuucuagcagauggaguucguuugcauagagauuggcuuuccauuugguggaccuagauucaaauccuggcuucucaaauuacuugucaaaugaccuugggcaagucauuuaacuucucugagccuugguuucugcuuuguaaaauggauuguaguaccuacccauacagauguaguaaaauaucuguaucuaucuauuaaauauauuuaaaauaaauagauuacauacauuagauagauuagaacagugucugacuuacaguaccagcuuacgaaguauuagcuguuugucuuagauccuggaaauagccugagcagagauacacgugcuggagguuacuggagagugcucuuggcaucauuccuaguggaggagggaaggaagcaggauugggcagaagcaggaguugaacugugaugcaucuguaacagagaccccaguugauccucucuugggggagcucuggaggugggauggccuuucugaguuaucucaccuuaaauaauaggggcagggccuucuacacacucccccaacucccaguugacuggucauuuggacuugggcuccccccaggaagagagcaugaccuugaggguggcaucucuuuaccuggaaacccuuuauggagagggacucugcugagaagcuucagcucugagugaaaggagagccauucuuauuccccuagcauuauggaugucuucauuuagaccaccaguaccauucacauaaaacacaggugugggauaaauauuucucacuaacaacuaaauaggcuuuguggaggagacugggaauuaaccaccauuauaacaguguuuccaugggaaaacgcauucugaauuccauauaucuguugacaaguagauuuuuuuuggaguaccaccuguucccuaugcacaggauuuguauuuugcugcauauuuaggccacuaaagacacuuuuuauaaccgagguuuguaguauauuuuaaauaguuucuuuuuagauguuuacuuuaauuccuacuacauuuaaauuaccuauauccaucaguaggaaaaugaaaaauguuugcuugcuguuuauuuucaaaucaaggaauaucuguugaggaucuaagguauauagguuaccauuauaaucuuagaaaacauuuucuugccuuaucuagaagucaguuuuuugggucucaagaacuauuugccuuuggauguugucuuuugaaauccaccuuuuuaguggagauuggcagaaaauauugccucaugcaucaaagauucuuccuguacacuucguguauuaaagugaagagcucuucugugcgccguucauggugcucuaugcgcagucucgucuuucucucauucuuuacuuguuagaggaucugugaucuguccuuaaguucuagaaacuaaaccuucaaugucaauuuuccuguaaguccaagaauauauuucauuccauggagaauugaaaacgggagauaaaacgggaaaaucucuugcagcuuaauccuccuaugaguuuacuucaggcuuuuagcuaugaauaauuuaaagaacuugaagguaccagaagagauucuuuacagaaaaaaaucuguccuaacugauuuugaucagcaacucuuuggcauuuuuguuuuuugagauggagucucgcucugucacccaggcuggagugcaguggcacuaucucggcucacugcaagcuccaccucccagguucacacuauucuccuaccucagccuccggaguagcugggacuacaggcacccgccacaaugcccggcuaauuuuuuguauuuuuaguagagacaggguuucuccguguuagccaggauggucuugaucuccugacaucgagauccgcccaccucggccucccaaagugcugagauuacaggcgugagccagcgcgcccggcccucuuuggcauuuuuaagggcuuuauuuauuugaaaauauuguguuauuuuauuauuuuaccaguaaugaaauaagcaucuuagaaaagaagcuuucuuugccuuucugguuaaacacauaauuccaccacuuaagagaucaacauuauuaauauuuugauauauguucuugcagccuuaaauuuuuuuucucacaaaacuuuuaaaaguacauauauaguuucugcaaaaagaagaucauauauuuuauaaucugauuuuuacacauagaauaguuuguggacauuuuagcagagcaguaaauauacaggugcaucaucauaugucugcaccuuggaaauuugaucauuccacuauuguuuaccuuuagguucuuauuuauauauuucugggcauuuguccacuuaauuacuucauguguuaauuuguuucugcugccacaacaaaauaccucaguguggauaauuuauaaacaauagaaauuuauuucucacaguucuagaagcugggaaguccaaggucacagccagcagauucuguaguuggugagaaucacagcauccucacauggcagagaaggugaaagggaugaacuuguuccuucaagcacuuuuaugagggaucuaaucccguucaugagagcccucauggccuaaacaccuucuuuuuuuuuuuuuuuuuugagacagagucucacuaugucaccaggcuagaguguaguggcuugaucucagcucacugcauccuccaccucccagguucaagcgauucuccugccucagccucccuaguagcugggacuacaggcacaugccaccaugcccagcuaauuuuuuuuuuuuuuuuuuuuuuuuggacauggagugucgcucugucgcccaggcuggagugcaguggugugaucucgucucacugcaagcuccaccuccuggguucacgccauucuccugccucagccucccgaguagcugggacuacaggcacccgccaccacacccggcuaauuuuuuguauuuuuaguagagacaggguuucaccacguuagucaggauggucucgaucucuugaccuugugauccacucgccuugaccucccaaagugcugggauuacaggugugagccacugcaccugaccauggccuaaacaccuucuaaaggcuccaccucauaauacuguugcacuggggauuaaguuucagcaugaaucuuggagggacacaaacauucaaaccacagcauguacuuaggaaaaauucuuccuguggacuugcuauauccaaggauuaugcauauucucgugacuuuuaauacaugcugacagauugcccuauugaaagguuguaccaguuugacauugcuguggucagagugcuuuuccccauggucucaucauucccugguuguuuuaaaggcaugcuggagaauugcucagcaaauucuccaaaaugucucagcaacuggagggccccauuugcauccggaauuuggagcagaugcugucguacauagggggacuuuccaaggcuggauguauuucuguuuuuaaaacagagauuuuaaaaaguaguaaugguggccaggcaaugguggcucacgacuguaaucccagcacuuuuggaggccgagacgggcggaucaugaggucaggaguucaagaccagccugaccaacaugcugaaacccuguuucucuacuaaaaauacaaaaauuagcugggcaugguggcgggcuccuguaaucucagcuacucaggaggcugaggcaggagaaucacuugaacccaggaggcggagguugcagugagcugagaucgcgccauugcacuccagccuggcgacagaaugagacuccgucucaaaaacaaaaguaauaaugguagaugauauuuuaguaacuggugauagaguuagugaagaugaaagcauagaccuuugaaauucugucuguauuaugauucuaaucuuacaaaguaagaucuggaguuuuuaaagcuuuagugaaaaaagacuggguacuucaggcuuggguguaaagcuaggugcuauaacuuacgcuauagcagagugacuuuggggcagguuauuuaaccuuucucagccucuguuuucuaaaugcaauccuuuaggguguuuuuuugaaggaaaacaguauaugugaaagacguuggcacagggccuggcagauaugagcccugucaacaacagcuuuguaaauuuugugguuuguucaaccuuauccaacuaaaaaacuuguuaagccauugugauguuaagaacagacacugaaagacauuaauguggaaaaagacuauaguaccgugcaaguuuuuauucaagcacugcuuugacucaaaaugauuaucuacucuucccccaucuucucuuucuuaucauaguuuacugggaaaaaaucagaugauuuagcuaaaaauaagcaaacaaaaagcaacauguaaaaauggguacaucuuccuuauauagaaauaaacgcugccaggcgugguggcucacaccuguaaucccagcacuuugggaggcugaggcaggcagaucacaaggucaggagaucgagaccacccuggccaacauggugaaaccccaucucuacuaagaauagaauaauuagcuggaugugguggcacgugccuguaaucccagcuacucgggaggcugaggcaggagaaucgcuugaacccaggagauggagauugcagugagccgagauugcgccacugcacuccagucuggugacagagcgagacucugucucaaaaaaaaaaaaaaaaaaagaaagaaagaaaugcaaguaaguuauuccauguauuaaacaagggcagcugugaaagagcaggagcauauguggcaaaauauuggguuaaauauaaguauuggauuugaagauggagaagucaaaugaguauguggaguuguguagcugaaaggaggugaggagcccaggauguacuuugggggaucagccagggcuuaguguuacugagaauuaaacacaggauccuucccucucuccaggcaacuacuggauucauuagauccucauucauucauuagauccucauucauuagauccuaauucauuguuuauauacucauccauuuacuacauauuuauuaugcaccuacuaucuccuaugacugagaaguacaauguuaaauuauacuuggggggaucagaauccauaccaucaagggcucacugugaagcuggcagagagacauggaaacaacaggagccaugauaauguacuguggauagccaguggggaaaaugauguuuccuggaggaggggacauuugagcugagucuugcaggaagagagacagugaauucuaaagguagaggaaggauguuccaaacagagggaagugaaaaagggccuugaguucugguugcuccaggaguuugauguagccggugucaggugccgugguaggacuggaggcuggaaagggggcugggucagacagucaaagcuggauguuuguagccaguggagaaccgcccaccuagguuuauaaacaaggacauggucagcugaauuugaaaaggggguaaucacagguuguugacaaguuuguaaaauuauauauuuuaacagaaugaguaucuuuuaauauaacuaauaaaggauuggagguggagccugccauggacccucaauugugguuuuucaaugaagcagagggcacauggcacaugcugcuuuucugcccaggaugacaguguugcaggauccaagacugcuguauggaaagccuaucuuaauugugggcagcagcagcccagugcuuucugagccaugugagguuacuaauugagguuaacaucagagaacuagaugccagugggagggauugggaccauuugagcaaguaagauuuucucuagaggcaggggcuugucccuaugguuuauuuuucguaccuagguagaaaguguauaucucugugccaaguuguacuaauuaucuugguuugucauuuuauuuuugucaacaucuuaccaguuuuuaaaacaauaaacucuggugaggggaaaugcuauuuuguacagagugacuguguguuuuaauuuuguauauuucagaaagcuuccaguuuucagugguuagcgaaauagcaacuugcuuuauuuaaucaacaggauguuuuagcuuaauuguacuugagagcuuuuuauaaacuagcaaaaagucaguagcauuucuaauacuuuaaaauguuacaauuuuucagacaaauuacuuuugcuaaauuguacagaugaggauaauacuugaaaagucuaagagugagaaacaagaaagauacuaagaggaagcuuaaagaaaagugaggaaaaaggaagaugaaguguucaauguagucauauaauugcuuagauagcauuuaaugagaaaguuagcauuguucucauauauacacguaauauaguguauuucauagauuuaaauagucaaggaggaaaaacuuucucuacucucuuaggcuuagugauugagggucugcaaauuaaauugacaagagacagauugcaagauaaaagacauuuaaucauagaagaaugugagccaaaggaaugguuagaaguaggggcuuguauguuauuuuaauaggggaaggggaggggagaaaagggaacuuaugggaaaacaaaggacuuuuuggaaagauaagugggcguuuaggagaauagaugaaagaugcgauaguuuggugguaauaucagcuugguguggugugaagacuuuucaucucuggugaugagucgcucuuccuugguugcucuuggggaggggauuuauguuaauugaauucuuuuugagagccucugcuuuuaggccaguaagagauuucaggaacuuaaucacuuucagcucuuuaauuuuuaugccacaguggcauauucuggacccccucacaauauauugccacucaaaucauauuaccuccccuccccuaccaagaacaauuacagauagucggauaggaaaagaugguccaggugucacaauucacauuucuuuuuauuucauuuuauuggaaauucauuaaaaauagaaugccuuaagauuuauuccuucauaacacgugaucaagaggaugaauucagacaaaaguuaguaagguaucaaauugcuccgguaaguuaagcagcuacuugccacauugaaaauguauauuuuucucuagggguaagcauagguuugauuauacuuuagaucaugucccuucaaguuauaaagucaucucaguagagucuuuggacacuaauguugaaacugagucacaggcuuuguuuucgcuuuauaaaugagcacuccugagugugaugcuuauuucaguguaauauuuaguauaacacaacuucuuauuaagguaacacacuaguuguuaugccuaacacagcucaguaggcagaagucgaaacagaaauguacagaaucaaguucuggcuauuuuugauuggcagcggguacaaucuguaaucugagagcgggagccugagauggcuggugauaggugucagugaacagacacggagagcccagaacagugcugccagaagccaugaagagggccuggcauugaaaaauaagugccugcugugguggaggcagaaguguacaugccugaaaacauagggaagcucaaagaauucuuccaaauggcuuccagcuccuuggauccguucuuacugggcagugccuacaugucacagugacuuucuuuaccucgguaaugauacaguuccacuguguuaggcauauaguuuuaguagugaaggugaugugcuguagugcagaagcaaauuaggcaagacuccugggugauugguguguugggucuguagaacuuacggaaaggagaagcagccauuccuagugacaggaaaagugaaguugccacagcuccccuuuuugaguguuuaguaggagucaggugugacaccugcagucugcagucuacauuugaguaugaggacacuaagcuucagagauggccuucccuucuugcagaaaaggcuuggcuguagggaagugugccugacccccaugcuuuauaguuggaaucuuguugauguuggguccaucuugacucacacacauacguacauaaauaaugaaaaacuguaugcagauuuuuaaaggagaggacugaaauucaguguaaaaacaccaauaugguuuuuauacugaauaaggacauuuacauuacuuuuaaaaggucuuaugggucgggcguaguggcucaugccuguaaucccagcacuuuaggaggcugaggugggugaaacacuugaguccaggaguucgaaaccagccugggcaacaugacaaaaccccaccucugcaaaaauacaaaaauuagccggauguggugaugugugccuguagucccagcuacucgggaggcugaggugggaggaucgcuugagcccaggaggaaaggcuugcagugagcugcaucuagccugggugacagaacgagaugcugucuaaaaaaagaaaaaaaaugcuugucauucugguacuugaacugaaauuacauuuguaaaacaagaaaauacuugacccaaggaagcacuuuacucacacauuguacacguauguugaucugauccuucuaucacagaaggacuuccuggucuuggcuugggagauugugaacauuugaacuggcacuuccuguucuuaauggaccagaguucauaacuagcaugugauuaucuuuaggguaaaguccuagcaguaggaucacugguuugauacauauugccaaacugcuccuacagacgagguuugccaguuuacaccaucagugguggugcaguuccuucgcacucuguaauguaaauuucgauuaccauuuucaucuuugccaaucagauagaugaaaaaucacaucucauugucauaauauuugcauuuuuuggaucaucagugaauaucuuuuuauauuuauauugaucauuuguauuuuuuucuuguuugugauuuuuguccauuuuacuaauaggguauuuguguucuuacugauuuucacaaaguguuugcguauucaggguacuuuuugacauacgcuuucccuaauuuauuguuugccuuucagccuuauuuaugguugucuuugcugguuagaaauuuuacaguuuuguaugauuacauuaacauccacauagaaauaaagguaaagguaagggagugugaggaaaguugugaaauuacuuguaggcaaagcaguuugggcauggcauaaaguuagcaacuuugaguucauuuguauaccagugcacaguaaugcuauuacauuuaugagguuguguuuacuuuuuaauuuggaaggcucuguuucucagaauugguugcaacccgccaggugugguggcuuacgccuguaaucucagcacuuugggaggcugaggcaggcagaucacuugaggucaagaguuugagaccaacuuggccaacauggugaaaccccaugucacuacuaaaaaugcuaacauuagcugggcaugguggcgcaugccucuuaucccagcuacucgugaggcugaggcaggagaaucgcuucaaccugggaggcagagguugcagugagcugagaucaugccucuaaacuccagccugggcauuagagggagacucugucuccaaaaaaaaaaaauugguugcaacuccugcugcccucccuuaccuccucuccgagucucuggccacucacugcugucgagucaauagcugagcuccagugcucaauacccgucucuucuugcacauuucuaaaaucccuuguaguuuuuuuccagcuauguaggacuuugacacuuguagauaaagacucauuauuuacuuguaauugccucuucucaagaaccaggcugcaaacugaggccucuuaaggcuaaauugcccauaaguugcuuaugauaacagacuuaaaugcugaaucauaagaaaguucucauuuuucuccuucuggcacuugaacugaaauuacauguguauauuaauaaaaugagaacauagcacucgauugaaccaagaguuuauucacacaccaugcaucaugcugauccagggagccuuugugccuucucagaugucugugauuuggaagagguuuccaaacucauuucuguucuaaacagugugagauuugggagacacagguuauaggugaucuggcucugccauuuugcaaggcugccaaaccuugccaagcccaaguuuuaucugcagaaagugagcaugacaugauacuguuugugacgagcucuuuuucaaaccauagagcuguuuggaaaagcaaaucguugugccaugauuugggguuuuuaguuuuuucuaggugaguuuuugguucucuguuuguaauguggugcaguguggcugcuucccaaccagugaugaaugcacacacugauuuguuggaagaaccagugcagauguuggcuuucccccagggaguuugcagugaaugccggucuuccaaaucuguauucugcugcuuuggggggagccuuucguuucucugcaaguuuggaucugggagcucuugcugugcaaauuuugcccagagaaucuguaguauucauucuccugccggucucagggcaagcccaguuuuuugaaugagaccuucuggagcuacugcaaacagccuuucugaccccacagugaggagaaacugaggcaaccgaagccuugaggaggguucuuucaccagugugagcauagcugacuuugggauucuuuuguugugaucuguggaucaauccugucccugagcucuccugauuuuguuauaacagcagaguccacuuagauuuuaaccauuugaucagcagagccuuguuuuuggccuguugugcugcaugauuuacagugugcaucuggauuuguaauuaugccucacauaguuuauauuuugauucacuucaggcuuuucugcuuucuccucuuuaccugccucuagggccauauggaguggaaguuugcauguuguuguaaaagcauuuugaaauguucaucagacuuucaugguuuccuuacuucccuuuuagguuuugcauuuuaaauuagguuauagaauugugaauuuaccaaacuauauuguggauuuuauucaaacaguuucuguggguaugaaauacuggucauguguauguaucaauauuuuauauggaaucauuauauuucuugggguuaggcugacaaaaaacaaucuguuagcuucauucaugagagguauucagauuugaaauuuuugacuuuggaauaaaucaguuuuccucaacuuauauuuuaauguucugugauauaugugaucuaaagaugacuuugggggugagaguggggcuaaaaaaaaaaaaagaaauagaugauaaaaaagaugacuuugaguaauuuuuaaauaauuaauuuuaaauauuuuuuucuugaucaauuuuggacauaugaguuagaauucauuuagaauauauauauauauguugaauauaaucauagguaauauaacaaauucuauaauaguagaaaguaaguuuuagauuuuuuugguaacucuuuucacaaauguuauauuauuuuuccccucugguuugaaaugaauaguuuugagucuuugagaauggucauaccauaaaauuauaucuguguuccacaaaaguuaguaauuggaaaaggaaugaacauuuaauuaaaauaucacuagcuuaaacuaucaauaggagucuguaacucuaaguuuacuuaauuuuccuuagaaaauuuuaugaaauacucccuugaaaucaaaucauauuauagcaaguugcuucaaguuaguauaugugaacugcuaguucacaacaaucaugacugauuguugagucuacuuuuucauuuuuacugagguauggauaagacuuagacaugcccucuucuuugacaaguuuuuccuuguugcaacagauucuauaacuugccuguugguugcugaugcagcuuuucagaaauaggccgugcaguguggccccaggcaaaagcuuugucuuuucucccaagaaccuagcggaaugacugccagagugaucacuauaaagcauuuuaccagguuauuuugaagggacgcagggagcagaaagaguguauuucagaaaguucagcagggcagaaaaggccuguggaaaacaaaagaguguaaagauuucauuuauuuuaggguauggauaggguaaagaagugaauuuagcuacaucgugcugagauuuuauugauuuaaauacaguagucuuaaaaucaucuugggaguugguguguuaacucaauccguuuaacuaaacagaaugcaggcaaggcaggcugaacuucuguuucuuccggccgugcuuuuucugcuacuuaauuugauauucuccauacugagagaaugguguuucuuuacauucuuucaaaggaaaauccuccucuuuugaguuuagcaauucuauuaacuagagcagauugacuuucuugucauuauuuuuaaggagugcaaagauuggggucaggaaaccuuuauacuguaauugaguuuaaguacuuuuuuaacguggucacuuagguuggugcaaaaguaauuugcgauuuuugccauuacuuucuuaccuacuuuuuaaguacucuaaggauuaauaugaggauugaacauuuugaauaagacacuauucucaauuguagaacuacauacuacaaucugguuacgcaaagcuguggggucacagccucuccauauaagcuggcucugugcucucaauuguccugugugcaguauggguggaaauacaagagagaaggccacuuacuagcugaauggccuugggcacaucaccaaaggagccuuccugugcucagaaagaguauguggaaucuggacuaaagugauuguccuauuucuauucugugaaacuuugauacuuuuaagaaacauuuaggauaaacuaugacacuauuaucuucauccugauguucagccuaaaccaggcauauucuggguccguauucuuuugggucuugacgugucuucuauuagacaaggaaaauaugaaucuucuacuuuauagucauuauugaugugauuucuuacugagaucagagcgucagagccagaauggaaauaacagguaaaauagaaaccuagaguuuuuuauuuaguuugaauuugaggcuggguagacuuguggguuuuaauuucaaaguaagaaaagggugggucuaggagaacagacuaaauauauuaagagaauguuaaaaacccaaguuguaaacuguauugaagcauuggauguguguguguguguguguguguguguagcuuccauguuuauuuugacagagugguuugccugaguaaaagcuuuucguuuaaauccuacuguaagcaaagaaaaacauguuuaacugaauguaauugccuugugcucaauuugcuacucacuuuggagcagguucacacacuaaaauaacauaaggggagguuaaauuacaucaaagguuaagacagauaagcuuaagugaucucauuguagcuccuauacuaauuaaaacaaguugacaaaauauuuuuguaaguacuagccuuccuuuauguguagugcuuagugucuuuauuuuuaguagaaaaaaggucuuaaaaauauuugaggaaauuuauauuaaaaccuuuugaguuuucauuuaaauaauacuugccgguuaaucaggaaaugauucuuuaaauuucuuuuuauuuuuaauuuuuguggguacauaguaguauauaggaaaugauuccuaaacacccugugaauuugaggcacaguguggagcaucagugggcugcaguuagcuucuuuguccacuccugugucuuaccuaauuuccauguuacagccacaggaaugggccaaggcugaagcagagacuuuacccuagcuggugaucagauggaaaagcaaggcuggggccuaauuacaggagcuccuugaacaugacccaagaacuuggagcauuagucugaguuucugagguuucugaauguguguaugaugugaucauagucaaguuuucagaaugccgaucugaagguauuaaucaaucaaacuuuuuuuugcuguguaucuccuaagagaauuagaaaaaaaacaggguucuuguaaauuuuuaaguugucacacccaguuuucuaaagacuuaaauagaugcugaggauacaguuuccaguucauuguaaacauuguaauuuaugcaaacagaauccuaauuaucguaguaacuugguaaccauuaucauccauuuaaaaaauaauguaauuuuuuuuuuuuuuugagagggaguuuugcucucgucgcccaggcuggagugcaguggcgcgaucucggcucacugcggucuccgccuuccagguucaagugauuuuucugccucagccucacgaguagcugggauuacaggcacgugccaccaugcccaucuaauuuuuguauuuuuaguagagacgagguuucgccauguuggucaggcuggucacuccugaccucaggugauccucccgccucagccucccaaagugcugggauuacaggugggagccaccgcacccggccuaaaaaaauaauagaaauuuuacauucuuuucuuuauuuccauucaguuuguacucagaauuugauccuaagacaggguauuguccugcuuagaaguauuuuauugaucauccuaucauauuuuccuauaacaaaauauacauauaaacuuuuaaauuuuuauuaagauggacuucugagauggcagaguaagggccuccagaaauuugcuccuccaugaaagcaauaagaacacugccaagaauuaccaaaauuaacuuuuucagaacucuggaaauuaaccaaaggcuuacaguaauucuaagaguguucuuucaagagaaaugacugaaucauaauaaaaacagugagcugugguguuuuaacuugguuaguaccucccccuuucccuagcucugugguaucagagcaauguaauugcuauguaaauaguuguuauacuguauuuagggaauaaugacaagaaaaauaagccuguguauguucaauacagacacaaccaucuguuuuuuuuccaugaauauuuuccauugacaauuggucaaauccauggauguggaacccacagauauagaggacagacugcauaugaaugggguggagagggagucuuagcuaccuggagaaugugugcugcaccaaaacagcauucugauucacauuccaaaaaaaaacucuggacugguuuacuaagacacaaugcaggccaaacugccccauuggaacucugaucuaggggauauauagacaucauaucaccuauuaucaguugagcuuuuagaauauuuugaacagcagggaguugugaguuguauuuucuaaccgguaacuggucuacggaugacccguguugccaguuaaucaugcagucuuaugcuuuaccuguugggcagacaagggaagggguaaagucauuagucuuuucagcagaggucauugggauuucagagguaaggggaaggggccaaaucggccauggccuuuggccuccaaauaccauuuuggggcucaucaagagagaagaagcagguccagcauuuacacugcguuguaauuuacaugguaaaugaaaaucacauagauaaacuaugaguaaagagguuugaguauugccacauuuugaauauuugugcugacaaaggaggacauuaauauggauaaucaaaaucaagcuuauuuuccuaagcaaggauaauauuggaauacaguacuaaagacugacaugaagucuuuaaaaauaggauuguuuaacaacugguuggacaguuucuccgcaguuguauauauacagucaugcauugcuuaaugacagggauacauucuaagaagugugucauuuggcgauuucaucaucaggcguacaucauagaguguacuuauacaaaguauagccuacuacauacguaggccagaugguauacccuguugcuucugugcuacaaaccuguacagcagguucguugaauacuguaggcaauuggaacacaauggcauuuaugcaucuaaacauacagaaacauagaaaaggcacaguaaaaauacaguacaaaagauaaacagugguacacacauguaggccacuuacacaugaaaggagcuuucaggacuggaaguuacucugggugagucagugagugaaucugaaggccuaggacauuacauuacuguagacuuugauaaacacuguacacuuaggcuacccuaaauguaggggaaaaaugagguagguauacuaggacgucacuaggcaauaggaauuugucaguucaguuauaaucuuaugggaccacuguuguguacggaguucauuguugaaucaaacgucguuauauagcauaugacuguauaugcacacguacauauacacacacauacacuuacacauaugcuuagucuggaguccucuucccauuuuaugauagugugauuugguuccaagagcuccugaaucuacauuuccuucagagcauauuauguagugcauuuucgugcuaggaugcuguguaguuuucaaugauuuaguacccccaagaucuaaaucuccaaacaagagaaaaggcagccugcuaauuucuuuucuaguacagugugaucccauuauaugcaaauugaauuaugcaaauuucaacuacucacauauaaauaauauuaauaaaagcuucacauugugugcaaaauuucaacaagcauguuuucccaaauuaugugugaagccauuucauauuuucaaagcugucaggucaacugaauuauaaaagugcuuucuuacccaguggcaccauuuauauuuuuuauauuuuauauguuucuauuuuauaaauauguuuauauuuuauauguuuauauuuucuuauaaacaaauacuaacuuguggcaguauuaugugaacucuucuuguugcuagaacuucuguaaggauuuuggugacguuuguauuauuauuuuuuacauucacuguuacaauuuaaaaucuuuacuauagcuuuuucuuuuuuuuuucuuugacagggucuggcucugucacacaggcugugguguaguagcaugaucuuggcucacugcagcuuccgccucccaggcucaagccaaugcuuccaccucggccuccugaguagcugggacuacaggcacgugccacaacaccaggcuaauuuuuguauuuucuuuuuuugauagagaugagaucucaccauguugcccaggcugguuuugaacuccugggcugaagugaccuuccugccuuggccucuuaaaaugcuggaauuauaagcgugugccauuguguccagccuguagcuuucaaaauaucaccuaagugugcuaauacuggugcugaaaaacauccuggaaaucaguaacuuuggaaaagaaauuagaugugauaaaagauaccaggaaaugacaugcuguuaauuuaugaaauaaacucagaaguaugagaguuaaugcugauagaauuaaaaaguaugaguaaagcagaaauacagcacaaugacggcacgugucuguguucugagugugcauuccgcauacucuauccuuagacuauggaauaaucuguucugaauuauguaaguucuucaggaccaugucccaugaguaaaaugcagucaugcuucaugaaucucuguuacccaugcuagggaaagauggauuagguuuaaaaauacauauuguuacaggagagggguccugauccagacuccaagagaggguucuuggaucucgcacaagaaagaauucagggcgaguccgcagugcaaagugaaagcaaguuuauuaagaaaguaaaggaauaaaagaauggcuacuccauagacagagcagccccaagggcugcugguugcccacuuuaugguuauuucuugaugauacacuaaacaagugguggauuauucaugccuccccuuuuuagaccauauaggguaacuuccugacguugccauggcauuuguaaacuugucauggcacuggugggaguggagcagugagaaugaccagaggucacucucgucaccauuuuggguuuggucgguuuugaccggcuccuuuacugcaaucuguuuuuaucagcaaggucuuuaugauauguguuuugugccaaccuccugucucaucaugugacuuaacuaucugggaaugcagcccaguagguuucagccucauuuuacccagcuccuauuuaagauagaguugcucugguucacacgccucuugacaauauaacagaguacuuauuugucugacacugagaagaacaucuucaugggguuagaagaagauaauuuugaaggucuccuuuuccuucuacuucuuugacacuagucaguaaauauugagugaauuaucuuaugcaugccauacugcuuuguugugaagaagaaaucuacuucuugccccucauaagccuaaagcacacauagaaagucaugacugacaaaaguguaaguugggagagcaugcaaguggcaacauuuggcccaagaguaauauagagggcuguagagagugggaugguacuuucccagcuaagaaggcuggcaccucccugggcuugggaagauguggaagggauugggcuugggacaggauugaggcgaggcacagguggaggagggugugugccugcauguagcaaaagggggcaaaugagagggggugaauauaauaacacugaagugcccaacuccuggugggcucggccagccuugcacuuaauguggagaaaggaggauggauggccacuuccugguuguggcuuugcucuaaacuuguucaaaaucucuugauuuuuaugacaaguaauauaaagugauauggcauuuguuaacaauugcuuauaguuaaacagugcuuggccaggugcaguggcucacaccuaugaucccagcacuuugggaggcuaaggcaggaggaucacuuaagcccaggaguucaagaccagccuggguaacagagugagaccccaccucuacaaaauuuuuuuauaaaaagucagcuggggcugggcucgguggcucaugccuguaaucccagcacuuugggaggccgaggcgggcagaucacgaggucaggagauggagaccguccuggaaaacacagugaaacuccgucucuacuaaaaaauacaaaaaauuagcugggugugguggcgggugccuguagucccagcuacuugggaggcugaggcaggagaauggugugaaccugggaggcggagcuugcagugagcagagaucgugccacugcacuccagccugggugacagagcgagauuccaucucaaaaaaaaaaaaaaaucagcugggagugguggcgugcaccuguagucccagcaccuguagucccaugcugaggugggaggauggcuugagccuggcagguugaagcugcaguaagccaugaccaugccacuguacuccggugugagcaacagagcaagacccugucucaaaaaaaaaaaaaaaaagaaaaauugguguuuaggugccaagcacuguucuaacuacuuuaauaacuucuucauuccucauggcaacccuuuugggguagguauuaguauuauuauuucugggccaggcacaguggcccaugccuauaaucccagcacuuugggaggccaagguaggcagaucacuugaggucaggaguucaagaccagccugaccaacauggagaaacccuaucucuacuaaaaauacagaauuagccaggcaugguggcgcaugccuguaaucucagcuacuuaggaagcugaggcaggagaaucgcuugaaccugggaggcggagguugcggugagccgagauagcaccauggcacuccagccugggcaacaagagcgaaacucccucucaaaaaaaaauuuuugaaaaaaaaaauuauuauuucugccauuuuacaggauuuuacagguaaggaaacagaggcacagggaaguuaggugauuugccaaaggucuuuaauaaguugcagagcugagucacauccaggcaggcuggcucugugucaucucccacagucuggagucgggaagcuggagauggaggacacuggucagaaauucauacccuaagaggaccaugcucucugcaaacaaggggauuuguucccacauaagaggaauaaucagcgaucuaauaaaacaguuuugaaaccuuacauuuguaauaaccaguucacuuuuacacagcuaguaucccauggaaccgggacuuacacauaaaugucuuuuuuuccuccuuuaaaaaaaaaaugguaccugggugccacaaggaggguagcaggaaugauguuaguuugaggaagugagggugagggccaggcucugucccgacagagaaggccuggacugaaucuaggagaccuggcuggagcucugcagcugccuccccagcagcugggcugguucuccccauggguucacccucucucuauuacuguggucacaaccagaggacugagucugguugggucauucuuuccuucaucagaagauuuauuaaacacuuauuuaugcaguaguggguuuacaaggaugaaugugacuaagucaucccuauuuuagauuuugccuggaaagccucauaugacuuaagaagacccuccuuaccuucauuccacccaacuccccaccugcuuauggugcagcuguuuuaagggggauaaaaauauuuaacucauaguuuaaaagcugaaaauagcaauguccgguuuauggggcuccucagugaaugagguugucaggagauuugggcucauugggcauucagugugauccuccucuuucaauagguaaggagcacagaguucucaagugagggcaggaugcaggguaagaaagcuggggagacaggauaggcuuggcccaggugacugcagccuagcuacccuguuauccagacuugaaacugagauuuuugcccagaaucacaugaacccuguuuauuuuaacuugagcagaagaaauagaagcuggguacugacuacuugaugaugaaccuaaaauacaggccuuggaagguuuauauacuuuuuuaaacaaugccaacucuguguaaaggagcauuuuucuguuuugcuuguuagauuaucacaguuuagauuaaugcgccaagggaaguugguggcacaaguguaugauacccuucucccaucucuccuguugaagauuuaauugugucagaucaaucuauauuccauuuaugccuuugugggacugcuguucuguuuuuaguuuggagacaagguuucacucauugccgaggcucacugcagccucaauuuccucgacucacuugauccuuccaccucagccuccugaguagcugggacuauaggcacaugccacugagcccaacuaauuuuuuaaaauuuucauggagacggagucucacuauguuguccaggcuguucucuaacuccuggccgcaagugauucucuggccucagccucccaagugcuggaauuacaggcgugagccacugugccuggccauacuuacuuauuuucuaaacaccuguauggcauguucaaaacauuggaaaaaguagaaaacauuggagcaguuugcauuuaucuggggagugaaauacagcgguauaaaauuaugguagcauauaagcaaacauuuuuaugaaacuuuacuauuuauaaaguguuuucauguacaugagcugaauagggcaagcauuuuauccccacuuuacagaugaggaaacaaaacugcucaaugucaaacaacuaaucaggagcagaccuggcaucagacaccucucuucuguuauucccugcugcuuuuccaguuuggacaauguguguguguggugugugugugucggggacagggguggugcuaaugagggaggaaaguauguuugaaccgagccuugaaggaaauaauguccgaguuuagaggccaacacacuucagcaaaagcauugucagacauccucugacuauucccgagguccacccuguuaccccauuuugccugucucccugggagccucacccugcuggugugucauagggugaagugucuguuguguguauuacuggguguauuuaacaugcucuuggcuuuguauuuguuuuugaagccuacccacaaggccacaucaaaguggcugacuauaaacaagcagggcuggcaaguuggagugggggcucuucauacaaggaagagguuuucugguuaggaaacaguggagcauggcugugaacaugacaaacacuguuaaagggacagggauggggcacagcugugguaccuugucuguguuccaugugugcacuucuguuagaccauuagagcucuuagcucaagaccuggcauguaggaagugcucaguauugguuaaaugaaauauuugcugcuuuuugaaaagacacagaauuuuuccucucuuaauccaccuuucuuuagugugaaaauacuuuucaaagaaauaucaagucagucucaacauuuacaguuggaauauugugaaugcaaauguuaguuagaucuuccuuugaccuaauuugauuuuauuggucuuggguuaguaaaauuugguuauugugguuacauuucagggacguuuacuucaaggcucuucaucugaaggaucaagauaaaaacaacuacacuuaauaauugaccaauuaacauuuuaaaggccucuaaaggucacagcccaggugacuggugaauuuacucaguuucaaaccacucuucuacuucuuuuuguugugcuucaguacauccaggucugacugucuaggauuacagcucucuuuuucacuucugcuccucuugucauguguggguuuggugagccaguaucuuuaaugcgacuuuuuucagcacuggaguuuuacaaagccugggcccaguggugccggaaacacuaagaugaguaagaggcuuccucuccugagucgucagcugguggggauuaugaagaguccccaugaugagggacucaaguaagauuggggccagaccaucagggaggggaggagaaggguuggagucaggauaggggggcaauccugguaaaauugguauguagagaggugggccuugaagcaguaggaguggggaggaaguuuacuagaugccaggugcuuucucagcauuucauguguauaguuuuuuucauuucauucuucugaaccauuuaagguacauucuguuguuuucugcauuuuauacagaggaaacugacacaaagagaaguuaaguaaguuguccaagagcaugcagcucauaaaugguccugccuggauuccaacucaggcagucugguugcagagucugaacugugaauugcugucaguggcugaaugggauuuggacaaaugaagauuaaggggaaaccacggugaucaaauauuaauacauagagguagacaaauugguuuagggccauuuugccaaggcccuggaaucccacaccugaaggggauaauuguaacauaugacagaacuaauauuuguauaggcuuuauggguccacauugccaccacccucugcugauugauuugguggaauguugugucugugguucagugugcagggauaagguugggaagguuguugaguagaggagucacaugguuuguucccucucauaugucuuuaagcugucgugagguuuuggccuguauucccugagcucaugaacaugguguuaaggcucagccucugcugucuucuguacccugcccaugcucuuucccugcccuacaguuacccucuggaaagaguuuccuggagucucccuguuucugccuuuucaccucacugucuaccucugaccugcccuccaucauucccgcuggagcuguucuccgugaggagacagugccuggcucacugcucauuuuggcugggacuuuucagguuuauugcauccagugaauucuuaacucggggugauuuuacccccuaggggauaccuggcagugccuggagacauugaguggggcuggccucuacgggauggacagugagguugcugcuagcugcuagacaucuuacaggauggcucccacaacagagauccagcccaaaugucuguagugcagagguggagaagcaccgauguuaccuggugcucugggacauuuugcaguucuccauucuuuuuuuuuuuuuuuuuuuuuaaagggagucucacugugccacucaggcuggugugcaguggcacaaucucuacucacuacaaccuucgucuuccaauucaagugauacucccaccucagccucccgaguagcugggauuacaggugugcgccacuacacccagcuaauuuuuguauuuuuaguagagaugggguuucaucauguuggccaggcuaguaucgaacuccugaccucaggugauccacccgccacggccuucgaaagugcugggauuacaggcgugagccacugcgcuguccccugacugccuggacauaauucucuccugacuuguuuuucaguaaauucugaguucauuucuuaccaaucucugcaggggaaucuucuccuccagccuugguuccaguccuugcaucccaggauucuuuuccuggccucuggucucugcccacuccucccguuuuucuugggcaucucauuaguccuagggauuugaccuucaucugugggugagugacuccacaucuguauucacagcucuagcucucuugagcuccagucaaauucaugucuccuccaccucagugguacacaggcacuucuaaaucaguggguccuaaauagggcagcccuaagucuuuuuccaucuucccuguccugcuguucccacauugcuguccgucagcauggacucucacacacacacacacacaaacacacacacacacucucucucucucucucucugagcaucuucucacacugcuccugaagcacaggcacuccuuauuucucaacccacagcacccucccucuggccuccuuacuuccagucccgugccccacgcugccaccaggggagcuuucuagagcagaacucugagccugggagucugccuuuagcuucugucaucuauacacauaaucuaaacugcuucaugaccaagcccagugguucccaauugggagaguaguauuucccuccaaaggggcccuuugaaaguguuaugaacauuggggguaucaugauggggaagguggggugggugggcuacagauacugagugcucaggccuagugauguuugcuuccuguagugugcuggacugggcuguccagugcauuacaggaagagaauuguccagaugccaguagugcccucauuaagaauuggcgauguaguuuuuagcuucugccuagaggaugaggagagaaaugcugagcacugguccuggagaguacuuauuuuggggauugggaggcaaaagaacugcaugguauaaaauccuacggaaaugcaagcaagaauguaagggagugaugaauuguauugaaaauuguagaaaugccaagacacaaguggggaaggcuguuaguugugugacucccugaagcacccuugucaucccagccuguaagccacacuaaccucccccccaccgccccccaccgcucauacaaccggcagccacucuuuugggccuguggcaacagguuuccuuccuugguccugcacuaugagacucucagucucccaguuuggccccacauuuggucaguuuugccaucucuacauuagccccuuccaccucuggccaccuuauuacacagcuucuuuuguaaauaaaaauaucccaagcugugucacagucagcuaacgacaagaacagcagcaacaacauuaaugauccuuuaugugccagguacugugcuaaacucuuuauaagcauuucuuauuuaaucuucaaaaaaucucuauaagguagcuacuacaauuaugcccauuuaugguugaggaaauggaagauuaaacagaugaaauaaccaguucacuuuuacacggcuaguaucccauggaaccaggacuuauacauacauguccuuuuauuucucauuuuaaaaaaacagauuuuauuuuuuagagcagauuuaaguucacagaaaaacuggagguauagaguguucccauauaccuccugcccuccuccagccucccccacugugaauacagaaugguacauauguuacaauugaugaaccuacauuuacacaucauugucauuuaauuucauaguugacauuaggguucccuuuugguauuguacauccuguggauuuugacaaauguauaaugacguguaucugccauuauaguaucacgggaauagauucacuucccuaaaaauccucugugcuucaccugcucaucccccacccccuguggcaaccacuuuuuuuuuuuuuuuuuacugacucuaucaugucuuuuugacauuuuagaaauaaauucuaagcucagauguucaguuaucauugaauagcuguaaggaaucaguggaguucccauauccaugaaucauguuuauuucuuaagaauuggguuagcggauucuacuuucugucaccauguuuucuguccuuucugggaaccggcuuggcuguuugcacagugugggacaugugugggacauguacuuaagauagaguacaacuauguuguucccacuuccuguccugguagcuuuggaagaauucugguuuuuuccuucacagccuggcuuuguaauuuuguguagaccaacaauuaguuugauucaauaucccugccauugggugucagaccaccuuagacgagaaaucgguaugagaccgucuauguuccagcggcuuucugguauucaggacaaccuaaagcucaggaugaagggcguugaagguccuuuuuagagauuccaccagacugguugguuaaguagcuucaucauauuauucccugguucacuggagugauucaucuuuaaaggaacccuggaacugccuuucauuauauucaugucuuagaaaaaccuuauaccauacuguugcaaguacagguugaguaccccuaauccaaaaaucugaaaucuguucucucuuuauuccucccccagaagccccaugugccacuccccugaucugcagcuucgguaggccgguggaccuggagaaggacgacuaccagaagguggugugcaacaacgagcacugccccugcagcaccuggaugcaccugcagugcuucuacgagugggagagcagcauccucguccaguucaacugcaucggccgcgcgcgcagcuggaacgagaagcaaugccgccagaacauguggacaaagaagggcuacgaccuggccuuccgcuucugcucuugccgcuguggccagggccacuugaagaaggacacagacugguaucaggugaagcggaugcaggacgagaaaaagaagaagucuggcuccgagaagaacacagggaggccuccuggugaggcggcggaggaggcaaaaaagugcaggcccccaaauaagccccagaaaggcccaagccacgaccucccccgccggcauuccauggaccggcagaacucccaggagaaggcagugggugccgcagccuacggugcccguucccccgguggcuccccgggccaguccccacccacgggcuacuccauccucucuccugcccacuucagcggcccccgcuccuccagauaccucggggaguucuuaaagaacgccauccaucuggagccucacaagaaggccauggcugggggccauguguucagaaaugcccacuuugauuacagcccugcgggguuggcaguucacagggggggacacuucgacacccccgugcaguuccuucggcggcuggaccucuccgaacuccucacucacauccccaggcauaagcugaacacuuuccacgugcgcauggaagacgaugcccaagugggccagggggaagacuugcggaaguucauucuggccgcgcucagugccagccacagaaacgugguaaacugugcccugugccaccgggcgcucccgguguucgaacaguucccacugguggauggaacuuuguuccuaagcccgucgagacaugaugagaucgaauaugauguuccuugucaccuucaagguauagguguuaauucaccuugccugcuuucuguuuguuaaaaaccaaacaacaaacaagacagauugcucuauuuugguguaguuuucaccaguguuguuuuuuuguucuagucaggugcuagguaacauuugaauauuucagcuucgcccagugacgcggugauuuuuuacucugaugucacaguaccaaguacaguuguccuagcggauaauuuuguguguucuguaauuugaagaaaggauugccgguguaugguuuugcauaauggggaaggaaauuaguggaguuguugcauauuugucacuuacuguaaaccuguuuaaugggcccaucuagcuguguauccucuuagauccuuauaaacauaacagugaggaaaagcaguggucagaaaagggccaagguauuuuuagauuaguugaauuaauuuugaaguuuaugaaagaugagaguguguugauagcagcaaaagguaaacaggauuauugaaagcucagacauuagcccggugguggugguggaaggaggggcgauggggaagcuuauuauuccuguggauggcauauaaggauuugguacauuucagccauaaauugaaugacacgagguugguuaguauaagaaaucugucaguucauguacaacuacugaacuuccauaaagaugagacacaucacauauaacauguuuacacuuuaaaugugugcuaaaaagcuuguugugaaaaugauauauccccaccugucuccuucccaccaacccugcugugucaguacccagacaaacauuuucaaaucuuagcugaugcuucaaguuuuugacaucgugauuguaaauacugcugucuucauucuccagcuuuacauauuaucuguuuauugacuggcuuugaagguggaugacugugcaucccccuccuccuuccucucaggauaagauaccacaauuauuaguuaaauccuuaauguuuacuaaugugaauauauauauuuaauauugagccaagaaguauaggguuuuaucuuauuauauaguaccauauagucuaggacuccuuuuguuuuuauuaggguuaauugauuauuuugauuugcauaguuuuuuuuuuuuuuuuuaacuuuggcuaguucucacucuccagcagcuuuacaaaccaucuuucaaagacauuuccacauaccugucagauuuuuuuuggaaaaaaaauuuuugccccugaaaaugccccucguggagacucuuacccuccugcuucuaccuguccuggugcacucaggaccugguguaccacauagcuguccuucuaggaaugccuucauuucuguccuauuuuuaaaaaucuuguuuccuagaucucaauauuuuauuuuuuucucgguuuauucucucagcuuuuaggaaacaucccccaggagcuuuuugagaaagggagcaugggaauagaugauuugagacuuucaacgucugagaauauccugauuuaaucuucacucuucuuugcuauuuagcuggcuguagucuucuaaguuauacauauuuuccccuuggaauuuugaagacauuucuuuacugucucccaucuuacaaugucacuauuuugagaggucugauguuacucuuauuccugucuuugccuccaucuccaccccuccaugaagguuuuaagauuuucuucauauaucccuaauguucugaaauuucaccauaugugggucuuuuacacaguuuccucuauuugucgugcuuucuguacucucuuggcccuuuggcucuauaaacuuaccaucuuccauuuggagaaauuuguuuuuguauuauuucuuugacaauuuccgcuacccuauuuucacuuuuaaaaaauucugugaaacucucauuaaucagauauuagaccccuuagauuauuuuuuuuguuggaguggagaacuccuuuauuuuauauauaauaaaggauauauaauaaauauauacauggcccuauucaucucuuuauucugcuuuauggaaaauuuccuugacuuuuuauuuugguguuuuuacggaguuacaaauuuucuguucuuacauuuuuaauuuccaggagcucuuuuuaauagcauucucuucuuguuucauguauguaauuucuugugcuaccuuugugagcaaggaaagggagcugaaauugcagagaguagucucuuucauuuugagaauuguaccuaacucccuuuaucuuguagcauuuguuauaaagcagagcauuccaaaacuuagugguuuaaaaggauaauuuaaugacuucucacaauucuguggguggauuguuagguuggcuuagggggccucagccggaauggcuugucuguguuccauguagucuuucaucuuccaguaggcuagcuuggacuuuuucacauguugcucucaggauggcauucaagagauguaaguggaagcugcagagucugucucuagaggcuuaagcuuggaacugaguaacaucacuccugucacauuuuguucaucaguauaaguccuaagucuagcccagguucagaugaugcugaaauacucugcuuuuugauggaaagugcugcauagaauuuaugguuguuuguaacuuauugcucccugcgagcucccuacaaacuccccggugcuuguccaguuucugagcuuaaccauuuacuaucccucagucuacuuucugacuucauauaguuuaauucaggguugaaauaaccucauuguuucauggaagauggaguuuguguuuuuguuuuuuuauccuguuuggggguaauuuuagagggaaguggauggaaacaccuuuauuucuccauuguaaaacuugaaacauuuuuuaugaagaugaauauggguacagcagauaugagaauaguaguguucuuuuucuauccaugauggacagauuauugucauguaauccauucaucaguucaucaaacuuacggauaucacacaugcuggguacuaucaguucuugcuugucaucaauuuauaaucuuaggauaagaugcuuuuauaaaauguaacuaacuuaccaggcuuaaaguucuaguaucauaccuggauaugauguacauuaaguauccuauaauuuccagaggaagggaccacuuuggcuugguucguaaaaagaggcagcaugaaugcugaugucaaaagguggacuggaucuugguaagcagagggucuacccaggucagguguuuguugaugaggagggagugccugcaagcaaaggaagggugguuaaaaagaagaagggcagguugcgaugaggagcuagggagagaacuguuugguuggagccaaggguguucuagagugggaaaggaguaggauagggagagaagggagagaacagauugcagaaguacuuucaagccauaauaaagaacuuugcuauauauucuuuaugaaugugaauggaaagauuuucaguguuuuuuuaaagcaggcagucacauggaggaaaggugcgggaaagggguuugaaaggggugggaucuagagacagaguugaggcuuuguagucuagauguaaggagauaaaagguguggacagaauggaagggaggggauauugucaagagguuauuuuaaagaaaaauuacagcuugugaauuuagaaacaaaauucacuuuguuucuagaccagauaaauggugcaagaguagagaaaggagauggguagauaaagguggggaaagggccugguuuugcgggcagaagaugagguuucuguguguuggguuugaagggauguugggacuuuuguguggagaugucuagcaaacaugguuaaaaauaagcauuuggguugaacacugggaguuuauaacaguggugguuaaaauccuaaggguggaagagcucuuggauaggaagaaaagagaaaaaaaaggaaggaggauaugauaaacccacaaccaaaucuugagaguaccuuucagggagcagaugaagaaagaggugaaaauuaggccugaguacuugugugugcguauauauacacaucaaaacauagacauacauaaauagauaaugcgcacauuagaugugcccacaaagauacugagaaguugaacguuugauguaaaaccugaagaucaggguguuuaauuauuaccagagaaguuaucauugccacaagugaggccuugaccacauaucagcauuuuuauugccacaucuuugagaaauccaugccgucuuauuuguaguaagaaaauguaaaucaugucuucaaucaccaauuacugaccacacauucuucuauuuuucuuuucuuuuuucuuucuuuuuuuuugaguaucucagucugucacccuggcuggcuggaaagcagcggagugaucauagcuacugcagccuuggacugcugagcucaagcaguccuccugccccagcuucuccaguagcuaggacuguaggcucaagccaccacacucggcuuauuuaauuuguuuaaacuuguuguuguuguuguuuguuguuguguuuuuuuuuuuugugacgggguuucacuuuuguugcccaggcuggagugcaauggugcuaucucggcucacugcagccuuugcuucuggguucaagcgauucuccugccucagccucaugaguagcugggacuacaggcgccgccaccacgccuagcuaauuuuuuuauauuuuaguagagaugggguuucaccauguuggccaggcuggucucaaacuccuaaccucuggugaucuacccgccuuggccucccaaagugcugggauuauaggcgugagccacugcgcccagcccuaaacuuuuuuaagagauggggucucacuguauuauugcccaggcuggucuugaacuccuggccucaaaugaucaucccauuucagccucccaaaaugcugagacuacaggcaugagccacugugccuagccugaucauguguuuuuuaaagcauuuucaacuccaauagaagggccacacugcaggccacaggauugcacagcaugcggggcugacaugcugcugcaguacuugcuguguucaguggcccuuucuggauuacuacucccucgcccugcccuuuaccacucacugcccuccccggacccugucucuggacuucguuugcucucuuucccucugaaaauagguuuuguuuagcauuaauuuauuaagauugaucuaauuaagaaguucuuauugggcuucuuuaccacuuugaaccacaugugauuguucucugaagaaucggcuuuuuguuuaaauucacaaaggguuuagaaauucaaaauucucuguggucaggacaauguguagcagaacugaaacaaaucuagacucaguccagaccagguguuccagugaguuugccuguagguuacggauccgagagacaugaaucagucuggacuugcuacuuaaaucuuaagaacuugggcaagcugcucagcucuguaagccucacuuccuacucucagaagugggagcaacaguaaugucuauucuguaaugcugcuguuaggguuaaaugaaaugauucacacggagcugguagcauagugccauacccucgguuaacucuuaguaaaaguuacucugucuucaucauuauggucaucguuagcaacaccugacuucugugucuaaggcugcccuuacccuucucagcuguggccucuguaccugggaauguuugggaauugcauugaguaugcaggacagagagugcaaaugaaauuuuuuccaguggcuccuggauccuugaacggacuuccuaacaugccccgaggccagaguagauguggcaugugagacccuuuuauuuucaaugccguagagcagagguggggaguauuucaagaaguucuugucauccuucccccuuuuggcauaaaggcccccaagguuaucugucuuuggcuguuaacaugccccauccauuuacccaacauacacuuauaaagugcuuuccacaucccagacacugugcuagucacugagucuacaaggaugacuaagacaugguucuugcccucaaggaggaagggggucaugcaaguaaaugcaaacgaagggcucccccuaaguacuguagauggaacauacauaccuuuccaucggguaaggagcagguugauccuuacuacugagugcugaagacccauagucugacugauggcagugagcagcacauucugaauaugaggccacuuaggauuauguguucuccugaugguaguuuuuaacauggggaagcacccuggguuccacacagagcagaaauguugcuguuauacguugccugggcagauucugggcauucugacucuuuccuaauuauuuaaacugugaugcuuccauauacacuaggaugacaucuuuccuuuauuaacauuaagauguuaucaaauaauggagggggaucauguuguaacuuuuaagagcucggugaauaauaagacauugaacuucuuuuaaaaaauuacgaguaagauauaauucugguuccuaaauuagauguggugauggcugagcauuuugaggacaaggauaguuaacaguaauuuugguugugguguaauucugggcuaucaguccccaagacagacuuuugauuuuuaugaugggacuugucacaagagagcuugugacaagaucagugguguugguuaagucucuauaugcuaaacauaaacuuuugagcaggaaguccugcgugaauacaguacaggcugguuuugaguguauguggcuuuguuacuugaauuuggauggacccauuauguaagcccagcagcccuuuuuggaaaagugaauugaagccaaguuuuuaauaugcuugaacuuaaaauacaugcuuuauugacaacagcuaguaauucaucauuauccugaaaggacagcuuguguacuaaauauugauuuuucuuuuuauauuuauccaaaugauaaaaucuuugcuuauaauugguagaugaaacauuuuuaucuccuuggagaugaaaugugauuuccaugauggccacucagagccuugugucuucugugcacagggagacucaugcaucuguaugccgugugcguggacugccuggaagggguucacaagaucaucugcaucaaguguaagucacggugggauggcagcuggcaccagcugggcacuauguacaccuacgacauccuggcugccucuccauguugucagguagguacugaacacacugagggagcagugggugauauuaggcuucuguccccaagugaauguagggaagaugcgucuggcaauaaagaagaaauucaguccagcaaugauggcugaguuacuacuuguaauguagucauuuaguggaauacuauucagucauuaaaaggaauacuguagaauaauauauaauuaugugggaagcauuuccaguauauuaggucaaaagaacagguuauaaaaugguauaauaauaugcuugcauuuguaaguaagugagcaugaaaagggaauugcuaaccuguuaccagauggucucaguggugggaggcugaaugguuccuuuaguuuucuuuuuccuugaguauauuuucuaagauucuguaugauuagcuuauaguaaauuucuaauagaaaaaauguuauucaaaaggaagaaagucacuuucuuaaauaggauuuucuuguuuucuuucugugggauaguacaguuauccaggaauugcaugccuuguaagguguuugagguuguaauccuuaaagcacuacuaaaaggaggcauugucucaugcuaugaggacaucugaaauuuagcugucaucagaaaaagagggaaguauucacauaugaaaacacaaauaaccuauagaaucacaggagacaaaaugcuuggaaauaucuugcuuuauuuccaagugcuuggggaagaaaacagcuuguuagguaauuccuugauacucucaugggcaggagagaaauuuuucuuugcucuaaaguguuccagccugguuuuuuaguacaaauagcugauacauacuucauuaguuacugcauaguuuuaugucuuuagcauuauggcuugauuuuuguaaagagaguaucuuuacuauuaucaguaguuauucacuguggcauuuuaugauaguuauugugccuugaugccagcucuugagagaaaccagaggaaguggcuccccucugcacacacacaccguggaggauuaucuuuuaaauugaagaaauaaggaagugaaagaacuuuugagccuguuaacucagaagauuagcacuggaaaggaccugggaucuagaccgaccuccuuauuuccucauacaauggaggccuacaaacuugggauguuuuacccaggucuacauacauugugucacagccaugacugcaccgugugacuccuguucugguguucuuucugguacaccauugaaaggcaaugagauuauuuccaugucuuuaggaggaaaaacagaacagcauccugccacacccagccucuugguauucaccaugcacuguauuucuuccuuaaaacaauugaagcccagaccuuucuuuucuggcccccuacugaaauggaaaauauguucgauuauuguuaauuuaaaaaaaucagugaggauacaaguguuagacgcuacuaaugaaucaagggaagucuucaauaagauguagccaaaaauaagcaauaauugauucuuagaaagguauaacagugugaagacggguuugcucagaaucacacuuuuaauguuguucagagagauuacguaguuaaaagaguguuuaucucagguuacagaaaaguaguuccugcaguggcugaggaucagcaggcugcuuugguucacuccagccuugcugcuuucuaaccauggucuuuggcauggugcuuuaucacaugugccucaguugcauuaucuaaaagucagcuaauacuaccuaccucccaggaguauuuugagaacaaguugagauuauacuuuuuaaguacauuuuuaaaaugagucuaaauugagucuguuuuauuuauaauuugugguuauucacuuaaguccuggacccauugcugaaagguuccaggacugugcuguuacggagaggcuaggcaugagugaagaugcagggugcugggaacuccagaagccucagaccagcaccgcacuuccuggauugcuaauuuuacuugaguaucuugggaaauuuuauuuuuacaucaaagaaaacgcaacuuuucuauagaguagaaugaaaaaugaaauuucaaagaaguuucguggagguuugggugagggaagucagcuucagccgcugucuuaaaauccagggggagggguuucuuauuguuagggaacuucaguggagagcauuuaggcaguaguaguuuagaauuuucuucucauaaguaggugaaacagcuagcagugcugcauaucaggagagaaguugggagucuuucagguauaccccguuuccauguuuuugguaguaaaagggaugcuuugcaaagcccuugaucaguuucccagcauuuugguuuggaugacuuugacaaguguugggaaguggagggguguuguggcugauggugucuguuucccccaggcccgccugaacuguaagcacugugggaagccggugaucgacgugaggaucgggaugcaguacuucuccgaauauagcaacguccagcaguguccacacugugggaaccuggacuaccacuucgugaagccauuuuccuccuucaaaguucucgaagcuuauugaugaaagcuuugcuuuaguaauagcuauuuuauugauauuauuacuuuauuacauaucuuuuauagggaaacauucugugacauuaauuuccuuucuaauuuaaaggagaguuacuuuguuguaugugugccacuaaaauaggggcugcccuugcccugucuugauucccgaguguuaaucugugguuuugaccagagcccagauggguaauccugugcauuuggguugggguucacucuuaccaagaaucuuugaugcagcuuuaagaugguggggaggauggggugaauuuaggaaaggaauuugugguuauaaacuaagagcuugauaggaguuggaaggaaacucuuacuaaaauguuaacuuucuaaaaaccuucuuuuagaucuuccuugggccuuuggaaaaauaugugacaagugaauguaagucugugccuggagagcuaauagugcauuagucuaucucagccuaguguucugcagcacacaugggcaggcaguuuacucacacugacaggugaccugaaaguggcacaagugcuguuucuaucacuauuguaauuugccaguucauuuuucaugcugaaaguaauauccaaauuguaagacauaugaaagauauuaguguugcaaauauguuuagguaaacugaccuauaacagaauaugugaaaugaauuuggaaauaaugcaagaaggcagaacucaaucauuuaaauugugucuuugaaguugguaauauagcuuuuaaggagaacccaugaauaaccugauuugggcagugaugauuuauuacagguugcacuguugaagugucauuuggugucagguucuucucacagguaaaucuuucagccacagaaucuaacuggugagcuucagaaccaauaauugccacauuuauuguccucaaaauugcuuauggccauguauaaccaauuaauucugaguuuccaaaaucaaagauuugaccuuaagagggaagggaaaaaagugugaaaggaugaugaagaaaauaauuuuacuauuucuuuuaaaaguauguuuuggaaaaucaaugauuuuaaugcauagcaguauguuugaaaaauagaccauucuaaaaagcccaugauaccuuacuguugaugaaaaaggaugaucauauauauagaacuugauuagucagagcauugggcauuccaaaauacagccuuugguucaguagauuuuaaugcuuuaaauagacugacgucgcauacccuuauagaauuggaauaugauuucucaaaaauuaauuugauaauuucauguaugaugugcauauaugcuaaaagaaugcagaaaaucauuuuaugaauagccaaauuugggguugaugugaacauuuuauguuacucauuugguuuauacuuuuuuuuuuuuuuuuuuaacugugugguuuuucuuuucagaaguauuuaggcaauauugcacgugaguuucaguucuuuuuuucuuuuuuuugagauggagucucacucuugucacccaggcuggagugcaguagugcgaucucagcucacugcaaccucugccuccuggauucaagcgauucuccugucccagccucccagguagcugggacuauaggcacgugccaccacacccggcuaauuuuuuguauuuuuaguagagacagcguuucaccauguuagcuaggauggucuagaucuccugaccuugugaucugccugccucggccucccaaagugcugggauuacaggcgugagucacugugccuggccaaguuucaguucuauaugaaguauuugauguuuuguuugaaacaauacagcauuaaagaaccaauguuauucacuaauaucauucaucuuucaguuuggaugauuugguuugcugcaucuagguugguguuugaucaucugaaaaaacauuucagugggaagaaaugcauaaaaugccuauaagaaguagaaagucauugaacugacaguguuugaugcaacuaaaagaggauuguaagacauagcuuucugcaaacuugucuuuaaugcacaaagcuguaguggugaauuaacuaucuccuuauugauucucuccuguacccagaugcaaaaagugcuaaguuucucuuguccucguaauaccauuuggauuuuauuucugaauuuaaauaguaaaauauuuaugaugcu

SEQ ID NO: 21468 - RNA, 3262 nt, Homo sapiens
cagcucauuggcgagccgcggccgcccggagcguauaaaagccucgggccgcccgccccaaacucacacaacaacucuuccccgcugagaggagacagccagugcgacuccacccuccagcucgacggcagccgccccggccgacagccccgagacgacagcccggcgcgucccgguccccaccuccgaccaccgccagcgcuccaggccccgccgcuccccgcucgccgccaccgcgcccuccgcuccgcccgcagugccaaccaugaccgccgccaguaugggccccguccgcgucgccuucgugguccuccucgcccucugcagccggguaagcgccgggagcccccgcugcggccggcggcugccagggagggacucggggccggccggggagggcgugcgcgccgaccgagcgccgcugaccgcccuguccucccugcagccggccgucggccagaacugcagcgggccgugccggugcccggacgagccggcgccgcgcugcccggcgggcgugagccucgugcuggacggcugcggcugcugccgcgucugcgccaagcagcugggcgagcugugcaccgagcgcgacccaugcgacccgcacaagggccuauucugucacuucggcuccccggccaaccgcaagaucggcgugugcaccgguaagacccgcagcccccaccgcuagguguccggccgccuccucccucacgcccacccgcccgcuggaaaaagaaaccgcucggacugaguuucuuucuccagcugcugccagcccgcccccugcagcccagaucccaacucgcaucccugacgcucuggaugugagagugccccaaugccugaccucugcaucccccaccccucucuucccuuccucuucuccagccaaagauggugcucccugcaucuucggugguacgguguaccgcagcggagaguccuuccagagcagcugcaaguaccagugcacgugccuggacggggcggugggcugcaugccccugugcagcauggacguucgucugcccagcccugacugccccuucccgaggagggucaagcugcccgggaaaugcugcgaggagugggugugugacgagcccaaggaccaaaccgugguugggccugcccucgcgggugagucgagucuuccucuaagucagggucgugauucucucccagggagggaguccuaacugugccgaccgaacgggggaaauaccuuauccaggcguuuuacaugguguuugugugcucugcucucgcagcuuaccgacuggaagacacguuuggcccagacccaacuaugauuagagccaacugccugguccagaccacagaguggagcgccuguuccaagaccugugggaugggcaucuccacccggguuaccaaugacaacgccuccugcaggcuagagaagcagagccgccugugcauggucaggccuugcgaagcugaccuggaagagaacauuaagguacauguucugcuccuauuaacuauuuuucacaggaaaaacaguggauaggacccaacuuagggcucuugccacgcuuguuaguauaagcccguuaucuccaaaacuaucuaaccauugagcuguuuugcuggaaugagagcuuguguaauagcaaccaccaguuuuccacuacgaaaucuuccacaggguuaguuaauucaagacauuccaagagaggcucuggcuauuuuuggacauagcaaaugagacucaaacuuccuccccucaaaauauaaacagaagucagacaacagaagacuaaaacacagaggguugaagaaagccacuccucuuguagagucgcugauuuuuuuuuuuccucucucuuuucccuugucuuccuuagaagggcaaaaagugcauccguacucccaaaaucuccaagccuaucaaguuugagcuuucuggcugcaccagcaugaagacauaccgagcuaaauucuguggaguauguaccgacggccgaugcugcaccccccacagaaccaccacccugccgguggaguucaagugcccugacggcgaggucaugaagaagaacaugauguucaucaagaccugugccugccauuacaacugucccggagacaaugacaucuuugaaucgcuguacuacaggaagauguacggagacauggcaugaagccagagagugagagacauuaacucauuagacuggaacuugaacugauucacaucucauuuuuccguaaaaaugauuucaguagcacaaguuauuuaaaucuguuuuucuaacugggggaaaagauucccacccaauucaaaacauugugccaugucaaacaaauagucuaucaaccccagacacugguuugaagaauguuaagacuugacaguggaacuacauuaguacacagcaccagaauguauauuaagguguggcuuuaggagcagugggaggguaccagcagaaagguuaguaucaucagauagcaucuuauacgaguaauaugccugcuauuugaaguguaauugagaaggaaaauuuuagcgugcucacugaccugccuguagccccagugacagcuaggaugugcauucuccagccaucaagagacugagucaaguuguuccuuaagucagaacagcagacucagcucugacauucugauucgaaugacacuguucaggaaucggaauccugucgauuagacuggacagcuuguggcaagugaauuugccuguaacaagccagauuuuuuaaaauuuauauuguaaauauuguguguguguguguguguguauauauauauauauguacaguuaucuaaguuaauuuaaaguuguuugugccuuuuuauuuuuguuuuuaaugcuuugauauuucaauguuagccucaauuucugaacaccauagguagaauguaaagcuugucugaucguucaaagcaugaaauggauacuuauauggaaauucugcucagauagaaugacaguccgucaaaacagauuguuugcaaaggggaggcaucaguguccuuggcaggcugauuucuagguaggaaaugugguagccucacuuuuaaugaacaaauggccuuuauuaaaaacugagugacucuauauagcugaucaguuuuuucaccuggaagcauuuguuucuacuuugauaugacuguuuuucggacaguuuauuuguugagagugugaccaaaaguuacauguuugcaccuuucuaguugaaaauaaaguguauauuuuuucuauaaa

SEQ ID NO: 21469 - RNA, 41129 nt, Homo sapiens
agagcucgagucugauccgggccuugccgggcacccuggaaaggcgggggugauaguacagauggagacgcaacugcagagcauuuucgaagaggugguggugagugcagcugccggccauccaggacuacggcuuggggacggggagacgcgggggcagccgaccaaggaaacuggccugggcaaccuccucucacgccucccuuuuuauucccuuguuuugacaccgagguuguaugcggggaaguuuagugauucucaaacugcugucaaguucauuguauccuuugaaaucgauacagugacaggccagacagguauugauaguuucagagcugauuaaggugacuugcccuguguuacauuguaauacuuggcuaagggaggcgccuuuuuaaaauuaacauuguuuacauuuuguuuuuuuuuuuuuuacagaaaacggaaguuauagaagaggcuuuuccugggugaguguaugcguggcagaguuuuguguuuuuaugugauugugucugucagauuuuacuuaguuucguguuggaagguuauaagauccacuauucugauuguguguaauuaccuuuuuaaaacgaaugacaaauaauguaauuuuuauuuuuuuagcauguuuauggauacuccugaagaugagaaaacaaaacuaauuagcuguuugggggccuucagacaguuuugggguggucuuucucaggugagcgcuucauuuuuaauacauucagcugaugauuuuuggccucuucuuuuuuuuuuuuuuuuucuuuuaacauuuacuuucaugcugcucuuaagaucuuccugagaagggagaaauaaaauuguuaucauuuuuuauucuggcuuccauuuguuuuaauuuguauauuucaguggaaaaccuguguugagaagucaaguugauacugcacagugugagauguuuaaaaaaaaaaaccuccccuauguuagauuaauugagaucauuuucauccuauucggauuuauuugguacacuugaaaacagauauguuaagcuuuacuugucaaggauacaaauuccauuuuucugcuaaauaaaggaauuggcacagcauugauacaaagaugcuacaauaggaauaccaagauucuauaauaaggauaggaaaauauuauaguaaaaaugaggagacaaacuguaaaaguaacaaagaacagcuaccagaaaauguauccgugaaaaagacaaaaaugugucauccucgaagagcucacauugcaguagugccuuaccuucucaugguacacuauagguagggaaaugagaacuguuugcgugucagccacuggugauaagauuugccacucagacauggaucauauaaugccaauacagucauguuuuaaccuuuuuguuuaguuguuuucuaauagguaauacauuuauaugguucaaaaugcacagguauaaaaggguggauccaauaacuagucucuuucucuucucuuaccuguuauuuuuucugucuguagccaauauccucagguuauguuuucuucuagaaguauuuuaugcauauagaaacacuuuuauagcaugaucauauaccauguacacuguucauuaauuagcacuuuuuuucuccuaauaauaaucuacagguaauucccuaucaguccaagcguuacuuguuccuuccuuucuuacuuuuuuuuuuaaauagcagcauaauauuccauuguauggcuguaccuuccuccuuuuaaccaaucuucuacugucuucuaaguuucuucuuacuuuuucuaauuuaaccaaugcugugaugaauaauauuaugcaugaaaaauaggauaaauuccuagaaauaguauugcugagucaaaagccuuaucaguuuguaauuuuuauagaaauuauuaaauuuuccauaaggguuauacuaguuuaugcuuccaccagcaguguuugagauuaucuuuuucuuuucuuuuuuuuuuuuuuuuuuggagacagagucucacucugucgcccaggcuagagugcaguggcgugaucuuggcucacugcaaccucugccucucggguucacgccguucuccugccucagccucccgaguagcugggacuacaggcaccugcuaucacgcccggcucauuuuuuguauuuuuaguagagacgggguuucaucguguuagccagguuggucucgaucucccgaccucaugaucugcccaccucggccucccaaagugcugggauuacaggcaugagccaccgcgcccggcugagaguaucuuuuucuuauaaccucacaauagaguguuaagcuuuuugaucuuugccaaucaaaaacaugagaaauuuuaucucaguauaauuuuauuuugcauuucucucagugauguugaauaucuuuccaaaauuuaaaaaaaaauucauuaaacacuuuaugaauuaugauguggcccucuaauggagagaccaggaagaaaauagguauuuccaaaucauuguuauaugugccacaauagaaguauguaugagaacagugguuguggagagaagcagaacauuauaggcucuuuuuggagauaauccuagaagacaaacuuugauacgggcacaacauuuugacaucguauuuaaaguuuugccagucuagaaaugugacaugucauuggauucauaaugggcucuuguuugggaucuuagggauuggauucacaccuaauucuccuaagccugauacauacugauccauaaugaauuuuacccccagugacaguaauauuuauauaugccauaaagggcacuguuuacaaugccuuacaacaaucuguguuaagaguuuucuauugaccguuaauauguuaacuaauuaauuacuacuuuugaaguucccauguaauaaaaaugguagcauuuuaucuauguaauuacaaaauguuaagcuuaaugugacaaauacuaaaucugaauuuuuuaauuuugcuuuuuuuaaaaauuauuuucauccacagaugcucauagugaaguauuucuuucauaguauugguauacuuccaguuguaguauuagcuauugguuauaaaaauguaacuuuagaccccaaguaaaaucauucucucauuuuccaggagucucaugaacaguguauccaguggauuguuaaguuuauucauggucagcauaguccuaaaagaauuucuuuucuuuaugacugcuuagcaauggcaguugagacuggucuccuuccacccagguacguuuaauggguaugagcaaucugaagaauuuucuuuucuauaugugauuggaaauugguugagguuguuguuguaaaaagguaagagaaugaagaagaaggugagguuuaucaaguaauccuuuauauaauaccucagguuuuaguuucuaggaguaauagucuuugaauuagguaaugcuugugggcucaaaaccagauguuucugcccaggggcugaaauuaaucacuuuaauuaguuuguaacccuuuacuuuugcugcacaaccucaacaccuuauggcuuaaaacaguaauacucagguuuuaaaauuauucaugguuuuagugguugacucggcuuaggagacacuuuuuacucaaggucauaaugauugugaucaauguggcuagggcuggagcauggcaaaagcuuccccacucagauaucuggugguugauuccuggcugucaucuggaaccucagcugggauuauuagccagaaccuccgcaggcccucaccuuguggccuagacuuucucaccucaugguggagccuaacagcaagugugcaaaagagggcuaggcagaaauuguaucaccuugucuucuuggaagucauacugcauccuuuuggccauagucuuaggucugcccagaucuaaggagugagaacguagacuuucccccuaccucuccuugggagaaaugucagugucacauuucagaagaagaugugggaucaaaaaucuuguugccauccuguuggaaaaauccaguguaccacaaggugauagaugguaaacaucuaaccgaaagcuuuagauagacuucuuucuaguaaaauauaacauaaugaauauuauuucauucuuacuuuguuuuugaucuuucauacaaguaaaaaauguaaaauacuacacagauuuauaagugugcuuaguaaucacuuuuaugaaagacacuugugaggauaaauauaauacagugcacagacuauggcuguauuagucugucugaugcugcuaacaaagauauacccgagacuggguaacuuauaaaggaaagagguuuaauugacucacaguuuggcauggcuagggaggccucaggaaacuuagaauaauggcaaaaggcaccucaucacaggguggugggagagagaaugagugcccagugaagggggaauccccauauaaaaccauuagaucuugugagaacuaacucacuaucaugagaacaguauugggggaacugucccucaugauuuaaaugguuuuucucaugacacguggggauuaugggaacuacaauucaagaugagauuugugugaguacacagccaaaccauauuggcggcuauuagagaacuuggaaaauucugucuuguaacuggaauggcuauuucuuuuuuuauaggcugguuugugaaucccugauaaacucugacacucuugagugggaaagaacacagcuuugggccuuaacauuuaaacugguucggaaaauaauugggggaguggauuacaagguauauuuuucuuauuauaaaaagugauugcuuucagauaugauugauuuuucggugugcaugucuuauuuucaggugagagaaaugauguggaagcauuuacaaaaucugucuauuucuugugguauauuuccugaaaagauuuaaaguuacucaguuguuucccuggcuccgcuacuccccucccaacauucuuauaaauacagguagcugauacauuuuuaugaagagcagggaagucacaaagcagaauccguguuccuucaugcugcaaguauuaugaucccuucaaaugaaagcacagagcagggguguguggaacugagaagggauguaggcaucacugaugaagggagcaagaccuggcuucacuucucuugaacgugggucuuaccucaauuaauaucuucagcacuuugggcucuugaccaaaaacaacauacacuuucuaguuuugucucauaaaacggcuuagggacuccauagcuacaaaagccauucugcaucuucaggagacuuuuguuauuguccuuuucccgggaauuaccagugucugacccugugcuuuauuucugcauuuucucuaaucugaaaugauuuaacagguaaugaccuaacagauaauuauuaguuuaaaucaugauuuaucacacaguuaacucuaagaagcuuuugcuaauuauuuucucuuuacucagacuuaugcaauuuucuuauuuguaugauacuucauaauuguucuuuuagguauauguucugucuuuuacaagcuugguuacguaguucauagucaauaaauaaauguugaaugaaauuucuucuuuauauaucagauaauguaacugguauuggauauguggaaaugauuaacagaauagccuuggauauccuugagagauuaagguaugugauggaugagaagggagaauaggccagucacaguggcuuacaccuauaaucccagcacaaaagggagugagcagaaacaguccucuaccaaaaaguuugauauuguuacucaaguuuucagagugcauugaagucuuguuacaauauauuucugucuauauguauaauuaagguuuuugacccuuguaacaacguaaacccuucuaauguuaugagggccaaaaaagcuugacaaacuguauaaugacuuucuuugcucauuguauuuuaagacagucuuuagaacucuguuuuggaacaugacucuucuguuggguuaauguuagggacuuagauuguaacugauucagaaaauuuaaaggugugaccuugaaggaauauaucacccugaaaccuucggacguuuuagcuaacacaguagacacuacuuaauuuuaacccaugucuuuuuucuuauaucaggguguucgagaucucuuaaaagugauuuuggagaagauuuugacaauuccuaauacagugagcucugcuguuguacagcagcuucuggcagcaagagagguaauuuagacaugucugaaauucgugaucauaaccucaaaaaagucuagcuuuguuuaggucugugcuuuuaauacuuacgguauuuugugagaugcucuauuucuucuaccaaaaaaaaaucacuucuauuuuaaaagaugcuaguucccuuauauuucaaaaggacauuuuaaauuuuaauucaugguuuuaaauuaugaaaacaaugaaauagaaauuaaaauagcuuaaacauuacaagaccuuagcauauggaccacuuaaaagaucuuuguacuuuguaacuaguaucgcaagaauuguuacguuggucuguugcacuccuguuuaagugugccaauauuuaaagcaugugcaagguuauuuacuaaccaugaacaauccauuccauuguuuauuaaucuuuauuuuuagauauuuuuuacauauaaauguauucuuugcuacaguugaaacccaauaaauccauuaaauaauaucucuauauuuuauuuuaauugacaaguagcaauugucuguguguguguauauauauuauauauacuuauuuuuuuauaaugauaacacuuaaaaucuacucucuuagcaauuuugaaguauacacuauaucguuauuaaccauagucaccauaauguccaguaggucucuugaacuuauuccucuugucaaagugaaauuuuguccuuugaccaacaucucuccagaaaguaacaucucuacuuuuuaaugucuuuuuuguugucauugucauuguaguguuuaaaacgcucacaugggccagaugcaguggcgcaugucuguaaucccagugcuuugggaggccaaggcgggaggcucauuuaagcccauuguuagagaccagccaggacauccuggggagacccugucuuuacaaaaaauuaaaaaguuagccgggccugcuggcauacaccuauagucccagcuacucuggaggcugaggugggaacaccacuggagccccagagguugaagauguagugagccaugauuacgccacugcacuccaagccugggcaacagagcaagacccugucucaaaaaaaaaaaaaaauaaugauaauaaauaaaauaaagggcuuauaugugggacuagucaagaaugauguggccuuuuuguuuuucuuagguuauagcauauaucuuggaaagaaaugccugcuuauuaccagccuauuuugcagucacugagaucaggaaacuguauccugaaggcaaacuuccacacuggguaaauuuuauauuuccugaauuuuuaauaaaaauuuucggcugggcuucguggcucacagcacuuugggaggcaaaggugggaagaugauuugaggacaagaguucaagacccaaccuggguaacauaacaagacucugucucugcaaaacauuaaaaaacacacgcacacauauuagccaggcauaguagcacaugccuauagccccagcuacucaggagcugaggugggaggauuacuugaaaccaggaguuugaggcugcagugagcugugaucacaccacuguacucuagcuucggcaaaaggacgagacccugucucacacacaaaaaaggguauuuuauaaaaaacaguuauauuaaucuuauuuuugugugcuuauuuuuuuaaugaugacuuuuauccuuagauaauauguauauuuuuaaucaugauguauuucuuucauuuccauuuccauugagaauuuauaugccauguaauaaaauaugaucagcuucaucaaauagcuaaggauaugguggugugacuugguuuaauuaagggacagaugaacuggcgagugauuuuuuagaaggaagcaaaagggagcuaaccuuuaaacaguuaucaugugcaaucuuuacauauauuaucucauuuuauauaaauguucauauauuucaggggcagucucaauuuuccuuuuguacguauuuauuugacuucccucuuucuuucucucuuuaguuacuuggaaaccuaguaucagacuuuguggauaccuucaggcccacagcaaggauaaacuccauuugugguaggauuauaauuuuaaauaugccaaauaguaccugauuuuuaguaaucuaauuauugaacaaagcugagggauguucucuuaauaugugccuugguggcuugucauuuuggugacucucuaagagcuuaauauaaugccuuucccuuguuuucacuuacucugugugccaaguacagggaggaaaaagaaacucucuggaauggguuuaagcuucauuuaaaaccauucuagaaguggguuucuuggugauuagaaagacauuuuaauacagcuaguaaagcaccauggaauuucuaggcagcuggaagucugaacagaccugucccucuguggcuacagaacgugaaagugucaggcucacucagcccauucuaauucccacuuuugcuuuuccuuucgcauuuucccauguuuuguuagagucucugaacuuucuuuuaaaaauaaccaugugauuuggcaauuuuugcagugcccacauauccucuuuaauuauuucuagaaaucauggugaccucaacuguguggaaauauagaccauuguuuauucagugaucaaauauugaguacuuccuauaagccaggugcuauucuagauacugaaaauacaaauacaaucuaaauagacacuagacagauaauuaucagguuucuagcuuuuguaacugaguggauauugauaucauguagugaauuauggaagcaaaguagguuggagaaggaugaugaauuugagacauguuaagcuugaggugcuuguaggacauccaagugacgauauuuguuaggcaguuggauguaugagcugauagucauaugugacaucuaaggccucuaggaauaucgugcauaaaguuuaaucauguugacacuggacuaguggucuuaaacuuuuuccuguaaagggccauguaguaaauauuuuaagcuucguaggcuacagaaucuguugcagcuacucagcucugccauuggacugcaaaagcagugguguuccaauaaaacuuuacaaaaacaggugccaggcuggauuuggcccauggauuauaguuggcugaucucugcccuagacauuuagacaaaaugcgauauuuucaacuuuggaaagccugugcaaauugaucuucaacuaucugaacuaaaaauaaaauucccaaccuucagucucauugaaacauuuuuauaagccauuuuuaaaccaaaccaaugccuauuucagcauauauguucauuaaauauuugugaagugaaugaaguacugcuguguucacauuuacuuaaaaacauuuuuguaauacauacaggucgcuguagucuucugccaguuguaaauaauucgggugccauuuguaauucauggaaacuggauccugcuacucuucguuuuccuuugaaaggccuuuugccauaugauaagguauguugcuaaauauaauggcacuuuuaguccaucugacagucuucaaccuagauuauaagauaugugaugcuaaauuguugcuucauaaucugaagaaguaaauauuuaaugaaagauaguuuauaguuuaucauguuauucuaguaucuaaauauacccugugguuuaugcuauuguggguguuuaugcuccagugguccaccucuggcaaaguauuuggaggugagaaacugaaauuuuaaauggcaaacugaaauuuuaaauugauuccuugauuaaguccucacauuuuaaaaguaguagagcuuuuuaaaugugaacucagucuaauuccagaaucuacacucuuaacaccugugcuaucaaguuauuugucuuuccaaauuuggaaauaguguuuuuguuuacacuuguaaaacagaauuuagaaacugucuccauucuucuuagauuacauuuccgagcagaaaauuacuuccuuacaaugauacuuaagacuaaugugacuauaucugaagucacauuucugaguuuaacccuaaagggacgaggguaugcuuuuucaaaucacugaaauuuugauauacccuuuaaggggcaccagucccucuaaauuguugcauuagugagcagucuugcugacugaacugauaauuuuuugggccuaguugcucuuuuuacaacuauaucuacauugucaacucuugcuauaagaaugucuuuguaaaacagucacuuugguuauucuguuuuuaaaugccucaggaauucuuuaaaauuagcacauugaagugaaugcuuauguacucagaccccuuucccagacauuuuacuguuaaaaugaagaaaggaacaguaaacaaagacauucugguagauggggugaauagagagggauuacaggcugaugggaaugaauuuaaaagaaaaaaaaaaaaagaaauuuaaugccguaacuguuucuaagguuuuuacaucauaguuacaauagcauagucuuuuaaagauuaucuuaaaaaucgguauaugaaguguuuuuuuuuuucuaucuauccguccauccaccuaaggggacauuuaaaaaaauccagcuaacauuaugcaaauaguacuugagguugauaagaagaaaaacuuucauugacucuaucaaaaugcuauguccccagcgacacagauagaaaugaaaacgaugugcucuagaaagccguaagaugacuuagaaaccaucuagcaucauggaagaguuagaauaaacuaaaaugaaauccuucuaaauuaauauauuuaauaaauauaaauuaaauauaaauuaauauuuuuaaauuaauauauuuuaaguaugggcaggcaaaauuaacaaauauaacuaggcuuaucacuguuucaucuacuucucaaaaaguugauaugcuuuaagcuaaaaagcuguuuuuugaaucuuacuaggaaaauagggaauugauuggucuauauucaagacauugaauaaauauucagccugucauuuggaaaacucugaaaaagauuuuguuuuuaaugucacuuucuagcauuauuuuuuguuugauuguuuguuucuuaagucaggcucucacucugucacccaggcuggaguauaguggcacaaucacagcucaccgcacccucaaccuuuggggcucaggugacccuccccaccucagccuccugaguagccgagacuacaggcauaugccaccaugcccggcuaguuuuuuguguuuuuuguagagaugggguuuugccauauugcccaggcuggccucaaacucaugggcucaagagaucuucccaucuuggccucccaaagugcugggauuacaggcaugagccacuaugccuggccuaguacuauuuauuauaaacugaauuuggcuaucagaaauucuauacuuacaugccuagaaagacuucuagaaaauugacuuguuaaguuuuaacagaaaggaagcaaagauauuauuaaugaugcuucuuuaugucuaggaaacaugagcaccuaggacaaaaucuauauaaauugacauuagugagaugcuaaaauuuaaaaaauuuaaaccuucugcguuuucagggaaaggauaguagaaagugcacuggggaagggggauuggaaggucuggugcuaguguuaucuuuauuguuacccucuguaugaccuuggggcaagccacuucaucucaggugucaaaugaggcaaaugaggggugggaacagaugaacuguaagcacuaaaauccuaugauuuuuuucccacuagauacugccuacucugugaagguaacaagugccuuuagaggauuuuuuaaucucauuucuaauaauuuggauuaauguugacauugaucuugaagcaaugauuuucuuauuuucuuuaaaggaucuguuugaaccacagacugcuuuguugagauauguauuggagcagccuuauuccagggauauggucugcaauaugcuagguuuaaauaagcagguacuguacuaugcuggaaaccuaguaaauucugcauagaaucugcacuauucuuuucucuuuucuuugcuauagcuaacugagcaaaacaguuaagaacuauuuagugacuuuuaaaaauauacaugguuuuuuaaacaauguauuauuccuaucauuuauauauugcuuuaagaauguuuaaauuuaaaaagaaaaauuuuuaaaguugguuuauuuugcauugcuuuuuuuucuauaaggccaguuucaaguauaccuuuugccagagaaaccuacacaugacucaaccauaauuuuugacuuuuuuuguuguuugggugucuauuuuuauauaacccuugguaucuucagcguggccuucuugcugauuuuuuuuuuuuuuuuuuuuuuuuuuuuuuuugguguguguuugcuuguuuuuggugguuuaacaugugggaggguuugugcugacucuggguuccuugaggcuggccucauagucacuguuuugucuuuucuuuuuuucuuccuuuauuuuuguucuguccugucuuguccugcccauccuccaaugcucuagaccuugaacauugcucagguauguucacaaccuuacuguuguauugugacuaacgauacgcuggccgcuuuguagccacugauuccauuuagagaauacguguauggucggggcuugaaauuggcaggaccaugcugagaccaaggccacuaaaaaacgauuucuucuugggauaugagaguuauuuuugguggauuguuuuuguuuuuguuuuuuugguguuuguuauuuuaauauucuuuuuucuuuuuuuuucuuuuuuuuuuuuuuuuuuugguaacaaagagacaacaccuggcacucaaugaagccugucacuuuuugaugguuuauuuuuccuucccacuccauuuacuuuuuccuacuuuagggcuaaagcuagccugguggaauuuucagagauggaaagauuugugguggccuuuaucuuuccagacuacuaaaacaaauaaagaaaaauaacaacaacaaaaauacuuauguugcuuugccuuaaaacaaaaacaaauuaaaaacaacacaaaaaagagaaaaaaggcacuuuaauagagauaugcugcuuuuaaaaguuggagugguaaacuuuauacaggaaaggcuuuuuuggaaacauggggauugacuaagaaaugucagacucuuaggugaccccacaccugcuugacaaacacccuucuuugucagucuuugccagaagugccuuccuccuagagugagcuccucucaacuggagcucaccuguggugggagaaaaacacuauggccaaacuuuauaaaucaaacucuuaacagucccaagucuguuccaggacuuuucaccuuugauauuuuaaacaaaauagugguuccaauuauuuuuguuaaaaauuuuugagcccaacauauuaaaauagaccagcuuuuugauuuuaaaaagacguucuugucuagguuauauaaaauagcguuacuguuugcaauacuauagugaagguugugccagugcuuccauuuauaaagcccuauuuuuaaggacauauagcuuggccauaaaacuugcucaguguugaaacuuugcaugccaaaccucacccuaauagcaguaucucuuuuauuauuuuaaguuuuuucuucugaaaaauuugccaaguuuccuuguuuggacaagcuuuuguacaugugaaacugaaacugcuucacacuagaguaucugacagguaccucauauaaucugucaauuuaacaucuuaaauaccaagucauuaauucugaucaacuuucauugaauuagagguaaguauucaguuaacuuugaaagaaugcuucaugcuauguuuuaaaacuaauuuuuacagugaaccuuaagucauacuggacucaauuuuuuuacaguuugguggauaaauguacccauggucauuugagcugcaaauacccucccccagauauccuuagcuauccuaagcuuuuuucucuugggggcgggcagcucuucucaaacuagaaauugacaaaacaauugagaguauuucugaucugaucauuucgguaacaaguuucaaccuaaaaaaaguuuaugacuaagacauaaauccauaaaaaauaaaguuuauaauggaaaugcugacagaacauuauuaguauugguaccacuguaguguaaacauugucaaaaauucacaauucaucaguaaucguuuucauagaaaacuuuuaguuaggggauguguagacagaagauaauaugcucaguugacuugauauuuuuaccuacuggaaaguagacuagaaaacgagaacacacaguauaagaagcauaugauuaaagauaaccaagucaucuuaucacaucuuuuaucauuacagaacuacauccuacacuauacuuucuuguccuuucucuagcaaugugauaauuuacucacagcuuuugaaaccuuaagagcuguucauauuacauuuuccaguaggaauugaguuauauuuuaugcuaauauugguuacauucagcaagucauaaauagcccaguuucaugaccugcaagguggagcguuagacuucaacucacaauggaaaaaucuuuuuuaugugcuuacacgagaguuuguauucuuucugcugaauaaaagcacuacaaaacagauacacuccucaagcucuuacauaguguggugugugaacccuggcuacuaugagacagugaaguauucaucauucauuugaucuuauguuaaucaguaaguuucucuuugaaauuauucugauuauggguaacuuucuugguuaaagcagagaauaugauuuugaaagagaaaaugacauugaaaagaauuuuucuucccaacuucuccugaauagauauuauuuuaaaauuuauuuacaucacugaaauaauuuaaaauuaagcucaccuaaguacaguauguuaaaauuucacugcaaaagcauuaugagaacuguacaugaaaagcgucaaguaccacucaauauaggauaugagaugcuaagacugaaaagcgacaucauuugccauuugaaauagugcugggaaggaauugggcauaggucgaggguuaauauuaauguuucuauuaaugucuuuugccugauuuuuagcuuuuaucaaagcugaaaauauuaaaugaaguuucaguauaguuugggcuacuagguagaaauagaauuguuaaaauauugaauguaaauauucuuaaaacagguuuuaacuaaauaggcauauaguuaugauguacacuaacaaauuuaacuauauaugucaguauuuugaagacuuaaauucaccaaagcuuucacaaaacaagaugugaacagucauagggauagcauccauuggcuuaugaaauaaucuuagccuagugauugacaguuaacuuuuauucauagauucugaaacugcuuuacaaauguuuguuccacuuuguaaaaccaucugcuauguaguagagagucuuaauuuuaauguaccugucuuuaaauaauugaaaacuaaagcaguuuauuauucugaaguagcaacacagaucauuuuguaucucagacuuuucuuuuuuuuuuuuugauguuaccaaaauuugcagauaaagcaacauauuuaagcugucuuuaaacuugauuugagaaauauccuugguuuuaaccaaaaacaccugggaaauuuguaguuaauccugauagcucuucugcuaccaucagguaccggagcauuagguacuguagauauuccugacuuaauuuuugacagaaaaguuaaggguaaucuugagucauggcauauauugaaagaccaucagcuuuaacuguaaauuuccuaguuguucuugcuuugucaaaaucguacuauuuuugcuuuccuuuuaaaaucauuaacuguaugauaaucacuacaugccuaaaaauauguaggugaaaauccaguuuuuuucuuaaauagcuaauacuaaaaaaggaaacuccaaagugacucaagugcuaaaaacuaguuuuauuuaguuugcucuuuuuuccuaaagcagauugauggaagaccauuauggauggagaaauagaugacaaauuggucaguuuccaaacuggaagcaaauucccaucacuagugaaaaauuccuacuggaaauccuggcuuuacuucuuuucacaauuuuuucugacucuguauacuuugaaugaucucacucuaaauuuguguugucugacacauuucuuagguuguuggugguuggcagaacuagugaauuucaagcccuguacacaguaguuuugcaugcugauuuaagaaauagucuguaguguugucuguugcacuuugcucugcuucauaaugauaauuacauuuggaggaaaaguacuguagucucaacuggugguguuaauauugcuauuuguaaaccuguaaugugauugaacuguggucauggcauuguguuuuuggaaaaaauaugaaacaaccauugaugcuuaucauuuggauagauguuuguuuuauuugcaugcuuuaagaaacuacagcuauauuggagcuuacaaguuuggagcuggcaaagagcaugcaaaagaggggaugcuauucauuaugucuuguuuauuuccaaauuuguccccauuuugcauuuuuuucccuaaauuugaaaaaaucauaucccuuuuucauggcaaaagacugauaaucacaucuaaaguuuagggggaaagaucuguauuaguaauuguauucacuagaagggcuuccaacugccugcuacuaagucauauaacauauuuauaaaggaaauaugaaaauggcuuaaacauggcuuaacauauuucuuuugguaaaaauauauuuuuuaaaucacuuuuaaaagcacagaucuuuuugccucuagaaagggaaguugcauucucauuuuuaguguuuaaacucaauucuuuuucuuguuuuagauuuuaaaguggucuaauuuaaaauuaaagcugcauuauguuuggcuuccaagaaggaagagcagagagaucaauuuuuuuuccucuuguggaagaaguuuccauuucaguaucaggacgaauaccacacauugaaaacagauguugaauaaucugguagcuauuuagauauaccucuguauauaaaguuaguguaaacuuauagggguuacuuuaaaauaaagagauucacauaacugcuuuauuuguucugucacaauguuugaugccuguaaauccaggguuuucaucuuuugacuuagauugcaaaauuaauacugcuaucccuguuucauaugcccuuuaaaauguuaucuuuuuccaaaggauaaauaacaaaauucucuacuaugcauugcccuuugucaaauugaaacaaugauguccauaguggaagucaaaaguuaaugggaagucgguuuuguaggaaaccugaaaacauuuuuucaugaagcuuauccuguauaauaauauaacaugaugcagcuuuaauagacuaaaucuaaccuugacuucuuaaguucaacuucauuccgugcuucucagccucuuguuacaauuaaugcccauuaacugguaacuucugaaacuaaccgagaggcuuuuggaauacuguauuuaaucucugcccuacagcacaagcagcgcugcccugugcuggaggaccaguugguggaucugguuguuuaugccauggagcgaucugagaccgaggagaaguuugacgaugggggaacaagccaacuccuguggcagcaucucucaagucagcucauuuucuuugugcuuuuccaguuugcaaguuuuccacauauggugcuuucucuucaucagaagguauguacuaaaucuuauggucggagugacuucaccuguugauuacuguauuuuagacugcugugggcauucccuagugauuuuagaacugacagaaguucugagcccuaauuucuguccuguuuagugcuuuuauaguuucuuaacuuuuuacuuucuugucacuguaaaaacaggauucagucauucauucuauguauucucagugcaggcaccagcagauacaagaugaaaaggcacuguaauauccucaaggagcaccucacuagaggaggggauacuuuauauauauauauauacauauauauauauguauguguauauauauauagaguacauauauauauguauguauauacauacacacacacacaacaugauuauaucuuaauaguuguuauaaugaaagcacauuucccugcaauacaaauaaaagguaauagucccuaagguugcagugagccaaaaucacacgacugcacuccagccucggcgacagagcgagacucugugucaaaaaaaaaaaaaaaaaaaaaaaaggaauagucucuaucagaaauaucagggauggcuguaucaaagagaucuuuaagcuaacacuugaaggacaaauagaaacuugcugagagaaaaagaaaaguguuuccuagcaauaaaaccaucauuuagaaagggauagagaugugugagaacuggaaauaaaaauauaaaggggaaaucguugaugagauaaggaaggcaggaaagcaagagcagacauggagaacuuugaauggccaugugccuguucuaaggaguuuagauuuuguuuuggaggcaaugcagaggagaauggcaucaucauaugcaaguuggaaaaaugcuaauguccacauggagaaagaaggugguguagcgauggacagguacaaagccagaagcaaggaaauuagugagagauacuacaguggacuaggugaaagaugcugaaggccuaaaccaggacagaaaggaggagccagagaucagguacacugacguggaauaggacuaggugacugacagcgaauacagagaguagcgggagucuaggcuugcugagugguuccuacugugggaaugaauagaagggaggacgaugaauccaaaaaagggagacaaguggaagacuuaaguuugugggaaaagacauuuuuugucaaaaauuuuagacauauugaaugggaauaaaaguuguuuuacauaacaucuccacagcaugaauuaucuuggggaaaauuuuucauaaauauuguuaaaauccuuucaaccaccuucucccagaaaccaccauuaguuucuguuauaauguacagaaaaccagccgggugggguggcucacuccuguaaucccagcacuuugggaggccgaagccgguggauugcuugaguucaggaguucgagaccagccugggaaacauggcaagaccccaucucuauccuuguucuaaaaagauacauauaaauaaacaagaaacaaaguguacagaaaaugaggaagcauguuuuaugacaaccaguccaugacaauuucaaauuaaaaaaaaaaaauccuuuuggugugauagaguauuccccagguuuugaugagauuuuuaaaauaagaauuaucccauauuaaacuugauucucaugcacacaugaucaacuuaaagaggugguguugugcauguuguauaugacuauguucuaaaacauugcauuuuuauaugcauuaguuguuuuggggagcaggaaauaagcauauauauaauauuaaaauaauuuagcagguuuugcauggugugucuugaauugagacuaaguaauuacuaagugccaaaguuagaugcugacuuucucagagcaagaaccagguuucuccuuaaaaacaaaaacaaaaaaacaacaaaaacuuccuguauucaucucuuuaaguagcaguguauacauguguauuuaaacaucuuuuauaguuagcagggcgaggacugauuaaaggcagagaucaucuuauguggguucuccugcaauucauuucuggaaguauucagaaaaaugcacuagcugauuuucucccugugaugaagcucuucgacuugcuauacccagaaaaagaaguaagcuuuacugaguaacuauucauaacaacaugaugaguaaauuaugucuaauuuauguuuaaggauuuuagugugauuuuguguauuucuaaaguuuaugcuaaaucacaauugaauguuaaguguagcaagcucuuucucuacauucuagguaggucuacaguuuuacaaaucacuaaagcuguuuuaaucuauauacaucauugaauggccagauaacagucuuuauuaauagcuauuuuuucuuugacaguugagccucaguauguccccuggguauuuuaucauauaagauauuugaguaaaaugugauguauuuugaugauugccauuuucuagaaguacuuuaucaugaauuguuguuguuguuguuguuguuguuaaggaguuucacuguugucacccaggcuggagugcaguggcgugaucucagcucacugcaaccuccaccuccuggguugaagcaauucuccugccucagccucccgaguagcugagauuacaugcacaugccaacaugcccgacuaauuuuuguauuuuugguagagacaggguuucgccguguuggccaggcuggucuugaacuccugaccuuaggugaucugcccagaaaauuuuaagaugaaacaagaguauuucuugaugauggguauaacaugaugggguuacuguaaccccaccaugcacuagcuguaaccccaccaugcacuagcuguaaccccaccauguuauacccaucaucaagaaauacucuuguuucaucuuuccuccuuauuuuuuuuguuaauguuggacaauuuucaagcaaaucccagacauccauaucauuuuacccauuaauagucaauauguuuaaauguaauuauuuagguugcguauuucuuagauuuuuaucuguucuuaaaaauuauuaugagacuuuuagaaagucuuguuuuuaguuacauuugucacuuuaguaagauuucaugaugauguguuuuaauuuuuuaaaaguaaaaauuaaaaauuuauuuuuauuugagaaugcucugcgauaguaggaaaagcuugaccaagcaccugugaauauguguuacuuaaagcaaguaaaaacauauaccaaauaaagcaucuuguaauaauuucaaaauuuuauggcuguuagaccuucugauuuguauuauugaauuaucggggcuaaaguaagacaugauaugcuaaaaagaguuauauuagaaauugauuacuaaaauacacauaauuauuuaauucuucucuuucuucuauuguguuauuuuucaaauuguuauuuuucaguauaucccaguuccugauauuaacaaaccccagucaacccaugccuuugcaaugaccuguauuuggauucaucucaauagaaaagcucaaaaugacaacuccaagcuacagauuccaauaccucauucccuaagacuucaccaugaguaaguuauuuguugcuugauacuuaauuuucuuguuuaauuaauagcggauuguagacuaauauuggucucgguguuugugugaaauuuggaaaucuccgcauacccacuauagguaagggcaaauacuugauguauaugucauagcaggagaaucugaccaguaccuauaucaggaaacagcuacaagguuagucuugcuuauauguauagauuuuuuuuuuuaauuuuuaaggcugaucuucaguuguauauguuauacuuuaaaguuauuaauauaaugaaagcauaucaauuuuuauaaauguaaaaauguuucagaauuucccaagugcuuggaacuucagcauaagcugacugagauaucauucaucucugggcugccaggauugauugagcugaucuggcuggcaugccccuuaauaucucuuccaaaguugugaugacucaaugaagauaccauucuuagauaguauuguauuguagucaagggugcuaggaguagccuaacuucccaccuagaacuucugagaaggacugccacuucucuucacaggagauggcaggauugucagacuugauacuucauuugguuuucauuuuaugagacagcccuuaaccaccuuuucauagugguaucuguaaugaagacauuguuguguuuauacagacagauaauaaauagaaaccugguucauagacuugugaguuauuucuucauucucugaaacuuagccuaauaugguggucauauauguagugcauacuuaacaguacccauuaauuguuuauuuaaaauuauuuuucuucugaaaugcuacucaaacuucuauguguauucccacuguacauuucacacagaaacuauaauaccuauaggaacaaagauagcauuaauaaauaauugcauaaaauugaacuuuuaaaaaaauacaaauuaacauuauggaaguuauuuucauuuuuucuuuuuaauggaacgugaauauuuagguuccugcagcagagucuaagaaauaaaaguuuacagaugaaugacuauaagauugcucuauuguguaaugcauacucuacaaauucagaauguuuuacauuacccaugggagcucugguagaaacuauuuauggaaauggaauuaugaggauaccucucccuggaacaaacuguauggcuucaggaucuauuacccccuuaccuaugaaccuccuggauucacugacaguucaugccaaaaugagguauguucuuuuuauuaauuugguuccaugucagggaauugauacgaguauaguauaaaccuuuauuucaugauuuuaugugcguauuauuucauagucagguacauuugagaaaaaaaaguuagcuuuauuuuauuacaaaaguaaauauuuuuuauuauaggaauucuaggauaaacaaacccaaagaaaguaauuguuguaaucucuacaugagagauaagcauuauaaaaauuuuuugcacauuuuuuuucauuuuuuauagauaguuaagaaugaggacuaguguagcuagagcuuccaacauuuuuggaaagggcuagaaauccagauuuuuuauuaguagucuuucagcuuuuaaguauuggcucaaauuugaaacaaccacuguauaggccaaagagaauuugucugugggccuccaaguggagcaucaguccugguagagcuaugcucuuuuucaaaugguaaccauugugauagaauuacacaugugcuucacuugcauauauaacagauuugagcaaagccccauuagaacguaacauuugggucuuagcagugauuuauuaaaguaaaucugugacaaaaguuauuuaauuucccaaauguauuuugaugcaucauuugagugaccaaaaucccucaagcaugcucuuaugaguugaauccaaaguuuguuuuuccaugagcagggggauccguaugcauauugaaagcgccacagaaacggaaugagucucagauugugcagugcauccuuaccaaguguccugcacagcuuaaacacauuaaaugaaucaacuucauuugaaucauuuaaguucagauuuauacuaaguuacuucuaaguagaguagccccuauguuuaugucaaaaauauggauuuuuauuuucuucccuuuuuuucuccucagccuuauucacagcauugcaaccagggugauaaaacuugcucaugcaaaguccaguguggccuuggcuccagcccuaguggaaacuuacagucguuuauuggucuauauggaaauagagucuuugggcaucaaaggauuuaucaguaagacaggacuuucugguguuuauaacuauuaacccauucauuaacucuaaaguuacuuuucuagguccuggggacacagcagagaacaagucaccaccaugauggagcuuauggaggaggacauuaaauaaaugaaauauacaauaugucagaugauacauguuauagagaaaaauaaagcaaaaaggaauaggaagugugaggguugggggguuuguugcauuuuuaaguaaagugguaagaaaagguuaaugugcuaggugccugggaugcagugagcaggauagaccuggucccuguccucaugcaaauggauucugccugaggcagcaaugcuguccuccagugcauacgaagucugacuggaaauaaagaaggaauuuuccuaccuugcagaagauacauuauaaugucucauuuauuauauaguucuaaaauaauagauacuuucugauauagaaguguuuuucugauucaugguaauuccagcuuuucacgaauacagcauagucuuaauuuuaaccacaauaacucuucuuagauaacugauuguugaacaaaacuuucuuggggguaggaggaaacaagggcagguauaauacaauuuuuuguauuaaaaagugaaccucauacuucaaaagguauggaacauuaauugucuaaaaauaaaagauaucagaauugagaagauuaauguuuuuucauaucuugucucauuuuauuuuuccagauaaacaugauuaucaauugccaaaucccaggaaaaaagcaaacuugauauuauaguuaggaucugaauuuuuccuuacuguuaaaguagaaaauaagaaaauauggagaauauauaugugugugggcguguguauuuucacaaucaaaucuuuauauuuuacucaaugugacuuucuucaaauaucuuuucaugcauagccuuuaauaauugguaccuuaaauugucuuuuuccuccaggucagcuuuugccaacuguuuucaaaucacaugcaugggggaucuuacacacacuccuugagauguuuagcuaccggaugcaucauauucagccucauuacagaguucagcuccugagucaucuucauacuuuggcugcaguugcacaaacaaaccagaaccagcuccaucuuuggugagcucauugaagaccaucuuuccuuaagauuuauuagaaacuuucuuggagaugagguucuuaauccuuuaccuuuaccuuauaguuuuuuuuuuuauuauuauucaucugucauaaaacuucucugcuucuaaaguauuuuguuuccaguauaggagcagaguccagcuuuuuaaauagaaacugauuaagauaguugaguccuuccuucaggaucuuuggacugagaauuaguacuuccaggguauuuauuauuauguuguaacuuagcccuuuagaaugcugguuuuaaguauacuucagauuaugguuaaaguaucaugucacauugauuuugcuuuacauuaaaauauauuuuagauagaaaaauauaauuuuugaaaugcaguaucuccaggugaaauuuuuuaguccuauaggcgacaagccaucuuuuucaaauguguaaaaagucacgauuuucacuauaaaauuggacacauuagguuuuuuaaacaaauuaagcaacauuuauucucacacaaaaguguuuuuuuaaagaagggauagucauagauugcauguuuuuccauuguaauuaaccuuagauuuaauuccauaauucugaaauuuuuuuacauuucuuuuuauucucccaauuuucagugucgagagcacugcucucaggcuuauaacagcauuagguagcucagagguacaaccgcaguuuacacgcuuccuuagugaucccaaaacagugcucucagcagaaucugaagaacugaaccgagccuugauauugaccuuggcuagagcaacucauguaacagguacggugaauaugugacuacaaacaacaacagaugaauuaaagugugccaugauucuacuaauuacuauaguuguaacauacuaaaaagauacuuuucauuuguuugaaaaaagccuguuguuuugauaucuucacuauuucacucauuuauggaagcucuuuuguguaccaucauucuauuaauaacugcguugagcaucguuuucagcuauccauaauuuuaaaguaguaauacuuuaagcuuuuuggucucaggacugcuuuacacucuuaaaaacaaaauugaaauucccaaagaguuucuguuuauauggauuauaucuauggauauuuauuauauuagauauuaaaauuaagaaguuuaaaaauauuuauuaauuuguuuuuaaauagcaauaauaaacauuacauguuaauauaugauguuauaaaaaaaguauauuuucuaaagcaaaacuuuagugagaagaggugccauuguuugacauuuuugcuucucuaauaucugguguaaaggaagacauaguuuggauucucaucugcuuagacauuuaauccauugaaguuuuaguugaaguaagugaaaaauguggccucacacagaugagguuggaaagagaggaguauuuuaauagcuuuuucagauaauugggaauguucuuugacaucacauggaaaaaugauaguugcuuaaagguuagcugcaauauggaauccaaaacccccaguaaacuucauguacuuuguuacauuauaaucuguacaucuguuuuauacauuuaguggauuuuuaaauccaugcauguuuuguaacuucaugaauuauucauuuugaaaauacugguucacugaguuacguagaucuagcaaacguugacauuuuguuuauacaguaucagaaaauuacauuuguuaauaucacugcaaaguuuauuagaaaaaucuaaguuuuggaaugcuaucaugucgugguagauacagguuuuccaaaauuucaauuuuuacuugaaaggucaaauuuuaucauuggaaaaaguuacuaucauuuguuuuccuuaaagugacaagcucauuuuguuaauuuucaagaaaaugucugcuaaauacguaagucuagcuagcuauaguuuucugucagacguucuuucaaguaaaauuggaauucaaaaaaaaaaaagcagcugauuuaacucagugcucagucagucacacaagugcacaaguguuuuuccucaagacacccaucaaacuuggaacacuaggcauaugcuuccccuuuuguuacauaugauguuaaaaauaggugucgagauugacacuggcacuuuucuuucacugagugcaugugcuggagaauacaaagccuuuucaucuagucuggcaccacuguuugauuugugcuuaggaccagcaguuuuaccaccauugcuuuuguaccgucagugcucauaccaagugaaaaagccugauaucuuuuuauuauuauuugaccucauugaaucuuugaagggcuauuggggaauccccaagaggucuacagaccacacuugagaacugauguuuuaaagagauaguuauugguuuuagcaaccucaaauacguuuauguaaauuauuuuguuuuacauaaagaacccucuucaauucugagauuuauacaugcauuauguaauuauuucacucaccaaaaaagauaucuuucuuuauucuguucccuuggccgaauaaaguacuacuaaaucagugucaaaguaaaugaacaguagugaugggcuuguauuacuguuaucgcugguacucuguaaccucaaaaaaagagauuucaaaugucuuuugucaucuuuucauaaacuguucucauauuuucuaaugugaucauccagaucauucauaaacuaagcaaauuuagguucuaagcugaauauaacuaguuaagcagugaaugcacugcagugaaauucucaguguacauaauuauuauuuucgcuauaaucuuuuaugaauuguggauauaaucauuuauaucuggauuacaucuauuuguuuauguuuagauuuuuuuacaggcucugauucaauucagggaacuugguguaaagacauacuucagaccaucaugaguuucacuccucauaauugggcuucacacacccugagcuguuuuccaggcccacuacagguaauuuggucuugaauuacuuauugaaugcacaugaaauccuucuucccauucacaaugguguucuagagugagucuuggugacuucugaauaaaauuagcuuuuauuuauuuuaaaaaauauuuaggggcugggcaugguggcacaagccucuagucuuaacugcuugagaggcugaggcaagggggauggcuugagcccaggaauucagguucacaaggaacuauggucacaccacuguaccacagccugggugacagagccagacccugucuguagaaaaaaaaaaaaaagucauuacuuacaaaaucucucaaguuguucuguguccuacucugguacuggacauguuucuaaaaauuuaauuauuaugguuucaucuuaguuaacaguuuuaaggggaggaagaguagaaagaggaaaaaaauaaaagugaaaaaaauugaaaaagagaaaaaaauaguuaaugguuuuagaaucucaugaaaauuaacauaguaccugaaaacuuuuuucucucucauagaacugaaauggggagaaguauaacguaauggagcuucacagagugugcguaauaugacacuucacugaauuuuuuucuuaaucacagaaaaacuguaaaccuggcuuuucuaauaaggagaaaggcaaaccucaucugucuucuccuuuucagaaaaaauguuaggcaugaugaacauccauuuuucauaacuccugguagggcuagagcauuugguuuuuaaacuuaccaaaucaccuggagggcuugcuaagcugcaguuggcugggcccccagccacagagcuucugauucaguaaaucugggauaaggucugagaauuuugcauuucuuguaagacccagaugaugcugauaccgcugguguugggaccacacucugagaaucacugggcuagugcaauggauuuuccucaaagacacuaacauauguagccaaaggguagagacacuucauucuuuuuuuucuuuuuaagauuggcggaaguaucaacagaugauugaagaagcuuugaauucaggcuuacuuagaauuuccauuuaggaaaucuaggaaaaggaaucuuggagauaaucuagucaagcuuauguauuuuccagacacagaaauucaggccuuaauugcugaguugcucaaggugaccuagaguuuauuagugucagaaucaagucuagaacugguuuauuaacuccauauccagugcucuuucuacuauaaccaaugaaauaaacuucuaauccucuuuuuaggcauucuucaaacaaaauaaugugccucaggaaagccguuuuaaucugaaaaaaaauguggaggaggaguauaggaaguggaagucaaugagcaacgaaaacgacauuauuacccacuucucuaugcagggcuccccuccucucuuucuuugucuucucuggaaaaugcucuuggaaacagaucauauuaaucagauuggcuauagguaagucaaaaaccuaauuugcauuccauuuggcaaauuguuguauccauacaacaauggaguuuauguuuuacucucugccuuccagaguauuagagagaauuggagccagggccuugguagcccaugugaggacauuugcagauuuccugguauaugaguuuucuacaucagcagggggucagcaacucaauaaaugcauugaaauucuuaaugacaugguauggaaguauaacauuguuacacuggacagauuaauucucugccugguaagaauaaauacauuucuaagcuuauucucuuagaucaagauguaugacuaauauauguuaugccaaucugcucuauauugcuuugaaggauuuaaugaauuuauacuauaucaagcauugcugucacuucccuaaagagccggaaauuuuccaauuucuguuuuuguuuguuuuuguuuuuuuguuuguuuuuugagacagggucucgcucugucgcccagugcaguggcgugaucauggcucacugcagccucaaccuccuggucucaagcaaucuccuccugccucagccuccugaguagcugggaguacaggcauaugcuaccauacccagcuaguuuuuuuucuuuuuaacuuuuuuauagagaugggguuucuccauguugcccaggcuggucucgaacuccugggcugaagcaauccucccucuucagcuucccaaagugcugggauuacaggcgugagcuacugcuuccagccccaauuuccuuauucauucauuuaauaaguacauauugaauaucaacuguguucuauguauagaagguacagaaguaaauaaaauagaugugguccuagccuugugauacuuugaaaauaugagcaauuagacccugaguugauucuccaaaacucccacuagagggaggaaguagcaguaagucacuguguuucuuuacagagugcgaauauaaccauuucuguacacuuugguaacaaacauuccccaaauguuuuuuucuucuccugacuuugaugucuauuuccagcagaauuuuuuuuuucuuuuuuuuuuuuuuuuuuuuuugauauggagucuuucucugucgcccaggcuggagugcaguggcgugauguuggcucacugcaagcucugccuuccggguucacgccauuauccugccucagccucccaaguagcugggacuacaggugcccaccaccacacccggcuaauuuuuuguauuuuuaguagagaugggguuucaccguguuagccaggaugggcucaaucuccugaccucguguucugcccgccucggccuccgaaaguucugggauuacaagugugagccaccgcgccuggccuucggguagauuucuuuaaaaagauauugaaguaggcuggaaaaugcuacauugaaaaaaauucuauggcggugacauuuggaguggcauaguuuaacguuaaccccuuagcuguggagcauagauauaaaaguaguuauuauauuuuagggggaauaauguaagucuauaaaucaauaagaugucaggauaagauggagguguagaaaaaauauuucuaggaaacagugagaaaucuuaucugcuuaggugauagcugugaaagauagauuaaauuuuuaaaaguaaagauggacaucccaggcagaaggaaugguaagccagaaauaggcaagaaaggucauauauguuuggggaauacugaacaguugguuugggauagacuagacgucuaaggaaauuauaauagugagauuuuacuuuguuaaaaucuaggcuuucagauggcccucaugauuuuacacagguugaacauuuucauauaauuuuucuguuguuuuucaaaggccaugcguagucacgaaggaaaugaagcccagguuuguuauuucauaauucaguugcuguuacucaaaccaaacgauuuuagaaaucgaguaagugacuuugugaaggaaaauuccccagagcacugguuacagaaugacuggcacaccaagcacaugaauuaucacaagguacuaguccuaauugguauuucaaauaguccuuuuaaagccauacuugaguauuugaugaagugauuuggccguuuucucucugguucuaauguuuuuucucuugucuauauagaaguaaguuagcucucugaacuucuucaagguuugagaguuucuauaauguugagaauaaauugaaacugcaguuuuaguggacauaaggacuucuauaaaaagaaguaaaguauaaucaaguauaauuuuaaauguuuccuugcaaaaaaaaaucuaaacaauguuuucacauuuagcucuuuuaagagaauuuuuuaaaaaaugcucuaaccauuuaucaucuucucaauuccacagaaauauccagagaaguuguauuuugagggccucgcggaacagguggauccuccuguacagauccagucucccuaucugcccaucuauuuugggaaugugugucuucgauuccuuccaguauuugauauaguaauccacagauuuuuagaguugcuuccgguauccaaaucacuggagacucuacuggaucaucuaggaggcuuauauaaauuucauggugagcuuuuuccaauuuuaauuucgucuaauaccuccauuaucaaaaguaggaugggcaggaccacaugguaauaguggcucuaaagguuuuauuuuaaauauuuuaaaaaugaaguguuuugaggauaaguacuauggauggugccaugaaguauaaaauauacaacauaaaaauauaaacaaaaguaugaguucagaacagggugauguuacuguaaacuaaacagaucuuggcggccuucuuggauggguaggauuuggacuugaugcauccaauuuauagcagcagcagggaaaauauagcacacgaggcagaagggaucauuugggggaaaucauggaggagauaaaguauauuugaagaaaaauugcuacauuggguugaauugaaaauucuuaccagagaguucuagaaauaagauuggaaagacagauuguaccuaacuguagaucaccuugaaugcuaggcugauuuuguaauugcagauaauaaucaacuggaaguuauugaguaugaucauggcauaggaaacauuauuucagaaagauacauccaguuauaguuggcagcagucuuaggaugaagccauuacaaggacaugucaaaaagcucaguugugugauuaguaucuaagcaacagugguugcauugaaaaugagagaaaagggacaaauggucacaaaagaaggaacaggacuugauuggcugguuauaaggagaauauugaaagaaaaagacaacuaaaauuuuaagcauaguuacuggagaguggcagggucagugacagaaaugugaagguccuggagcagccacucugggaacaaaguguuugucuggcaggcaguccugcuucaucuuuaagauaccuucccucagagcagaaguaugaauuguguguuaacaugguagaauaggcauaaaguucaagugagcguucuuuuaaaaacauuuuucuuuuggauuagguaauauacauacuugaugggguggaguauacagugaaagguaauuagucccauccuggccuccagcuacccaguuucuuucguaggcagccaguguuaccagucucuugccauccccucuuagauauccuggcugguuuuguuuguuuguuuguuuguuuguuuguuuguuuuaacacaaguguucuguacccuguuuguuucaacuuuaucauguauuaggguuggucauuuguauuaguacguaaagagcugccucauacaugccagauuuacuuuaucaguccccuguuuuugaccuuuuaggcuguuuuucaucuuucgcuaguauaaacagggcugcaaugacaucccuuguuguaugucaagggauuaaaauuuaugcaggauaaauuuucagaaauggaauugcuuccacuuaaauaaaaacaaauauaaauacaaacuguauauuacuagaaacauucugagccuucugccucuccucagauuaaaauauucauaguauacaauugcccagcaugugaaguuguuucauaaaucuucugagcuguuuuucaguuaucuggaaagcaguugaucaguuuuucacaguuauuaguaaccaguuaaacauuguggugguauguuuuuuucuuggcagaucguccagugacuuaucuguauaacacucugcacuauuaugaaaugcaccugagagaccgcgcauuucucaaacgaaaacucguccaugcgaucauuggcucucugaaggauaaucgaccgcagggcuggugucuaagugacacuuaccugaaaugcgcuaugaaugcacgagaggaaaauccuuggguuccagaugacaccuacuauugcagauugauuggcagacuagucgauaauauccuuuuuauugugauuuuagacucccagaaauaacaguauuuugauuuaugagaauauauuuuuucuuuuaaaguaauuuuuuauguauuucaagguuuuaauuuuuuuuaagaucacuuccauuuucaucucuguaaagauuugaaaucuuaaauuaacagcaucaugccaauuaggcugaaauucuguuaaaauuuuuauuuuagaacuugaggauaagcgguaaaaaaauuauauuuaaaaauagacuuuauggagauuuguuucaaagaaaaaaucuuauucuuacauacuauauuuuguagcacaugcaucugugugcuacuggagaacguaggaucuuguuacuuuaaaaaaauuaauguuuguaguaaauaauaaaugauaaaauauauuuuucuuuauugaaaagguauauuuuagugaaaauauacuuggauguuuauuucuucauuuugauuuuauauuuucaguuauuagcacucuauacuuaaugucuauaaccauaccacuauuuuacuagguaagaaauucuacauaaaugagcaugacuuauuuuccuacacaaaggaauuuauuuucugaagcaaaagaaugacucauuagaaaauaauuuucauauuaaugucuuauaacuauuaaaagaaauaggcucaugaaaccuagguaaaccuugguugcaucuguggcuauuauaugucauauuuauaagaacccaccugaaagaccaaccauuuauaccugugguuaaucaaaugguugcuuuuaauacauuucaaucaugucaaacucauuuguauuugguuugcauuugccucuuaaucucucuaagcguagacaaaucacuucuuggcagcucauaaucagauaaauugacaaucagaugagauaguccaauuguuauugcuuuaacugugugcaccgauggcuggcaaaucuccuggucccuuuccaaacugugacuggagauucaaugaguuucccaacccagcugcccaugcucuccauguuacuuguguggagcucauggccuuggcaguuucaggcaaagaaguugggaaugcccuucuaaauguuguccuaaaaagguauguauucugguucaugcaguaagauuuguuguuuauuuguaaauagaaugguauucuauuucaaacuuuuaagacaaaccuguugccgcaaggcugaugcacauuggaugaugacuguuuucugguuccagaucuugucuuugugauauaggaguuauggaaugagcccuggacaggauccuaagauccggguuuguuccuacuucuacucauuaauagcaguuugacauuuaauauaggaauaauguuaacuugucacuuaaaacaagauucucuucaucuuguuuucaagauuucaagauucuuuuaaaaauuagcaugaaguaugggauaaugauuggggaggaaguauuuuuaaaaagccuucuugaguuuuuaugcauauuacauuuuuauucaauaaaaaauuccccauuguuuuauugaaauggauuaguugucgauccucugaauuagacauauucuuuaaaaauaagauccguugucagccaucuaaaauguuuuuauaaauucauacuuacauucuuuuuugccgguugcagucagccuuuagugccaagagagaacauuacagcauggaugaaugcaauugguuugaucaucacugcccuaccagugaguuaauaauugugauuuguacuuagugaugaaauacagccagcuguuccaugucagcaaaaagaaaaagaugcauauaggaugcccuuguacgggacgucaugcaaauuaaugaaguauuuuauguuuuuaaaguuuuuucauauuauuacugcuuuaaaaaucuacagugacuaguuuuugcuuuucuguauuagaucuaaauauaucuaugugacuuacgggucucugcauuuucugguaccaccuuaccuauccaacuuuaguuuuuacauaauagcuugaucuacucuuggccacuuaacguguuguauaucuacagccuuuguuccuucagauagugcuuaagacauguuuuagguacuucugaaugugagggaauaagacauuuuucuuauuccagaagcuucuucuuuccaucaccuucucuaaagccuauucauucuuugcuagcuuagagccuccuuucucagugaaugaagccuucccugacuuuuccagcucacaugaagacuccuuucucugaccuccacacauauuuuuuuaaaguuuauuauuuuuaaauaaguaauaaagcuauagauuuauuguuugauaaauuaauugauuuacugcauaguguauaucagguaccuaaaugagcuggacagauacauguauggagccccuuaacucacaguuacuucucccagguuguuacugacuuaauuugaccaguuacaaagccacccagcuguauugugcagaagcuggaaaaauagaaaacuuuaaagaaugagaaaacacuauuacuuuagacuuugggguggaaugcuggauaagugauauuuuucacuagcuuuccuccgauuuuaaaggagccauauuggauuguucuucaugaucgaauugugagugucaucagcagccccagcuugacgucugaaacagaguggguuggcuauccauuccgccucuuugauuucacugccugucaucaguccuacucugagaugaguuguagcuauacguuagcucuugcacaugcuguguggcaccauucuagcaucggacaacuuucucucauuccaaaguaaguauaauaauuucuuaaagaaauuugacguaggcugggugcggugguucaugccuguaaucccagcacuuugggaggccgaggugggcagaucacaaggucaggcgauugagaccauccuggccaacauugugaaaccccaucucuacuaaaaauacaaaaauuagcugggcauguggugugugccuguaaccccagcuacucgggaggcuaaggcaggagaaucacuugaaccagggagcuggaaauugcagugaaccaagaucgcgccacugcacuccagccuggugacagagugagacuccaucugaaaaaaaaaaaaaaauuguauuucauuuuguucuaaucucauuaacagaugagguauauacuucauucauuagaacaacuugcggcugggcgcggugacucaugccuguaaucccagcaauuugggaggccgagauggguggaucacaaggucaggagauugagaccauccuggccaacauggugaaaccccgucucuacuaaaaauaaaagaauuagccaggcgugguggugugcaccuguaaucccagcuagucagcaggagaaucacuugaacccaggaggcggagguugcagugagccaagaucacgccacugcacuccagcccaggcaacagugugagacuccgucucaaaaaaauaaauaaauaaaaauaaucaagugaaaguaauagccagugagagaugugagauuaauuagaaauauuauuguuaccaaauuaaaaggaacuuuaaaaaauuauauuuuauuguaauacuuuguauauacuguaugaacaaaauucaaacaauuuaaauaauuucaagucacaggagauuuuuaucuucaaauuuuagguuucuuacugaaguacuucuuccuauagugaagaccgaauuccaguugcuuuauguauaccaucuuguuggaccauuuuuacaaagauuucagcaagagagaacucguuguaugauagagguaaaauauaaucuggguuuccugugacaugauuaaauucugaaguaucuauuuaaguuucuuuaccaguguuauugaaacugcaggucacaaccauuaguagugaaacuaguuuaacaggauccaagagcaauuuuagaggacuuaguuugccaguaaugaauuuagggugggauguauugaauuggagaugcagaggaaacgcccaucaugaagguugagaagagguuaaggauggagaaguacauuugagaucuuacagugcagaggagcuaauuaaaaucaugagaauggaugaagucagucacuucuaacaaaaugucgcaaacaaggaaaggacccaggaguagaaccuuaaagcaagagcuaccaaauggaacuaagaaaguauaauccaaaggaucccuaggaguggaguuaucccagacaucgagagauggugucuagaaaggggauuguuuaucucuugauuuuaagagaaauuacuuaacuaugaagagaaauuuuauuuaagccuugucaggggcauuuuguagcacuauagauucuuuuauaaaugcaagccauaucauaucucaugugcauagagguguauaugguauaugacaguucuacagcaaagacaguaucccccggugcuaguguuguaauggagcccagcugcaucaugcugaauuacugaaucacuugaucacuuaaauaauuuuacauuauuuguuaaauagauugguguggcguuuuaugacaugcugcugaauguugaccaguguagcacccauuuaaauuacauggaucccaucugugacuuccucuaucacaugaaguauauguuuacuggugacagcgugaaagagcaaguaaguugaauuuguuuaauuauuuuuaaugauguuuaauuuagaaaacuugaacauauaguaauagacuuuuuugguuugggugauuauuuuuauuuugucuaauuuuuucuuuuaaggaaaaaggguggguaugagaccuuuuuaggcaucagaggcauauuauucuagauguaguauuaaaggaaauacauguuauaauuucuuguacuuuucccccuugauauuugcaacagaaaaucugaaaaagaccuagaggguuaauuaauaguaaucucauuagggagaaacagugggauauggcugcugaaauaugagcagagagguuguuguguuaugaguaaaggagguccugcuucuccugacacucauggugacaguagacaaaccgcggcauaacuagaagacuaaagucaggauucuagacuaauccugacuagagacuaacucaugaaaagcauuuagagaauaugggaaugcuuauccugaagaaaaaaguccuagggaauuauuuaugaccucagcauuuuggaggguuuucauuuggaauagguauuagauucguucugugucacuuuagaggguguaugaauucugguaaaguuaaagggaggccacccugacuuagcauaugaagaggaacuuccuaauggggaugucugaaaguagaaaaagaccuugaaucauaacugaguuuccuacguguaggaaacagaaucugggccauuuuaaaggaguggagguaggacagauagggaaaguuaaguccauccuccuaccccucccaguacuuuagguugagaugccaaggagguugacuccuuuaugucucagcagcagugucaaagagaguugaccuguucucucucauguaagaaagagagaaauuguaucugcuuuuguuacaacacagaacaugcagagaaacuguaaaagaaauuguuuauuuguuuguuuuuuuaaaaaaaguauucuuuacauuuaggccuaagaaacuuuaacacaagggaguacagaaaggaaaaggucaaagagcauuugaguaaagcuaagaaagcugugaaacgacuugauguguuugucuccuuaguguuuuucaaaagaguagaucuaauauuauuuaguuaauuccaaguguaaaucaaaaccaaaauaguuuuauagauaaauguugcaaacaugaguuauucaaagaacuuuauaauuaugcuucaugcuucuguaaagauggcauuuuaaaagaaugaucaacuuguuggauguauaaaauuuccaguguaaacucugcuagcuuuugguagugggaugacuggcuagcuagaugaguggauacgccuuuguaaguauaugcauauauaugaauauacauaugguacauguacagacaugcacauauaauauauaaggggugugugugagggagaacguauuguuucucaugcaagaaagaaaucauuguaucugcuuuucuuaaaacacagaacauguuaagaaacuucucaucuaccccacgacacuccuuaguuuauugucuccggauauguguaaauccugcuuuaaaugugagaaguugaaauucucugauuaaaguacguuuuaauguguuuuuauuucuuagguagagaagauuaucuguaacuuaaaaccagcuuuaaaacuucgucuucgauucaucacacacauuagcaagauggagccagcugcagugccuccacaagccaugaacagugggucuccagcaccucagucuaaucaggugcccgugucuuuaccaguaacucagugaagccagacuguacuguggagaaaguagaaauauauccgucuuugagaguggacucaaaccuuuuaaaucugaaugcgaucacacuguagugauauaguagaagcagugaugauauucagauuguuuuauuuugauucaaaugaugaaucuguugacaccuuauaacucccaucucccuaucuauauuuuugucucuaagagaucaaguaagauacauguuguucauauucauaacaacuuauuagagcuauguaggaacauagagguaucugugaucaaaugacuugucauuggcacuuucagucuuuccuauucuagccguuguuuuuguuuguauuuuuuauuauuaaugacauauuuagucuucagauauauuauuuuaaaggcaccacacauguaaaacaguuauuacaaauauuuuauacauaaaucucuugguagauuuucagaauaauagagauuuauaucaagaaaaggaaucuagauuuuguugcauuguaggagcaaacaaggcuucauauucuuuuuaaaaugacuugaaauuuuauuauaaauuuccauaguuucuaucaaggucaacuggcaguuuuauuaccuuugcuauggacuugaacuuacuguauaaaauuaguuggaagccauguaagaaaauaacaucugaaaauucuugaacuuaaaaucaugcuuaaaugguuga

SEQ ID NO: 21470 - RNA, 30424 nt, Homo sapiens
ucgcgaguuggugccgcugccaccuccgauuccgagcuuucggcaccucugccgggugguaccgagccuucccggcgcccccuccucuccucccaccggccugcccuuccccgcgggacuaucgcccccacguuucccucagcccuuuucucucccggccgagccgcggcggcagcagcagcagcagcagcagcaggaggaggagcccgguggcggcgguggccggggagcccauggcguacagucaaggaggcggcaaaaaaaaagucugcuacuacuacgacggugagcggccgggccggugucggggugggcgcgcggggccgggcgcuggguuccgcggcugccgucgcgagugggcgccggggcugaggggugggaaggaggagggaccgacauuuggccgcaucuuaacccguucccggcccggcacaguuagaacgagacccucuuccuggcgcagcccccgcgguuccugcgggcgggaaucagggggcccgcccgucuugucuccugccucucccccuucggccgugcaguccgcagccucgaagguggccgccgcuggggacggcgccggccuaccccgccuuggugguggcggcggcgaagggggcggcccauucucucccuucucccgcccaccauucguggcaacgcagguuuggggugccccgcgucggccuccuacccccucgacccgucccccgcgaggcaaaauuucuaucccggccuugacucuacacaaagccccgcggccgcgagagcuccgccccucccguccccuucccuccuccucgccugcucgccuccccuacccugcguucggucuggccggagcgucuucuccuuccucggcuuacccuuuccccggaccccuccucccggugggcgcuggagaguaguuacugagggugggggcucaggucgcguguggcuuuaucacacccauguuuugcgugggcuccaacccucuccuuuguucgcuggguucuuugagcgcgucuuucucaggauucaaauggaagggcuucacuuccucaauaauaguucggguuuuccaguuucaggcagaaagacuucguaggaaauaagaggugguagggagauguggaacugcuacugcuuguguuguagaucagacuccauggguccuggcuugccucagagaggugguuaccacccacuucuuuguugcucuuuguucgaucaggaaauagacccugcuuuggggauuuagagagcauugguaucuugcaaaggcuguuccuaggugguggggaauccugguaugggaaaacuuugagaagugggagaagugcagaaguacuaaauauucuaaugagguaaauuugaggucaccguguagugaauuauaaaagucagauaauuuaauuaucuuaagcauucuauaauuuggaguaugagcaguaacauuaaaucuucgaauccuguuuccuguguuuucuugcucaauggaguaguaaccuguuauacagauuucacaaaggcuugguaaauaguuuauaguagguuacucuugagagaagggauuccaaaauuuaacagagaaucuauccuaggcuccuucuccugaaaguccugucugauuuguaggaagcaauacaaauuuuggaagcuguuuccuacaugugguguauuguaaaucacaaaauuuuagagaaguaagaccccagagcaccagcucagaauaaaucuacuuuaacuuguaaaugaccguacugucucuuuuuaguuaaaaaggauuaaucuuuuaaugacugauacauauaaaauaaccaccugugucauuuggggaaaaucugaaaucuuacagaacaaaucuaaauugaucugcgauagcuaggacagaauaauaacagcccuacuuuuaaaaaugauuuuucagaggacuagauaugcauuauauaaguugauuugaaauuaugccaucguggagggguggagauggaaauacauuuuaauuucaacaugauuuacauugcauauuuuggguuauucuugcccugcauucccugaucaaauuggaaaggaaguaacccugcguauaaguuaauuuguaaaauuacauuguuucuaaaguuuagagauuuauccuugucagggcuuggaguaaagaggaaaauuuugguuagggaaagugguacugagguccuucucgaagcugucaguugguguugguagugaugggcucugaggaaguaagcugcuuguaauuuguugucaccacaauggaacccuagaaccaggaggguacacuugaguagcaguuucugaacagcgcucuuguccugggcccauuuaugauaaccuucguugugggaaugggagcaggcacggguacccgggaaaggaugcaagcuugauaaguaggguggaaauauuugucuugugauugugacuuaauaugauacuuuauuguagcccauucaccugcuuacgugauggccagcaacaagugaauagcugauaguuuggaaaucucugguggguuauuuugucuuuugucugugacucguuuguuaaaguggaguuccuaguugcuuauguuucacauacucuuuuaauuuuugugggagggaauuaaaauauuuugcagagauuauuaauguuuauauuaugcuaauuauuaauaugugauagugugcugaccucauccaaaaacuuauauuuuuauuaccagagaacauuguuuugucagcuuacaaaaguagcaauacuaauucuuuuuuuauugugagaagagaaugcaaggaaaggagcuucuguaucaaagaaucgugacuuuaagguauauaacauggauuggauugggaauggguuauaucuguaguaauagggucugaauuaucugcuagccuagguuagaugguuuuaacuucuugguaaaggaaguagaaggaagaaagugagugaaaaagaaaaggacggaaguagcaaauucuauaaccauaggaauccuaccuuuaggcuuccuggggcuguuaggcacacggagccucuuggccacacagaaugucugccacugaggcuguuugcaucuuaaugaaagaacuuuuaaauauauacauauuguucucugcacguuauguaaucuucagguaacccuuuaggucacugaaacguuggucccaagggaaccuucagacauugauggauuagguauccuuaaaccuuugaagaaaaguaagagaaguuauuacuucucugacuguagcuauugauccaugccuccaaauucccaaaaacauacuucugaaucauguuccuucuuuauacacuagaagaucaucaagaaucuguaaaaugauacagcuaauuagauagucacuaagaucccuucugggccuuaaaacgaugugauuuuucucuacuuaaauauaauuagcagcuaagcuguguuaggcucuaguuauaccacucacauuuuuaauacuguaucuagacauguuuaugcuuuguuuugaauuaaucuugaggccaaacauauuuagugcuuguuuuuaugguguauacaguauaauaggguuuauauaccuaauuuauguaacuauacacaaauuucucugugcucuauuuuuuccuccucugagagggaugcauaaucaguuuuggagacaagugguccagaaaaaaacacucaaagacuguauacagauaaaacuauauaaauacaaaaguuaucaagauuaggccaggugugguggcucaugccuauaaucucagcacuuugggagacugaggcaggcaaaucaccugaggucgggaguuugagaagagccuggccaacauggcgaaaccccgucucuacuaaaaauacaaaaauuagccaggcgugguggcaggcaccaguagucccaguuacucgggaggcugaggcaggagaauggcuugaacccaggaggugcagguugcagugagccaagauagugccaugggcaacaagagcgaaacuccgucucaaaaaaaaaaguuaccaagaugauaccucccaacguacuccuucuucagcaaauuauagaaauucuacuuggcagccaacgauugucagauuuucuuagacuuguauuuaugaguaguaccaaagucuuuugcugaauaaccuuuaauacaacuacauggguucuuagcugugguauaaaucuuuauuauccgugaaauagguaauaauuucuuuggaggcaaauaagugcuaaauuaauuauagcagcaguucauaaauaccaguaauacuaauugcacaauaaaacaugacuaaauaagacugaaauuuuccuauacuucucuuuccccagaaaucuuuugccucucuuuucuuucaaauuuuaccucaucagagaugcuuucuccuauuaccuaagucccuguuauugccuuauuuuucuuccuuuugguuguaccauauaacuuuugucucucuccucacuauaacauaagcuucauuaggacagucugucuguuuugcuuguguuuguaucuucgccaacuacauuuaaaaacguagcuuuuuuuuuuaauuagugaugaauaaauuauuaauuccuuauacuuuuuuuuuuuuuuugagauggaauuuugcucuuauugcccaggcuggagugcaguggcgugaucccagcucacugcaaccuccacuacccucccggguucaagugauucucuugccucagccucccaaguaguugagauuacaggcacgugccaccaccccuggcuaauuuuuguauuuuuuaguagagauggggguuuuaccauguuggccaggcuggucucgaacuccugaccuggggugauccacccaccucagccucccuaagugcugggauuacaggcgugagccacugugccuggccaauuccuuauucuuauagauagaacgcuuucauauaacguucccucuaauucuugaaacuacucugaacuacauuuagguaggauggguggcauuuuggcauuuuugguauuguuuagaugaaaacagauucacauuuguuuggugcagucuaccacuuuuccuuuuccacacugacuguaguuuuaauguucaaggagaguucaacauccggaaucuuuauuuuucuuuuuuccuuuucaaaguguuuccucugcuaccaaacaaacaaaacuccuuaacaaaaacuuuaaaugcuucuguugacaaguccuuaaaggaaaacacuugggauuggagaaggcaucucuuagggaauguuaauaaauucaaacuuggaagaauucaaaucaagucuaaggauuuuuuuguacugguuauuaagccuuauuccucuguauuucaguagcagucugcuuauuguuacuuguucauuaagccagcuuuggguucagacauaucaaauaggcuuaaaguuccuacugugugccaaauagacaaaagauugcucaaguccuaagaaggaaauaaaagacugcagguauaaaguaagagagggggccgggugcaguggcucacgccuauaaucccagcacuuugggaagccgaggcgggcagaucacaaggucaggaguuugagaccagccuggccaacauggcgaaacccucucucuacuaaaaauacaaaaaaaaguuagcugggcauggugacgggugccuguaaucccagcuacuugggaggcugaggcaggagaaucgcuugaacccgggaggcagagagguugcagugagccgagaucaugccauugcacuccagccuggguggguggcaagagcaagacucugucucaaaaaaaaaaacaaaaaaaguaaaagagaggggaccuuugauaguguaaucagaaaagggaagaccugaaggaagagaaugggccagccuuaaaaagaguuuacuacauaagauauuacaaauagcaaagccagauaguuauuaauagaacuuggugcacuuaaugggaaggaagacaaggaaaauguggagucccauguuaggcaguaaaaagugggacugcacaaaacuguguaguaagaaauuugacuuuacccagagguggaaagccauugaaaguuucucaaauagaaugcauucucucaaaauaauugguaaggaguuguggaauauaggcuggaagcaagaauugaacacauauugguccauauaaaauguaaugguugcauuuuagauagaaauagacauauuuaagagagauuugggccucaaaccaauagaacuuuuugauggauuagaaauggaguuggagcugaggaaugguguuagagaaugaaggaugacuccuaaguuucuggauugagcaguuaggugguaugugguacuacucacuaagauugggaauacaaauaaagagcucuguuuugaacaucuuauauuugagauccuuauugaauucaagugaaaagacugagaagagaguuaaccucugugaguuuauaauccagagaggagagucuagacauagaaauuugggauuucucagcuuauaucaggugaaguauugagacugaaaaagauacagcauagacagacgacuggucccaggacuuaacucccgagagaagagaauuuagggcagaacuauuguucacugaugaacccaaacccuuagaacaguaccugcuuggcacaugguaggcucuugauuuauuaaaugaauggcugaacugaaaacccuugauguuuaaagguugguggaggaguggccuugggguacaaguaaaaucccaagaaaaugguauuauggaagccaaggcuccgaaugucucaaggaggaauaaccuccuugaaauauguauuaaagauguguuaauauguauaaaaaauggauagugggcuaaguagucuggaagaugaaaauaauaaacuuuuuucuuuucucuuguuuuuuuuuuccugagucucuuuuugcagucaacuuaucuuuguggcuaaagguacauuucacaguucugaaauccaaaaugaccugaaaauugaaaaaaauuuugguaacucauuuggaaucaaaaucuuaaccugaaucaaugugaggcuauuuaugaucuuuauuccucugugaauaccgugaauauucacacuuuuuugcuguagaaauauuaauguuugauuauaucaugccacccaaacucuaggcuauuacauaauauauggcagguguaccauauuaucucuacaaaaucugaaaaaguguaaaauuugaaacauaucuaauuugaaggaauauggauaagagauuguggaccuuaguagacacuuccauucuguuaguuucuugaagagugagcaauuuguaaaauuuugcagauaaauaauucuuuacaguaauuucuuugcauugacaauuaaaguuuguuguguucaaggaaccaccuugagcugauuuuucugaauguuuauuucauugguaaaguauuuuuauguacagguugaauauccuuuaucugaauucuugggaccagaaguauuucagauuuggggagguuuugcaauauuuguaauuauuuaccaguuagcaucccuaauucgaaaaucaaaaauuugacaugcuccaguuagcauuuccuugacuauuaaguuggugcucaaaacaguucagauuuuggaacauuuuggauaucaaauuuuuggauuagggauaaucuguauuuugaugcaaaucaguaacauuuaaaaugcccaaauuauuaauacauuacugaccauuuaaaugaugaauaaaaauuguagggucuuaaaacuucuuagccuuuuuauacuuuaugaaaaagugggcugggcacaguggcucacaucuguaaucccagcacuuugggaggcugaggcgggcagaucaucugaggucaggaguuugagacaagccuggcaaauauggagauaccccgucacuacuaaaaauacaaaaauuagccggguaugguggugggcgcuuguaaucccagcuacuugggaggcugaggcaggagaauugcuugaaccccagagguggagguugcagugagccaagaucacaucaccgcacuccagccugggugacaagagcgaaacuccaucucaaaaagaaaacaaaguggaugccuacaaaguagccaucuagagaauugugagauacagaauuagugggaaaaaguuggagaugguuauuuuauaacgccuuuauauuuuagaagaauucuuuuuuuuuuuuuuuuuugauacagagucucgcucugucacccaggcuggagugcaguggcacgaucucggcucacugcaaccuccgccuccuggguucaagugauucuccugccucagccuccugagcagcugggacuacaggcgcaugccaccacaccuggcuuuuuuuuuuguauuuuuaguagagacgggguuucacaauguuugucaggaaggucucgaucucuugacuucgugaucugcccgccucggccucccgaaguacugggauuacgggugugagccuccacgcccagcuagaagaauucuugguaaaccaaaaaauuaucuguagcuuggcugcccuguauacauguaucauuuagguucuuuguguauucuuugugggacuggggucccuaaauuucaacagagaaacuuguugaaagcuaugcguauucguauacgauuugaggacccuauuaguaaaaaguaaauuacucugauauauuagguacaguuucuuguguucauuuucuuuaaauuaaccaagacccuaagccuuuauuuaaaauauuuauauuucauauuaugucuuuuuuucagccuucacccugccauuucuagugaaucuguaaguguccuugacauucccuguuguuauuacuuaagaacauuagcugugagcugcccugccagaguuugaaucuagcuccuccacuugcuggcuaugugacuuaggcaauaauaccugacuugucuguuucucauccuucuuuacuauuauacaauaggaauaauguaauaauacccacaucauaagguuauugacaagauuaaaagauaugugaaguacuuaauagugccuucuaguaagcacucaacaaguguuaauuacugcuuuuuuuuuuuuucaaacacacuugcucagaaauugcuacuguagucuccaauuauuggggccuggggcuuuucacuggauuuucagugugcaucaaauaacuagaguauuugauguuaugaugugguagauguuagagacauuucauuuggguaauuguuacacagaggcagauagauggaaguuauuguuuaguuugugucuuuucuguuuuaggugauauuggaaauuauuaugggcagggucaucccacgaaaccucauagaaucugcauuucuagugaagacuagacuuucauuauuuuuacuuuaaugauuucuuuaguagugauaacuaagaaaugccuucccuuguauuaauuuaauuacaugaugcuuuguaauaacacuaguggguuuuccauaucuaagaaaugaugagaccaggcugcuuucaaggaacuauauaucccuuguauugucaccauguaagguagagcuuuaugguagauucuuucuuaauagguaguuuauuuucugcaaucauagccucuuaauuauaauugcagaggaauguugcaaagggccauggcccugcuuugcuaaacucuauauuguuucuuagccuuguuggcaccugcauuaaaaagguggcuuucccuuuaaaagacuuuguauaugaauuguuuucagaagagagcugugcugaaaaugaaguuaacuaaaauuagaggugugauaccaacaaaaucaaguauuuauguuauuagaagcauggauuuuguaaaagcugauuguuuaucccguacuguuaucaaauauguaggagagaggacaaaaaaguuuuugggguuguuuccauuaaacaaacaaaagguguauuuagggaggacuuugaaagauuuaguggauaaauugcauuuuuuauucuagcuuuuauuguaauauauaaacccguguugaaaugauagacuucaaaccauuaaaauagcuugacuguccugacccuguggggaauuaguuccaagacuuccacagauagcaaaauucauggguguuuaaguuccuucaauaaacugguauaguauuugcauauaaccuauguauaucuccccuuacacuuuaagucaucucuagauuacucauaauaccuaauacaaugcaaaugcaguguaaauaguuguuacacuguaugauuuaggggaagauuacaaggaaaaaaagucucuacguguuuccagcagacaccaccaucuauuuuuuaaaaauauuuucagucugcaguugauugaauccacagauacagaggguugacuuuauauauuugagaggcuucuuguuauuuacuauuauaggaaacacuggagcuuuaccuaaaaguauuaauuuuauugaaauuuaguugaugaaaaucugugauuuuguuauuuucucuuuuuuaaaucuuaugcauaaguuuaaagacauugugauauaagaugccguuuaaaaagacaggcuaggaauuacaacuuuuuagucaugaagaaugagacaguauuuuuauuaccuugaaaaauguaaugcugugucuuaguggagcaaaaccucauuuaggaccuaaauuucaguuaccaaaacuucccugaugggcuuuaauauggacacgguauguuuuaacaugcaaaacgccaauuaugagauuucugaaaugccagcaaaucauccaaaaagcaguauuugcugaaaaaauuuuaaaucauaccaauaaaacucagagaacuuaaaagcaugugaauuugccagagaauacagaaagcaggcaucauuucaaggaacagaaauuuuaaaaauuggggguagcuaaaaaucagaaaagcuugcuuuccuuaaucuacaaauaaauauaauguguaauaauggagucuucagcugguaaaagugugcguagcgucuuagucaucugauacaguuugaaaguugcaaaauaaaucuaaguugcuaagguuuuaaauaaauuuuguuaaguaguaaaugccuucuaaugauagacauacauaaauucaaauaguucauggagggucucuugucuguauuguuuaguuugugucuuuucuauuuuaggugauauuggaaauuauuauuauggacagggucaucccaugaagccucauagaauccgcaugacccauaacuugcuguuaaauuauggcuuauacagaaaaauggaaauauaugugaguauuccuuuuaauacauauucagcacugaucuuuuuuauuuuuuuuuagcuacugugaaacuuugucuauuauuccccuuuugagggcauuuagcagaugaaaagaucuggaagaaaacaaacuucuuuuuucguuuauucuuaggagaugaauaagaaugagagcuauacccucuuuuuccuuuuccuuuaaccauuuaaaaaaguucccccuacccuaggcuuucaugguucuggagaacaacucaguauagcaacaacucaguguagcauauuaaguauuuuuuuuuuuuuuuuuuuuuuuacaauaauuguuaaucugccugugcugcugaaaagaguugaccugggacuguuacaaaauaauaacacauaaaauuaaucccacaaauauuugcagggcauauaauacauauggaauacuguguuaguguggccaagcauaguacagauaacacaagugcaacagcugccuuaauguuuuuguagauaaagaugaggguauguauaaacaaauacagacacgacaauuagcuauuuggggagaaaagaaauauuuaaaacaauuaaugcuaggcaauauaugugaauaugugaauuauuuucaguuacauguagacauuuagagaagaggggaaguuagaauaagacucagucuggaagucuuguggaagaauugugucauacgugaaauugagcucuucggaacaaggaagauuaggauagaaaaaaggacgagaggucgugaacaaagauuuagaauugaaaacucuuguagugagugauuucauugaugaaaucacuggauguuuuaucauggaaaaggagagaaaguagaguuuaugaacauauggauuugacuuuuuacucgaacuguuuccacuaaaauaaggagugauuaaaucauaguugauaugccuguguaaugcuuuuaaaggaguuugaauuaguuuugagauugauuacuguuuucuaaaacacauauaaguuuggguuaguuuuggaauuuauauauuuuguucugguagacuugguucuuuugaggggaccgauaggggaauuuguauauuuguuugauaauacugauauaaccgguuguaauuccacaguucugacauuuauuucucuucacagaggccccauaaagccacugccgaagaaaugacaaaauaucacagugaugaguauaucaaauuucuacggucaauaagaccagauaacaugucugaguauaguaagcagaugcagagauguacguuucuaaguaaaaaguaguuuugcuuugauaaauguaaauuaguauuuuuaggagcuuagaaugaucuaaaucugaauauuuuuccuguuggucuaauauguuacaguuauuuacugauuugaaaagucauuuuaacacuacuaaagcuacuuaagaaaaaaguaaaccuaucugaagcuuauugguuugcaaaacugcuguuuggguauucuucuacuccuaguuugcuccccugauaacuuuggguuaauacauauugguagggagaccucacucccuuacucccucgcuucaaaaaaacaaaaacaagauuacacuuugauuagccuuagcuuggcauguacauaucucuugucuugucuuuguguacuucaguuaaccuggacuauaauacacaucucuuuuucuuuguuaagauauuagugaagcuuuugauucuacguaauguucucuuguacagguuaaaaguauuuuauuuuuagagauuaguaacaaauuggcuugaagguagaaugcaaaagucaaccuaaaauuauuggaacaguaucuuuuaaagcuugauaccaaaguucauucucauuaguguuuguauugacugacuucagugaugauuauacuaaauuaguguaggugcuagacaucucauauuuacaaccucauacacauuucugccauaucuuguuugauuuguuauaaugcuacaauguaacuagaacauguaguauuuaauuuuuuuuuuuucaaugaagauuccaacuuagaugcaaaagaggcaugaguagcccuugggcaaacaacauaacaggauugauuuaaaacccacauaauaaugaguucuauuaagcuuaugauccuggccaggugugguggcucacgccuguaaucccagcacuuugggaggcggaggugaguggauuaccugaggucaggaguucgaaaccagccuggccaacauggcaaaacccugucucuauuaaaaaaguacagaaaauuagcugggugugguggugcgcgccuguaaucccacuacucuguaggcugagacaggagaauugcuugcuugagccccagagguggagguugcagugagccaagcucacgccauugcacuccagccugggcgacagagugagacucugucuccaaaaaaaaaaaaagauuaugaucucucugugcaguaagaaacuaaaauucauuucuuauagugcuugugacuuaaggguauacaaagauauuaauauacaaaacaaggacccuuauucuugaagagguuacaauucaagggcauagggaaagacuaagaaaggguuacauacaucugccauauccuuucauucucucagugcuaaggaacuaaaugugugaucguuuaucuguaaauguuuuccuuguugucuuuaguauccuauguuuuggcucccaugaaccuaguuaauucuuagcaacuuucaagaucaagauuagccaugggaauaggcaaccagcuguuacaucuuuuugguuuaguaacuuacugacaugcauuucaaaguuacagauauuauagguauuuaaggaguuucaaagaaaguaaauuauaaagcaauugaaguugcuuuuagaauguuaacuuauuguaauauuaaggggaaaggccuagaaaauuuaagccuguguuuuaauuaaauaagaauuguuguacuuagacaacuauugaguucuuguuaauagacagaaauauuccacagauaauccugauaagauuugaugaucuuucacagauaacacuuuaauuaccuuggauaaaacaauaaauauauuuuaaaguuggaaacuuuauauuauacugugaaguguauguuugaugauugcaucaagcaaaaaaguauuugugggaaauaguuuuuguaagaaaaggcuuucauuaauuugcagaauguguugaaauuaaugaaauccaucuuccacaguuaauguuggagaagauuguccaguguuugauggacucuuugaguuuugucagcucucaacuggcgguucaguugguaagugcuaaugcaaucagauuuaaaaguugaucugaacuugguguguuaucuuucggguuauuuguguaaaacagaaguuuuaaugauugugaauuuugauaacaaaaggaaaucaguauguuuauaguaaaguacaauuuacuuucaaaccucuauguuuuaugauuaugacuuaaacgcuuuuuaaacuuauuuucacuuggagacuucauucauucccuuugucuucuagguaucauuguuacuaccacuuuccacauaaaccauuauuuaaucucagguugcagcucuaggagaauauuuuucuaaggaguaacuccuauuuguguuauagaugauuucuguuaacuuucaugauuuuaagcucuugcuuaugcauggcauacacuuguaguguuuuugucucauucuacuacuuuuuuaugauaaauguuuaaaaggucuaucuuguuucuacuucuuagcuggagcugugaaguuaaaccgacaacagacugauauggcuguuaauugggcuggaggauuacaucaugcuaagaaaucagaagcaucaggauucuguuacguuaaugauauugugcuugccauccuugaauuacuaaaguauguuaauuuauauugauacucuuuucagugauaaaguguuuucauuaaaacacaauaaauaaagucuauggcuuuaaaaaauauuagguaaaccauagguugaaauaguuaauggugaauuuucuaugaauucauuacaaaacaaugaagaaaugcaggaaauuugcccaauucuucaauuauuaagacuuagaaguguggccaggcacuauggcccaggccuguaaucccuccacuuugggaggcugaggugggcggaucucuugagcccaggaguuugagaccaggcuaggcaacauggcaaaaccccaucucuacagaaaaaaaauuagccagaugugguggcaugcaucuguagucccaacuacccaggaggcugaggugggaguaccugagcccaggaaguugagucugcaggaagccauguuccugccacuacacucuagccugggcaacagugugagacccugccuuaaaaaaagaauuagaaguguauaaaaggccagugccguggcucaugccuguaaucccagcacuuugggaggacgagguggguggauuaugaggucagggguuugagaccagccugaccaacauggugaaaccccauccuacuaaaaauagaaaaauuagccgggcgugguggcgugcgccuguaaucccagcuacucaggaggcugaggugggagaauugcuugaaccugggagguggagguugcagugagccgagauggcaccacugcaguccagccugggcuacagagugagacuccaucucaaaaaaaaaaaagaauuagaaguguauauaaaugucaaaacucccauuaaauacccuuuuuuaaaaguaguuuggcaauuuucauuuuaguuaguuucaacuaguaaaaaaugacaaugaccuuggaaguuuauauucuaguauuuuggauguuuuaaacugaagacaaaaauuugaagccaguguuaaaggaaauuuuuuuaccuauugaguuagucuaacugccuaacuuccauaucugaaugaggcuuuguucucuacugauggauauaaaauuaucucugaguuguugaaggaguuauuuuuccuuaucuguggcugcaguuugagagagagaucuauagagguacuuaggaauuuggauguucgcaauguuaguuauuuuuugccaucaguuaugacacaucuuagcagauucuacuuuguauuauacugagcuaguguuuuuugcuuguaguuauuccaugcaugcuauccauagaggcugacuuuucagucaacuuaaaauugauacugacuccucaaauaaacagugauugagcaguaucaguguaacaucuugccugcucaucaggagcaaaggaaaaucauuugcaaucauuugccuuguuuuuuaauugacuguugauguugguuccagugucuucaacucuuugagcaaguucuugcccacucagcuaauaguuuuaaacaacuuuaauuugucuggacacauuuuuuugggugguguaaucaaacaugauuuaauuaauugacuuggugcacagcuuuccuugcuuaucuaacacgugagccgcucagaaacuuuauuuugaucacagccucauuucuguuuuuuuaauuuugugaagaaauuuugcuguacuaugguaugcuguuuauaguguuaugagaauauucuuaugagugcuuagucuggaaauaucaauuuacauuguauuguuuuauuuagcacaguuauggcaccauuauauaauaaauacaaugcuuugccaucuaauaauaucucacuucacuauacuucaaaaggaugacaugagaaguccauuuuccccuuauuuugacaugaguauacacugguaacaaaaugucaugacauggugauucaugugacuccuaaacugcguuugaguuacaacugugucacuaaucuguggugcuccaagcaccaguuugaagucaugagaguaccacauguagccucugucacagcuaaucgauucugcaguucaaaugaagccauagguaauaaacaauugagcauggcugucuuucaguaaaacuuuuuuuauggacacugaaauuugaauuuuguauaauuaucacacgucagaaaauacucuuguuuugguuuuguuuuuaaaccauuuaaaaaauaauaaaaacuucuuaguucaaagcugaaaaaagaggcaauuggccaaauuugggccaugggccauaguuagccaaucccuauuuuauacuauugaagauuuacuacagagguguuuuaauuaacaaucuugaguaugguauaaucuucaguuuuuaauauauuagaaauaugugcuauguuuuugaagcauguagaauagaacagauuucacaaagaguaaauauauauuuuuuaaccuacauugggccacaaguggguauuuaaaggccugaggcucaaaccucagauauuugaauaaccucuuaggcugaauguaaaaggugauuaaacauucuggaaugcaagagcucaaaaauggguuuccugaauuuguggugcuucuucccaucuuagaaccuuuaaaggaaaaaccaaaacuuauggauuuguuuucagguaucaucagagagucuuauauauugauauagauauucaucauggugaugguguugaagaagcuuuuuauacaacagaucguguaaugacgguaucauuccauaaauauggggaauacuuuccuggcacaggagacuugaggguaagacuaaauucugucugaaaaaauauugugagaugaaccuaggagaucaguaauccuauacuugaaguaguauuuuucuccugaguuaauaauuugaaacuuguaugcagaauugaauuacuacguaugcaguaacauuugcuagaauucacuguugcugacuauaagcaaaaauuuagugaaaacuuaaggacaguuuuuuucucagcuguuuucuuugguugaauaaauguuuuugaauauccacaaagcaugaagcccuucucuugauguucaguuugaaucuucaaaacuaccugaugguagccuacguugcuauugauuguaaagaaugguggaauaaaauagacuaggucuuuuuagguucuucugcuccucucuuuugugauuggucuugauuuuuaguagaucuaauuuuaaucuuuuuuuuucuuuaagcuucuaaaauugguaauguauuuagguagagaaaggauaccauaguguaaccuugccugccuguuaacauuaaguguauuucuauuuuauuuguuaucuuuuuccauuugaugcucuugucuuuuaugacucugaaaaccacuggucaaauccuauuucuauaaguucauugaagguuuuuugccucacuacacuuuuuuugaaccuaacuauacaaaugucgaaauuuauucaauaauuuaaacagcuguuuuuaguucagccuggauuauaugggagauuuauauggcauugaacaaaguuuuaaacuauuuuauuaagauuauuuuucacaucugugguauaucauuacaguuuagcaaccaaaguuuaaagaguugccauaaaguauucuuaagcuguauggcuuuucuuuauuagaucacagugugauacuuucucaguaaacucuuugaguaaaagaguuaccuuacugaaacuuuuccauacuuacaaaugggugggaggucaaauguuugguuugaguuuaaauuauuuagcuuuuaaaauugcagauuuguaauuucaauuccuugccaguaaacuccuucaauuucucccuuuccccaccuggucuuaucuuacagaccagugcuucucaaacaguggcgccuaaacugaggaaagcagaucagcaucaccugggaacuuguuagaaauacacauucuuagggcccagaaacucugggugauucuucaccuuaaaguuugagaaccacugcuguaaacugauagaauacauuugucaacaaccauuacauccuaguggaagucaagcaaaagucuucucuguuuuaagcuuaaagaauaagacaguaucuuugcagugugaugcuaguuuaucucagaaguggaaaauggaagcuucauuuaauuucugacagguggaugucacuauggucucaucucaguuauuauucaaaauucuuacaguuugaaguuuuugaaaauauuagagaaugcuguuuuagaaggauuugagaauggcuuucaacaucucuuuuucucacuuaagauuuuacaaucgcugggccgggcgcggugucucacgccuguaaucccagcacuuugggaggccgaggugggaggaucacgaggucaggagaucgagaccauccuggcuaacacagugacaccccgucuccacuaaaaauacaaaaaauuagccgggcgugguggugggcgcuuguagucccagcuacuggggaggcugaggcaggagaauggcgugaacccgggaggcggagcuugcugugagccgagaucgcuccacugcacuccagccugggcgacacagcaagacucagccaaaaaaaaaaaaaaaaagauuuuacaguugcugauguuuucaggauaacauuugaauauuuuaagcauguccccauaacuucguaagagaauuaaaaucagucauuacauuauauguacagcuguuuuuggacuuucuguguaauucacguguaucuuuggauguuaauuuaauaaacacuccuuuuucugccugcuaauucauucucaugcugaaaagaaggcuacucugaguuuagcucauuguugaaacuguuugcuuuaauucaaguagucuaguggaagaaagaaagguggcauaguagcaguugcagaaugaaaccuggaagagagaaagcuaugucuaacaagggcagcagcucugaguugccagcuaguuaguagcaguuaggaugagaagugcugaccaacuuuucuguauucugaaaucuuagggucaaaauauauuucaucuguguuuuaacugugcaguaggacuguaaaguuuucacaauacuuuggcuuuuccauauuuguaugguuuguauuuaguuaaucuuaauaaaaacuuagacuucaagaaaaauugggagaggagguguguaauuuugcuugcuuucuccucguuggauguugggucucauaacucuaauauugaggguaaauuuugcuuuuguaaaauuggacugaagcuaagaucauuccaugagagguucagaagaacuugcacaagugcuaguaauccugaaaauucauggaucuucagacauuaucauucaacgcacauaagaauuaggcaccccccccccaccccacucaggcgcaguggcucaugccuguaaucccagcacuuugggaggcugaggcgaguggauuaccugaggucgagaguucgagaccagccugaccaauauggugaaaccccgucucuacuuaaaaugcaaaaaaaauuagcugggugugguggcgugcaccuguagucccagcaacucaggaggccgagacaggagaauuguuugaaccuaggaggcugucuuggcucacuggagugcagugagccgagaucaugccacugcacuccauccugggcgacagagcaggacuugaucucaaaaaacaaaaaaaaacaacaaagaggcacaccccaauccuuugguauugcaguuaaaauacuauuuuguaguaaugucuguacuauacaguaucuucuaggaauacguauacacacacagaaaugcauaugcacaccuacaaaugcauaacauauacaaauaaguaaguauauauaauauauguauauaucauuuaagaguauauguagcuggaaccuuugcgucuuuugagagagauuaaugccuggagugguacucauucaacaaguaggaacaaaauuuguuugaaguccaaguccaauuaagaacaaaucugaggcugggcaccauagcucacgccuguaaucccagcaccuuggggggccgagguggguggaucaccuagguugggaguuugagaccagccuguugaacauggaggaaacccugucucuacuaaagauacaaaauuagccuggcaugguggcacaugccuguaaucccagccacucgguaggcugaggcaggagaauugcuugaaccugggaggcggagguugcagugagcugagaucacgccauugcgccuccagccugggcaacgagcaaaacucugucucaaaaaaaaaaaaagaacaaaucuggugcuuuagucgguagcuguuaaaucuucgagaaagugugggucguucuuucaucauaaguaaacucauaccaacagauugugaaccacaagaaggauucugcagaugauuguccggcagggcuuuuuggcuuaauuuauuuuccacagguuuacucauaaaguugccuugucaucuuaaauauucuauuuaugauggauuuucugguuuaauguaauguaauuucauugccuuuaacuuguguuaaauuucuuuucugucaaaaauaaucacuacagauuaauugaaaaugguucuuguaugcuuuacaagcagucuauaaauauuggagcauauacuuauuuguuguuuauuauuuccuuucucaguuugauuguuccggucucaacuucuaagaugaauucaaaauuggauccuuaauacuuagucuuucagucuuuucaaaauguaguaaacaaaugccaaacuuuuuauuauagaauauucucuaagaucaguuuaauuauguauuuuaggauauuggugcuggaaaaggcaaauacuaugcugucaauuuuccaaugagagaugguauagaugaugagucauaugggcagauauuuaagccuguaaguauuauuguuuucacaauuggaauggaauuucagaauguuauuggagaugcuaacauuuguuaucuuguguguagauuaucucaaaggugauggagauguaucaaccuagugcugugguauuacaguguggugcagacucauuaucuggugauagacuggguuguuucaaucuaacagucaaagguaagcaauucaaagggugguauuuccagaaaaaaaugguuuuucuuccacccaagaacuccccguaaaaguucucauuguaguuucuugccugcuguuuuaacacuguacucugcauuuuucaugggguuuugucuguuguauguaugacuagaguuauucuuguuucauuauggcagauuuauauauacauuuauacaagacuaguuuuuuaagguuuauuguaguuugaacccaaggcagcuauuuuugaaugguuguugacucaguguaaauaaaacaugcauacuuuuuuacuuaauuggauuauuuauuucucauuaaggaagaagaggguuuagcucuccucaccauuuugcccacaacauacuuguacccuucccauaccucuauuuuuacaaaucagaauuugauugugauacuuaguguuuacggcagcaucuuuaaacacuuuucagcuuauccaguuguucuuugcugcauaauuguuccuaaguuucucauuugcuuaguuuucucuccacuuauugcugaacuacuggugucucaguaucuucauguguucagauucauugaauauucugucacuuucaccuucuugaaaaacagccuucucaucuguucauguuuggaugacuaucuuugguagaccuggcaggacacauagcuguucucugcuuuuuuucuguuguauugguucucccugguggcucuguucucuguccuuaauuuuuuucucauguuuugguggagugccuucugaaguagcuuccugauaaaaagugugugggggauuaggagugcugcaguacauacuaaauuuugaucauguguugaaaucagcauaugauugaaggcuaggccaaagcaaaauaucaccauucuggaaugaacuucuaggguguaagaauaaaucugaaauuuuauuuaauaagauauuauaauguauauguagauuagaaaugauuuuuaucaugaguguuuguguaugauuuuagagguuuuuuuccacgugaacuuuuagguagcaaguugacagugugcuuuguauucucuaagauguggagaauucucaaauagaacuuucuccagaacaauugcuggucuuaauggaauuggauaacuaaauacagauauuaaaagcuucuuuauuuaauguuaugauugcuacuauaccagcuauauuagaauuaugguauaaucuguuauucuauguuaaguggaaugauauuaaauuaauugucccuuuguaggucaacagugguugaaccgcaguuucauauuguaacuuaauguguuaauaaccaucuuuugccucaaaauguuuauaaacuuucuaaaaugaucuaccuaauguacucuuaaaaguguauauuaacuaucaguuuuccucuuugacuugaaaguccuuaauguuuuuguacuuaauauuuuuuauaaucauaaacugcagcaguucacucuuagaaaaaaauuuacuuuguauuucagcuaauagaguuucaguugcauaaagcguguaaggauauuuguaauuccaagucuuaaacuucauucugaguuucucugcugccagcuuugauucagcuuuuucagaucugcugaaguuaguuaucucuuuuccaucuccuugcugccaucagcuauguucuuccucuuguauugucucccauucuucauuuuuacaaauuuuggccuuuaaaaaaaucccuuucgagucauuuuugucaaguuuugggaugaaggaaaaguaaacaucuuuguuuagccagcuaucuuuacuuggaagccuguaaguuaacuuuuaguauguuuguuuuuucuuuaaaaauauccaaaugguuuuuaucuguuaaaagaaacuuuucuaguagcaauaauaaaaauugagugcuagaauuauguaaaucacauguugcaacuauugaagaaugcuuaaugaaaauucccacaguauacaguuacaugaagagaacagauaaacuuuguaaaauuaacucugaaauggaaggaaauauagaaaaacgauuuuugaauaaugucauuuuuaggugguuaguuuuuucauugucccuuuuuaauuuuuucccaaauacucuucaguaugcacaaaugucuuuuguaauugaaggauuuucuuuucuucuuuaaagauugaguuaugugccuaacugguaauauuccgagaagggaacuuacuggaaacuuauaaauguuuauugaauuaugacauuuauccacauaaaauauuuacuuuuauguuagguuuacuauuaauauuaaauuucuacacguagaaguugaaguuuuugaaaauuaauagauguuuuuaacucuuaaguuaggaaaacuacucaguaccacuaccuaaaguuaacucaggguuaaacuauguuguuuagcuuuccauaauuauuuuacacauguccauagggaaagaaaagucaauaaaaauuaauuuagaugauacauaauguuuuauuguaacaugaugaauuucaccauguaacccuacaugaacaucuuucuguguuaauaaaauagguguauauucauauuauaaucuuaauauaguuguguacuugacuuuuccaucagggacaccugcuaaaauagcuaguuauaucuuaauuuuuuaauauguauuauuguauaacguguuuggaaaggaguuuuagacuugacauuuuuuacauuuuuauuuguuuuuaaaauauuuagaaaacccauuuugguugaguaacauuugcacuuauuaucuuuuuaaaauuuauuuuucgaacuguugcaguaugcagauuuuguuguuacccaaaucuucuugucuuaggucaugcuaaauguguagaaguuguaaaaacuuuuaacuuaccauuacugaugcuuggaggagguggcuacacaauccguaauguugcucgauguuggacauaugagacugcaguugcccuugauugugagauucccaaugguaaguguucucauuacaauaucuuuauuguaugaacugucaauacagaugcuccucuaauuauguugcaauuagguccugauaaacccaucauaaguugaaaguaugauaaguagaaaauggauauaauacacuuaaccuaccaaacaugacuuagcccagccuacuuuaaacgugcucagaacaguuagguuaggcuucaguuggacaaaauaaucuaauacugagccuguuuuauaaaaauaaaacguugaauauuucauguaauguacugaauacaagacauugaaguugguacaaaaaagccagaaaacuguaagucaagccauugaaagucagagacugucuguauauagaaauagauggaugaaugauuagaguaagugccauucuuuauaaauaggagaacauucacuuuguguucacuuuuaaacauuuucuuaggaaauauuucaccaccuaaaucuggauucugugcaugguuuuuugugaaaacugagcuuguaauauguaacuuuauuuuauuguuuucauuagaguugccauauaaugauuacuuugaguauuuuggaccagacuucaaacugcauauuaguccuucaaacaugacaaaccagaacacuccagaauauauggaaaagauaaaguaagaaaucauugaauuguuuugauaaacauuuuaucuugacaaagauuuaguaugcuuuaaagggccaaguaugaugggucuuuuuaacuuuauuagauauuuuguuuuuuucuaaaggauuugaaacauuaaguuacugauuauucuuuuuuuuuuuuuuuaauuuuuaauuuuuuugucaggaugggauauugcuugguugcccaggcuggucucgaacuccuggcuucaagugauccugucaccucugccucucagaagugcugagcuuacaggcaugagccaccguauucagccauuuaauuucuucaguuaauggaaauaauuuuuuuuauuaguugaaauguauuuuaaaauugcaaggugcacuauaaguuauuuucauugucuggaacauuuuguuaaggcuuugucuccacaagcaaaguagagacauuauaguacauagcauggguuugagucaccucuguaccacaaacaagcuguaugauguuugauaaguucacuugccuuugugcuuauguuuucucaucauugaaauggcaggcuaaaauaaugccuccuuggccagucaagguggcuuaugcuuguaauccuaaugcuuuggaaguccgaggugggaggauagcuuuagaccaguaguuugugaccagccugggccauauagugagaccuugucugcaaaaaauuuaaaaauuagccgggcaugguggcauacacuuguaguccuaacgcgcagaggcugaggcaggaggauugccaggaguuugaggcugcagugagcuaugaucuugccacugcacucuagucugggcaacaaagagagaccuuuuaauauauagguuuagcuagaccaaagaugaaauuuuuugcuaaauauuuucucuugcauguaagaacugcaaagaaauuuaauuuugucuaauaaacuuugcauguguaauuuagacagcguuuguuugaaaauuugcgcauguuaccucaugcaccugguguccagaugcaagcuauuccagaagaugcuguucaugaagacaguggagaugaagauggagaagauccagacaagagaauuucuaguaagauaaugccuuuauuuuuccaauuugucaaaaugauaauugaaauggaagguuuuaguggccuaagaacuucacuauaaagucauguucacgagcacacuguuaauauugucauuuuugccacuuucagagauuuagcuuccugaugucucagaaccugauuugggugucagcaguuucaguuuguauggcuggauauacauauaugauugaaaguuuucaaaaauuagcaacuuuaguauauuuggaaauuaauaagacaucucauuuaucuaaaguagggugaacuaaauaacuaaacaucuguuugauuuuacaacuucucauuacacuuaaugugaugguuagauuguagcauaacaguauguguaaugguauagacugucuaacauauuugguauugguacuuuuuuuuuggucuacuucaccucucagcucugaaauaaaaugcuacuuuuuaaguaaugacauuauucccauccccuauuagaaaaacacacuuuuuuccuuuagaguuucagcauuuuuaaagaaaaagagauucccccaauuuuuauuauguguuuuugagccauuucuucauacaugaaagcaaaguuuucaauauuaaauaaaccauucauuccauucaaauuuuaaaaucauuaggcauguuacccuuuacguuuaaaugugguaacuaacugcuuagugcauuuguaugaguaugcuguaaugauuauaaaaccugugacuguuuuugucaaaauuuauuaaaauauucugugcaguucgagcaucagacaagcggauagcuugugaugaagaauucucagauucugaggaugaaggagaaggaggucgaagaaauguggcugaucauaagaaaggagcaaagaaagcuagaauugaagaagauaagaaagaaacagaggacaaaaaaacaggucagauuuguuucuugguaauuguguuuuaauuguaaauuuuaaaaauugggcugcauuauaauguuuaugcuaucgagaagucaguugcacagguaucaggaggaaguaugcuagguaggugacucuuuuuucuuacauauaagugguacuuagcucuuaaagcuuuuauauaaauguuauuguuccuauuugcuuuaguaauacaggaaaccuuauuuucuugauaacauagguuuaaaauagugaacauugcauugugauauagauugguuaagaaagaggacaaaguaauuaugaaucuauugguagugcauggucagaacugaacuucuaagguaauuuuuagcuaccuaaagcuuauuuaaugggagaaaacacaaagaagaguuacauauccuuagaccaguuuugccauuuugaaaaaggucaaauaauggauuuuguucagaaauugaagaaaacauuaaaaacucugaggaaagcuaggaggggauuugggaccuggguuagggaggaaaaaauacuuugauacauugccuuacuuuaaaacgcuguguuagcuuuaggcaauugaauuugcuaccggaaucuguuaccuuucaucugacuucccagaacacuuacacaugccucugccauuuuauuuaacacaucauauuauagcaccucacaggauuuugucucccuacuagacugagcugcucauggcuagggaacacaguaucuuaaauauuuguauucucagcacuugaugcauuuccuaaugcaaguaauggugaugagcacacguuuuaguuaaccuguuaauuuugauccuguaguaugugaaaaacugauuuagagauaaugauccaauuuuuccuaugucuaucaaauugaaguuaugugaauaagccagcuuuuuuuuuuuuuuuuaaacuagagaguuaguaaucuauaacaucugacacauuuaguucuguucuuuuacuuguggauucacuccucaauaggcuacauacagaaauuuauaauuuuaacuucccaauguauuacaaugauggcuucagucuauauuuguaacugauugacauccaaaaauucaagccaugacugaauuaaggacgacuuaacuuuagcuguaggauuuuccuaacuuuuuuucuuuucuuucauuuucacuauguuuucuugucugucuguuuuugguguucucauuuuuaaaagcuuuaucuuuucugugcuuaaaaaauaaacucucuauuuggugaugaggcucuuucgauagggccuugcaguuguuaaaauucuucagccuacugaaaaaugaaauacuaccacagaaagcuuuuuuuaaaucuauaggucaaaaccuagaguuagggccaccuuuucucccucugcaccccaauccagugacuauucauagcuuguacugccaucguuuaggaaacacccaacacaaagcuuauuuagaccgaauucauuaauaauaagauugcauaacuuuuuauauuuuaaaaauaaaguauauuuugaaauaauauauauacauuuuauauuucaaaauagguuuuaaucuuuucccaaucuuuauuuuuagacguuaaggaagaagauaaauccaaggacaacaguggugaaaaaacagauaccaaaggguaaaugauguuccuuaucaaguacuuuuuacauacuauaaaaauacuaaacauguuuauugguguguguuuguguacacacuucagaaauacuagacugaaccuuagaacaucauuaugaggugcucugaauuuuaguuuguauugguacauaagacaacauaugccaucuuaccuauugguuuaucaguauaacuauaucagucaguuuguauucuuguacguaguuuaucugagacccuuuuuugcuguuaucuuuuauauaugcacuuaaugguuuucaugguguucuuauuucuguguacaugauuuuuuuaguguugugagauagguaaauuuaagaaacaauuuuaaguaaaaacaguugaggauuuuagugucagaaagcauguaaauguuugggcacacauaauuuugugccagccuuuacaggauaacuuggaauaguuuauuaaaucacuagaaaaauuaaggcauuaauuacuccagaaacacuuaagacauuaucaauuaauguguuucuuagcaugagccuacaggaccugaucaauauaauaggucagugcauuuaaaccaagauugugccauuuuuaauauuucacauugccucuuuuaacagaaccaaaucagaacagcucagcaaccccugaauuugacagucucaccaauuucagaaaaucauuaaaaagaaaauauugaaaggaaaauguuuucuuuuugaagacuucuggcuucauuuuauacuacuuuggcauggacuguauuuauuuucaaauggcuuuuucguuuuuguuuuucuuggcaaguuuuauugugaguuuuucuaauuaugaagcaaaauuucuuuucuccaccaugcuuuaugugauaguauuuaaaauugaugugaguuauuaugucaaaaaaacugaucuauuaaagaaguaauuggccuuucugagcugauuuuuccaucuuuuguaauuaucuuuauuaaaaaauuguacuugg

SEQ ID NO: 21471 - RNA, 23572 nt, Homo sapiens
acucggcccuccaguguugcggagaggcaagagcagcgaccgcggcaccuguccgcccggagcugggacgcgggcgcccgggcggccggacgaagcgaggagggaccgccgaggugcgcgucugugcggcucagccuggcgggggacgcggggagaauguggacuggguagagaugaacgagacuuuucucagauguuggauauuugcuuggaaaaacguguggguacgaccuugguaaggaacuugaauuuuuuuuuuuuaauucugaaauugaucugaaaacuuuauuuucuuuuccuuuauuguuauuauuauuaauuuuuuuuggcuaaugucgcaguagaaacaugcuucugcuuuagugcacuuagugcugucaaacauuugugagacuuuccuuaugaaucauuaacccuuucaguucuagacauaauugccaauucauugaaauuucaguagugguuccagcucacacucgucaaacuauuccggguuggcugaaguuuucuauuuuauuuuauuuuuaacauguguuuggcgucaugacucuacauguuggaacuaaauaaaaauaagcagguuugcuuaaaucauaacugagggaaaaacaacuuugcauccaacuuuuuuuuuuuuaagagcauccuauuuagagaaguggaagaauguaaaaaccuccuugaaggacuuccacagaauguuauguuuacauuugaacaaacacacauucuuacauggaaaugauacccauauuccucauuuuuaucaaacaugucuauaugagaaaacccuuacagaaguuguuuaccuuuuuuugccuuuggaaaacaguuuuuuucugagugugagggaggauuuugggggaauauccucaucaauguacaaguggaagcagagcuuguccuccaagucuucuaaauuuguuauaacuuuaguuacaguaaacuguaguacaucagugacuucugggaauucauacacuuucagauuuaaauggaaagugcuauuuguagcugaggacuccuaaaggaauucucuccagggaauuuuauuaaacgguuuuauguuuuguuuuugccuuuucaauuugguaugagaugcuugcaagucagaagacacugcaggcuguuuuccccuucacccauuuuuccuccucuuuuccugugguccaagugauuucuaagaggccguagcucagugaugcuggcaggaugcaacccuuuucagucuuccaugugagaggaugaaagagagcucgcagcagagggaggaggcaguuguuuugaaaguuguuuugcguugggagcuggugggaaaguucggucuuccccauuuggaaaaggcaggcuggguuccgcuccugcaccacacgcgcuuuccauuuuuagcuucauucagaggcagacagagcuccuuccucuuccucuccuuguuugugacacuuuucugaggcagcuuuuccacagugccgagggucuggcggccaugaccccaggcauucugggacacuggacugugugcccagaacauuuuucugccaugagagguaaagccagggauuguucagaggugauucuuuuuuuuuuuuuccuuuuccccacagugagguugccacauucuuuuuuuuuuuuuuuuuuuuaacuaagaguagcauuuaaaaaccuugcuucuuuucaaggcaguuuacuuuauacggcuucuuggcucuuucucaacuguaccaagcacucugcaucugcuuuuaaagucuucagacuacuguauuagucauagccucucagaaggagccacaggaacggcgggacaauggggauuaaaggccuuuccuuucucuuccaggcugcccccaaguguaacuccagcacugugagguuucagggauuggcagaggggaccaaggggaccaugaaaauggacauggaggaugcggauaugacucuguggacagaggcugaguuugaagagaaguguacauacauugugaacgaccaccccugggauucuggugcugauggcgguacuucgguucaggcggaggcauccuuaccaaggaaucugcuuuucaaguaugccaccaacagugaagagguaagccucugguuuauugacaagaagauuggggaccuggugccaaaucucccuacuugcccuugaggccuuguauaucucugaaaaccucugagaaucuguaaguaucaguaaauaauugauugcucuauucaauucuugcauugcuuucucuuucccuaaaccauuuccuucucauuucuuccagccuucaacuguuccucacuaauuaguaaacaguuaaauauuuuggcaaauuggcaugucuuagaaaagcaacuugcagcauagggugggugaaauugucagugaacuucaagaaagcucugggcccacuggcccuagugucccuguuguacaauaucucuuaagggagaaaacuuuuucuuggaaaaaaaaguuuuaauauuucuuuugucugucuuugguaauuaguuggcuuuacucuuuuuaacaagccagcuuuauuagcuggguuucuaaaacuauccucaaaacuuugacguguuuaugaagugaagugaugguauaagccgagaaagggggucauguaaaaguguccucugucuggaugacuucagagcuaaccacuguuuaucugcagcagcuccuuugcuggggcugggcuggcaggccaauuccuuacuggccucugaaguggguacacucuuuguuguuucaaaggggaugaaaacccaaacuuggaaugagcaacugauuuguguuuaccuuuaauauaaagauuauagcuaggcgugauguuuagcugugaaauaacuugcagaaccaccucuuguuuucagaauuuggcuuacuguaguugcacuuacuagucuacuacuggguugaguugaaugaaaggaccccucagcagacuucccauaccaccauuagcacagagcacugucaauucuauuacuuccuucagaaaguagggaaaggggaugguuggccguagaaauccagaauuugcuacugggacuauuccuuacagccgugucaaaucacuuucccccuucccuaaggaacaguauuugaaggaauccgggagacuaggaaaugcuuugucucuuuccuguuugugugucugaguccaguguuuuuggugagggggagacacagcugucuaaaauuaaauagaacaacgaugcucagucuuucuuuuuucccccacugcugcgugaauggaggcagauuuuauaaaaaauaaaauuuaaauucuaguuguaguugaauguuaccaaaaaauuuaaccccagaggucagccuuaauuauaccucuuccugaaaguaaugcucuucuuauagaaagucucucaauauguggcccuuggaaugaauguaggauuuguuuggguauaugagguuugacuauggcuuuaaaaaguguaguguguuuuuuccccauaucaaguuugaccaaauauucgucuguucccaagcuucguuugugcuguguugcccuguccaguccuuugggacugaaguaaaaaucuccauucugugggucaucuuugccuuuuaauucuauaauguucuuaucgucaguucagcucuuagcuuaaguuuuucaauuuccgucauucuccuuuaaaaucauagcuaagucaaguaaugcucuuagaucauuuaguucaagguucagaaagacagucacuuacccaaaggcauauagguaaagccagaccggggacuugaagcaaagcuuuucugacuucuccaaugagugcuucucgauuaugcuacacuggccccucuuggugucacugugguuuuaguuaucaucuuaauauauuucagaccaauccuuaagcuauuuuguguuuuuuucccucugaauguauaacuuccuauuucaauauauuaagcaaccaaaaaacagacaaugccuguguuccugaagaagguccuucgaaacuaaccuaagaggugaggguucucuuauccuauuucccuaucuugcauuuaacugaagcgcuugaauagaggauaguaugucuuuaaacccuaaucauaaagucaagcaaggaguaaacuugaauguaauacugucuuaagcuuacucuggaauuuguaccuguuuuucuguuucucuccuuuguuuuugaacuuugggaaaggacagcuuccuuuagaaggugaaagaggaugguggaguugagccauuaaggguaggauagcugcaaacuaguuccgggacagcaacauuaaggauugaugaaauguuuacauuaucuuuauucaguuaguucuuuaaguuccaugagccauugaaauaggaagagucuuucuacauguacuuuuuaucugacuuauuaaucuugcccuucuuuaaauguuuucguuuaaauagcaaaagauguuacaauauguacuauugugcugacauaccggggaauuuuuuuuuuacaagaccauuuuucauuaugaauuuguaccaugugucagcaccuuuuuuuuuuuuuugguuaaaacaaaacauacaaaucauauuucugaucuugacccucauuuuuagauuggguuuagaaucauucugcaccuuuaaugaaaaacuguucuuacuuccuauuuccagaacugaaaucaaauauagaccuacuauucaaaacuuugaaaauguuuuaaacugauggguuauucuuuuauggggguuuuccccuuguccuccugaaauaaucucuuaugacuacuugacuacagaaaaaucaguucaagcauuuauauuuuagaagcguuacccuguagaguuucugccgucgguugagacugcuugcacucaagaggcacuguggcucugugagucucaccucccuguaucguggcugauaaacaucagacagauugugaggacuccuuugguguccauucugaucgaaauccauuauuaacucaagccaucuguaaaaaguaucucaccauaacaugcaauucucucuucauguugccuuuuauuugagaaaugauguaccaaggcaucaccaugucuccuuuaauagaaagauaaugaagaaggaaaccuucuccaaacaacuuuguucacuucacuccuuuuaaaaauggggugauugccgggcgcgguggcucacgccuguaaucccagcacuuugggaggcugaggacagcagaucaccugaggucaggaguucaagaccagccuagccaacauggugaaaccccaucucuacuaaaaauacaaaaauuagccgggcgugguggugggcgccuguaaucccagcuaccugagaggcugagguaggagaaucgcuugaaccugggagguggagugagccgagaucgugccauugcacuccagcccaggcaacgagagugaaacucuguuucaaaauaaauaaguaaauaaaugccauugcacuccagcccaggcaacaagagcaaaacccuguuucuaaauaaauaaaauaaaauaaaaaugaggugauugcaggcugaaggucuuggucacuacugaguucuaguucucucaagacaaauauucauauggucaaaacagaauuauaaucuaacgagucauucuuauagagugggauucggggagggaaaacagauagcuaguaauuuaaaugaucuuaauguaauuuggggagaggaugaucagaugacauuuagacuuggauauaguuucugcuucaaacccacgcugugugugucuguuugcauacucucuaaagaaggaauuugaaaaaaaaaaaaaaaaacaaaccuauauuguccuuguuaucagccuuccauuaagcgcuccaacucaacccauccuaagcugucaaaucuccuucauuguguaaaauugaaaagaagcccuguguuuuguccggaagcuguggaaacuguggacggcgggguguguucuguaacugaggccacagacagaaacaaaucugcucaagugguggaggggucugcaccgcacauaaagagcuucugugggagcaggugaagcaaggagguauugaagccggguguccucuugcuguugaguuuauagaaggcacagagcggccuguccccagcaguaauucuuuaggacccuggucaguuccagugaaguuuccuucuugaguuaggugaacacauucuuugucuuuuuagcacugugaaguuuaagcuacacaccaaguuccuccuuaguauuugcuugguucaaagauaaacuguuacaaacuaugggucagggagauggguagucuaagaugcacauucuggaucuuucuaggaccagagggagacuuaguacuugguuuuuucacuucccuuuaaaaacaauccugguuccuguucccccuccaaaguuaccuggacaagcaccauagucuuagaguuucagcuuuuauggcgucugugucucagacgugcauuugagaugaagauguuuacuguauauuagaacgcuagacuuagaauggauauaggugguuuguaagugccuuccaguuuugaaauuuuaugauuuuguaucuuuaucuauaggugugaguuuauaugugcccuauagcacuguauguaauugaaauuuaaaauauuagggcgcucugucccuuuccuaaugauaagcuaauauugaagcucuuuaauuugucugggguuugaggauuaucauagaccucucuucuaccacagagccuucucuuuuuaauuguucuccugucuugccuguugaauugaauuuguaagguuagagauggcaagagcuacuuccggugcugcuuuauagcuuacuagugaugagucuauaguugugcucaaauagguauuggguagcuuaugcuuucuaguugacuucuuuuugggcacaagaaaauguguguaagauggauaacugaaaaccuagaggcccauucuguaaaagaauggcaauuuggaagaagaaccacgaccucagugcagugcuccguuuugguaaucaagcucugacucccaagacaccaucuguaagagacuauaauuuaaaacaaaguugaugaaccaguugagugccuuucuuaaaauuacuguuguaaaguagauauguugaaaauaucaacugcuaauuauuggcucaccaacaaauggcaugauuuguuuuuccuguuugucauucuaauauuauggaauaaucacugaaauaugaauguuaaaugauuugcaugucauagaauucaauuccauuaauuuuccaaauuaauuagauucaauaauaauauguccaaaacaaugagccucugaauaagucuacuaaagcuuuaaauauauauauuuauaucucaagacugcucugagauacucuuguccccaguaguuuuacugccaacaaauaccaauaaugacaaacggugauuaaaagggcagauagauguaaaugaaggcagaggaggaggaugaaaugaacaucugcuuuuuucagcucucugacagaaauucuuaaaggaccaaaaauaacacucuuguuucaacuuauguuagguguaggaaaauuuucuuuuuuucucuuuccagucugaguaugcuucauugauuuguauauugaauacuaaauuguuuuagaaaaaaaaaucauuggcugauaagacacuuaaaugagaaaagcuagucugucacaggcauguaggugugccauaucuauuuaaauagagguuuaaauuauugaugagacuuaaugaggaacugguguauauuguaaccaaaauuguagauuccacugugaacaaucugugcauggaucgauucacauauuugagucuaccauuucagguacaugaauguacaggagcuacugggaauauaaaaacuggaaaauaaacauuaucaucuauuaccacucccuccuccuugguccauuuuaguaaagaauucaguaaagugauagguaggcuaucuugaaugagaagaaaauaaaacuaggaaagugagagaauaaaaaccaaaacaaaacuguaacugcaaacuguuguaaaggacuacucacagaggaguucuauugaauagugacgaauugcuuccugauucacgguuggugauuuuuuuaccccuucaaagagaaauuuauuauuaaggaggaacugguauaguuaacauguuucuuuagcaaggccccacaaaguuaaaaugugugaugcauccagucugaggucauuuccucagaucuuagaaccuacagcuuuccuccguauaaacuuaauuucaaaggagggcuuuuggccaggcaugguggcucagccuguaaucucagcacuuugggaggccgaggugggaggaucgcuugaguccaggaguuugagacaaggcugggcaacauggugagaccccuucucaacaauaacaacaaaaauuagcugggcgugauggugcaugccuguagucccagcuacucaggaggcugaggugggaggaucucuugaucccaggaggucaaggcugcaaugagcuaagaucaagccacugcauuccagccugagugauagugggagaccuugucuuuaaaacacacacacacacacacacacacacgagggccuuugaccacucuugaguagaagacucgagaagaacaaaguagaaggccagagaagaacaaaguuacuugaaagaucucuuauuaaagagaauguacaagcuaugaaaaaaaaaaaacacacacacacacacaaaccucaucuggaaugaaaaaaacauaaugcauuugguuucugguuccuuaggcuguuauggaacaaccaaagaacauuauuuugguuucugaggucagaacuauuuuauuccccucaagcacacuaugcuuaugguuugagggagaaugagaaauaggaaacuaggaacaggcugaaauggucuaaucuugaccaucuaauucugcagugucuuauucucauucuaaaagagaaugguuauauucgcuguucuagcauaaaaaguaaugauaaaaauaaaagaucccguauuaccagacaauaauccccuagacuguuuuaaugcuugguugaguauuugcuuaugaucucagacuuuaaaagauggucucccccuauggugaagcuuguuaauuauguaggcaucauuaaugucuguuuacuuaucaaaauuuuaucauuguuaguuguauuacuacuugacaguccaauuuauuuaauugaaaagauugguuaacauuuuauagucaaaguaauuguuuccuguguuuuuuccuguuuagguuauuggagugaugaguaaagaauacauaccaaagggcacacguuuuggaccccuaauaggugaaaucuacaccaaugacacaguuccuaagaacgccaacaggaaauauuuuuggaggguaaguaagggaaauuucuucagacccauuaaauguuaggaaaaaauggagcuaaaagagcuggguggcucaccuuucucauccugugcugagaaaugcuggggcucacccauaaguauccagcauccccauggacacagggaauucugaacaaaugugaugaaaccgaugaaaugucuggccuguaggugguuagugauggagauacgggcuauaugugaaucuugauuuuugcaauucauuagagcuuuguaaugaaaggaaacaguuuguugcuugcuuuaaggauagguucauuugcauuucuccgcaaggaaguaguaaugaguuaccaagccuuagauuucaccccuuuuugauuucuugcugacuuaacuuuaauugaauggaagaguuaucacaaaugaauuaucuuuuugguuuuuuuuuuuuugagauggagucucacucugucaccaggcuggagugcaauggcaugaucucggcucacugcaaccuccgccucccagguucaagcaauuguccugccucagccucccgaguagcugggacuaaggugcgcgccaccaugcccaguuaauuuuuguauuuuuaguagagacgggguuccacuauguuggccaugauggucucgaucucuggaccucgugauccgcccaccuuggccucccaaagugcuggaauuacaggcaagagccaccgcgcccagccaggaaugacaaaugaauuaccuuauaaguaaaugccauuaaggaaggauagcuggaagauggguugaggggaauggaggaccacagaacuaguccuauuuaaauacaugugcaugguaaaaugauuccauuugacaauagguuaauuaucucauagcauaaggaaaaugcuuaacagucauaugcaagaugauaagcuuuccuauagcauccaaccaaaagaucuagccaguacaauuuccuuugcuauauuaggguuagaaaggcccccagaggugaaccaauuagauggaauccuugaauaaaacacuggauuagcagugaacagaaaaaagucagauugcuuuccuucuucccauagaugucucagggauauuuaguuuccucagaagauaaagaauuuaguaagcguuuuuuugugcauacuuacaugaaauguacauuauuugaauucuuuaaaaagaaacagcugcaugauaacaaaaauuguguuaugcuugcuuuagcugguauuuuugccuagaacgauuauaucguucggacaagaagcuauuccuaagaaacaauauuuuuaauccaggaaguuuuucauuuuuagaaauuuaucuuacuauuucccaagcaaaagaggguaguuacagauucacuaagaaucaugugcucacaauuuuuauuuaauaauuauuccuccuuaaaauauauuaaucaccugacuuacaaugguggaaccaugagugcauuuuugccuuuauugucaauaacgucuucucagaagugagccacaaaggugcauaguucuuggaguuaaaggucugaauuaagacaauccagcauaagucucauuaaugugugauuauuuugagaaaaggcaagaaguaccuaagaaucucccccucacuguccaguucccuguuucauuuaaagauucacuguaaguaacugaaaggcuuuccuugggaggauuuauuugaaucagucuuucacaugcaaaggauauuguagaacaucucguuuuugcuggcaggaauaugaacaucuguugugaggaaagaaaaaguuucaugcaaauuacacugccaaagaagggauguucaaguugagaaaccagugacauuucuuguaacuguacuaugaaucagcgcauuuuaaucuucuagauaauauauggaagugcaggaaggugguaggaaacgguguucauuuuacauaugcguuauuuuauucugugugagugacuucauggcaccgacauugcuguuuuuaaaugaggauacaguaaauugcaguccgaggaaggcuaacuggaaucaacauacccguagcuuuagaaagcaguuuccgcaccagcgaagaguacaagagcgauggaaccccauguuccuggaaguuugcacaucagaguaaacaaacuugaaaaccccucuugauagcagaauucacccagccuuguuccauuuucucuuaacaaaacacaccgcaaaagcucucacaagcugcuuugaugaagccacauguauuucccccuucacaauuuacaggaaguuacucuuaaaagaaagugauucugguguuuaccgccuguguuaaagggacagaguuccuuuuuauuucugauaacguuugagcgaaauacagaaacuaucuguagacuagcauagucgguacgugaguaaggaaaagcaauaaccugcuguccggugagcacaaaauuccugcuacgaacagugccuuacugcugcuuggagacugcaagucgcagaucacacuagguauugacugauuguauaaggaaauuucuuaaagucuaaaguaaaggugguaccuccuaaaaagaggggaagagagaaaacuuuguguggaaggauaaggaguguguuuauaguuucaguaagaguguacguuuuaauuuuucuucuuccucugccucuuugccaaguagccugagugcaucuguuauccagaaguaguauuacucuaggacaaacuucaaauucuucauucugcguugccuuuaaggaacaacauacuuucuuccuguucuuuuuccaaaaacacacgccuauggcucugugugugguguuuuagccagccuccucccagauaagggguucccuucccuccuuugcauugaaaggaaagugcaagucuggacauguuuaucaagaggaaaagugacuucucaguaauagacugucaaauucgggcugcugcccgaguguucgcuuuguuauggcaggugaaguucaccuuugccccacccaguguuuccacaaaaaggcaagguuccaaguauucauaugaacaaguguuacuuuaggacuuggaggguuggggguggaggauguuugcauaguugaagccuugggcggggguguaggaaacggcgaguacagaggccauagaaaaagcuaagacucaguuugacgucgucagccggcuuggucuucuacccagugacucaaagcacuaaaagucagcauaaucggaacugaagucaguagcaucgcccauuugccauucacugcaguagcaaaaguaguacucugugguggguuaaucgguuugaggcagcuccuuaaaugaacauuuguguuucauuuuucuguuauuuucccgaacaugaaaagacgauaaaacugaaauggaaaagguaacugacaaaagugugccuuaccuguuuccgcccugauuucugcugauucaagacuauucuggcuaaacugauuggauucuuuuucuaacuaggcaguaggggaucagaaaucacacacgguaccggcuguguuuauucugagaggugcuggggagcuuugggucugacuuccuuuuacaugccugucuucucuuuuggacagaucuauuccagaggggagcuucaccacuucauugacggcuuuaaugaagagaaaagcaacuggaugcgcuaugugaauccagcacacucuccccgggagcaaaaccuggcugcgugucagaacgggaugaacaucuacuucuacaccauuaagcccaucccugccaaccaggaacuucuugugugguauugucgggacuuugcagaaaggcuucacuacccuuaucccggagagcugacaaugaugaaucucaguaaguggauuacagaacaaaaaaauaaaaaaugccaguaaugucgguucugccccuuugaacuaauaacauguuguuuaauuauacggcuuugucauguguuggaugaaguagguggcuuaagcuagggacuaggaagaggaaaaacauuuuuugagucccuauuaacuauuaggaaacuugaucauuuaaaaguauauauauauaugaggagcuaccuugaguuuugaauucaggauguuacaggaagaaauauauguccaauucuaauuuauccaaaagcaguugggagaauuacagggauugguccagacaugcugcguaugcaagguauagcccucaucugugguacuuuggcagggcuuagacugcaucaaaauauuuauagauguacauuugaguguacaguuaggaucugauguggaacauuguaagaucauugcuagaaaaacuuugucauaauuuuucaauauuauucuaagugaauaaccguaaagauuuuacaucuuagcuuccuuccuuacaguaaaaaaacuaucugaucucuugaucaguauuauaguagccaccuaucacuuuaucuuaacaaauucucaauuccuuagguuuaugugcuuuuacuucuuuuauuugauuaaaauugcugucaugaccucucucugcagagggcugcaucauuuuggucauucucaagugaucucuuugagcaauuuaagaauugccauaagauucuaaccucugcuguaacuaugguuguguguucuugguuagaccacuaaaucuuauuagcaguuuuaaaaauuauuccuuuugguuuagaaguuaagacuaaaugcugaaguuuuuguaacuuuugguuuugauaucauuucaaacuuaagaaaacauuugaagaaaaggacaaagaauuuccacuuacccuuuacccagguuuaccaguuauugauaaguauauccauuugcuuuaccagaaggcuaacuuguuuuaguucucauuuucaccuuugagacauuuggaauaaauaucaauguuaacauaaauuggaauuuugacuuugauuuuaggaccaaugaacaagccaaguacuuacccuagucauauauaauccaacuguaugguuauuugguauucauuccacacuucauuuuacuugaucucccuuaagauugcaagauuguguuugcaguuuuucugaaaaucuggggcuauaaaagcaucaggaccucccccguaggggaggucguguguuugggguccuuacacaacagguuacccuugagcuucaggaaaagaacuggcucucaguuccccaguuccagcuuaaugggucuaauuagguccugaccaaaaagguggcaguucuuuucccucaugucucuucagcgcuccccgagacucuggagacucugucauaucccuagggcugagccucccaggaaccauucggcuguuguggcaucuguguaugccaugcccagugcugaggaccuaguaacaaacgacaaaugcacaggcacaguggcauuuuuguggaacucguauuccagcugugcgucucagaagaagcgcacagcucccuccuggcuuucuuaacauagugagccacuuccacuuaagggucuccuuacauuccuugaguuuaaucauucauggauucagaggaaagucuuuugauuuuugcuuuucuuuaaacaguucauuugaggugaccuaccccagugacuuugcaccaaccaccaagaaacuuuuuugcaugcuucccgcacccugugccaaucaagggaaggguuuaaaggccuggcguuuuuauuccucaaagaaagguuuugcacaguauuuuaagguucaagugcuucuacuuuguguucagaagcaacugucauauauacugugaaaugacaccuuuuauuuaucccuuuuuauuuaugcaguauguccccuuuuauuuuggcagaauuuuuucuaaauggugguuuaacauuuucaagcacauuucauuguccaauauucauaguaaagaaugagaguuaacaauaaccagucacauuaaaacaagauuccugcugccaguugugaaaccgguugucuuaggcguggcagcugaugauugagacugugaucaggaaaauuuccacuauuucaucaggccuaauagguagauugugucuccaaaugaacuguguuggguuuccaugcuuaaagcacaauagagguggugcaagaaucuccaugagggcuuaaauggcagugaugguucaggcgguagaguuuggagaagaagggauuugaaacaaaccaaaggaaagaaaaguaaguagccagaaaucacaaaauggcauuuuucuaaaaacaaaggaaaaggaauaaaagaacuaauaaguuugaaaccccuaccccucccaaauuuggcagggggggagguauuuuuuuucuaucuaucuaacuaacccaucuagaaaacaguugaccaaauuauagacuucuaaauguuaaucugcuuucucaguuucaguugaaaagagacuuuguuuugccuacugcagaacuucuagguucuuucuuauagucuugggguucuuauuauagaucgaaaaugugagucggcauaauuaagccauucggagucuucagaagcaguucacucuugaaaugacuccguccgccuacagccauuuaagauuucagaacaaaaacagaucuugauuuucuuuuucauguuaacucaagcuguugcugagugggagagucagaaaugacaccagcuccacugauuacucagcugcugaaggaugauuuuuuaaaaugcaccuuuacuguauauggacuuccuaauuuccaccuguagagcaucuuagggaggcuaacaugucacucuggauguucuuuuagaauaagaugcaaaucuauuuuucugaaggcauuagagauagcaaacauuuauugugaguuuacuauauacuaggcacugugcuaaguguuuugcauagaaaguuuaaaauucuggcuuuuuuguuggcccaaucauaaguuucauaucaguucaacauucaaauuauauuaagguacuuaagaagaaucccuggcuaaaugugaggggcagugccacagauggacugaaacuuuaugcuuauugcacauuuaugcuauuauuauuuguugaauuauagaaccaagggaguguggaagccacuggaaaaaauaugagacuuagauacauaauuugaguaaaaauggcucaaagucaugaggguaaaguuuuuuguauuuccauuuuauucgagcggcaucguuuuuaaaaaucauuaugaauuugacccuauauagauguuuccaaauaauucuuuuucaccuucauaaaauuccuuccuguggcugugagaugccuugccuaucaguuuucaagcuuaguugucuuucucauccuuuaccauuuuagcuuuaaaaaacaaaagugacaauuagaacuuccugccugcugggccucacugaaagaccgauauuggccugauaaggagauauuuauuuuguuuuaguggcuucagaaaucccucucccucagcaagcuuuccaucacggcccccccgucagcaucuucccugauagcguucuucucuguguuuauucuggggcuucaggcucgcccaggaggaacugauaaccgcuggcaggagauaacauucucuaaggggcucucaaauuggaaucgaaucccucaagccagucagccuagagaauacauuuaaaggguucaguucuggaguuucacagaguucauuucuagaccuaucagauagcaaguguggaguucuuucucaacuaaauucaagcagagacauuuuuuagacgaugaaggauauuugcacaaaggcuucagcaugaucccccaaaccugcugccucugaaggcaucuccacacauugacagccaaugccuucagugcguuccuagggcagguguccuggcuugagugacuguccuccaauaaucagagcucaaacuaaacaucguauguuuuacuuuugguuuccaggcaaggcugagcagggaauuuucaguuuucccugcccagauggguguuuuuuccugaaggcaucauuuauuguguagcgaggagacagggcuggcuguggcagggauagucuagaacuguccucauugcugcuguuccuaaauaguaucuuuaccaaguaauaacgugccgucuuugggaauaagugcuuuccucuuagccuguucuguuuucuugggugcgcuaaguaauugaacuggcucaggaaguaccuauugugguuuggcagaggugacugucacgccuugugacuccaggggccagcacugcugggauccuggcuagaccagacagagccuuggugaagugcuuaggcugucugcacaucgcgaggaaggugguauucacuucgcuaagcuccuuggcauaggcaguuugaacagggcuuuaucaaauucguauucaacaagaguagaagcgaaaauugaugacuguguauuacuugaaaugagucuuaaucuuucacauuuaguucucaggguaugcugauuuccuuuagguaaaccaugaacaucagaaagacuuuuauuaaccuaugacaggguccccaccccaguauuuuuccacuccauuaaaauggaaguuuuuuuuuuuuuuuucuuuuuugagacagaguuuugcucuuguugcccagucuggagugcaauggcacaaucucggcucaccacaaccuccaccucccagauucaagcgauucuucugccucagccucccaaguagcugggauuacaggugugcgccaccacgcccagcuaauuuuguauuuuuaguagagaugggguuucuccauguuggucaggcuggucucgaacuuccgaccucaggugauccgcccaccucggccucccaaagugcugggauuacaggcaagagccacugcauccagcuuaggcuaucuuacuccagccuaaacagcaauuuucuaucauaaggucuguacuaaugaaaacagaaucacccaaggcugcuguuuguucugucugugcugccauuguccgcauuuugcugaggaggaaacggaacugcacuuuugagugaguggcccagagccuucuagaaugagagugcguuggaagccagauauguggcgauugugucgccagcuguuacucagguuuucucaagaaggaggagcaacuuuggcaguuuugcuucaguucucucuagcccucuguguaaucgccccuuuuucuuuauuucagcacaaacacagagcagucuaaagcaaccgagcacugagaaaaaugaacucugcccaaagaaugucccaaagagagaguacagcgugaaagaaauccuaaaauuggacuccaaccccuccaaaggaaaggaccucuaccguucuaacauuucaccccucacaucagaaaaggaccucgaugacuuuagaagacgugggagccccgaaaugcccuucuacccucgggucguuuaccccauccgggccccucugccagaagacuuuuugaaagcuucccuggccuacgggaucgagagacccacguacaucacucgcucccccauuccauccuccaccacuccaagccccucugcaagaagcagccccgaccaaagccucaagagcuccagcccucacagcagcccugggaauacgguguccccugugggccccggcucucaagagcaccgggacuccuacgcuuacuugaacgcguccuacggcacggaagguuugggcuccuacccuggcuacgcaccccugccccaccucccgccagcuuucauccccucguacaacgcucacuaccccaaguuccucuugccccccuacggcaugaauuguaauggccugagcgcugugagcagcaugaauggcaucaacaacuuuggccucuucccgaggcugugcccugucuacagcaaucuccucggugggggcagccugccccaccccaugcucaaccccacuucucucccgagcucgcugcccucagauggagcccggagguugcuccagccggagcaucccagggaggugcuugucccggcgccccacagugccuucuccuuuaccggggccgccgccagcaugaaggacaaggccuguagccccacaagcgggucucccacggcgggaacagccgccacggcagaacauguggugcagcccaaagcuaccucagcagcgauggcagcccccagcagcgacgaagccaugaaucucauuaaaaacaaaagaaacaugaccggcuacaagacccuucccuacccgcugaagaagcagaacggcaagaucaaguacgaaugcaacguuugcgccaagacuuucggccagcucuccaaucugaagguaggccuugagagagagcaguccaaggggcugugagugcaugcuuguguuuguauuuagcuugcuuuccaugggguaucgauugcauuugcaguaguaugagcccccgguuggggauaguggguauggauuccgccuggcuuuugccacuucuagcucuuugacuuuggacaagugacuucccuucuccugauuuucuucugaauaauaaaaaaauuagggguuuggacuagaagauuaggugaaacucccugcuagccugugauuuuugugcuuuuaagaaaaacaccauucugaaaacaugaagauuucuucuuuuuaagacugucuugaugcuuuucuuaagauauuugcaucaacacuugagucuuggagcagaaauguuaggucucagagccagcuugagagcagagcuaacacauguggcuucuucccagguccaccugagagugcacaguggagaacggccuuucaaaugucagacuugcaacaagggcuuuacucagcucgcccaccugcagaaacacuaccugguacacacgggagaaaagccacaugaaugccaggugcgcaguauuuucuggguagaccuucugaccuuuguagaaaaugucugugagucacccucccauguccuauauagcccguaguuaaagccaacaccagauucugcguugucccauccuggacugauggcacuaugguccuucccaguacuuuguaucugcugaugacuugagauggcacagccagcuuccagugggugggaaaaugguaggggaaauaaacagccccucgugugcugugugcccacauccccccguuugcuuaauaccacacuggaggugccacaaggaggcuucucaccuccuagguugcugggcguuggccgguaagccugccccucccguuggcaacucuuaaucuucuggccuuccugucucccuucccugcugucucucuccccuacacuguaggucugccacaagagauuuagcagcaccagcaaucucaagacccaccugcgacuccauucuggagagaaaccauaccaaugcaaggugugcccugccaaguucacccaguuugugcaccugaaacugcacaagcgucugcacacccgggagcggccccacaagugcucccagugccacaagaacuacauccaucucuguagccucaagguucaccugaaagggaacugcgcugcggccccggcgccugggcugcccuuggaagaucugacccgaaucaaugaagaaaucgagaaguuugacaucagugacaaugcugaccggcucgaggacguggaggaugacaucagugugaucucuguaguggagaaggaaauucuggccguggucagaaaagagaaagaagaaacuggccugaaagugucuuugcaaagaaacauggggaauggacuccucuccucagggugcagccuuuaugagucaucagaucuaccccucaugaaguugccucccagcaacccacuaccucugguaccuguaaaggucaaacaagaaacaguugaaccaauggauccuuaagauuuucagaaaacacuuauuuuguuucuuaaguuaugacuuggugagucagggugccuguaggaaguggcuuguacauaaucccagcucugcaaagcucucucgacagcaaaugguuuccccucaccucuggaauuaaagaaggaacuccaaaguuacugaaaucucagggcaugaacaaggcaaaggccauauauauauauauauauauaucuguauacauauuauauauacuuauuuacaccugugucuauauauuugccccuguguauuuugaauauuuguguggacauguuugcauagccuucccauuacuaagacuauuaccuagucauaauuauuuuuucaaugauaauccuucauaauuuauuauacaauuuaucauucagaaagcaauaauuaaaaaaguuuacaaugacuggaaagauuccuuguaauuugaguauaaauguauuuuugucuuguggccauucuuuguagauaauuucugcacaucuguauaaguaccuaagauuuaguuaaacaaauauaugacuucagucaaccucucucucuaauaaugguuugaaaaugagguuuggguaauugccaauguuggacaguugauguguucauuccugggauccuaucauuugaacagcauuguacauaacuuggggguaugugugcaggauuacccaagaauaacuuaaguagaagaaacaagaaagggaaucuuguauauuuuuguugauaguucauguuuuucccccagccacaauuuuaccggaagggugacaggaaggcuuuaccaaccugucucucccuccaaaagagcagaauccucccaccgcccugcccuccccaccgaguccuguggccauucagagcggccacaugacuuuugcauccauuguauuaucagaaaaugugaagaagaaaaaaaugccauguuuuaaaaccacugcgaaaauuuccccaaagcauagguggcuuugugugugugcgauuugggggcuugagucugggugguguuuuguuguugguuuuuguugcuuuuuuuuuuuuuuuuuuuuuaaugucaaaauugcacaaacauggugcucuaccaggaaggauucgagguagauaggcucaggccacacuuuaaaaacaaacacacaaacaacaaaaaacggguauucuagucaucuugggguaaaagcggguaaugaacauuccuauccccaacacaucaauuguauuuuuucuguaaaacucagauuuuccucaguauuuguguuuuuacauuuuaugguuaauuuaauggaagaugaaagggcauugcaaaguuguucaacaacaguuaccucauugaguguguccaguagugcaggaaaugaugucuuaucuaaugauuugcuucucuagaggagaaaccgaguaaaugugcuccagcaagauagacuuuguguuauucuaucuuuuauucugcuaagcccaaagauuacauguugguguucaaaguguagcaaaaaaugauguauauuuauaaaucuauuuauaccacuauaucauauguauauauauuuauaaccacuuaaauugugagccaagccauguaaaagaucuacuuuuucuaagggcaaaaaaaaaaaaaaaaaaaaaagaacacuccuuucugagacuuugcuuaauacuuggugaccucacaaucacgucgguaugauugggcacccuugccuacuguaagagacccuaaaaccuuggugcagugguggggaccacaaaacaaccagggaggaagagauacaucauuuuuuaguauuaaggaccaucuaagacagcucuauuuuuuuuuugccacuuuaugauuauguggucacacccaagucacagaaauaaaaaacugacuuuaccgcugcaauuuuucuguuuuccuccuuacuaaauacugauacauuacuccaaucuauuuuauaauuauauuugacauuuuguucacaucaacuaauguucaccuguagaagagaacaaauuucgaauaauccagggaaacccaagagccuuacuggucuucuguaacuuccaagacugacagcuuuuuauguaucaguguuugauaaacacaguccuuaacugaagguaaaccaaagcaucacguugacauuagaccaaauacuuuugauucccaacuacucguuuguucuuuuucuccuuuugugcuuucccauagugagaauuuuuauaaagacuucuugcuucucucaccauccauccuucucuuuucugccucuuacaugugaauguugagcccacaaucaacagugguuuuauuuuuuccucuacucaaaguuaaaacugaccaaaguuacuggcuuuuuacuuugcuagaacaacaaacuaucuuauguuuacauacugguuuacaauguuauuuaugugcaaauugucaaaauguaaauuaaauauaaauguucaugcuuua

SEQ ID NO: 21472 - RNA, 90299 nt, Homo sapiens
cggauuuuauuagacuaggaaauauaauuuauuucauaaaaauuaauuuuguuacaauaggaaugcuaaagguuauuuauagguugcaguuuacagaauaaacagaggugggauugggggccaucccuggggcccugcaccccccucucccgggcauauaaccauguccacagaccuggcagggguccagcccuuugccccaccaagagcucccugcaccaaagcuccuggucaccuccccuaagggacccggcucagcugccuaggagcuggggaauagggaccagagugcccuggaggguccaggagaugagaaggauccccugcacccucaggagaaccccuaccccugagcucuggagccgggggcacugugagagaaggcagagggagaggcacguagaagauacauugacugacccugugggcucagggagggcagaagacaggcacaccaaacccuagacguccaaaccugggacgcagaggagcacacacacacgcucgcucagguggggacacgugcacaugcucuccgaggggcauccugaugugcccacagagaaaagcauaggcacgcacacgcgcacgcacacacgcaccccagagaggagagagagagaaauaccugcguaagggcccugcaacccccaaggguaccugagcugcuucccaccagguacaugcccucgggggcuaccucuugggucugaauuggaggagaaaccacccaucccaccccggaggcaggcagccuccacagacggauggagucggcaaagccuuucugggcauuucucauagagcugaugguuugaacccucccaggaggcuccagccaaugggucugugcucuaggacauggugcacauuucuggaagucagacuggaaauggcaccuggguggcuggcugcacuucauccgucaagcuccuguccugggggcagagcaagcagcuucugagggugggguggggaggacagaaaagaacagggaggaggggcacggcagaucacaagguccccuacagaagccuagaacagugugucugaacccaaagagccucagaccgcagacuucuagguaugaaaaggacacugaagcccagagaaggcagugauaugccugaagucgcacagcaguuuaauggcagauuugcaaguugauucuuggucuuuggacugccaggcuacaugugggcacauuagagccugcgaggggaauggcacccccugucacggcacguguggucuagccuggucagacugcccucaaagccacgugaccgaggcccacacguguucaugggcuaacagugaccagugaggccgagcccaugggaugggcacuuuggcagggaaggcucacugccuuugucugaggcagcauccacauggaggcaccagggucgaaagccuuagucucagccuccgggcccagccagagccuagccccugaugcaggccuggccccucagcagcccugguagaaggaaucuucucucaaaucuccaggcaaguccuccuuugcccacagccaggccgcaccccagcggggcuggugggugguaagaagccccacgagcuacugaguccauggcagggaagccaggcuggggacgcuggcuggaacugcggcccuaaaaccugcccuccucucaggauaucagacuuucaaaggccaggaugugcugagacgggucccaguggcugcucggagaccugcuggggcaugcccuagggucacugccuggagguguuggggaagcgggcaccugccuugccuggagugccaagagggagaggccuuugaagaggccucugugcuggcugcaagauccuugucccagccacugccaggcagcugcacagggcagggacucaucccgugccaugcagggccccucgaacagguugggugggggugguaugugcuguccccucaacccuggcaacccugcccacugggaaagguuauuucagaucucucagaccguagcggggugggugagaggaggguuauaggaggugccuguggagaucagagcugggaaaccagcuucucagccuccuucuccacuccugggcauaugaagcacagccaggccacccgccuccaaggcucccacguugcagagcugacugacaccgggaagcucaggcuucugcagcuagagaggacuucucagccaucacucugcuuuacagaaggagaaaccaagguuggggaagggcagauucuggauuccuggccaucaagagagcaccacgcugcucuagaggcugcugggcugaggaggggaugagggugucagggcuggccccacccuaggguaaagcuauccagccgccaggagagagaugcccguggaggacuccccuccccuacuucaucucucuguuugagucccacuucugggccacaucccuuucuaggagccaccagaccaaaaccagacuggaacauucucccuggcucacaacuggccugagcaguccuccucuuucaucccaacuuucuuaauccagauucccaggaguccagauguaucucccuggggcugugggagggagggcccacccacuccagcccucagcacuccuuggcuuuauggauucagcaucugcuuaagauuuuagaggaaaaucuaaccagcuaaaucuagacagugaaaacccugucugaccuacucccugcacaacuggggaaacugaggccuugucagaauuuaguccaagauggauucguuagcagcaaaguacucucuguucagucucucucuccucaaugcacacgcguacauguacacacacacacacacacacacacacacacacaggcacauucacuccuggccagaagugugagcgugcccauucucauccacacucaagaaaagaguuuucuauuuuuuuuguguuguuuuucauuuucuuuuuuuuucuuaaaaaggacuuauccaaauaaucuggauaauaaaucguuugcguuuccuaagaaacuggguuuuucuuuucccuugugguuuugguguuuuucuucuucuuugagccuuacuagcggucugaagcuuucuuucuuuccuuugccuuuuugcuuuuggacaggagaaagcaguuugucugaauuguacuugacucuucaaagaggaaaagggcguggaagcagaagggggcuuagggagaaaggagaaaucaauaacggaggaagaaaacgagaacggaacuaaaacccauggaacccagaaguugccgggcugaggguggggggguggagggagggccuccugccugcccgcccccaaccaacugccuccagaggcuucagccccaucuugguuccugcacagagaucucaggccaagagagagagagcggggguggagaaggaacucugggcccucuaacaacagaguacauggauuuucuaaggcuggucauggucuggggguuggggaagaggaggaggagaggcaacucuggcugugaacugggaggaagcagaggccaaacauccccaucaggaggcugccccaggccucccugcaccugccuccugccagucccugccagcccgcugucccaggaggcucagcaguccccgucgguggccacagccaccagcaucucacucuugcccaucuccuccaaggcacucgccaggcuguugagguccccaucguccugcugcagagcuucccagagguccaggaucacacccguggggcucgcuuugguggcaaaguaauucagguaccuggcagagggaaggagggcacugagguucccaagcacuuagccccuccccggagccuggaggugaaggggcacaaggggaagugggaaggcugugagcuuuggugucccacuguccugggucugaauugcagcuacugugcugcagucuguguggcucucggcaauucagaaccuauggcucagaaucucagucuccuugucucuaaaaugggaacaaugccaguuaccgcucagcaagauccaagaucauauaaaguaagggucuagcguugucucuagcauguaaccaucuuguucaucaucaucauuauuaucauugaaagacacuggccccaagagagaaugaccacgucuagcauguggucauuccucccacccguguucccuccugcucccaugaacuccccugauaggaggaauaaagccuuagccaucuuuguaaguccuauucauuucuaguaaaaugucuuaucuaaagcauauuuuauuuauuuauuuuuugagacucaaugcagguuuauuacacaucuuucaauaaguauaauauuuauuaucauuggccuuauauuuauccagcacuuauccagcauuugagguucuccaaaggaguuuugacaccaaaguguaucuuggucagucagcaagcaucucgcagcacauucucuguccuagauaccaggugcugacaaugauggcaccaagcugaugcccuggcuuugagucuccugcuguucggugagaugggcagguggagcauuauccccacacaaugggaaaagagcagggucugagagucugccuggcucaaggaccagugcucugagcaugaugcuccucaagggagcaguauucuugaacuuugcauauccaauccugaguugcugauuugccacaaaugguggcaaaagggcagcuggucugggagauggucguggcugucaggcugccugcccugccugccccugugagaccuugaggacgaaggcagauggggaugggcugugguuugggauacucaccgguccauagagagcuucugugcuaacauccgccagucauugccccgugaguugggggcaucuaggcuguugcauaucuucuggcggauggacagugggaucuugaaggcauaaggucccagcuggguggugacagugcugccaggggcagagcagagaguguccagggagccagcaggugucugcaagggugggggccaagagugagaggggcacagugcugggcaucugcccuccagccucccuccccuuggacugugagcucauugagccuugagucacucccaccuccucuggacagacucccacuguucaggcaggggcuucucccuugaagggucgguucccaagggcaaggccugcauggccacccuucaggccucagggggugcaccaugcuuaccuaaggccccaggcaaaugcagaugcagccucaugguuaggaagccccaaggaggcccagccacagucuaauccacaugcacccucuuguacagguggaaagugaagucuagaaaaggggaguggcuugcucauggccacaugccaaguuaguggcagaccuggguccagaccuguauccagugcucuuuacaaugccccaagaggaggaucuaguguugucacccuggguggccuggguuuuuaaaucucaauccggauuuuuaacgguugagaaccacaggccugguccuugcaucaaccuggguucgaauccagucuugccacugguguacugugugcaaauccuugcccuuccuaaaaccuacuuucucaccucccagguggggaugauaucugucaugcaucucccggugcuugugagaucauguaaguuuuuugguauaugccaagcaugugaauggcacucaaucaauaaaugacacuuguuagaaaaacaugaccagauacccgcucagacuugggaggugagagggaacuacaggguucugugugcugcagcccagccccaaacccuagagguauccucuggcccucaccuccaccagcguggugugcagcuggaauaucuggcggcccuucccucaccuaugccacagugcugugcagccggaauaucuggccgcccuucccucaccuccaccagaguggugugcagccggaauaucuggccgcccuucccucaccuccgccagcguggugugcagcuggaauaucugccccacccuucccucaccuccgccagcguggugugcagcuggaauaucugccccacccuucccucaccuccgccagcguggugugcagcuggaauaucugccccacccuucccucaccuccgccaguguggugugcagcuggaauauguggccccgacuucccucaccucugccagagugguaugcagcuggaauaucuggcccuccccuuccacuugccgcacgcagaucuugcaggugagcucuguggaggccaagcugugccucuccagggugaaagugcaguggagggccuucuggcugccacuccaaaugugauagaaggggaucuccugcaggaggagggggucaggaccaggcaggcaaggccagccugcccuguccucauagaaauggaggcucagggaggguugggagcuuuggggggcaguucaggccucuccacccagauagggaggggucaagugcccuaagcuagccagcugaguuggugucaggcccucaguuccagaagggagcugaggguggguaggugggggagggaaaggcacaggugugugugugucaggggcuagggggccuuguggucucaggcgcugcugggugggcagcgggcuguggcugucagagaugagaugggcagucugccaggagggcaugcccugaagggugaggagccucugugaggaugaagggcauagucgucugugcgugugagggugugacagggcagaagugugcauguggcugcccauugcccugaauuuggggacgugccuggggauggcugaaagccuagagacuggggugggaggagacagagacagugagagauccagggagggguaaggccacaggacagagcuaggaggcagggcccgggagggagcugggcuucccgggcagcccuuaaguggugccccuccccauccaucagcccagcccucaccugguauuuggccagcagcuugcuccuccaaugggcaugggggaggucauggagggagaggcgcagguugugguaacuguccuugaacauuagcgguuucggcuccuccaccaaguauccgcccagaguccgcuccagcuccagcaccuccugugggccaggggcauggggaaggggaacccaucacaccuggccaaugggccucuucuguggcacugugcggggcagggggcaggggcccaucugagugcauggcugggcauuugcaagagcucacagagggcuuauggugugagaagaugaauagaugacggauggauagacagacagugggaaagaugacuagaugaaugaaucuauagaugaccguauggcuagagggacuaauaaauggacagauggauggauaaacggauugauggcuagaaagacagacagaugaauauacagauggauauacaaggauggguauaugaauagaaagauggaagaaaagauaaaugaauggauagacgagcaaugacuggguaaacagaugggcugcugacugaauggguauauggucagaugaacagaaagacagauggauggaugaacagauggacagauggauggauggaggguugaauaaacaaagaaugccaucaggcccaaaccugguaacuucucucuugauuucuauaccacucucuggccaaagcuggccauuagccaacgccccaggaccaagagauccagcugcaggagcacuucccaggcaccuugcacccaucacagggccacuggcaucucaagccaggguccucccagcaggggacacuccuucucccaugggccuuucaccuauguugucugcagugugggcuuugggacaagucccaugagccugggagaugaaggagcuggacggggccagggagcaggaacagaaagugcauggagccaugggaaaggaccaugaggcgcugaggagggcagaugggaggagggaggggaaggggcucacacacggccaagugucuguaugcuuccaggguuacaucaggaugagccugagcuccugagaaugggaggagaacuugggggaaugcacaagggcucugaggcuggcaggggacaguggugcuaacacggggcuccauaccugccaucaucaggcucuagguacuaaaagacccuucccuccccuucccucccuccugucccaaccaccccucaucugcaugacccuuccuucacuuggggcaccgcucuccauccuucugcauaugcuaggagccuggcugucagccuuaacuucccucucccacugcccaucccaucagucaccgguucuguccauuugacugagcacacgcagcauccagccccgccucuccuggcugcugucacucccuguggcccaggguccaaccccagcuucccaacaggccucuccaccucucaucuacccacccaaguauagccacaggggcuuucuaaagagcaccugugaacaggugucuaccagguccauuccccuuccugccggauggauuccaaauuccuuggcaaggggcccugaggcuucugggaagcugagcccugcccaucucgcccgcccucacauucacacauucccuaugccuuuuaguuggucaugcugaaacgcuuaugaaacgcagucauuucugucggucuggaaugcccuucacuccuuucugcugaaacuccuacaugucagccuucucagagucccucccuaccagcccaagccccucccagucugaugcucccucaguccuggggcagaccccaucagagccuucagggaucccuggucugccucccaccucuaaccuggaucuuggugaggcaggcccugugcccaaggcuguuucagugugugagggucgcaagcgggaccuaauaaugcugguggcggggagggguuccugggaggacccaugagccuggggugggggauucuggcagggaucaugcagcuggccggccagggcugugugggcaccugcagcuggcccuaccuucagugcuacaggcguguccuccaggcaguagacccggaggcuguacuccagggaggugcagagggcgggggcgaagacggccagcuggagccgcuugacugcugagcgggaauaggacucgcccgugaacacguaggugcccagcugguccagcaggaugugacaggcccugggcuccagcuggcaguagcaggguguguucagggucuccucauccagggucaccaccuccuguaggggacagcaagggugggguaguggucacaguuauucaggcugggccagaggaaaagggcuuucuuuugccucccugggcagguugggagagcugggccagccuucaccguggcuccucaccucccaguggcccuggugggccugggucuugagcugaaagauccagucacgggcacugacuucggcacaguggggcauggugaggaugacggggcggcacagcaggaggccuguggguccacaggucaccgaggggcucaauacugucugggucccuucugaaagcgggcuggaggaggacacaggguaggagagaggcagugaagagcucggcaaaggugcaggcuccugcugggcucccaagucugcccagggcccgggagguggagggcagcucuuugccacucagggcucugcauucccagaggucaugggggcaaaggaggcaaagaaaauggcaugaaccuugagguuguuuccagauuuuugcuauuccacugcaacauuaucauagcucaaaauuccuggcuuauauuuuccaagguuguguaaucuuggaagguuuucaauaggucacgcuaaagugcccuccagggagcugguuccaaucuauacucccggccacgugccacagaaggccauguucccacccccuugccagcaagaggguauuaucauuugggaaaagguccuugcaaauuccuuaauaauaauaauuuaaaaaucccaguauaccuuguggugguuuucauuaguuuucucugcaaauuagacuaaacauuuucucauaaccuacuggccaguguguuugugugagacagugugugugaaucacguguucauauccuuugcccauuuucacagugagauguuuacuuuuucuuauugaucuacaaaaucucuuuacauaguaaggauauucagcccuuugucacacuuguagccagcuugucaaccgccuuugaguuuuacaauuuacgguguugguucugcaaguuuucaauauggacacaguaagauuaauacuuuccuuggaggacuguuuggucuuggcaucaggcuuagaaggggagccacgugugggcaggcagcaagggaugggaggaagaaaaaggagcagcggcuggggcucuacucacaggguacuuucugccuuguugaugaguagauacaucucguagaacuugcccuggggaauggcuccauugggcaccagcaagcugaccccuagggggagagggaagucagcagggaguccaggagcuuaggagaacaaguguuugggaaguuggccccagcuuggggcugggagagaaagauaucuccugagcuccagguaguccccagccaggggugggagacagggucuggggacuggaugcaagcagaggccaggccacugaccagugcuggcuugucuaggaagacaggggucucugacauugcuauggugucuggagguccaagugccagcucuacuccuagcuuaguauaugaugcugggaagcuguuaauugcuggcuuugcaaacuaaaacaggcgccccugucccucugcugcuaguuccaggacagugcuuuguaggucugcugaacuacguuggaauauucucucucacacaacagagacacugaagcuuagaagauggcuggcccaagguuccucugcccuagugagggcauaggcaggcuugaagccuagcuuuucuagucagaccucucuauuuuauacucacuuccugccuucaggccucccuuuccccaucugugagaugggauuagggcagcccuaucuucugcuggauggguguuggggcaguccacagaggaggugcuaaggccaggcugacgcacaagcagggcaggggcucaccugugccggggaugcugagccucccacccaggcagccaaaggugccgcugacgcugcucccugggucucggggcaggcccaagagcugcugggaaccgaggcuggcgcugcgcaggugcaggaagugggugucccgggcgaaaucgcuaggguaugugccaggcggcaagacccccagcaggucagccccaucugccaggccuggcccagagcccguggugcuggagcuguagaccuugaccuuaaggcuggguaagggguccagcagaggagaguuggucauggggauuuugucgguggaguccugcagggcauacacggguccgcgguagaugccggcgcuggcugucaggucaggaggcacagagggguguaggagcugcggguugccugcaggaguaggggcuauagucagacccagcugugccucagcucacuggcccagcucccacugcaaaaucccacccaaauguccagcugugaaaggcccaauugcugccagcugcaggaagcuuugggaaucccgcagccugggucacucccuuccuucucgguaguucucuaauccauacccauccacauaguuaucucuagagcaaacucuggaaaaacccugggagggagucaggagccuggcucuggucuggguaccaccagagcccucuggguauccugccucugccaaccaccccagacauccucggguucuuacugggccuugccgucuuaaaguugacgggguggaaaccaccagucagggcagcagaugagucagugaugucugugucgaagucacggcaguugcggcgguacaccaccacccccaccgccaugaggauugccacgaccacgaagauggccaccacgagccccgcauacagcgccgcauccccugaggccuccagcacugcggggacaggaggaccacauaaggggcagcagagaccaggcccuggggcaaucagggaggcccugggucccuggaaagggcagggcccagggccaaccggcccggugcugaguuccagucugagcccugccuacacaggcuggcaaccucgggcuagccuugaaccucucuaucgguaaaaugggcucgaagucccugccuuacugcccuccuaguuguggcaugagaaacaaaagaacaaacauguucaugccauguguuaauucauugcuugcugcugaugagacagggucuguggcucagagucacuggggcuacauaauuugcccugugagugcuggggcugaaaccucugagucuguagcaauuuccagaggaccaaagguccuggcucuguuaucuuuguauguagauaaggucuucuggcucuguuaucuuuguaaguagcuguucugaacucuucuuccauuccaugcucugagggugggaaguggagggacggggagcugaagaaguggaaugagaugcacaacaaugcgguggagaagaggugagcaugugggaagaaggaugggcccagggaggcaacccacggcuacacuuuccucccccaggcaaacauggccaggcgggaagccucaaggucaaaguggcagggucugaaguaggguugucugguggagcuuucuacagugguagaaaauccuauggcugcacugucccguaugcagccacuagucacauauggcuccugaacaacucaaauguagccaguaccgcugaggaacugaauuuaaaaauuuauuuaauuuuaauuaagcuaaguauaaguuugaacggcuuucacacugggcaguucagggagagcaaaaauggcggccaagauggcugcucuuccccuugcuuccuuugggagcuccaggaagcaccuguccacgcacuuccucccuggggggcccucagagaaguagcccugcuuccucugccuggaguccuccacacccugcacuuggcgucagccuaaggcuuucagcaaggcagggcauggcucccagccccggaugucugcccacuuccgacuucugucccccuguaucucuccucagcagcccucacucuugggcuccccagaggaccccucagggcugggcuccugguucagcagagaaaugguucccccagcuuggcucugccuccuaaugccuucacugacacuggggccacuugccuggugacuuacacuugaaucauccccagcccgacccccagugagcucggccgagggccucacugauuuuaugauuccagaacuaacuggaaauugugguuuaauuaccaugggccaaccugcucaaguggcuuugcugcucugauaugauugcagugguggcgcagccucuggggcuggagggugagcccuccagagcugacgcagggcagcgggcaacagagacaauuugggaggcuuggcccagcugcuggggcagagagguacagcaaggggcaugaggggggacuggaguggugaugucccggccuuggcccagagaggagggccaagggcauaugguuaagaacaacagcuuuggcuauaaaaauauuuggguucaaaucuuggcucuacuauuucuugccugugucucuggccaagucccuuccucucucugugacucaguuuccccucuuaugagaggaggcucaguagggugcccuaaggccuuucuuuucugucagccaaggguuugccugucugccggugauggagaugcagacacaugcagugucagguguagaugaucccgugggggguggguaggcaccuucagcucucccugcccugcacccugaucccgggaaaagccagccaaagagaaccagggaucccccagaggaaagaggacagccaugaaaugggacuuacgguggcuguuggggucgcuuagaguuuucuuaucugucaagggaaauaaagggaaagacaaugacauaggugacagggaaaggguggcagagaaggcaaugggaaggaugagaugagaugauggaugugguggggggacagaggcccugaggacugccgugcugcaggcugggcacugaggcauggggccggguuugggggacccuuacauggcuccagaguccccacccccagggccccaccuucccugugacucacuuugcaugcacagcccaucugugcaguucuuagagucgagcagcgucccgcugcagucacggccuccguucuggggugggggcgccaugcacucgcggcuacgccagugggcacacucagugcugcaggcugaccacuugcuccacuccguccacgccccaucgacuguaagagcauggcauacaggagcaugugcacgcagagacaugugcacacauaguuaugugugcagaacagagcaaugugccaacacacaugcaugcauacacaccauggaaggaaaugaggaacccagaacacaugugugccacacagagaaauccacaugauauccacauaaccccaugccaaugaacagccagaugcaccuggcagguggacaaagaggguacagauagauguauaaggucaucaacacgauauagcccagugcacgauuuacacacacagacacaaacccaggguaaagaaaaacagcguaggcacaaacauacaacccaagggagagaacacagcacaugugcggggguaggggagcagaggggcugcacagaggaugagaggaauaggaggacugucaguaugaauagggucuguggccacggugugucuuaacagucaggagcaacaggcugucccugaggccggggagcucugaaaccuuggccuggggcugacaugcugacacugagaacccucagcuuggagggcagaagagcccaggcuagagggucagggagaaggggcuaacccucaaagccucugccuccaucucaccagcagcccagggcagaauaaggggucagagaucagagcaucuagucagccugggcagccggcugugggcucgggacaagcaccuucugcuccccaugcuggggagagaauggcugucccggcucuggcacacaaaacagaaggugggacaggguucgggguggggcuggacauggacaaggcuccuuaccugggcagaugguggugcaggcggucuucuggaaugccuggcccucgcagaaggccccuccguugaguggagcgggguuggugcagguccgggugcgcuucugccagccucggccacagcgguuggagcagggugaccacucugcccagcuggaccagccgccauucacugcaaggcggcagcugucaacuggauggcuuggcucuggaacccucugcccucccccaaacccgucccucacccugacgaggccccucugcugaagccuggccuuccuagugagaccccuuuugccuacaguguagggacucagaacuggcagauagagcugggcuguaaccgucagcaccagaggggauccgggaagucacugucuaugccccaccucauuguaagacggcaaagaagguccagaaagggcugccacuuccccagggucacccugggagugaugggggccugggacugccugcagcuggaaccuagcacaagguucuuucuaaaacucugucaagucaccucagcuguggcuccacuccucccacccauagggcccaagggggcagcagagaauagcucacaagccugggcaaugguccuuaacucuaccaggacaacagccuucuggacauacugacugggcccugccucagcccccagacuuggagaacuccuucagaguuaggcaaggcaucuugagaacuggggaguguuccuggcugggaacccaggaaugcccaacuuggccaugaauucugcuguguugugaucuuggucaauucacuuccccucucugggcugcauccucccuaccaauccagggguccccccuacccccaggcucucuccucccucccuuggccgugucugccccucccacuccgaaaggcccgcaccguagacgaugacgguggcaguggugcuccggcguuuggccacgauguucuuggccacgcagguauaguuggcaguguccgacaggcgggccuggcggaugaugagguuguggucgauggugagcaggaaguugguguccuggguggggucgaugacauccucauucuugagccauuccaccugcaagagugggggugagggggcagugagggcccaggacagguuugaucauaaacagaagaagggcaguucuaccuggguccacgccauagucguggcagugaggcagggccuuggugggacuauagcacuggacacuguacagcucugggguuaagagcaccauuugccagcuggguggucuugggaggggacuuaccacucagggacucaauuucaucaacugcaagauggaauugaauagcaccuaccccauagggauccaucgcgaggauuacaugaguuagcauguguaaggugccgagaacaaugcucagaggaaguugaguuaaacuaacuaaauaggugcuagccaggaguaucugucuucaucauuaacuccucccagcucugcuagccaggaagaaaagccugggaggugauacgaagaagguccccgggucuggcagaccuggguccaaaccccagcucugccacucaccagcugccucacccuagguggccacugggccccucccagcccugcuuccuugcugugggauggaaugguaacauccacuuugcaggguuguugcagagaccagcgugcuaagugccuagcauauaugggccagggguauuugucugagcccacuacgcagaggaggguuugggcugggagaggcugaaugaugagugcaugguuuugggaucagagagggcugaucccaggcuggaagucaggguccugacugccccagccguccacucugcugggcaaagcugagaugcagcucuaaucccuggaccaccagugcagggaguaugucuggaacauagguaaggauggcgagagaggacagcaauccaaagacugugguuucaggaaggggugaucagcucgugggggagaacacacucacacacacgcaugaugggauccuuucgcauccagaaagcuggggccuuggguucuggguggggcaggagauagagacugagcuggaggucuaccuaaggagccccugaguucuggggauuucugccuuagccaccccaucccgugggguuaugccuguggcagacccagcugggaucuggcauugcugcguucgacagagguaacaguucucuucucugugcuaagccucgaucucaucugcgaaaggggcagggcucugggagacuagcaccauggcuggugguaaauaccaugccugccuggcuucugcaggcauggccacagggccgugcucaguggucccuacguccccgcucaccucggccacaggcacccccuccggcgggcggcacugcaggagaaccucaugguccaggggcaccuccuugcccagaggcuccugaucgaaguucuugcgcaggucugggagaagcgagagggucccaaggcagucaggugcgggcaggaucagaaccugaugugcuacacuguagccacuggguggcagugcagacccaggguacuguugaugggcccaccuggccuuugccugggaaauuuccucuucuccaaaggaggggucucacuaggcagacuugggggaacaggguucccucccugacucugggauccuaagcauauaguggcucaggaugggggaggaagcugccagcuucuuuuauacagaaguagaugaaaagaggccuagguucugggucuaggagcccucucugagcuggcauccaugugcugggaugucucugccgugggcauccucagccagggaugcuggaggaggccccacagaugugaaguucccucuccagcauccucagggauggggaagguuccugcagggacagggugggggucaggguggcguacaggcgaugcggacguaggcucggcgacucuugguggugcccgcggagcuccaggccacgcacuggcaccaguaauccuccagcccaaagagcuccuccaccugcugccgcgacaccucgaucugcaccucgcgcacccgcaggccugggaggagaagagagagccgucagggggcaggggcaaagcaaggaugugaggcacaggacacccccggccuuccaccucggauccugcuggcacucuugcccaagugccuuucccuccauuccucuugucuccugucuccacccuggcucaagcuucauggccacucaccugcacauugcaguggcuaacacaagcccucugccccaccaaugcaucuucuaccuggcagcuagugucaucuccaaaaugcacaaguggugugucauuccccccguuaugagacccuucaugcggggucucaguggccugcaggcggguagggucauccccaggaguggcucugagcugcacugugcauccaccauccccaucccacugcagccucaccgggugucuuccaggcccucauguucccuggcucugcagccacggggcccuugcacaucaguccccugccuggaaucuucugucuccucugggccugguggccucccagucccugccagauuucggaucagccucacuucccgaggaaagcccccuccacccugcgccuccccgacagcucucccagcacugcucggcacucccaccacugugcccggaaguucgucuaugcagcagucacuccccuacccagcuucgucuccucccagcacccaccauuagcuggacucagauuauuuauggacgcauucauguguuaaaugucugucuccugcaggagaacaagauggggcuuuguccugcuugcugcuguggcccagggcuuggcacagaaagggggcucagcacgugcagaggugggaugccugcucucccuggucacuacucaggcccugugggccuggagcugaggaagucccucucccagggagccccugaucucucaauggcuccccggucagggccugggaaacucccuacauaacaggaccuaccggccuacacaagggggucacucgguuuucuguuaaccaucccucaacgaagcccuccaugcucaggaaaggggggaaccugccaggaaaggggacauucaucugaaguuccuccccaaagguuacagagcccucuuccuccuccaggaagccucccugacugccuugugucucagaauuucuaaagcugcuccucccugccacgauguguccuaucucauccucucauugcaccauggauuguuaagguacgcacagccgguggcaugguggguaaggacaggguuggauggcuggacagguuuguguccuggccccacccucaaaccccagcugggugaccuuugugaaguuacucagucucucugagccucagaucccucaucauaguaaacucucaagguaaacucuagacaaguuauggugacuacuccgccacagcgcccagcccgggccagacacaaauauacucuggcaggucaucuggaucucaaccagcuucuucuguuaccuuugaagaaacugaggcucagagaggguagguggcaggcaccaaguccccuagcaagcuguugcagagcagaggucagcucccuggugucuuucccagguuagagcuugguccccucacccacaacuccucucuuuuuuuuuuugagacggagucucgcucuguugcccaggcuggagugcagcggcgcaaucucggcucacugcaaccuccgccuccuggguucacacaauucuccugcuucagccucccgaguagcugggacuacaggcgccugccaccacgccuggcuaauuuuuuuuuguauuuuuuuguagagacacaguuucacuguguuagccaggauggucucgaucuccugaccucgugaauugcccgccucggccucccaaagugcugggauuacaggcaugagccacugcgcccggccccacaacuccucucuggaccucuccugaugaagucauugcuguaacucuccuauuguugaggagggugggguccuugugcagggaguccagaugggggacagccccguccugauggccaaggauguaaaugggagguggcuagggguaugccauccagggaagaggcugcuucaggggugggugacagugccugccugccauggcugcccacaggcuggcuccacagucaaugaugcaugacccagggagcacagccccugccccuugcuuaccagacugugaaccuguaagagugugcccuuuuaagggggucauccaugcaagaagguuucagcagcaccaauagcuggauagaaggaaacaaccaccagggaggaggcgugacaccucauccaugaucaccagcaagcagagaugcagggagcauaggacagggaccuucggucucccaggcuugaggcccagcaucagacugcccucccaagcauggcaaugccuggcccaggacacccaggguugggcugccugccccaaucuggcauaagcugguggggggcuguucugccucuccuggcccccagcuguccucuucuguguuuucaggccucagaccaaggcuagagaguaggaggcugaaguggaaucaggccccaccacugccaaggaagcucugcccauuauuugcagcuaauggggacaacagugccccaauuucuagggcuggcagggccugugugccugguggcaggguuuugguaagggccaugcuguuacuauuaguaauaaucacaggguuauuauuacuaugcuaacggccugugaggggccccagcaggcacacuguucccucgccuugccuggaccccgauggcugaccucugauacaggccagaggggcucagugggcagagagguaaggaccguuugagagaaagaggccaaggaaagcccggaaagaggacagaggaagcagguguuuaucgacugccugcugggcccuggcaugcuguucugugcuauguguacgccaccuggcucuacccucaccaggaccuucagucaacuucccaguuuacgaagagaagaacuggggcucagagagguugagugacuuccccagggucacucagaaaaagagugggggcagcuggaaaauauguguuguuuuguuuccccuuaaaaauuccuuuuucuagcugggugugguggcucacgccuguaaucccagcacuuugggaggccaaggccgggggaucacgaggucaggagauugagaccauccuggcuaacacggugaaaucccaacuuuacuaaaaauacaaaaaauuagccuggcaugguggcacgcgccuguagucccagcuacuugggaggcugagguaggagaauugcuugaaucugggaggcggagguugcagugagccgagauugcgccacuguacucuagcccgggugacagagcgagacucugucuccaaaaaaaaaaaaaaauuccuuuuuccauuuuuauauuuugggugagcaugggacuccaaaucuauuguuuaaaauuauguuuaaauugugguaaaauacacauucuauaaaacuuagcauuuuaaccauuuguaagcauaugguucagugaccucgaguacauucuagaguaugguuuuaagccugacuguuucugaaaucugugagcuuuacaugacaaaacagaaacuaaagaagggggaaagaaggacagugagacagcaugucagggagacagagagugagacagagagagggggaugaagagaaaaagaaagaagcaaaacaggcacauagggaaaagagagagagagaaaugagcagggagaggcagggaaauaaacagagcugaagaaggagaaagcaaaggauccagaaagagacgggaaaaacaaaacaaaacccaggaaggcuacucgggagcccccugagucugggguaggcuggcucugucaggugacugaagggggggucccaucugccugucuuaagccccaggaagggcuuuucaccccgagggcuccugcacuaucaacagggaccuggugacaagugagcaagagccccucacuuagacucgagggcacccugggggcaggcccaguucugggagauguggggagccccagggcucugccuccuccucugggaguaccgagagcuccccacauauccgagaaggaagggaccccaggcuuccucgaguuucccaguuucagcugcucuccucuuucccuccagauuuggucuacaucccagcaccacuuggaugguuauuuacuuaauacuaucaacuuuuucuuuuuaaccuaaaacaauuuauuucaacacaggaaaugccauaucauuauugugaauggaaaccaguaucacuuuccacaaacagaagggaacuguaaaaauaacgauugcauugaauucugggucggugccguggggugccagggcugugaggcagagaccugcccucuuuguuaaacagggagauuagcagguguuugggagggcucaagaacccccaccugacgggaacuugcucccuaacagaagcagaaagauggaaaguggaaaagggagugagggcucacagggcacucggugcuguccaaugcaguggagauggucccaaagucaggcugggacauguggccagcacuuggggaaaugcuaauccaagggggcaccauggcugugugaagucucacauggagcuaggccugugccucugggccugggguguccuggggugcccaggcaaguggggcgggcucaccgguggccucauccaggccuuccugugugacguggucguucuggcugacccacucgccguugcacuugaaguagaucuguguggcggggaaggcgcggcagcggagcuccacaggcuuguucuucacaauguaggcguccuguggcuccugcaggaaguagggcagcggcucugcuggcgcugacgggaaggagucagggagcaccucgcugccagaaucagugccugcagagugaguggagaccuccaugaggcugugugcugggagggcccuguggcaccccucgcccaccccgggggcccaccgcagacgaagaggacaggggaggcagagguggggcagccagagcccuccuggggacguaaucugcaaccggggucaagucuggcacuccugcggccucaguuucccaucuugcccugcuuuuaagaggcugggcuuuauaaagagccaguucccacucugcaaugcugugugacuguacuucauuacagacagagaggccaaggaggucccgggaggggaggcgaucugucugggugaggacaccccuugggcccccccacaacgucugcuccacugucccugcccggcuucuauccaguuccucauggugacgccacgagaugcaaugggcuggaaacggggcuggagcucaaaccaggccagcucugcccuggagucacagcugcccuuugcagccccugccaggcuggcaagcgggacaggagccagggcugcggggcaggggugggaugagccggcugaagcaggccuggacuccauggugcucagcccccugcaggucuccucucccaggggaagcccuccuucccagaagcuuccucacagagcucaccucccauggucuguggcucucacccaucccuuggccucuucuucccaacccccaccccagccagauccagcccucagcacagcagaugaggagacuucagagcagaugggggcugugccuguggcagucuccucccacaaagggggccagauggaaauccuggcccaccgucucccuggaaagaacugcaccucaggaggugagacaaacaggaagggggguguggccaccgccagugcccagaagcgggggaaaccaggccauugaccugcugguuuacaauccaccuagaaaaaugaauuuuccagugccaaaugccaaaugaucagguggcugggcacaagccguugggggcuuguccucuucugcuaacugcccagaggacacagugaaugaagcugugggguggcgcauggccgcccagccccuccagcuagaggccccaccuacagcggagggaggggagcggguggugucccgggaggccuguguggccacugggaucgugcacuuguucucuggucuaggaggccacaucuggcucuagggaguccccccuacagucagaggggccaaggggacaccugguuuuccaagaacagaaugucugacuaugcuuucucuuuguggaccaggagaccaugcugagacuggggagcuuaggagaaaaugcaugaacuaucacuggcuuggggccuaggcccugggcaguguguguacgggcggugggggugggguagcuaacaagaugacacaugacuccagcuccauccagcauguucuguagggcccagggagagaaccuuaacaccuaccucguuaugucugaugagcacaagagguggacaaccuuaccccgucucugggcugcucugaggaugagacaaacaugcaugaacaccuaggcggugccuggcacacaguagguacguacauguugcugcaucgaacgaacaacuaaggcucacccagcaucaggugcuauguuugcaggaauuuaaguuguuaacuuaucgaauucuggcaccaacccuguaagguauguucuauuagaccccauuuuagagauggguaaaugggaggcucagggagguuaagcaacuuguccaaggucauacagcuaacaagaggcagaucaaaaguuugaaccugagaaaagacuucagcguuugggcuguugccccagacuccacaccaccuaucauugaucuacguagcucuguaaugguguaggugucuccacacccaggaauccuaauagcacccugacagggccagaacuccacaguccacagggcucucucaucaagggaccugcaaggcuggaaauguccucauuucaaagcagaggaaacugaagaccauucagaugguucccaugacuugcccgaggccacccggugaguggguagcuaaugugggaagagcaaggcagauuccugaggccaggccagggcucccugacaccugcuucccacugccagguacagggauacauucacuauaggcaaacugguagcccccuagggcugcuuggggauuugaugaggagaugacacagugacuugaucacaacccagggagcugaacauuggcuuucaguggccugagagcugguugcugugcaugcccugagauggccacugaggccucccugccaggccagacagcucugagauagcaggauggagccaggagggcaucugggcagcagagaaccugccaggcuccaugcccaccacccaccaccagcaucuugucuccgucucagcccugaggggugugggacagagcucugccuucagacucaagaggccccugggucugaaccagccccuugcuggccucaggcagcucaucuuugaaauggcaggauugagccucccucugggggcaggucauggccacaggagaaggggcaugggggcccaugggugcaugucacgugccugcccccaucuucuaaccgcaccacccccagccccggggugacagccgccucugugcucugcagcacugcaggcuguauuaugacuuuguuuuauaacucuaaugcagaccauuuauuaagugggugcagacaugacugaggaaagcaaacauuagacauccauuagugcagcaggcccugcgucuggcagccccaccgcccuacucuuccuaccccgccccuccucucagcccuggugcaaagauucagcucuggccuuggcaggggcgcaggccaaguguccccucugugccucucuguugcagcaguaccggauggcucuugauguagcuguugcccucuugcugucccuauacccuagguguccuggaggcagagacugccaggacauaaggaagaaugagaggcccaccugagguuccugccuggagggaccaugaguggacucugcuggccagcacacagcaggugcacagugaaugcaacuucaguaagggaguaggccgggcgcaguggcucacgccuguaaucccagcauuuugggaggccgagguggguggacugccugagcucaggagcucgagaccagccaggccaucgcgguggaaccccaucucuacuaaaaauacaaaaauuagccgggcaugguggugugcaccucuaaucccagcuacucgggaggcugaggugggagaacugcuugaacccgagaggcggagguugcagugaguggagaucgcaccacugcacuccagccugggcgacaaagugagacucuguuuccaaaacaacgagagcccucacuucuccuuggcccuggcuugggccccagugacugaggaaggcuugaaaggugggcuagaugagagcgaccuauggccaggcugcacggauaccagcugggugggagaauaauggggucucgggguuccuggaugcuuacccugccaggcgccgcucagagagugguucauaugaacucaaugagcuccauaauaacccuagacagagaugcacaaacguuuugauuuuuagugccucaguaauuuuuuuuaagcuaucccaaggccaaaaagaagucccuaacaggaauguauuagguaauuagauccaaacagcuuuguaaauauuuauauccuaaaaucuuaggauaaauugaaagaaaaaauauauuuuuaucccauuccuaauagccacaaagacuuacgaacagggaugugugcaccugucgggcacugcacaacuucucaaacuuuggaauccaagcggacaccacuauucuuacuguuugucauggguuacucaagugccacaaucccagcuuugcaaagauauggugccaaauaaaggaaaacagagugauaugaugcugaaacugagcuaccuggagcuacuuguuggugcagugucugacagcuaucuaguauuaccgugucucccacauuaaaaauaucccacagcuucccugugagugugcugaugaacccugggauaacuuggcagguaguuugggaaccacaagccuaugaguuggauaugauuauuauccccacagugcagaugaggaaacugagaccaaaagcguuuaagugacuggcauagagcuauaaagcuaguaaguggcaccgcuagggggcaaauucaggugaucugauacuagaaucugucuuccgagcucugcugaacuggaaaugggcauuuaggucuacuaugugcuacuccuugcaauucuucccauuuuacaaaugaaaacgaggggcaacaagggacaugaagggucaccuggucgauggcaggaagcaaggcuugagccaugucucucagcccugccucccuggccucucugcaggacuuccugcugcuccgucucuacagaggaaccacaucuaagacaggcuccccuagaaguucuugccucagccaggccggaucuggguuuccugcuggcaggaaaauucccacaugaaguguuuuuucccaagaguagaacucguuugggccuaaauugcaaaagugcagccugccuuuaaagcugcauccaagaaugguccagauaucccgccaagaagcuaugaaagaagacacaucccugcacagauguaaugacaagacagucaaaugaaggacacgaaagaucgcuggaggcagaggcccuggguuugcaucccagcuggggacuggcauugcuguguggccauucucucccaggcccuggaguuucugucuguaaaaugaggagguuggccaagucagucucucaagcccuccucugcuucuaacacuuugagguuuaaagaucccuuauggggaaucuguucaugugugaaaauguccuguugaguaaauuuuuuucuucagaaagcaaauuugcuuaaauuagggucacuuuccuugccauugcuauacggugguccuaaagcagagcguagguagaacccagggaaggaggaggaggaaacacuguugggcucgccuaaccaugcuccagcccacccaucccaggccuuagaucaaaaugaccaccagcaccucuggaugggaccuccgaggggugccauccaaacucucaccucuaauuugccuuuaccugccucuuuaugaggucucuuuaugaggucucuacaugagaccucuuuaugaagucucuauagaaguuacuuaaagggccaucucauccaacgucucccaucaacuccucagccaaccuugacucacauaccuguggggauggggaauucaucacugcuuuucucagccagguucuucuucggacagaccuaauaguuagaaaagccuuccuuacucacagcugcaauuugagauucagccauugcuagacuucuaauuucuauuuuauuuuauuuuuuuuuuuuuuugagacagagucucgcucuguggcccagcuggagugcaguggugcaaucucggcucacugcaaccuccgccucccggguucaagcaacucucugccucagcccccugaguagcugggauuacaggcacccgccaccacaacuggcuaauuuuuguauuuuuaguagagacaggguuucacuaucuuggccaggcuggucuugaacuccugaucucaugauccaacugccuuggccucccaaagugcugggauuacaggcaugagccaccgcacccagccuagaauucuaacuucuaaacuaacuaaacagcacacuucuaacuaaacagugcacuucccagucuggagguugcagccuggucccccagucugucuuauccaaauauucucuagaagacacaguuuugcaccucucaccuccaugcuggcuuccuuauggacaaguuccucaugucacccacccauuuaaaaugcaggagggugaggugaccaggcuagggucuagagggcaccuuccugcuucuggcaagucuguuuugagucagacagcucaaagccuccuuugcaguuuugguggcugcuccuggagggcagggaacacacuauguucuuccuggugucccccaugggcaacagggcgcccgucuaggaguggaguggagcuugucggacagcaggcccugugcccgucuguaggcuucuucccaggggcugggccugugcagugccugcuguggagacacaagcuuguauaagaggugucagaaucugacccaccuggaugagcaggagugagggcccaggaggcgaaggaaugacuucaggacaaauguaaagacacuguaccucucagagggucuucucagaggaggggguggcuccaacauuccugagagggagauugucacuaucccuaggggaagccagaggagugcuguggcccuuaccaugacucugagccugggcccaggcugacccaagagccaacaguccugguuccaagccucacccagcacugugagaccuugggagguuguuugaccucucagagccucaguuuccccaucuauaaagaagugacuagcaguuccugcucugucaacuuugggguauugcugugaaaggucaacugagaaaacagaugcaaauaucuuucuuaacaagcacugugggccgggcgcggcggcucacgccuauaaucccagcacuuuggaaguccaaggcgggcggaucaccugaggucaggaguucgagacaagccuggauaacauggcgaaagccugucucuacuaaaaauacaaaaauuagcugggugugguggcggaugccuguaaucccagcuacucggggggcugaggcacaagaauugcuuaaaccugggagguggaaguugcagugagugagaucucacuauugcauuccagccugggcaauggagcaagacuccaucucaaaacaaacaaacaaacaaacaaacaaacaggcagugcaugugccugggaguggcagcaggcaggagcuguucucuagcugaacugugugugggaggucagaagccccacagacuguuuccuuggccuggcaccaucugagcccacguagaccagacacagaaagucaacguucagagagccuggagcccuuggagccccgcguucuaccggaucagagaggggaagugacuaaugcaacaccacacagcaaauuaacagccaagcuggaccagagcccaguugcugauucaggacugaggagggacagggggcccagaaagacagcacagccacggcaggguugugggugaaggcuugggcucugugauucccaugccugggauggaaauuccugcuauccaucucagccggguccacuuccggucagcccuguugcccagggcggagaccucagagggaggcugcuguggucugguagggaaggccuugaaacccccaccgcuggcuuuuguccacaggccugggacccccaggcuuccaccaggggugggcaucuguagccaugcagggcugugugucuccagggcugacuggcucaggacagggaggggaggagucaggcgggaggugaggacagagaaacgccccacgcugggcacauuuaucaucagcaaucacagucuuucucuagccccuggacaccggcuaauucuccccagacuugaccucccacugcauggaaaaucucucccauucacugcguggcugaugugcucaguggggaguggggagaguugggggagaggagccaauuuauuauuauguuuuaaaaacacacaaccucacauggaaggaccccucccuggacacaaagcucuuccuccaucuggcccuggcuccuugcggcugugggguucaggcaggggcccccucggaggcggucacaauggccguuaccgaugacaaaugggggcuggcgggcucgggggacgccaagucauuccuaacaaagguggcuccucacgcagcccucuucccacacccucugcacccaucugugcccugacaucacuuccucugcugucacaggaagcggcuucgccaagguggccagcuggggcaggggccugcauccugaaggggguguccaucugcuccugugaaacgucucccucgaaggacugugaggcaggugaagaaguggaugggaggcuggggucgaggccccagggcaggugcagugcugggaugagcccgggccuggcuaugggggccacgcugcuuacagagcuggaaagggcacuagagucacugggucacuggccacccugacuuccacccccaaggcccucccuccagacccuuccucuggcuuuggguuccuuuggcucagucuuggggcuaauuuuugguuccuuuuccaaguuucagguccgauggggucacugugauggaggccugggcccugaggaggggauauucuguuuccccuucuucucccagacaaggagcucaaagcccuuucauccaugcuccugcagauaauaagcauauucccaccaccuggcacugaaaauccuguguguuccaacgagacagcgcacauuauugucaacacaaugacccugcgaagcuguuccauuuuacagaugcgaaaacgaggcagaagagugaaagggcguguucgaggucacagccaccaaaacccagcagggacagcuauuguucuguccucucaggagcucccuagcuugcuggaggggacggggucucagcuuccugacuccagcacuuggcuucccuugcucuguggaccugccccucccaaaccgagauccaggaguaaggccuggggccagccuggccccccacucagugacagguggcaagcccccucagacacacacaugcccagccagguuacauccacagcuaucucuggggacacccugagagccccacccaggcugggaccacagugccuuucucagggugggccuuuguuaaugcugcugucccccuaaggcaauggcaggcuccccaccugugacucagaccugcuauuuuauaggucaccucucccugacccaggguuggcauggggugaguuugagcugcaaucuuagacuccgccaagcacccaguuguucaggucccaucugggaggaugccugguggcucccuuuccuucaccccacuuccaguccgugcugcuggagggaccuggugcugcuagaugaaccuggaagaugugccucacacugcacgaccacccccaccacccgcugcagucuccaagcccaggucuucccgccuggacccuuccucucucugggcucccuaccuuuccuuuugccccuaaaauccacuuuccucuuaacaccagagugaucucauaagagagaaacccugcccucuagugguguacagccuccugcggcuucucugugacccuggagaaaguccuaagcuacccagaacccucuaacuucauggacucaccagucuucccucccucccucccugccucccacccucccucccucccucccucccucccucccuuccgcagagucucauucugucacccaggcuggagugcagcggcaugaucucagcucacugcaaccuccgccuccuggguucuccugcaucagccucccaaguaucugagauuacaggcacauaccaccacgcccagcuaauuuuugugucuuuaguagacacgggguuucaccauguugcccaggcuggucucgaacuccugaccucaggugauccaccugccuuggcuucccaaagugcugggauuacaggcgugagccacugcacccggccaacucaccuaucuuucacugugcuccaagccccaccaggcguguuuuccugggacaugccuugcuuguucuagccucagcgccucugcuggucucuuguuuuggagcgccucccccaaccccucccacacacacauauucucuuggcugacucuuugucauugagaucccaacucaaaugccaccucuccagugaggccuucccugaccacccagugaaaaugcaccauucucuuuccucccugugcuaucuccccaaugccuuuuuuuuucucuuggcaggcucaccucccucuggaaugaccugcuuuguguauguguuuguaagcuugcugucuguuucuggacagaaaggaacuugccuuucuggaaggcaaguuccuugagggccugggaaucuuguuugcgguguagaugggcccacuggggacacaggacaagcacugggguggcagguggagggggagggagcagucagaggggguuugggcagcaggagcggguaggagggcugaccugggcuacaggagcccaucccuugggaaauuccaugcugcaggacuccacuaacugauggaacuucacagaccaucuaaucacugcccucaaggauggagaccagagaggguguggucuggcuccagaucacacagcaccugagcagcagagccagaaagagaaacugugcaccagacucccaggaaaggagaaguugugggggggggacuucauuuuucuaaacuuuuuuuuuaauugaaaacagauguuuggguuuauucugauuacaaagguaguagccucacuguaaacaaucuagaaaaaaaaaagaugaaaauaaaagccgccccauucccaccccagcugaguuacacuggauguugauccucucugacuuuuuuagaugcaugaauauuuaguuaccuaaaucuggucucaccauguaaguugcauaucccaugcuuucccuuaaaggcuauugacugaggacuuuugaaucauaagcagaacacgcugggcaucucucucugucuccccccaccagcccccgcacggucacacgugucagacgggugagggccagcugggcugccugcuccugccacgcguuucagguugcuggaggagcugaaggacgcagagcuggcacggggagugaggcuggcaaugcugucaaguuggcuguguguuuggguucugggcaggaagaugcccaguguccugucacuuucucccagaaaaguccaaaaugccuugguacagucuugggucuaggggcugcccggacgaggccagacaggacagugcuuacauccccaugccgcccugaaagcccaggguuaaggcuguucuuagagcaccaagggcacacaaauuucccccgucucccucagcgccacgcucuagaaccgaacaacccuuccucgcaaaggggaggcaacugccaaacacauuuccaaguggaaaaacugcugcaguccuugccuguugccugcugucagcaccaccaccaggaggcagcucagauccugggcuauggggccuucaaaacugcauccaagcccuucaccuccagucggggacccuucaccuccagcuggggacccuucaucuccagcuggggacccugaggccagacaggggcaaugacuugugcaagggcaaacaaacagucuguggcugcagcgucacuccuaucuuggcaucacacuggcauaaaagaagucacagaaaggacagagaaaaaggaguggccagacucuggccuuugccaaucugugaaaugggcaugagaaggagagggcaaaugggcgagauaaacagagguagagauggugccacgaggagagggagaaagagccccugagagcgccuggcaguaaggggugaauagaagggguccuuggaacuggguagggguuuccccuuggauuuuccugaauguggaagccacuuggauuccugcucaguccccaggggugagggaggaaggcagccaucucuggccuccauucccaaggcaggacuggggcucagguuccaugggccccggggaggccaggccuuguagacucagagucccaggaacauccuggggaccucagaggaguaguaacuugccucagaucacacagcaguuaggaggccaagccaggacuggaaugugggcauccuggcaugcaggccaugguuccuguguuugccucucuggucccagugcugggaaagaccccggcccuggguuugggugagcagcugaguugucagcuggugagauauggggagacagguggcacuggccaaagggaaggccuguguggcugcacagaugcacuucaagggaggcagauggugagcaagcacucacucccauucauucauucauucauucacucauucaucaaacacuuccugggggccuccucuugaccaugccuguggugaggcucagagagcaauaaccaagcuucaguuccacaagugggaagcucacagcaaauuuucaagguuaagaauccagacaucgagacuucuuagaccagugcccagucugccuccagccuacccccauagccauguaauggucccuuugccugcccacccaccaucagugcagaaaucacuccauagcucuuucaguagcugucuccuccucggccaaggaaucagcucacuuucucuaggaagcaggcuuuaacuacuuccaacuugaugacuauagggauuuuucaaucuccaggcucuuauaaucccaugcgcuucuugaggugaaaugcguuggugcugucagugacucacaagacaaccccugggcagccacuucccucugggccucaauuuuccuuucugagaaaugggaccacuuuuacuugcuuugacugacagggcuguuggaaacaccaaagucagaaguacaaaaauauuuugccagcugggcagcccuaugcacuagcuaauuucuauuacaggaguccccguaucugugggggauacguuccaagaccccccguggaugccugaaaacuugaauaguaccaagcucuagacagaugauuuuuuuuucgaucugauaauggagacagccacugagugacuaagugacggaugguguauacaguguggacacccuggacaaagggaugguucacauccugggcaggauggagugagacagugggagauuccaucaugcuacucagaaucacacacaauuuaaaaugugugaacugcugauuucuggaauguucuguuuaauauuuuggugucacaguuggccauggguaacugaaacuguggacagggagaccucgaguaaggggggaauauuguacuccauucucaggaaaaaacagugaguggaccuuccaggcugccagggucccggcgagccccacaccucaccuccaccccugccccagccucccagcugcugccuuggcccacucugugaugacacagagcugcaaaaggcugaugcaagcuagaaggagggaaugaaacagacucguguggggcggauggagugccgucuccagccccgagggacgcccgucccugcucccgccugcuuguuugcaccugcugauguaaucgcugggccgccuuggcucagggcucggcccgcuccccauguccucugagugagcagcagaggaagggugcaagggccagagggcaggcauccagcugaggacaccgugagagggcuccuccaggaggggcaccaggaagcggggagggugaaggggagcaaaaagcccaaaaccugcaggagguuagccaaggagaaggcgcucuggagugcgugggaccugcuucaaucccauccugcccccauuugcugggggaaccacccccugccucugagccugguuccccucacagcugcaggaucucaugaaaugagccugguacaugucaggcacuaaguuugucaguucccuucuagggauuucuugaggagggauaaggaaguaugagguaggggugaaaaaagaaaggauagaagcacggccuagugacaggaaauaccagaacacuuuugggccaccaguucagugggugacucugggcccuagucuuagcuccugggaccucgguuuguuucucuguagaauaggugcaccuucaccguucccaccucacagagauagcuagaggccagaggugugaaagaaaguguggcaucacacuaaggcauguggccagcaugggggaccuggggacagccagcagugggggugggguggugccucaccaagagccugggguucccagaggcugggcaggcccuuaccaagcaguggaagcacagggaagguggagcccguccacugugcucgcugcccggcuggcccagagccucuccuuagggaggaagaggagcgcacggcuccccugaggccuccaaucaccauugaaaacacacggguggaggggaagagagcaaagacauguuccuggaagcugccaggccacagcaugcagcugaagcccccaugagcccagggucuggggaucgccacaucaccagaccgucauucucagagcugguuucccugagaaagcggcggagaaaaguucuuaguucacgcgucucuuugguuggcaucauaagcucagggaagacagggagccccugcuagacagggcaggccagguggggaggaaauguccaucccagacaccccugaugcccucagccugcaaggguuaccucuguuacccgggcccccagucccgccagguugcccuagaggggaagcuucaccccagcugggauuaaacggcuucccuggccacaaagaaccaccuuucccuuuaguaccucuucagugcuagcagguaauucagguaaugaguuaacagcuaccauuuacagugcuaacuagcucucagguucugcgccaaguacuuggaauaauuaucuaacugaacccuccccgcaacucuuucugguagguauucuuaucauuagccccaguuugcaggcacagggagauuaaguuacuugucuaaugucacagagcaggguugucagcauuugaaucugggucucuuugacuuuaagcccauacucuuuuuuuuuuuuuuuuuuuuauagagacaggggucucacuauguugcccaggcuggucccaaacuccugggcuccagcaauccuccuauuucggcuucccaaagugcugggauuacagguacgagccauggcgcccggccaaguccauccucuuuaaccuuggugccagugguacucaaaccauggccugcaccaggaccaccuggagugcucgcuaaaacccaggcuccugcccccaaguucugauucagucgguguggggugggccuugagaauguacauuucuaagaaaugucuaggugcugccgccaguccacacacggcucuaugcucucuugccucccgacagaaauaucaaacgcuuagugcacauaauggugcuuaacauaugucagcuuccuuuuccuuaacacuucuaugauucagcuggagacuuuucaaaaggagcugaaggaauuacacagcagcauggugccaggcuuucgcuaucugagccggaaucaggaccugcuguguggcaauaacaauaaaugauggccaucaccuguguuccugcaaauucgccucucugggccuccauuuccuucucugcagaaugggguaauaguauuucuagcauggauuagacauguuaauacacgcaaugagcuuagaggagugcugggcauguuaaaaagacuuaaugaacaaaagcggcauucuuguuuuuauuauuaccauugcuaauaccuauaucuucuacauuauuucauuuaauuguugcagcaaucuuaugagguugguaucaauagccaucucuauuguuuaucuaaaguuguacaaagucagacaguuacuaaguggcagaggaaagauucuaagccagguuugccaccccaauggcaggaacuauccaccauuagcaaauagggaugcccauucugacugcuuccucuggaaaggauaaagaguuauuuucuuauauuuccagcaauuucuucuaguucaacauuccccauucccugccacccauuuagcucagaguacaucaauaucacuggugaaggaagaaugucucaaauggggcaaccagaagcugugucagccaccaaugcuuggugacuuugggcagcuagacucccucccugucugucuguuuguccccugguaccuuacugggcaccccuguggcucaaggacuggcuugguguuggcuagcccagccccugggagaggggauggucauuugcuucuccugagaagcccugcccccaaguccucugggauuccaaguucaaaacaauagaggcuucagguugcccuugauguaaagguuuaguagguggcuaauuuuagcugagaaauacucggcauuuucccagccgcugucacugccgcacuccguguuggacaaauggccuugguuuuccucucugauuguucucggcugggggcugggggcuggcucuaucuagcucaggacaauucucuuugugucugcuuccggguggcucuuaauaacucagagaaggggaugggaugucuggagcucucagcucgagcucucuggcccccucccccgugcccuggcugccuuucagucaucaggggcaucccgaaaaguggcauuugaacagaacuugcuggacuccucaaaaccucaggcuuggggagggagggcuuguggccugaaggggccucccuuuggacagaugaggaaacugaggcccacagagggugugacuagccugaggccacacaguuccuggcagagcugggccugagcaccaagucuacagacuuaguccagugcucuuuguaugacaugcaggagaaaccccacugccuccaccccgguguggggacaccucagaacguaggaugcccaggcugcaagccuccauggagacaccuggaaugcugccuucccaccccuaccuggcuaaacccuguuccuucuccagguaucaccuuaaaguucacuuccccagagagcccugacugcaccacucccaccuaaaccagggcccuggcucuucgucuggcaucucuuuuccuuauuacccucauuaccuuuucaaguuauauacuuauuuguguauuuccuuuaaugucugugcccccaucgacuguguggucccagggcagaggcucagugacagccacacauuuaaccugcgugggcagccaacagucugacaggguucugggggaggguccuggggcccugcugugccaagugaggcccaggggguucaggggagugacuggggugacuagaggguaaucaaggcucaugaugguggccauuugccaucaauguggacuucuucagauauuuccagcagcaagauggcuuuaaugugcuuucuccuugaacaucauuucuggcuggauggcaccuguuuacccacugcuguaacccagugccagccuggcacacaguagaugcuuaauaaauccuucgugcaugaaugaaugagucucccgggcgggcuccucuggguccuguucuccccaaggaaguggccuggauucgaucuaugccccaucccucccaacgaugacucugaaagcaagacaaaugaggagcccaggacagcccccccacaauccuggcccugccccauccccccagccagcucagagucucucucugccuacacaggccuccacuguggucucccucccccaacccacuccagcccggacccaguaugcuauaauuagaguccuccuuccaggcuccgguaaugagggggugucgggugccagccguaauuacagccugguuagaacgaacaggagccaccuccaagccaaauuacaaagucugcagccagacucccuccugccccacucccuuuuuauggggcugguuaaaggaagggaccaggaguuuauggagaagccagcucaggcuggggcugcggucucgggagaguugagagcgaacagucugggccuguguugcuuugaaacuaucuucccaccuccccccuaccccaucccacccccguccaaauucccauccaaagccaaggucagaauaggcaaagaagucaacugaggccucucuuguaacccuucccgucagagcccccaucuaagggcuggguguucugugccaggccuggggucacaggcuuuauguaguuguauucaaugggcacagcaacccuguggacagguaccauuaccccuauuuuacuaaccaagguucagugcuuaaaauaacuugcccccagucacacagccaguaagaggcagaugcagggcuccagccaggccugcacagggcaagacucuagaguguagguacacuccaucuugcacuccucacugcacugggcacaaggaggggcacaaggaaggacucgguuaauacuaagaaugauguguuuugcagguugaggcaggugagagguccagcugaguccuucucucccuuugaaagaugaagaaauugaggcucagauuuccacugacgucucagggaaggauguccuuuggggaagucagggccagcauuugggaggucuuuugcaugccagccugggcuuugucagccucagaaucucaggauauuagagugugcaagggcuauagagucaaucuagucuaggggcaaaugcacggccaccuggccaauccugaggcuguggcaagcaucacuaauaaauuguggcacaucuggacaaggccuccuucucagcacaggacuauacucagccacaaccaaucaagugaugaagauauuccacccccuccccaucucauuaaucccuauucacccucacucaacccaagggaaaaacaggguccagagaguuggggugacuugccuaaagaacugaggggcccuuauuccauaaugacagccucuagguacugccagcuugccacccucggugcagcccugucaauuaugggcuucccaaauggaaagauugggacucaaggucccauccucuccccauucccacgcuggccccuaauagugaaccagccggcugcucugcugcccucaccagaagguggcuuucguaagggcugcgggggagcagucuugcucagcagcggaggugucccagcgcaacagcagcaaccucuccgcagggcucccagcugccugcccgccccuuccugggccucuuggcugggcuuuccucccagccugaaaaccuggcuccagccacccacugcccacucaucacaauuggccugcagugacucagucuccuugcuaccuccuccucccgucuucuggcccuggcgucccccagcucuuaggagccucuucaauagugccuuugauccuggcugccgaggcucuuuaaugaggacggccugcugccuucagcaaugggauggcagagaacagcuucugggagcacagugacgauaacagggugaacauagcccugaugccccccagccucccccagaugaccaagggcccugagcccagaggcccugcagggaagacaggaaagcugcugagauuuuuugggaggugccugccucacccagcagcacugggccuggaccggagggcauuuucauaagggcacuuuaauuaggaaacaaggcagcuagccagcgggacuaugggccacacccggugccauuagaggccuccgugcucccgggcccagcccgccucucucgccuccacccacuccaccuccucccuaggguuguggggaaaggcgguccccgagcaccccugcuugccuccccuauccugaggccccuggcaaggaauggaaugccggauuucucaggugugguuucucaagcugaguuuuggaucucaggcuggagacagcuggcaaaagcagagaagccacccccuugggcaguggccagagcgguggccacccccaugcugggccacaggaaggagagggcaucagugccucugcuccugaugcuucaugcccccccuaccucucuccaccaggagcuaccaugaugaagcuccugccuggcaguuggcuuguuuguccccuagaggcuccagcuuaaacccaaacugugcuguuccaggcacuguccccagcaggcaguguucccacagccacgaugggcagacuccgagcugccccuauccaguccccugggcuaucuaccccaaacucaggaggugggcagaauacacccuugagacccucagcaaguugggcagggacccacgcccacugaccuggcugagccuggcuauggcugagcuaccgaacuccacacucccucccuguggggccugggcaagucacgggucuauauuuccuccucuauaaaaugggacaauccacaggaaucucccagggcugucguuaugguaaacagagucauguaugugaauguaucaagcacagggccugacugcagcguucaguaaacucacgcugaccuuguguaggcugaaguccuccccacagucuaacuggcugugugacugggcuagccacuuugccucucugagccucgguuucuuagucuuugaaugggugaacagaacacauucucuuauagaugcagaagugcuucauaaacuaugaagggcugcccaaguccaagauuagucauuauuauuuuucucuuuuccuuuuuuuuuuuuuuuugagauggagucucgcuauaucacccaggcuauagggcaguggcauaucggcucacuacaaccucugccucccggguucaaaugauucuccugccucagccuccugaguagcuggaauuacaggcacacaccaccacaccuggcuaguuuuuguauuuucaguagagaaggguuuugccauguuggccaggcuggucuugaacuccugaccucaggcaauccuauugcauuggccucccaaagugcugggauuauaggugugagccacugcacccggcccagucauuacuuuucuaaugaauggccauacuucaccucccuccacccugcccaugaggaaaggcugggccauucuaucccaguucacccgaugggacccuggugacauugggcucacguggccucacacgggcugccugcccugaggcucagcucuucccuguugccugucagcugccuccuggacagggcaguaccuggcuggccacugggcggggaggacaagaggggauugggaugcucaguucuucagcaggagggucuuuacccaucuggcagcuccucugcuggguugggaaucaacuccucgggaaaaggcaauguuggggcaggguggggaccuuggugacucuggaggcaagugggugccagcuuggccaagcucacccuuggcuccuccuguccuuucucugaagagcuccagcagggcugcuugggaugucgcuagcugugugaccuuggacaagucccuuccccucucuggaccuuccuccucugaaaggacgcugcccaagaccacggcuuguccugcugcucucaggugcucuggaguggagguuccagaagaagcauagagagcuggccacacagcucaggaaggggccaggcuuccuggaggagcuacagggcugggcuuggaggaggaauggguggucuugggacccucaagaaacaaaaauggcugagaccaccaggucuucagcccagagucucccaauuugugagcccucucuuucuguccuggacuuggccagcaggugggcagagacaagccugaggcaauacagauuccuguauccuaggaggggaguggggggcccugcaucugcccugcccuggcccagacugagggcaccccauguggcacuagagagugagggaaccuuacucaguggaaagagcccaacauccgcaggauagagucucggcaucgauagcuguggggccuucaggcaggugauuuugucucccuggccuugguuucuccgccuguaaaaugggcuaacagucccuagccuagaggauaaguaaugccuuagcuccugugcaccuggcaucaggugaacucucaaaaacaguucccagugaaagcacguguuucuugggcauggcacuucaagccucuggccucuguuuccccaccucuaaagaggguaucagaacauugccuaccuccaggagcucacauauaucaaacggcuuuagcacaggcaggugccuaugcacagcacggauucuagguguuuguggaagccacugagccagaugaccugaaagaguucccugcacaccuggccacagccugcagugauuccagggaggggacagagguuccucuuugcccuacaacaggcgcgguuguuuccucacuccuugucaggccccagagggcugcugggccccaagccauggaaaacaucuuccaaacccacacagcaccuccaaggagcaccuggcauguacaucucuccacggugagaauucaguccaggcuggugcagcucaccaccgaggcgcuccucgaagaugcugugugggcuuggcaugcaggaggaagcucaccacccagucagggauaugccuucuugccaggggcugggaggggagcccauuucacagaugggauacacugaggcacuagcaaccuaugugacucgccugggugggccuggagggggaagggggcaagagaggugccagggguccugagacaucugaacugaggugggcgucucuucuucccuucggcuuucucucaaccugaacuucccuauucacuuaccucccacuuacccuuugagguaggcauaacggucccauuuaagaagacacagagagaggcucaggagagcugaguggugggccaugcuggcuggaggacaucaguggaaaggagcuaggugggauccgggggugcucaccccucagggcccagcagagccccaggaagcaccugcuggcucacagagggaacccaguggggcuguggguuuccaggucccccuuaacccucccuuaccaggagggucgaugccagcugcugcaccccuuccucugggccccgcuguuggggcugucccagccuccuccuuagcauccucuuuaaucccugaccaugacugucgucuuccugcaccuucccugcucugugcucacccuccugcccacccugcccaaggucuuccucuccacuccacaccggcugccguguucuugugacaucccaggguucuugucucagcucaguaacuaacaugcugugugacccuggacaagucccugacccuuucugggccccugcuuccccaucuaucauugaggggguuaggugagaagcuuggauguucuaagaauaucaaaacccacacaccaaaugcacgggcaggugugcugcuaggccucuggggccuugggcuccuggcccaccucuuggcucccuucugggggcccuggagaagccagucuggggacugggcugccaggaagugccacccucugcacgcccgaguccccaccugggcuccaucugcucucagagccuucagcgccucugccucuggccucugcccaaguccccucuguucccgaaccuauccuugcccugaggcaauggugguugccccugucacuggagccagcuccuggcagaauuaucucccuccauucgagcuuccauuaguccauaaguacacugggcccaggcagggcacuggggagacgcggcagccauaaaucaccauggcucuccugagcccagcugccaauggccugagagcucugcuggcucagcggagggaggcucccuuccuggaggagcuggggccagggcugggaguggcugugugaguggcagcagcauagggguguggcggguacucguccacucaccuguucaccucugggguaugacauugugacagcagugccacagcuccaugugcaaugucaccuggagaucuuccaaagaaggggcuaugguagggaccuugacaagucauugcaacucagagcuuacagauaaguuuccuuaucuguaaaaugggugcucauaccaaucucacaggguucacagaaggaucacugagaacaugcccccgcccaaccgaacaaauguccagcacggagccugccagggcguaugacucaauacauagucgauuuccuccccaccgugggggcucagagcaggcaguggcagcugcuugccuauguuuaaagccacagcuuuuacacuaugcucuugccuuuuguuguuggacagagacagcccuuuggcuucggaugcaagcugcuggaggccagacaaaucucagcagagcuugcagaaguccagagccacuguuuggaaagggugagaauucaguccgggcugguggagugcuuuuggcuuccucugugaaugaaguuugguugagaaaauuaaaugagaucacaggggugauauuaaaagagcaaauuacuuuaaagggcuuccgcucauuccagaucugacuggggauggauggcgcuaauuacgaacaaggaguggccucuuaguaaagccugucccuaaagcccggggguguuucuaaguuagggacccuggaagugagagccccaagcuccuuuugugucaauucacauucccuccccccauaaucagugacagccggugacauuuggaagucugggcugucuaggaaauacuucuuaccacccugugggcccaugaacaacugcugggacuucggagaaugacaacuuggugacgacacuugcaucaaauccacaaagcaaucuagcagcguguaugaaugagggcgugucuuuuuaccuagaauucuacuuuugggaaucucucccaaggaacccaaccaagcugugagcauggagauguucaacgcaguguuauuuaccagaguaagauacccaacaaagggagaacugcuugaguaaauuaaaguauauccccacuguggguucuucucggguauuaauggcuaauuaugaagucuauguaauuauacgagaaagauucauggaauaauguuaaguguagaggccugagcaugaaaugaaaccuguaaguaugugaugacaucauaaaacaaaccugggcaugagccugaaaggaaacacacgaauaugcaaguaguaguugugucugggugggauuaagggugauuauuuuucagaacuuaguucccaccauuuggggaaauauggcaacauuaucuggacuguagaaacaaacaaacaagccacuuccuggacccagaaauaguggagaaagggucagugccugguguuguuucuaagggcgccaggcugcuguucuggaagcaggaccaaugguggaggcucaccacgugcacagcuggaaccuaugggggccugggugguggucauccacccugcucagugcaccuguugccacaggaaggccucucuggggaugucccauuguucuccagccaggaggaaggugggaggcgggagaauggcugguuuuaaagccaggaaauaaaucucccuccccccaacccagccucuccauucaggccagcuuauugauggggacccagggggccuggagacaguaagccgacuucccaggacucgugagaaaaccuccccaagccaggcccacacugucguguggacucuaggggccuauccagaggcuuccucuggccauuuccuggcauugucagcccuaugccccccacgacagcaggacgccagguacccauggucccagagccauuugugcuccuccugaucaccacagaagguuggggcccaggcccugagucagauaguggguaaaacaauuaccacgagcccuuucagaacugauagucuugugacgggagaagacucccgccagccccaguagggcacaaaacccccucugcuaggcguagguaggaagccacagacauuugcauauaauuuacauuacuuugcauaaccaccugcuauaggggaaagagcauugaaccaagagucagacuucggaguccagucccaacaauacugcugacuugaugugacguugagcucauuuuuguccucucuacuaggcauccguuucccccugugcugaguugggaaacuggacugcugguuggcgagcguggaccuggcuaaagguugauggaguugacaugauauagugagcaggaaggacacgccuggaaccagaagggggucccugggacccuccaccuugcagcgauccccaucuuaacaaaugcucccugaacaccuccugggagacaugcgugaaccagcuuuccuaguguccugcggaccccugcuccccuacugaccagggguacaguguccaccucucacucccaggcuauggggaucucuggggaggaggacccucacacccccacccaacucuccugccccuccuccccuuggcagcccuggcgaugccaacagcuucugacacccuggaaaugcuuucagccaggaaccagggagcuuggcaggggagagggagacaaagccccagcuugcccugggacugaguggacuuagcacacagacauacaccccacccccacuguggucagaaccaaaacaaugcuggggagcagugacaucagaugcgccuggccuucccugccagccugcccaccugcuacagguauuuccagggcaauggacgaggagaagguggaaagaaagccucauucccaggaagcugcacugcugcugcuccuccuugggcauggugucgggggaagggaaggacacccaaacucggguacugucuacuccugggccugggccuugcaguaggguggccagcaucacuaagaccaagcuacggggaaaggaggugguggcccccuuuaauggcagggcuguggcacuucugauacucagugcuggggaggguugggccuuugggguucccccgagguuggagucugcagcaaggaagugugagaagcagagggugcagacccagaguccacaggugaggaggugaaguguggaaaugaggggaggauuuuagaggucugagcugcaaggaagcaaagagcuaagagggauggagggaaaugccugggguccugagaaaugaccaauguccuggacacagguccuggggcuugugcucugucucucuucucuccuccugucccuugagcucucuaagaaaacccccucuucucuguccuaacccucaagccucaccuccccauccaccgucuacucuccuggggagacccgaacagacugccaggcugagucagguccugggggucucuggggcuccugcugucacucccugcccgcucucuggaauggacuucacugcuaccaaugccuucccucuccuugcaggugccgucucacaaggcaggucucugugaaggggucuggccuugggcaaaucacuucaccucucugagucuguuuccuucacaauaagaugggagaaaugaugccuaccucauaggguuaggguugcucugaagaauaaaugaggcaaugcauucaacaagcucgcgcagugccuggcacauaauaaaagcugaaaaacugcuagugguugucauuauuagcaaucucuccaagcccagguuucuuuccucuuuuguacaaugcaauaccagucccgccuucacaggguaauugugagaugagaggaaugagagauuugaaagcgcucucacagaagcaggcagugagguggagggcguggcugcuauuaacugcagggcucugggacucauggcaggacacuugguaggcagcaggucaaacucuauccugcucaaugcagagacacaaaagggagccacccucacagccuggugcucuaucacgcuuccugcugcucaggcccaaaguuagcccauuugauagauggcaaaacaggcccagagagggcaagagaucagccuagagucacugugaaugaucaacuauauagggacuagaccuggaaaaauaaaauucaagauucagauaccacugaagagcauguuaacugucccuucacccauuuuuaaagcacaggcauuugggaaaauauuguaauauauauaugugacacuuauuuuuaacccagauuucaaaucacuuuuuuguuggaggaggugaaggggaacauuacacagcacuucauuuacuuacaaagaugucacaccugguacacuuaaagaggcaaaguccuagaaaagcaaggucaauuugagaggaaauaaaaucaaugacuugagguauacaucuccagccuguggguuuuuuuccugggggaaaacaacuuaaagaaaaauaaauauccucaauucuucccugugugugcuucagccuguggcacugagacucucacaggagaggaauuaucuugguucauucauuccccuauguggcaaggguuucagauauggaccgagaagaccccuucugggucuuugcaggaaccauguauacucugcaacuuuaaucacuuugucugcaggcaugagcgaaacgaucuccagagacagccagcauuuaaaagcaaauuuauuaaaguagacaccaccuuccugacacaauggcacaugauggauucuuauuucccauuguggagcaaauggaaaaucgcucuugcagauggggagauaaacugugcucuggggccugcaagucugaaguccaggguggcugccagaagaaaauccaauuugccuuuaaaugccauguacagcguuucuauuguaccuaccaccuacuauaucaaaaggugaaaguuuaaaaguuuaaaaaccgcaugaagacauacaaagacuacagcuguaggaaccagucucagaaagacacaucaucaguuugucuauccaggcuuugaagauucuaccuuccuuacccugaccucugacagggaaacuccuuuggaaggagugaggauucucuaaccauccaagcaagcagcgggguaaccucugacagauuacccacucugaguccuaguuuccauaucaauauauuuggaagacugaaauaaaacagggauagcaauaccuugguacaacuacuaccauggcugagcccaugacagacaucacuaauugacccaacugagccagaucugagucucugaaucagcacaucuccugaaagucaucacuguuuguucaggauugguagcaagaggagaccuacuugccaucccugaacucagugaucucuagaauuccuuccaccucuagcaugcuguaaguauuccccucuucagugucuacuauguaucuagaucuauauuagaaucuguaggagacagaaguauacucccauagauuauaaauuagaaaaguuauaaucucuaccccaaagugcugggagcuaggagggggauaacccuucaggaaaccacugcagcgcagcaacaauacuuuagaauuuagcccuggaucuguuuuggcaugugcccagccugagagccaccaccuccccaucccacaccacagcagacaucacuaauuaaugcugacuucuguaaaugaguccagauguggcccuagauuucucaacacuacacccugggaagucacccucaaacuuucaaaacagccaccugagauaaaccguuugccacugcugcccuagauuuugagguacaggcuauacaggucuggggagguuggagcuaucaggaaaagauuccucggaaagucaggaauuaagcugggacuugaggaagcauccacacacccaagccaggccagacagaugaagaagagaggccaaggcugggagaggggcaaugauggggacuuccagaaggggccuagcucaugcaacccgguaggaaguaucccauuuggacccagcagaacggccggaggcucggggucaucccuagggccggggggaaaggaguucugaugucucccccaccggcacugccccuucauucaaggcauccuggggagcagggccuggggcaccaccugguaagaggccuucagcaggcagguggcucaggcccagcgggguuugccaugggcucccagcaccucugcccugcucaagaguggugagaugccuggugucauggcagucuccugaagaggcacagagaugggcaccuguggccacacacuuuccacuuagcuccucugggcuguucuccugagccuaaacauaugcuuggggagaggaaccacguccccaccccaucccaaccagaaccacagccugagcacuggagugggaagagggaaaucugggcuccaaaagcccucauggcacugggauacguggccagugccccuaagagggaccuuuccagaagauucucuaaguaaccuaucuguuccaugcccuaaccuccugcagccuugguuuuuccuucuguauaauggacuaccccaccaaucagauaucugcacugcccacugcauuaccugccuucuaccugcucugugcuuuguggcugugggagagagaugagggugguaggaggagccagggaccaugccaggggacucuccuggaguuagaaaugacagcuggaaagccacauucucagagauggcucuggaucccaagggccucaccuguauagcauggucucggcacagaggugcaaggugcguuccacagaaccaggggcccaacccagcuuaacaagcuuggaauauacacucacacauaggguuaucacucucugucacuuuuguccccacccccuggggagcccucaauccuugcaagcuggugcuggggcagcugggccaaguuuugaggggcagccaggaauuggcaaucccaaauggggucccuuuggcagccuagcuaugucagggcaauagcuuaggccaugccagguuacuggugcccaggcugcaggcucuggaggggagcaugccugagaagcccaggaggacuuuguagcuggugccagcccacagcaugugagcacacuggagcuguggccguggucacguucucaugagugcguucaacccuggggugaggugccuguguagggcugugcaaaaagggacugaaagcuuggacacagaaugggacaucugaaugucaugcuggggcccaguagccucuuugccagagggagcuauguuugggaucaccuggccaacagaugcaaauacaagcauauguguacauacugcccacaggaaggaguggggugcaggugggaguggagauggcuggucugacaugguguguguuuuacaucuaugagugugugugugugugugugugugugugugugagagagagagagagagagacagagagagggaggagccuguacccacugcuucagugugccugccuguaagugggugcaugucaauguucucuaugaguucaggcauccucugcuguguaccccugagcauguacacaggucuguguaaaagugcaugccuaggagccacuuugaaaacaaagaccuugggcugcaaagaaaaaugaugagauucuuaagaacggugagugcagcagauauuagccggucuacuggggguuguuacacuaaccguguguccauucugccuaauacauaaauuacuaauguaaauuaaaggauaauugaagcccuuuaggcccaaauauuuaaauuauucaacaggcugucaggaauaggagaaaaaggaagagcugaguuuaacacucaaagagaaaagugccaacucaggggaagaaggggaaagugggccccccuucucccugccucccgcuagcucauucugcucuggaggugcggggggcuuuucuccagggcgcuguguguauugccucccuccuggccguauaggcucccagggcgucccugcuugggaaagugcugccaaggccagaggcaaggcugccuaccugagagguggaagcaaguggggggagcucaacuccucuucugcuccucagagacaggacccagggaggccccaagacugcuaucaaagagcugagagcugguaccagggaccugggugcuuggaugguucccagggugaaaccaguaucuccuucccugagauaccacaagccuggaaaggcagugcuagaagucagaggcuuuggcaaaggggagagagaagggggcaauugaguccacuccuacccauuauacagaguaggaaaguaaaggccacauaggaggaggugaaucagcagcuugccaaaggcagaugcggcauucccauccuuucuccuuuucccugaggccuugagaggguuuuccaggucucaaggacacaaguaagacccccaaaucacuagggagccuuacuucacuuggguccuacaucccagggcaaagcaaaaaaggaagcaugucuucccuuagcccccggucugauuucuauagaacucacugccugguuucucuuuguucuauggcacagaacucccaaccaugcaaaggucccagugugggugcuguggcucgcucacauccaugcuggggccuggggacuggggguguacagcugaggaaggcccagacucagacuccugaaacaguccaacucagcuggggccagggugccagguuaaagugcagagggucaggucugggagcucagaaggugaggccuccagcugacugcaacgucugggagccuguccaacagcgaggccucagugggcaagaaagaaacaagccaggccugcugaaucaccucuccucuccgcauguuagccagguaggggcagggguggaggggacugcugcaaggcuggguagauggaacagugccuucccuacagccauggcccucucuguacacccagugccaauggcaccugcuccagggagccuucccugauguucuggauguucacucugcagcccaagaugcugucaccucugagugaccucucuguucugacuccauaggcaccuucagggcagggauaggccuuuacuauccuauugucucaaggaaccucugugaauaagcugguggucuauuauugcucaguagugagcuuccuggacaaugcugcugggccugcacacggccccagugaacaaccugggucaugcacuuccucauuugguuugcacuggaaucugggcaaaggcuggaggcugaaagcuccuggcgcugacauucuccagguagcaggggcgugaucagacagguccuggacggcuucaggguggggcucuggucacacagggagugggcaagggagugugaaugacucagugccaagcccucccugcuucagggagcaccgugaacccggaguguuuaaagaaguggucgccccagagggagccugccggcuggucagccgcccucugcuccccucucuggccugggucuuagucuuauugacacuacgaauauagucucagcuuuaucuccuucaaaggaugggugugggaucaaaagaauguggcuggcucugaaaggguuuugacagauguggagcgcuggggugauuauauucauuguucauccuuccuccuuuccuuccaucuacuuauccagccacccauccaacugucaguuugucccucccucccucacuucccucccuucuuccuucccucaacccagucacucaccaauccuguacccacugauuguuggugaauagauauugaauauguaggacucugacccacagcuuggucccugugcagagagggagcucagagagcccacagggugcuucccugauucagccccaccucccucaggugggcuccccuaccauccuggccccccaccccacugugaucucaccugccccuggguguggagagccacaaagccauccuucuggaaggaaccucucggauccucuccccuugggguccuccgccuuucugggaccuccaugccuccucagcgucauaccucucccagcguacaguaugcagccccccaagccacgccagucuuguugacgaaugaacuccuaccaggucucccuuaccgagggcagccuucaccaacugcugggcuucugaacugggggcugguuucuccuuaggcuuccacaggcgggagucuuguuucccagcuaagccaccagcugccugaggacagccugagcuucaguucucucggggccgcccccaccuccaccuccagccaggugugccaggccuuccgcacacccucgcucagauacagagaggagggagccaugacgcccagaaaugaggagggugcuggcgguguaucaccaguaagucacagccccguguccuugggacugcccugagaccaacagagcugauacgauuugcucuauuuucacaggaggcaggaugacaagccgggucacaauggaacgggaggacaccagcuuguggcaccccaccugagcacccagagugccuacagaauagacagggagggccagacccaucuccagagggcagcuguggguggagcagggacucacaggagcccacagagcagaucuaggacuggcccaaaccuaguggccauguggcacggcgaggcuggcaugggaccuagucuguggccaugcuggcuaccagggaugagguggcauauucucuggaugaauccaccccuuugccuccccacaucagagacuagcugggcugccucuccccgccagcccacccagaaggacaguucagaccccaagcucugagggcucagggccucucagucuguaccaccaggcccuacugggauucugcuaaagaagaccugauagaaggguccccccugccagacucagccuccauuaccccaucaauaagacagagcuaggcucacgguaaacgcgaauguaggugcgaauaccuugggaucuugucaaaacgcagacugauuguggucugggacagugcugaggccucgaauuccuaacaagcuuccaggugaugcugguagcaaagcucuaaggggcucccagcucuaagcccuagcucccagagagaugguguuauggagagagcacacgucauguaggauaaaaagaaaucuuuucaaaagugguccccaggguugggggagaggaggucagagaagggagcccggggacaauagugaauagaauugggauuauuuccugaacucugauuccucgugggaacgagguuuugaaaagcuuuucuuaaaaugguuauuauuuaguggccuguccaaaauaaacacacacaugcacugcacggagccaggcaggaagugaggaacaucugggagacaucuggcugcuggagaacugagaaguggguuggggagggccagcgggagcuggaggcggucugcgugccauggucgcccacagucacacaagcacgccagcacgcccccgccgccaaccaguucggcgcacacaggcaugcaugcaugcacacagggugucccuaggaccugcaggaccuugcuggcagcggcugcagaucgcggguucucggaagcggacauccuagcucucaggauccgccuucccuccucccuccucuccucuuggagguugugauauuuaugacuugccucucuacguaugcaagcugaguguuuuccuuccaccugcuccccggcuagccucagaaagaagcaggggccugaguaggggcaaacuuagggcaagucuccagguuccuccagaucugugcccucuguaagaaggauaugacucuucugccuggcucacuggaacacuagaggccauucacccaacugauauuuacuguaaaccuucugcagugccaggcaacgucccaggggcuaggugucaucuuaggagauuauaaccaaaccuuaacacccaaguuuagggugucgucauaaugccugaguggcccugggguggggggccacccuuacccagcaggcauuggcccaggcuguagggaugaaccugccaccacccugugaaggccagggcucagagucucaugcugauuaugccugggggcacccugcaucauuucuguugugggcguguugugcagggaguuccuccaaggagacuaagagggcaggaaccuuguguugcacaauucucugucccuaaagaugccuggcccaguacuagauacagcagaauaggugauggcuaaauaaauggagagaccugggcuuguacaaagggcacagucucugcagacagacacacccaggugcagauccuggcacuaccacacaccagcugugugaccucgggcaaguugcuucaucucucugggccucgguguacucaauuauaaacuauggagaacaaugguuagcuccaaggguuaagcagccugauacauaagguccuucacgcagugccugguauuugguuagaacucaaccaauguuauuaucacgaggcacagaagagauuuuaaaaguaguauucacccagugaccuuaggugaucccuguagcugugguucugauuuuccuccauguuccuuccagcccacccuggacugucuagucucuccaaccuuggccauccaggugggguggccucugaggaggggguggcgaaggcuucccaagccccccggggaacagggaagggaacuaacccuggcugagaaccuugguguugggcacuugauggauggcaucuucccagaagccuucagagcugugccauccaacacaguggccacuagccauauguggcuguuuaaacuuuaauuaaaauuaaaaguucaguuccuucaucacccuggccauauuuccagugcucaauagccacguguggcuaguggcuaccagacugggcagugcaggcagaagacguccccaucccugcaagaaguuucacugcacagugcugcugcagggaaggugugacagcccccacugcacagauggggaaacugaucugaagcccaggcucuuucugcuuggcccuaaagcagcccccagacucuuuuucuuuuauuuuucuuuugagacugagucucccucugucgcccaggcuggagugccgugaugagaucugaguucacugcaaccuccgccuccuggguucaagcaauucuccugccucagccucccaaguagcugggauuauaggcgcgugccaccaugcccggcuaauuuuuguauuuuuaauagaaaauacaaaauacagccuguuggccaggcuggccuugaacuccugaccucaggugauccgcccgcuucagccucccaaagugcugggauuacaggccugagccaccgcgcccggcuccccagacucuugaaugggugggcugagguccucauuggguguuccauggccccaccugcuggaaggcugggacacacccagugcccugcugcuggcagggccaagcccaggacagagagagugacaccguggccccgucucccucacccaggcaucauaaagacaccuccaacacgugugugugagauucugggggccgccgaccaagagcccagacccaaucaucuacaggaacggauguggcaggagagggcacugggcacuccuggccugccauggcagaccgccaacccucugcagggacagccagggucucacacggacaauggcuauacaagggccugaacugcagggugaccacauuccagcuacaaaguggaucccccuggaaucuuggugaccacaggcuguguugaugucucuagaggguggacaggcccugcccagggagaggggggcagaccugacuguauuggugcagggcccagaugaagaggaagcugcccacucagcugcuggaaagaagcccacgccaggcucuccucucccucagcagucuuuccucucugcugaacuagcucgggggaccucaaaguaccucacaaugagcacuaccacuuucuggccaugucguuuugggcacugugggccucagcuuccucaucccuacaaaggagaucaucucacccagggggagguggggcgaggucacaugucauaguaacagacacagggucugggccacggccgacggacgccacgcaggaagggagucacagggagggccugagacagacugugagggaaugccacgcccccccauguccucuccccacugcacuccagggggcugggguuggccuaggaagaagggccucaggccuccacaaagccgaccagcaagcugggccucugugcagccucucugagcaccaggucgugugugggcaucucacuggcagccagggacugcuaggcaagucucaccuccuucuguggugacucuaggccagccccacauucccuccaggcuguaaucacauaggaggugauacacaagauaacuaacaggcugcuauuaucucuauuguuagaaguuuauuauuacuguuagccuggccuucacccacucuaauggcccaggugcaccaugaugauccugcguccuugggcggcacuuagaagcacugggccuccacuugggcaaugguaaugggaggcucuuuccaguuccgacagccugugauuuaaagauagagaucuccuggggagaugccaggccaaggagaagacgggccuucugucguggugccaguuacuacuguuauuguucaaguacagcucagccucccagggacagagcuagaugugcccgauaagcacauuuccccucucucugcagccucccccugcucagauaauacauguguucaccagggccucuggcucacuccuggagcagacuagagcccuggagacagcacuaacccaggacacgagcuaguucucugacuggagagggcuacgcggcaguggggauauggggcauuugaggaggucuucaugugucuuuacaagccaggugccuguaggauguuucugcggggcucuugcugaagcuacucaguuacagacucucugggggggccuucggcacuggcaacccaccaagcuucucaggccugcuuaggcaaccucuccucuagcuaaagugaaucacagcuaacugagucucaagacaggagcccugggaggucuggagcuaggacaugaaacccagcugguugcuugacuucucuaagccucaguuuucuccucuguaaaaugggggccuaguucuugccuaaggaggcuuugaagaugaauagggucaauacaaguagagugaucugaccaguuccuggcauacauguaggcuaccaugaugauggacucucagacacaucaaguccaaaaacaacaacaacaacaaaauuauagaaucuuggauucgcaggcugcuaauuacaagaagcucagcaggccauccugaacuugcccuucaggcagggauuccuauuaaagucuucuucuuggcccuuggggacugguaccaaggggccugccccaucuucuucuaagggccgucaaaggaaccuuuugguuucucagccacaggcauucucaagcuagacagauggacagccagaaauaucagcuacgccucugcuguuccugcccccauccuccccucaggucuuuuagaaaugagaccgaguaguggagcgacagugggggaggaggagcaggcggcgggcagcugcugggccgggaggaaaucauugcugguagccucugcucagccgugacccuaacaggaagcgaucgugagggccccuugggaggcuggagucugaagacagggcgagggaugggguuuggaccuuccaggccucaucacccguguccacccugcuggcccugugcccacggccugugccuaucagaggcaggccacgggcaucaccacuauggcuaguccacccugagagccugccuuccuuccugggguuacugggguccccccuacugggagaagggguaucacgcucaagagguuacaugagaagaggaauugaaguauccuugguggugaguggcuggccugggccagugggcagaagccagaggaugcagauuugggccggacaccaacagcugcccaagucauccaaaaaaaugcagcaggccgcauggcagaagagugagcaugcccauggggggagggggcacagguuggcacacgagaagcgcggcucauaaucuccgggacucccuccugcagcagggcuucugagguggagaauggagagaccgugagggugggugggguagguggggagggaaggaaggcucagcaggaacagcagcuaacaugccaccuucccucacccgccuggagccccagcccagccuuuccugccuccaggcaccccacacugggcaccuguuuauuucuccaugagcccaaggccaguccccucacagaaugggcagccucccgagggcaggcccagggguuuaguauauauacagggucugccaaauccagaugugugugugcucacaugcagaucacaggagggaacccugugaagaugaccggaggaaucugggcuucagggucacccaggggcccucuggcaccagccaccauaugcucugcuuauaaucucuggggcucccacccauccagcaggggugugugcccacugcccgcccccguggaugcccugcucuugcacugcugaacagaggacuggggguggagugggcucuccagacugggccacugcagcuaagcaccagaagcuaaccucagcgcugggcagggccuggcauggaccuuuugacuaacaugcacagccucccaugaggcuggaacuauuagugauggggaaacagggcccaagagguuaagugaucagccagugacaugcaugaggagccccuaacugcucagucaggacgggcgacccucaucccacccacccgaacucgauggccacccucaggcccauucccucccugugccuggggccuccugccaccucaggcacccccucuucauaacgagguucuccuggggguggggcgucaccucuguuaauguuccuuuauagaaaauguuuccccuucccaaggccgcugcuaaaaccugccccacuacccccaaugccaucccaacgcaaguaagcccuggacacuaagguaucuacuagcugagagguuuucuggcacauugagggagaugauaagucagucuucccugggucacuggcacugugggggcagagguuggcuuaggguggcugggagacacgccacucaaaucugaacccacccucucuuccaccaucccaggacagcucaagggcagggaaaugaacaggguguuaccaggccuccauuucuaagucugagcaggcagaagccuuaacucccucgucuaaagccucuagggauuagccaggcaugauggugcacaccuguaguccuagcuacuagggaggcuggggcgggagaucauuugagcccaggaggucgaggcugcagugagcuaugauugcgccauugcacucaagccuggauaacagaacaagacccugucuuuaaaauaguaauaauaauuaagcuucugaggauauguauaagagagugaaaaugcugcccagguguguaaucccagcacuuugggaggccugaggcagacagaucaccugaggucaggaguucaagaccagccuggccaagauggugaaaccccaucucuacuaaaaauacaaaaaguagccgggccugguggcucaugccuguaaucccaacuacuugggaagcugaacccaggagguggagguggcaaugagcugagaucacgacucugagcuccagccugggugacagagugagacuaaaaaaaaauaaaugcaaauguaagcauggagucgaggccucagacguccagcagggccuaucgcuaaucagaaaccacaagacauucugagugacaggauugagaacaggagugagugugagcaacaaaacuuggggucacuggaaacuuugggaagaaaagagccacucuggagaagugggcccugggcagggugggcguuguggggauuuugccugacuuucaggacccuuugcacccuccagaacaguuuaccccugaggucuucgagcaaccccuuccuguggcuccaaaugguagggagacugguguuuccaacaggaaacgggcuuuccacccagggcaggggggcucccagcaccucuaguuuuuaaugaucacacuccuauuuauuuagcuucugaacagcuccagauuucugccugagggaguuacaggcuguugggcuauuuguggcgaaguuaaugaggcgacucaguggaagcugccuugucucccguccccuucugugggaagacacaggaagccccuugauccccaauuaccugccugacaggagccucuccccaccuuccucaucuuccccagcuccagguaccacaccucuucccccaggcucaccuggcucaucaccaaugagggaaauggacuggcugagguuuuaccauuuccacuugccuuaaggugagcaucaaauauuucuugagacagaauaaaggacuuacaaaguccuaguaaagaccacuucugcucccaguaaaacuaccuccuucccgauccuauagaggccacaggcuggagauggaggcaggaggcuuccaauacggacuucaccgcaccuccuucacacuaggugcugcaggaacaccuugcauaauaauaguuaaugcacucaggauugccagcuuugugcugaggacuucccguguauuuacuuauugacgucucacugcucuuacccccacuuuacagaugagagaacugaggucuuaagaggugaccccaagggcacauggucaguaagaggcagagccgaguuucagacccaggcuaaccaacuccaaaaaugcccaagcacugagugagacggcucucucucuaaaaucucauuuaaaccucauggagacguuaugggguagauugcuauuaauuccacuuugugguugaagacgaggcucacaugggcuaaacuguccaggaacacgugguuuggaagcagggaggguaguauuugaacccaugcuguugccagagcuuuuccacauaaacacgagucuuggugaccaggcaaacaggggucauuagggaacgugcacuugguccccagagugggccucugcucacaggcucuguggccuuugcuauuccacacccagccugggauccuagcuacccuccgcccaggcaggccuguuugcccaccaccugugcuuccugccucuucuccaaaccucugaauacccuggagcccccaucuacaccuccaccuccuccaggaagccuuccacaucccagccguggagcucacuccucugagcuggagaaaaugugggcguucucuucaggggcaugcaucuucucucauuccuaaguggaauuuugugagcuccuuggggguagguucuggguccccuuggagcgaggcacagagaagggaaugauaaauauggggguucacugcucucaggaccagggucccucuggccucuugagggcuucacuggaccuccccauccauucucccagaggagaagcagagcagacuuccuuugcacagagaggaaaccaaggcacagcuaauggcaagagccagggagucuccagugggggcucgggcagggaagcccagcacccaugaaugaggaggccacugccggucaguguggggcgggagggcccugggucccagcucugaggagcucugagaaacgcuuuacgacuuucuaaaugggccucugcugacagcuuaacagccagcuccucccugccccggcuucauauuuacgagcuggcucugaaggggggcucaggaauccggcccacaccacccgauccucagcccucuggcuccagggccaggaagccauaaaaaaugaucuugcauugcuucccuucccccacauguuuuaggugaggcagggcgggcauggcaagggaugcugggggcagggaagguguagggucuuucucuaaggcuacacaagcacauucucacagaggggaacucaacugcccaggcuuugcccaguccugaggucccuagucugagcugucaagggcuggacauacucauacuuauggggcaccuacuguaagccaaggugucaccuucaauaucucauugaaucuuacaacaacccugaggaguuugacaaaguuuggaaaggucuuuggacucagaucuccacuguucccuccugccccgaccagaaggccccuucaguuuacaguugacgagugagacccagagauggaaaggaacuugccuaacgucacacagcguauuaguggcagaguguggaccugaacuagggcucccagcucccagggcaguaggacccaugcugcaggcuccugacaugccagugggcgagguggggaugaucccuuugccuuccacaugggucccucugucuauagauggcccagaugcgaccaggugcucucuagggcucucagcggcuugggcacucuaaggcuggaauuccacaauggugccuggucugaagcccaguugguggggagcugcccuuccuuuucagguugaggccaagaggccacaccagcccuggccauucucuaagcucaguccucagggcuggaggcugggcuccgggaacccccuaggaccccccuaccagucccuaaguguccucccaccgucuggccugggaagggccaaugucucccacaggauguggccgucuggcuggcugaagccucuaccacauccccucugggugcucuccaggcccaaggcugaggaacgcugaccacggaaggaaccccacccucuguccccaucccagcccacgcuggcacaaccuccaguccacauacccucuucuucccgcugaagugggucagucccacccagggaaaccaguccucagcucucugcugaguucagggcucuggcuacagugggggcucagcaaaugaccaucaagcccccagagggguucagaagggcugguggcugcaggccuguuagucccaccccuccugucuuucucuguggucugggccccuucccugguggcuccccuagcgaggggcugucugcagauaaucagggaacagauuuggaaagaaggaggaaaaaaagcacuccggcgccagacaggauccuuaucuucuggggcgggaugucugucagaggcagaggcagaggcagaggcagagucagaggcagcggcagcgaguccugcaauaggggcccggcauugcagccaggccgggggaggaggggccccccugggcgcugggggugggaagggcuggccucuccuucugggccaggagaccagugggaaucuaucuggccugcuggggaggggaucuggaugccaaauccuguccccucaacccagcuuuuaggaugagucucccugauguguucagaaugacccugggaccucugcaaauagagcagaggaagagaggcccagguuuccaagucucccaaguuccuaacaaggcagcagggcccccagacccagcagccuggaacuggcuggggaacugucuuagccacaagacucuggccaaguauucuagcugcaucuaggugcucucaccuguagaauggggaugaaaccccacacgccucuugcacugagcuauuaggcuucuccccagggauuccaucuagaaagugccuugcaaagggaagguguguucugccuggggcuuugagcuucccaccccaggggcucccugcugguucucacacagcuugacagaccaaaggaaggucauacaaggggcuuugcuucuuaugcugguccccagaauacuuuucagugaaaccccacaacauggugaagguccuuuucauagagcagagagcagguuuuccgaugggguacuguuuccccagggcaguccauaaaccuugggaccaagaagcuucgauucccuggcuuggacuucucugggccaggccugaaucucaagaaugaagccucaucuccgugagggccccagcaaaagccccuggagggggcggugucaagugcgggccaagggcacaggcccuaaucaggcuccaaauccaggcucuuuugcugcuuccuggcugugugacccugggcaaguguccuuaucuccgccccccacccccgagguuaauuuccucaucuauaaaaugaggaagauaucucuucagugcuaacauuuuguaacuucacacuugaccuaaccggcucugccccugagaaacuugaaccguaaaaagaagggagccauauaacacauauaacuguacuugcacacucaucaggcagagaagcaucaaaucaagugugccuguguggccuggagcacccugggaccagguuccuuuguggacccuguuucuaaucuccuggcggccucagccaagagcaguuagagugggcuggccuccugcaggaguuggaccaguucaucucccagggaugggcugcaggaggaaaugccagcaaggguccugacaaagaaggaaaggcuucugucuggugcuggggauuaaaggcacacuccccugugccccaccuccaguucccugugccccaccccagccccaccagaaccuggcuggccugucucccagcugccaucuguagggguugguccucauuaacugcuguggcagcugaggggcugggagagggagaugcaggcugcagagcuagaaacuaaagccaggcugggacgguggccaccucuggagcuagagugauggaccguggaguggggaggcagagggaagggggagacaagggaguauagggacgggugacaggcuuggccagugggagaggcaaaggugagagcuggcugaagccgccagcaucuuccgggcuguuauucugggcaacauuuuauuuauucagaggcuagggaugcggcucagcauugguuggcucaauauuuauuacaagugcauugaccuuguacuguggaccccgugauggggccaccucaggaccccgggauggggccaccucaggauccucaucuccucggugcuaggacacacuugaaaaccugcaacgaaaagccgagggguccuaccuuccuggaagaccacccaguccaacucuugcuuuaccuuugggaaaauugaggucugaggcagaaacaaccuugcucaaggucacagggcacacugguccuugaucccuguucucuuggcauuuaggccaucagaauggacaagugcuguggaaguagaaauacugcagaccacauucagagggacagcgaccugcccacaagucccccaucaggugcagacacagcuggcagaaauccuggaguaaggucgcagcuuuguguacaaggcacucaagcucccugagcuuugguuucuuccucuccacgagcaagguaaucaugcccaucucacagagugguugggaggacugcaugagaacacccuggaaacugucaagccccauccuacuggaauugguuuauucacugacaugcugcauggcaggcugugcugggaagugaggcagcauggccaugggggacuggcauccauccauggccccuaaaccccuuccuuaucacagcuaccaaggcuaggcaggcggcaacuaauaaaucggcaguaagagcuccuucuuaaccaacugaagacauguaaaugacccaaagcaaggccagggcugccaacuggcggagcucacggugacaucacaugcccauuugcuccaagccuuccagcagcugaggucagcuugcaaagugggagccccucccccuccagccccgugcugagccaagaggagcauggcacugccagggcuggggcuggggccggggcugggccaccagcucagguuccacgaguuccucccuccuugugcacucccucugcaaucggcucuccuccacccucccugacugcauuucccucaugaacacaagauugcuacuucucauauaacacauacgcgguggugugaacuucugguaaaugaagaucuuauuuaaaacugugugcuaucagaggaggagaugagauagguuuugacacagcucagcuggcuugccaggaaaaggaggugcuggggggcugugcacagagccacaggccauuccugggaguuccugggcagucaucggagaugggccacaaggcuucuggcaaugcuuucaacucaucuaugagggucaaaaaggguaucccuuucuucaucuuugcaggaggguucaacaaggagguuuccccauuugagaauucaguuugcuguguggaacaaguggcuuaaccuugcagggcuuuccaagaaugcagaauuuuggaucagagaggccuuggagauccucagguuccaggguccucuaccucagcuacacaagaggaccaccugggggacuuuuaaagauccugacggccaggccagaacccaagaccaauuaagucaggaucucugggugggaccuaggugccaggugaucccauuguccagcuaagguugagaaugaccaagcuagucucuuuuuaacauaagugugccacagaaucaccugggguguuuugucaaaauucauaugcccaaaccuggcccacagucccuaaaccagaaccuuuaggguaaaggccaggcaugugcauuaaaaaaaaaaaacucuuaagauuuuuacguacgauugugguuuuucguuugcuaagcaccuguucacaagggcccaccgugugcugggcaccguucugagcauuuaggguacauugcugagcguacacagcccugcgcucccaggcuggggagucaacacauaagucuguauucaaacaaccauuccagauggcaagaagugcuggaagaagaguaaaagaggcagggggccaggaaaggacucucuggggaggggccauuggagccgagaccuggaugacaaggagccagccacgccaagcucagugcgagagcacucccuccagaggcacguuugcugaugugugaaaugacgacucuagcaauggccgagcccauacucucgccaacccccaccucaccccuacuguauuuuuagggugcccagcaggaaaugcuuggaagaggccagugggugucacaauggcaccuucugccccucaggaaauucuauaggcugcugggcuaaggggacuuuacgaugcacagcuuauauagcuuucauauaaggaauccuaugguucacuaguccaacccccucauuuaacagacagggaaacugaggcucagagagaggaagugauuugccuugcuguagcaucucugcucugacaggguuaaaugggacaaugacuucaccauggagguggcuugcugcugucaagcccauugucuuuacccccagccacaccccaaaucccuguuccuggcugcucuccauauaaacaaccuguguguuccagccaugguacaagucugugacacauccagggagcuugaguggugggaagguggggaacccccacuucccugcuucccugccccauaaucuuucugugggcgggagguccuuccucccacacaaggaaacccaugaaaggccagacagaauggugccagauaaggccauggaauuuggaauuuggugggaucuagaauuucccuuauggggaaggcuggucccagcuguccacccauggugaguauccaaagggaggcugugccaggcuccagggauguggggggaggcccacauacccagggccggaggccugaugagguggggagggcagagagaagguggcugguugucuuuggaaugucccuccccagagaggcaggcuagguccacaggucacuugguggacaggacauugaaagcaauuuugaccuuggccacuggccugcucugcucagucugauguccacguuugugguauagccaggagggcuagaggcuagggacugccugucuucaaccugcuuggccuuggcuucucuguguguucaggggucagcagcuucccucgcugagccauggaguggagguaaguuccuggcucccaaacaggccugcaccccuccucacucugaccaaucagagugagggcccucagguuccuccuaaucacagcugaguuccccuagggaaaacauggagguaagacaggguguccuugaaggacuaucuagaauggucuacaaugcuucuuuucuuaaucuuucucagcuaccaaaccaaggcaagagcagagaggaggagguaggggugaaaagucagaugauaacaguguaggucaggagguagcucugucucaguuugcccagccauaaaagggcagugaaaacacucccccugaugacuucguggggcucuugagaagcucagagucaauaagaggguguuucugcaugccgcgcucugugccugggagcaacaggcaucacccugaccagcgacggugggacagccagagauggcauggggcugauucucaccaccagcucuuacucaagccaagggacacggggcccucaugcaccccuuuauagggucugcaagacugcgguuccuaagaagcucugagaacuacacgcccugccccagaagcacaacaacucccuagaaggagccuuggaaaggaaguccagggaagugagagggagaugccccaaggucccagggaauuucuguuuagccugcccuuccagcagagaucagggccuccgggagcucgggcaagcgcucugguccagugggccgugaugggaaggaggguggauggcuugauccacgcuuccagcgaccccuuucccuugagaggucagacccucagcaggcccugccccgcccucugcaggcuccucaggauccaggggcaggggcggaggaggacacugucaaggguguaauaaacaacuuacugacuggaaagcagaauucucaggcuuggagcaggaccuuccggcaaucaugcccccaccauccucccagggucuccucugcucucuauaggagcugaggucuggcucagccucuuuuccagcagaccagcugaucugccccuggggcuuguugcuccccaugcacccacaaacacccacucucucugaccaauccuuaaaaugggaaaggggcugacugaggcuggcugacuggccugugggaaagugccaguuccguccaucaaucaacagcucuuuagcgagacaacaaucacguugguggaggagucugcauuuuauaaagcagcuccaaguucgauucccucaccgcccagucacuccacaggcaacuccagagcauccagcacucccugggcauugagggaggugcgcaggggauaaggcccagucccugccuuggggaguggguguagggugggcucauggaaggagcaccgaaucuggaguccaaaggcuagggcugaacccagaugaggcccugacacuaaaagcuagauuagggugggucacuucacuuuccugagccccaguuugcucuucugcuaagaccuuccucccagagccaucgcaaggacugagugagacaaugcauacacaauggccaaggugggcacagaggaggccccgugggugccccucgggugcucaagcccccuccacaacugaaugugaggccacaguguuucauguuuucccgucugguaaaugagaaaugguaucuuguaguuguuuuacaauauguguuuaucuaauucugaguaagucuguucgagggucauuguucuauuuuauuuugugcauugucuguccgugucuuuuucuuccaccuuucugugagggcuugauccuuuguuccuugauauuuaaaagcacuuuauauaccauaaauaucagcccuucgucuguggcauauguuaggaauauuucucucaguuugucaaguacuuugucuucugacuuuguuuaagguguucugugauuuuuuuuuuugucgaaaauuuaaaaauguucauguaauaaaacugaucaguuuuuuuauuuuauugccucuagaucuuaagucauaguuagaaagccuuucccacccacaaguuuaaaaaggaauuuacccauguuuucauuuaguaguuguaucauuguuuacaucuagaucccaaauccacuuggaguucaucucucuguauggugugagacuugaaucaaauuucaccuuuucccacauagcuacccaguaguccgagcaccauuuauuaaaaagucugucuuaaccccagugaccugugauaccaccuuuguuauguacuguauuuccguagacauuugggucuaauucugaacuuacuauuaucuuuggucuauuugccaauucacacaccaguaagcacacuguuuuaauuacagaggcuuuccaguauguuuuacuaucuggcaggaauaguuuuacuucuucuuuaccccuuucuaaugcuucuaauugacuucucucauuuaaucacauuugcuaauaccucuagcggugaauacuagcagaggugaauaccagcaggguaucuauuacugaucuuacugaaaguaccuuuaguguuuccccauuaaauaagauaccagcuuuaggacuaggguauguauguguguguguguguguguguguguguguguguguguguauauguguguauauauauguguauauauauguauauauguguauauauauguauauauauguauauguguauauauauguauauauguauauauauguauauauguauguauacaaaauuuauuuuuauuuuuauuuuguuucaauaguuuuugggaacaggugguauuugguuacauggauaauaaguuauuuaguggugauuucugagauuuugaugaacccaucacauaagcaaugcacacuguacccaauguguagucuuuuaucccucacccccucccacauuucccccaucucccuaaaguccauuauaucauucuuaugcuuuugcauccucauagcuuagcucccacuuacaagugagaacauaugauuuuuaguuuuccauuccugaguuacuucacuuagaauaauggucucuggcugggugcgauggcucacaccuguaaucccagcacuuugagaggcugaggcgggcagaucaccugaggucaggaguucgagaccagccuggccaacauggugaaaccccgucucuacuaaaaauacaaaaauuagcugggcaugguggcacacaccucuaauuccagcuacucgggaggcugaggcaggagaauugcuugaacccaggaggcggagguuguagugagccaauuuugugccauugaacuccagccugggcaacagagcaagacuccguuucaaggaaaaaaaaaaaaaaagaagaauggucuccaacuccauccagguugcugugaaugccauuauuucauuccuuuuuaugacugaguaguauuccaugguauauauaucuaucuaucucaucugaaaaguaucccuuaauuccuauuucuuuuaguguaguauuuuauccaagcuuuguucagcaucuaugaagauaauaauaugauuuuguuuccucagauucauuaauauggaacaugauauuaauauggcauguuauuaauauuagcgaauucauuuggaaccacucuugcauuccugcaauaaaucagaucuggucaugauguuaaaaagagagaauggaauuggaugcugcugaucagagcuaccaucacuaaauacuuucuccauccucuccaaguauuaucugauuccauccuuaaggcagcucugggaagcaggcuucaugauucccacuucacugaugaggaaaccgggacuaacaagagugaaguugccuggcaaacaucaugcagccagcaaaugaaggagacaggaugggaucuugggucucagugauuccaaagacccuaaugauacaugggugguguuaucuggcuguuauucaguuauuaaaaaugcuuaugggcugggcgagguggcucaugcccguaaucccagcacuuugggaggccgaggcaagcggaucacuugaggucaggaguuugagaccagccuggccaacuuggugaaaccccaucucuacuaaaaauacaaaaauuagccgagugugguggcgggcgccuguaaucccagcuacuugagaggcugaggcaugagaaucacuugaaccugggaggcagagauugcagugagccgagauggugccacugcacuccagccugggugauagagcaagacucagucucaaaaauaaaaaauaaaauaaauaaaaauaaauaaaaacgcuuaugaucugauaagauuuuggaaagauaauaucucuguaggaacuaggggguggggaggaggagacucuauuuguccuagaagcuugagugguccuccucaacccaccacaggcucagcagaggagccgugugaggggcuggcaagguguggccagccaggugugcugccagcagguagugucugcaggguguccucaagucuguguggcacgguggcaagcaguccucaagacccauguccccuuccaacuugagcuucucucugccuuggcacuuacgucucaggcucugaacagugugggagcaacucagagagugaagacugguccagggauguggugggcugggagggaacaaaaugcagagaagaaaacucuaacucucuacucccugcugguccugccugccccguuuucuaagaaugggcagccggccgagggauuauguaacuucuggugggcauggcagauggugugcuggcucagacaguaucaaacccagcacugacacuaaccuucucugacguggcacccgggccuccuccgcucugggauguggggugugcaauggggucaggguaugggggcacaaagauggaugagaaguggcuaaaacucuugucacuuagcucaacagcuguggccagccaggcaugggaggugccagggaaaugggcacgugggcccucucaucccugccacacaggcagcaguucccaggaugcaccgcauaguccagggacuguucugcaggccuccugcugccucagaucagcgacccccguggguuuggagaacaguuucugaagcaccucucuggguguuuucucacuuggcccuaccuggcauucaacuucuuuuguuccuuuugcugauggguaaacugaggcucaaagaaggugggugagauuugcguaucacacagagacagauuuggccuuagagcuggagauuccagacuccuaguccagugcucuuuccaaaugugucuaacaaggcaggcucucccaaauguguauaacaaggcaggcucuccccucgcugauaacccucagacgauuaccaagucaccccacaggacuuccugaacuguauccacggugcuuuacagcgaugggcuuugaaggcuggaagguaucucagaagucuguaggauaacccuacuguaccuuaugucuaauaugcccaugucaagaaggcaauaucagaaagaaagaaggcgggcucuguggauuugggauccagcaauccaaaaucccacuagaaggcaggauccagcaauuuguggauuuccuucuggguggaaaggaaagaaaaccgaccuucacugaccaugcccauuuccuuuaauguccccacaaccaauugggggcccaguuuauagugaggagauggaggcucaugaaauugcaguuagugauggggccaggacuugaauccagguuuucugauuccagggcagaaccucuucauuuggacagaggaagcucagagagggaaaaggacuggcccaaugucacaaagcagauuagcuacauggcuaggauuagaauccaguuuuuuauuuccaaaaaaagaaaaaaaagaauccaguuuucccaauccucaacuuggggcuuuuucugcugucauuucgugugugugugugugugugugugugugugugugugugugugugugugugugucuacauacagaagugggauggaccaggaggaaaauguggggcuggaucaaauuugcagcaggggucacugugcccagcagccccggcuuuccuggugugugugugugugucugugugugugugucugugucugugucuacauacagaagugggauggaccaggaggaaaauguggggcuggaucaaauuugcagcaggggucacugugcccagcagccccggcuuuccugggcugccagggaggaauuccagaucagccucuggcagggacuccugacaaggaccagugagccaccagcugaggauggucacugggccaggcuuguugcugccuggggauguuuaaucucccaaagaugucaguacuggacaugaugccacccagagucuauaucagccagaccccauggccagaacugcucuccugcaccaagcccagcuccugcuaagaagcugguagcaguugcuauagagggcugaggccuggagucagaucuggccauggccuuuagauacaccugcucagcccacacuugcucucaggccucacggccaguuguccaugcgguaagcauucucuugagccacaagaaggcaagguggggagaagugauaaugggcuuguggcuacaaguaggaaagaaacauuuuaaagucgccuggaccagcugugccuuacaagggccaccuugcagauaaguacaaaauuuaccagcccagcaagugucugccagucuacuuucucuauguaaaggggcccagggcacuugacugcaaaacuugguuaauucucuguggcuccgcuggauuuagugaauaaauuccuuccuaccuaggggcucugaucacugaagauuuggcucuggcuuccaccauguuggguacacaguaagugcucaaagaaagcaagcagcagauaaugaagggagggaagcaggcaggcaggaggggaaggcuggaagcaaaggaaugaaaaaaucuucuaauucuuugguuacucauccacagcagcagguccacgcacagcugggacaaaaucacagcuacuucucgggugaguaaggccugaccaugaguucucauucauccauucuacagagauuuauucaguaccuucugggugccaggaauccacacgagugagccaaaucaggcccagccucccuagucaccuagugccauggcugcucugccaucaccuagucguuucaauccaugcuggcugccccugcugaaccugucuccccaacccuggagcccuggcuuggugacaaggaaaaggaaagaacgcaggcugccccauccgacagacucccaucccaccacaggucacugcucacuccgaaugucacucugcucugcugugucacagaaugaccaaaggugggauagggaugggggagggggucagggacaacuuuccuggaauuccugacucaauuucuuguaagcucugcauccugcauggguguccagguccccagccaggcaggcggacgccucugaucgcauuacagagcugcuuuccuuugggcuuugucuccugaaggcaguaaugccuccagaugccgcuuggggccucuggggguugcaggcuccugggugaucucagcagaagacucccuggggaugccuccugggucagggcaggcccaggugaacaccagggaccagaaaaagcagccucucucuuccugccccucuccuuggcucucuggccaaccuggaaacugccacuuugggacucucugucccacuguucugcccagagaugcacagggagagaaucagggcccaggcccagcccuagcccuauccagaggucagccaaaucgggggguggaggaggggcaggaagagaagggaaggcaauggaaauccacagagcacccacucugccaagacuguauauguguguguucacgucacaucagcaccuggugaaggugguggaaucaugccuaucucaugaauugggaagcugaggcacagagagugagccaccucuggaagauucaaauccuaaaggcuggggcucuuuccacuaagagaccucuggcccuagaagucuugaguugcuagaugaucagacacgagucagaagcugaauguagaauuugucuccuggguagaugugccagacauucacacccauaccuucacguacacauccccuaccagggccacacucuccauuuacccaaagucucucaucuuucaagggccagucaagugcaaaccuucccucuuccaggaagccuuuucugacugcccagaccacaagagcuucuuccucucaacauccagacauuucccuucguuccacgcaauacauggugcccauaugaugaugaugaugaugaugaugaugaugacaguagugaaugucacugagcacuucagaauaugcaacacacuuuuaagcaugaucucauuuauccccaaaucuaaugagauuggugcuguuacuacucccauuuuacaaaugaaggaacuaagcucagaacuaagcucagagaggguaagcaacuugcucuaagacacacagccagaugguggcacugccaggauuugaacccaaguaaugugacugcacagccugcccucuaaacaucgcgcaagaccccucccaagacacacacaucuuggcucaugcuugaaugauucauaucuguugcaucauccuaaucccccuugcaccccagcaucacaggccaggcacuuggcccaugcuucaagaagcagcacaaagcccaucaguucuucaagagucaggcccaugguuuuuaagcuucugacugcggagcucagcacuugcucaggcugaaugaaugggcaugugcaucagguuuuagggugggcugguguucugauacccuacauggagacaggaguccucauuccccaacccccaagauuggccucccccugccucugagaaaugaagcuaugcaugacacgggggccaggccugcaaagucugucucuaacacccucagcagggcgcacuugagcuucggagugggugacaaggggggggaccacaggccccuucucgcacaugcccaggcugccucugccaguggggcccuucucuaccuccugggcccugcuuggcaucugggguucucaguuucugaagcaggaaaugcuuauggagcaggaaaaagggaccgaguucccagagggugauuuauggcuucggugagagagacacccagggcugcauaaugcgugcaagggcauuccagucaauauacugacuuuccagaggggccucuguaaacacaagugguucuggaccucggcuaccucuguuucuuucugacugcuggagccucuucagauagaaccagacaaaaaccccacauccuguauggaucauccuuccaccucugccccacuccggacuuacagaugggaagggaaaccaaacaaucagaacccagagagggaaaggcacuugccuagggucucacagcaaaugaaaaucaagagccagagucuacuaacuccucagccaggagcagcugagacuccugguccugaccucccagcuuucacucccguggaggaagaugaugaugcauugcuaggcucucuccggggcaggcugcaugccaacaggcccugagugaucacugugugccgggcacugugcuaagggcuuuaccauacaucagcucaugagacucucaaggcaauucugaggaugauguuauuauuacccccauuuuacagaugagaaaauggagguacaguccaguuaggugagcugcccaacgucaccaaguuagucagugacaaugcugggaggccguguuaaccuccuuagaauuccaauuggcaaugccaugcacucuucugcacccgcagcuaaggccccggggagagguguguguggaaagagagcagcuggggguucccagagguggugaugacaaaggaucuccccaccccuaccccugccaaauggcucacagaagugcuaggcagauuccauccuuccccuucuuacccacuuuguguucucuggugggggcagggcagaaaguagggagauaccuccccaugucuccacccccaauaugaucccuaccagugcuuagaaaguauuuucugggcucguuccaccuuugggagccauacagagagauccaagaagaaggccuuuugccuccagggccugccaugguccuagcccacagagucagaagcagcugagaggguucgugacccaagcgcacacauucaguagaaccugggaugcugggagguggaauggggccagaggguuuguucuccaaggauugguguccaccucaagauagugaacacagcagaugcuaacaggggcaaauuucccaagaguaaggagaggucggcuggcaccccugcccacauacccagcuagcuagcccccaucccauccucucuucaggacaugcucucagaagaacuggaaaaggacagucaaggucuggcacucaucaccugccccaggaagccccaugccuuaaaaccuuggcucugcuaugcucuucccugcauaucaucugucacccucacauggcaucugcaaugcucugaaugccacuuaacauuucuagaguggacaucagcaacacuuacagacagcaccuccucgagggcuguggccagggcugcuuaggaguucugaccuugugaugguuaauacugagugucaacuugauuggauggaaggaugcaaaguauugauccugggugugucugugaggguguugccaaaggagauuaacauuugagucagugggcugggaaaggcaggcccacccuuaaucugggugggcacaaucuaaucagcugccagcagggcuagaauauaagcagacagaaaaacgugaaaagagagacuggccuagccucccagccuacaucuuucucccgugcuggaugcuuucugcccucgaacaucagacuagaaguucuucgguuuuggaacucggacuggcucuccuugcuccucagccagcagaaggccuauugugggaccuugugaucgugugaguuaauacuuacuaaacucuccuuuauauauauauuaguucuuucccucuagagaacccugacuaauacaaaccugggucccaguccugucucuucagccuucuaagugagagcuuccaccuucucggugaguucuuacaaggacaaagugagacugcacauauaaaaggguuuuguaaacuguaaagcaacaugcacaccaggguggggcgagggacugugauuuuccuauaggccucccugcuccagaacaguccaucuuauccuagaguugaagugauggaaguccuuccuguggacagcccugggaaagcagguaagcgcuucugugaccaagaaaguuguaacgacaguggaguccagcaugugugugggugugucuguccucuuuaaauugcuaccgcugagagucccaggccccagccacgucagccugagaugggguucuccacuggggaucccacccacucaagcucugcuggccccuucuccagcaaacucuagaggagaacucacucccuuugggggagacaggcugaagcauaagcugacccaggucagagagcagaucuccaaaccacagccgcucccaugcucuggggaagcugggaguugacugcagaagacuccaggucugggacucugaucuuccugggggcaguagcccaagcugcugggcuggcuuaggguccaucucugccaaccuuccucccccuggagcaccaggacccaccugcaggcaggccuaucccaucugcacucagcaggggaagcuguccucugcccuuccaacagcagaaccuggcacucaggccaaacccugcucacagugcagguguggggcaaaaugaggucucuuaagugcugaugggcaaauggccugggucccauccugaaguggaauccccaacggaauacaauggauggagcuucccaugccugguggugacucacugucuccacauuacacauaccuauuuauacacaaacacaccacaagugugcccaugugacauugcccaccccacacacacccaaacacagacacagccuauacaucacaccuccugaguuacaaaaggcacaacccuccucaaacacacauccauccuccggcacacacccaguccaugccucgcccccacacacaccugacaccccagugcaacaccacacccacccuccccucccugcaaacucccaccuccgcccaccugcuuaauacacauucucaccccccacacacuccuuaauacauacucucacacccacaagccugccuucuuggagaagugagccgagccgugcagcgccgcgaagggguaaguugcaagcacugggggcagccuguucugggaggugagaaggagggcggcuccgugcacucacucgcuaggcgguggcguuagagcucccggggcuccgcagaccgauuuagcucggcuggggagggagguggagauggggacugggggugggggacgcaggagaggguagaauccagccccacaagcggcggcgaugcuaaucaggccgcuaagauggaaaagguaaauucuggcgcccagcagcccagcgcuuuuggagagaaggaagaggaaacaaaaggggugggggugggggagcggggaggcggcugauuuaugccugcacuucagcaaauauuuucgcugccauuagcauccccgaagaccgggaggaacgccgcggggaccuguggcuuagcgcgcuccgcccgggcuugucugcccgcgggggcgcagcggcugaggcggcuccgggccggaguuccaaucaagcgccacccaacucccagucgggggccgaggccagcgccgggaugccagcuucccccaaaaagauccugccucagggaaaugcauggagccggcggaaaagcccgcggcgcccccggcggaucgcagacccuaagggggcgggagguggcgccccagucccaaccucuugagccaacccagugggugggaagugcccuuacccuaggccuuccgcaaaguguucucuccuuguauuauucuaauuacgguauuuuuaauuuccuuaaaaaaauaagaaacagaaaagcacagaacgcacuuguuugguuucauuuugccuucacagcuuuaaugacucuauuuguggaagcuguuuaggaaacuggugaggaggagaaggaggaggacgccaagagaagcgccagcucuggccugagcgccggcuuucuccucccuacccucugggggccaucugcccaggcagcaguuucccugggcccaggcucccacccccaagucccagccuaugacccagcccccucugcccuuuccugaaggcggcaguggccuccaaacugucuccuuuccacccaaccccaacucugagggucaaaagacgggcugccugcaggcccugggggagggagguaccagcacugucuauucagaaucacuaaccugguccgagagcacuuggaauggaaaugauccaucuccccccagcccauccccaaagucuuaggcagcccacaaaccuccuuagaaaaccucuguggcucagggaauggggcguaggaggcagaccucgucuuaagccugacacccaggaaaagggucacuagaccugcgguccaggagaaacucaacaacaaaggugggggagggcacuggcuccuaaagcuuugaauauaaguaaaaaguaaaaacauauucuguccccaacucuacaaaugggugcagagcuauaaaaugcuaauguuuauuuggccaugcagcccaagggagcuuggcuugugaccugucucccuuccccaggucagggcaguugcucaggaggccaaugcuggggguugggggagccaccuuugggcacuugccuggucucagagcuucacuccugaccuuuggcucugcccuguucccccucuccuggaacaccucuucacccuuccaacucucaaccucuuuccuccauccugccaugaguuccagucuaaagcagccaucaaagcgaucuuaucuuuagcugccugccuuaaguggugccucaauuucagagucucaagcccacacccaugauggugggucuccagcccagauggaaugaaggagcuagaagcacuagauugagguugugaggccucaguucaaguccuggcgcuaccggugagucccagugugaccuugggcaaguuggccugucccaaagugucaacaguuaaauaaauggauuggaaaagaggggaacuguuuuauccuacagaauucccuguuugugggggaggggagagagguggaggagagagauuacaggagaaauuccuccccugcagugguacuuucacuuuaaugagaaaacccauuaagacacuugauuuuccauuuguuuaagugagauggguguuugcuacagugagugcagagggagacaaggacaggcuaucauugugugugcacaggcgcaugcacgcgagcacacacacacacacacacacacacacacacacacaccaagcagagacacuacaaaaacucugauuuuaauugcaccuuaaaaagaaguauuaucuugacaccucgacuccuucucaaccaucccagccagaggccauggaaaggcucauuaaaagcuccaggaagggcugaaagguggggugggaggagauuuccagggccaaccagagcuuuugaaguggccuuuucuggcuagucacuugcugacauuaccuucuaagggucugggguuuuaugguuccaguuuugauuucuccagcaucagacuuuacagcuuaaaaauauucucagugcuguaaagggagcucauucccauauucaccagggauggggugggguggggaaaaggagagagaggugccugccacuugaggggagcuuggacacccccaguaaagaucccucuuugcagagagagccucgccugccucagucuguuaugagucucauggcagagggguggguggauaagaauaggagggagggucugcugggcuugaaucagucuggcuauuggacaggagcccuucacaugucuucaaucuguggccaagugaaggcaagauuuggagaaagccaacacucuggccuugauuuuccccaucagugaaauggagcuugugaaggauccaauggaaaaacccaaagaacauucugaaagaaugaugcucugugccuguggcauuagagaaaaacaagauugugugggaggaagggacauguucucccuccugaaggcagguuucuaagggccacacauucugggcaaugagaaggcugcaggccgaccccaccaguuggccccucuccaggcuggugggcaggcagcuacugccgcacuaaguaaugagcacaauuccaacaccgcuucugcucgcuggugagaaaucaaagccggguauuagaggccauuucugacugggcaccauucgugcccaaauccaucaaagcccugggccugggguuucuucuggggaaggugggggcuggaugcuuuguuaagcaggaaaugcaggccacccccagccuucuuggccaagcccacccacccagagaacuauaggccaaccagucuugucuuucuccuacagcagccccucauuccugguaaccuaaguauuuauuccugaucccacuguccugcugguacaaaagcagcuucccaagacacaacccugcccaugugccauuuacagagacuucacccuacccuucaaucaucuccucaaacccccuccaaccagaaaccagcaccccaaccaagcaccucccacgucuaacugcacccuuuaaaacaagguuggacauucagcagccugccuuccccauccccaucauuaccuuccaacuucaaaacacugcuuuaaauaccagagucugcccaaaucauaauuaacuuggaucaaaugguugaguguuguaacucuacugcacaggacuugcaccagaaaaaaaaaaaaaaguggggaaugugcuaaagccaagcccucacuccuggccgugggaaucacuaauuccagaaugaggaaucuuuggcuauggaggggggaagggcggaugucaacuucgcagcaggagguaggagguggggagggcugcgucaucucguccacuuucugcuccaguuuuccugcuccauucucagccucaacucagagaggacuccgugcaggaggccccguccccaccuggcuccggagccgagccgcccggcagccguggccagcccacuugcuuggguucggguaccagagagaggcuggcuccauucaguccacagccuccccgagaagacgcagcccagccagcgacgccggguccagcuacaggacgagcgagaaacguauucauccacggcgagagaggaggguuagggacuuuauuucggagcccaccaguucgcugaagucaucuugguggguccagagcgggcgcuguaccaaggagagcgcaccuagucuguuccccggacagcgagaaugucagugaccaauuuaaaaggaaacuccgcaggaucgcuaagaaccccuacccgcauccaacacacacacacacacacacacacacacacacacucuccaacacucagaaaauuaauaauaauaauaauaauaauaauaauaauaauucuuccagaccugcgggcccagcgaucucggggaaagcuaugugugcaagacuuagcccuccccgcuucaggagcccugcaagccggccugccgaggcuaccgaagcgcuuccuguguucagcaggucuuuucgcucucucccucuagucugcagauugcugucccuauagcgcguaagagccuaggcgagccgggaccagacuaguaaguuaccggcguacggcagcgagcgcacaccuugcuuauguagccaauguucuuuuucggggcggaugccaggcgcgcggagagccgggcguccccaggaggcggauccucccggagacucagacccugacuccuacaccccuuccagggagaagaagggaucccuuucaggagcgagcagggaccuuucagcuuacugugaagccccuucccugcuccccgcucccgcgauguggaugcgccauugcccacuuugggaggcaguaaaaucuacauucuaacuugggcgcccuugccgcuuuuccugcgcgcaucgaugcgacgaaagaccaccucaacuucaggacagagugaggcgcaaggguccccuagccccgcgcccccagacccgaucgcuuccuaccugcuuggcucagccucgggucccagcagagcagcagugccagcagcagcgcgccccgagcuccgcuccgggcccccaugcucccgcggccugguucgggcgccucucccccagggcugucucccuggccccagucucgccgccgccgucuccgccgccgccgccuccuccucgccguccuccccggcgcccggcagcgccagcccgugccuuccgugggggcagcggaagccacgcugcgcggagggccgccuggcacucggagcgcggugggugccuggcgccggcucucgaacgaggcuccggcgcgccccucuggcuccgggucucugagcgcucgccuggcuccggcgcugugccuccgaaguugcgcgaccgcucaguggcgcucgcagcggcggcgccgcgcagucccagccccagugcgcgccucucggagccccgcggcugcgugcggcuccggcgcccuagccggccccagccgccugccacaau

SEQ ID NO: 21473 - RNA, 4373 nt, Homo sapiens
cuaacugagcgaggagcaauugauuaauagcucggcgaggggacucacugacuguuauaauaacacuacaccagcaacuccuggcuucccagcagccggaacacagacaggagagagucaguggcaaauagacauuuuucuuauuucuuaaaaaacagcaacuuguuugcuacuuuuauuucuguugauuuuuuuuucuugguguguguggugguuguuuuuaaguguggagggcaaaaggagauaccaucccaggcucaguccaaccccucuccaaaacggcuuuucugacacuccagguagcgagggaguugggucuccagguugugcgaggagcaaaugaugaccgccaaggccguagacaaaaucccaguaacucucagugguuuugugcaccagcugucugacaacaucuacccgguggaggaccucgccgccacgucggugaccaucuuucccaaugccgaacugggaggccccuuugaccagaugaacggaguggccggagguaagccgcgugucuucgcaggcccggaccugcgcggcccggaggugguggauggggugcagugggugugcgggaaucgcaggagaggauuggggcuccagguggacggugcugacugcacuggcuuugaagacuggaagugggugcaggaggaaccugcgacagcugagaccagggcgcgcgggcagaugcgccaggucgccagcaaaccggcgugcgugcgccccggcgcgcccagccccgggcgagcgcagggauggggguggaagaggcguccccccggguuucgaggcuugcguaggcccucuggccggcagcacuucgaccuccccucucccggggcaggggcaaagugacgguaaaguucggggcucucggggagagcugcgcgccuggagagccgagcggcggagaagcgccaggggaaagcgucgguagcucccuccugggcagagccgaccccgggaaaaucucggagcgcucccuucuugcggccuggaggcgcgcccccaccugcccgccgcccgcgaaguugaggggguuaguaaggcgggggcuccggccggcggaggcagcgagugggugguggaggagggcgcgcaacggcgggaagcagcccccggacugccgagggaggcccgcgggggcaccggcgacgccgguuuccuuggcgaugcuguggaaagucgucucucgcggcccccgcgccuuccucgaggccgggccacuggccuugggcugaggcggggacgcgcggcugucgggaaaggcggagaagauugggagggcacggaaaccuacggacuccuuccucuacaucccccauucgcuccagcagcccucggcugaagcgcagcgggagagggagggagaaaaaggcacaaggcgccggggauggggagcagccgggaaaucacccacccccuucucgggcucuccucucgguuuggcaccaucacggcacugacugggauaggucgauucuugggugguguuugucuuggugccucagccguggaacccccaggcaaaaaagagggagaaaagcuccgggcggaugaggcuuuuuaaaauauuguuguugcuauuauuggguguuuuuuauuggggacuagagccacagauggcuggggguggaggggaguugggaaaagcucauucugcuuuuuuggagguaguucuugaguuccauacugucaauggguugccacaguugggcuggccucuucuuacagucugugggccucaauuuccccaccuuuuggacuuugccacagcucuacagugcugagacucucggccuuggaaauggaccuaugugagcgggggugagaagggaguccuggcuguauuuucauuguuccaccuccauucugccuuuccccuccccagauggcaugaucaacauugacaugacuggagagaagaggucguuggaucucccauaucccagcagcuuugcucccgucucugcaccuagaaaccagaccuucacuuacaugggcaaguucuccauugacccucaguacccuggugccagcugcuacccagaaggcauaaucaauauugugagugcaggcaucuugcaaggggucacuuccccagcuucaaccacagccucauccagcgucaccucugccucccccaacccacuggccacaggaccccugggugugugcaccaugucccagacccagccugaccuggaccaccuguacucuccgccaccgccuccuccuccuuauucuggcugugcaggagaccucuaccaggacccuucugcguuccugucagcagccaccaccuccaccucuuccucucuggccuacccaccaccuccuuccuauccgucccccaagccagccacggacccaggucucuucccaaugaucccagacuauccuggauucuuuccaucucagugccagagagaccuacaugguacagcuggcccagaccguaagcccuuucccugcccacuggacacccugcgggugcccccuccacucacuccacucucuacaauccguaacuuuacccuggggggccccagugcuggggugaccggaccaggggccaguggaggcagcgagggaccccggcugccugguagcagcucagcagcagcagcagccgccgccgccgccgccuauaacccacaccaccugccacugcggcccauucugaggccucgcaaguaccccaacagacccagcaagacgccggugcacgagaggcccuacccgugcccagcagaaggcugcgaccggcgguucucccgcucugacgagcugacacggcacauccgaauccacacugggcauaagcccuuccagugucggaucugcaugcgcaacuucagccgcagugaccaccucaccacccauauccgcacccacaccggugagaagcccuucgccugugacuacuguggccgaaaguuugcccggagugaugagaggaagcgccacaccaagauccaccugagacagaaagagcggaaaagcagugcccccucugcaucggugccagcccccucuacagccuccugcucugggggcgugcagccuggggguacccugugcagcaguaacagcagcagucuuggcggagggccgcucgccccuugcuccucucggacccggacaccuugagaugagacucaggcugauacaccagcucccaaaggucccggaggcccuuuguccacuggagcugcacaacaaacacuaccacccuuuccugucccucucucccuuuguugggcaaagggcuuugguggagcuagcacugcccccuuuccaccuagaagcagguucuuccuaaaacuuagcccauucuagucucucuuaggugaguugacuaucaacccaaggcaaaggggaggcucagaaggaggugguguggggaccccuggccaagagggcugaggucugacccugcuuuaaaggguuguuugacuagguuuugcuaccccacuuccccuuauuuugacccaucacagguuuuugacccuggaugucagaguugaucuaagacguuuucuacaauagguugggagaugcugaucccuucaaguggggacagcaaaaagacaagcaaaacugaugugcacuuuauggcuugggacugauuugggggacauuguacagugagugaaguauagccuuuaugccacacucuguggcccuaaaauggugaaucagagcauaucuaguugucucaacccuugaagcaauauguauuauaaacucagagaacagaagugcaaugugaugggaggaacauagcaauaucugcuccuuuucgaguuguuugagaaauguaggcuauuuuuucaguguauauccacucagauuuuguguauuuuugauguacacuguucucuaaauucugaaucuuugggaaaaaauguaaagcauuuaugaucucagagguuaacuuauuuaagggggauguacauauauucucugaaacuaggaugcaugcaauuguguuggaaguguccuuggugccuugugugauguagacaauguuacaaggucugcauguaaauggguugccuuauuauggagaaaaaaaaucacucccugaguuuaguauggcuguauauuucugccuauuaauauuuggaauuuuuuuuagaaaguauauuuuuguaugcuuuguuuugugacuuaaaaguguuaccuuuguagucaaauuucagauaagaauguacauaauguuaccggagcugauuuguuuggucauuagcucuuaauaguugugaaaaaauaaaucuauucuaacgcaaaaccacuaacugaaguucagauaauggaugguuugugacuauaguguaaauaaauacuuuucaacaaua

SEQ ID NO: 21474 - RNA, 2626 nt, Homo sapiens
gaugcgggaccugccucucaccagccuggcccuagugcugucugcccugggggcucugcuggggacugaggcccucagagcagaggagccagcugugggcaccaguggccucaucuuccgagaagacuuggacuggccuccaggcagcccacaagagccucugugccugguggcacugggcggggacagcaauggcagcagcuccccccugcggguggugggggcucuaagcgccuaugagcaggccuuccugggggccgugcagagggcccgcuggggcccccgagaccuggccaccuucggggucugcaacaccggugacaggcaggcugccuugcccucucuacggcggcugggggccuggcugcgggacccuggggggcagcgccuggugguccuacaccuggaggaagguauguggggcccagccccaagcuuggcaccgccgucuuccuucaggugggccggguccuccuagggaagaucaggggcuggcagagcccccacccugggcagggaggcuguggucuuguuccuaggacuggguugcggguccguggccuggaaggugggcaccacacucuguccuguccccgaagcccagcucuuagacuugccccugccucggugccagggagagagcugcugccuucuccccaccccugaagacgacgcagggcucggggccaguggaacccuucuucccacagccccagccuguucucagggccgcuggccuaagauacucccugcggggaaggggcuucaucgggcaccccaacccagagaccccagggcggcagccccacccacagccucagacgcagccccugccugccccugccgucaccgcucccuggcugcaggaaggcagcuaagaggggcacccuugucccccgcuugagguccccugcacaguggccagagcggcagggacagaucccaaagauucccgggggguguggccuucaauggcucaggcguccccugcugucccggcugcagugaccugggagccaacacccucgcugagguuccaggagcccccgccuggaggagcuggccccccagagcuggcgcugcuggugcuguacccugggccuggcccugaggucacugugacgagggcugggcugccgggugcccagguaccagggaguugcauggggcagugcccgggccguggcggggggcauggauuuguugcagggucugcaguacugagaacagcguagaaccaguggcgaugggaggaaggggaccgguagagcggggcuggguaagccuccauccagccgggcugagcccuggucuccgcagagccucugccccucccgagacacccgcuaccugguguuagcgguggaccgcccugcgggggccuggcgcggcuccgggcuggccuugacccugcagccccgcggagaggguagguccgcguggagagggacggggagccgggucgacugcccccgggcccccagccccugagccagccgcgugcccacccaccgcagacucccggcugaguaccgcccggcugcaggcacugcuguucggcgacgaccaccgcugcuucacacggaugaccccggcccugcuccugcugccgcgguccgagcccgcgccgcugccugcgcacggccagcuggacaccgugcccuucccgccgcccaggugcgcgcaggcaccgggacacggggcaggagcgggcgggggcggcguggccucguggccgcucucaacuccuccaauugcggguuccaggccauccgcggaacucgaggagucgccacccagcgcagaccccuuccuggagacgcucacgcgccuggugcgggcgcugcggguccccccggcccgggccuccgcgccgcgccuggcccuggauccggacgcgcuggccggcuucccgcagggccuagucaaccugucggaccccgcggcgcuggagcgccuacucgacggcgaggagccgcugcugcugcugcugaggcccacugcggccaccaccggggauccugcgccccugcacgaccccacgucggcgccgugggccacggcccuggcgcgccgcguggcugcugaacugcaagcggcggcugccgagcugcgaagccucccgggucugccuccggccacagccccgcugcuggcgcgccugcucgcgcucugcccagguggccccggcggccucggcgauccccugcgagcgcugcugcuccugaaggcgcugcagggccugcgcguggaguggcgcgggcgggauccgcgcgggccgggucgggcacagcgcagcgcgggggccaccgccgccgacgggccgugcgcgcugcgcgagcucagcguagaccuccgcgccgagcgcuccguacucauccccgagaccuaccaggccaacaauugccagggcgugugcggcuggccucaguccgaccgcaacccgcgcuacggcaaccacguggugcugcugcugaagaugcagguccguggggccgcccuggcgcgcccacccugcugcgugcccaccgccuacgcgggcaagcugcucaucagccugucggaggagcgcaucagcgcgcaccacgugcccaacaugguggccaccgaguguggcugccgguga

SEQ ID NO: 21475 - RNA, 6813 nt, Homo sapiens
ugcaggauccacuuuuuuauugcaggaagacuaugucuagagcgaaggcuacacagaccccacgaugggggagugggggcacccacaugcggggggagagggggcaggggcggagucacagcaagcauggccuggcacaguccccagcaccagggaugcccaggcaggaugggccagcagccaggacaggcucggguccccuccuauugcagaugcccucucuccccagggucgggcagggccugaggugggagaggccuggaggugggcagggccccaaggagauugugcuaucagggugugucccugagaaagggccgcagaccccugcccagccucacucucuccggcaccuucagaacccagaagcuacugccaggacaggagaggaggcaacaucagcugcuggugggcccugggccagcccaaguuuuggggggacccagcucugcucagacacaaugccagcucuucugggagcccgguccacgugcuggauagcaacacacacgcacgugugcacacucccucucucugaguguguccaauaaacauuuguugaguaaacacucacacgaacacagaggaaaacaaacaugcuuguaccaaaucagacacgagcaaucuguuaccuacauagucccaccuggccacaugacuacagagacacaugugugcaaucucucucucucucucacugcacaaaagggcgugcgcacacacacacguugcuuccucacacccaauaagaccaaaaccuccaucucaccuucccucacuaacuuagcugccaugcuccgagccccgcuguggagagacccacaugguacagaacaaagggcagcuuccagccaacagccagcgaggaacugaggccuucagucuugcaacagcaaggaacugaaugcugcaacaaccacaugagcuucuaagaagcaaauccuuccccgaucaggccuucagaugagaccucugccuggcgaaugcuuugauugcagccuccugagaucccaaguagaggacccagccaaccugcacccaggcucuugacccacagaaucuaugagauaauaagcauguguuguuucugguugcuacauuuguggucauuuguuacacagcaguagcugacugauacagauuuggaaccgaaagucacauugcuagagucauguugcuauagaguggaacacagaucgugucccucaaucaggacaaacauauuuacagauaaaugcucucagauaaaccauaucacccacuccccaaaauauagucaugcucauacaggcacaaagauucacacagacaccucacacauauccagucuugcugacaaccacacacagguaucuacaacuacccaccucucuguauacccuacaccacuauuacacacacagacugccacaaaaacauaucaucccagacagacacacacagguauacacgcagaugcacuuagauacaagucacccauccgcgcaccccagguugcacaaauacaccauuccauagccacuuccguguauguuggacacaacccuguggggucacacgaguguggugucacucagacucucucaaaaaacacccagaaccucauggcugcagguacacucgacuccaggacgccaccuucccgggcaggcccugcucucuggggcacaggugguggggaggaaguggguggggcagaccucuguccggggcgcccucggauccugcuggugcuggcucccaucggcuguccccccacggggguguaauugauguaucucuggccggggccccggguacccccuccugagcaccccagguccccacccgccaugcguugcuaacgucucugucuugguggaagaggcgggucccgggugggcgguguccgggaagccccuccacgcccauggugccucuccagcggggcaguugugcuguggauguggcuggucccgggggugggauucggggcuggcaggggcacugcugcaggcccugugguuauugccugguggccugaggcccaucccacgggccccacaccccacugugaagacagaggagagaggugcgucuggaaccggaggagugggcacagaucagaggucacgacgggccgggugggcuuggguguauguuaacaccaaauaggagaaaaaagaaaaaaauaucugaggccgaugugcauuuucaacuccccccucccccagaaggucacagugaucaaaugugagggacaggacgcgcaggucuggcuggggacaccccagggaaagagauggaaacggggaaacgcagccuccucugguccuggugggaacaagcagcuccucuugccagcuccccauccuguuuucccaucugcaggacaagggggccaccuccggcucuugguuuuggaggguacagacagaacaggaggguggagagagagcaggggaggaagaaaagccccagcccugccucggggugggcaggggcagcggaggggggggcgguggccucgguuuccccagccgaggugucggaggaaggaugagagaagaggaggaggccgaggagggugucgguguugggggaggcagcgggggucagugggggugggcggcgggcaggcgggcguuccgggcucacaugagggugcauuugcccuugacgcggucuguccucuucugcuucccggagcgcuugccgucgauguugaggcucauguuccggcgcgucuccagcgucagcagcuccuggaagagcuccuugacguuguaguucaucuuggccgaggucuccaugaaagcgcacuuccacuccugggccaccgccugcgccucgcgcguguccaccucccgcugcgucucaucgcacuuguugcccacgagcaucacggggauguccuccacgcugcccuugaucugcacgaugagcuuguagaugggccccagcuccuccagcgacugcuugcuggugacggagaacaccaggaugaaggcguggcccuuggagauggacaggcgcugcauggccgggaacugguggcugccgguggugucugugaucugcagcgugcacacgcucuugucgcagcugaucaccugccgguagguguccucgaugguggggauguaggugucgcggaacgugcccuucacgaagcgcagcaccagcgagcucuugcccacgccgcccgccccgaacaccaccacgcgguaaucguuacucuguuccggcaucuuccccgcggcgggugggcggccggggccgggagggcuggugccagcugcaagaaccccagaccgagccugugcagagaggagggucacacgucaaaggccacccaggcuugaggggacagccccacgccccggggagggaggaggacauggcggcuucucagaggagguggcugccgugccuccugccuccugaaaaggcccauuugcuuguggcugacuuugcaguucugucccacaggcgggcgcacagccaacacccuuugcuuacuucucccuaacaaaaucuggggccugagcuuccccgggggacgcugagcuaggagaggcgugggagacgccgggaugcccacgaaacuccuuccccgggugugggugucccuuccaggcugugccagcuucccccucucuucccaguguggcaggggccccuggaagcuagcaggccuggcuuccaccucucgcuccacaccugccuggcucugagaccuugccgagccaucaugccacccugagccuguuugguggcucaaacggugcccgucuccaacaaccauggguccccugcucuuccgccaacccagagauggccaauccucauggaagccgcacauggucggguguuuaagaugcauaugucagggccgcagcccuaggugugaugaaucggucggccagggcaacggcccugggaacucguauuuuauuuuauucuucuuauuuauuuauuuauuuuuagacagaguuucgcucuugcugcccaggcuggagugcaauggcacaaucuuggcucgccgcaaccuccaccucccggguucaagcuauucucuugccucagccucccaaguagcuaggauuacaggcaugcaccacaaagcccggcuaauuuuauauuuuuaguagaggcaggguuucuccauguuggucaggcaggucuugaacuccugaccucaggugauccacccaccucggccucccaaagugcugggguuacaggcgugagccacugcaccuggccuucuuauuuuuuuuaaaaccaagucuugcucuguugcccagguuggaguucaguggugcaaucucggcucacugcaaccucugccuccucgguucaagcaauucuccugccucagccuccagaguagcugggauuacaggcaugcaccaccacacccggcuaauuuuuguauuuucaguagagacgggguuucgccauguuggccaggcuggucuugaacuccugaccucaggugcuccucucgccucgggcucccaaagugcugggauuccaggugugagacaccgcauccagcuggaacuuguauuacagggcugcucuccucaccugccauaaaugggauccugaggcugggaaucugagaaccacaauuugcaaaucagggcacugauucccaauagccgccccagggaggaagggucuugcagcccaggugggacacaaaaauacaaaauccagaagcugaacgggaaaaucgccacucccuaaacucuaaaaucaaacuauggccuggugugcccuagccccucccguucaggucugaaggauccuuagaauagcacuuccugggaggggcaccucuuagccccucucuuccuucuugggcucagagagguccagcagccugaggaggucacacagcacagcagauccugaaaugauggaggugggggaagaacgcuggggggagggcggguggcuuaucuccagaauugauguccuccccuccccuuccuccuuccaggcucuggggcagcgguggggggugggggagggguguuccccagcaagguggucuacagugggagaggaggaggaaccaguuucuaccugcugcacuggggguggggguguguuuauggggaggguccagagguuccccgggggucagugguuugaaccuaaacaggcaaauucaagucccuaagccuccguuuucucuucugugaaaugcgagccacuguuggggcaaguaaggugacaagguggagaaaggcccuaggcagugcccuguacagcggagaccccgaucacaauugugaucacagucacaagggcuuggggccggugggcagggcacuuggcugugccuguugguugcaaaggcaccuucuggauuaucaaggguaacagauuugccaggaaaagaaaagaggcugaugaaagcgccagcugacacaguccccaguugugaugagccaggcaaacuucugggcgccucggcaaugccaacucaugugauuggcugccggguuuguggacuacaugcauaguaauuucucggcauucggaggaggcugggggugcugguggugggggggaggcggccugugcugcagacccugcccuuuccugggugggcgcccugagaggcgggcacgcugcugugcagaaagacgccaccaagaccggccugggguccuaauggccauggguucuguggacccagauccagccuuugccuugcugcgggcacugaagcuccagcccccaugagcaguacuguccuccccgcugggucuggaaucccugaccagaaaggcgcuugcacucaacagccccgaagcccacgccacuucccaccuccaccgccuggggggugcggguggagggagggggucgugggcaccgaggcaggagcaggaggggcuggcucaaggucacagagcagggggguggaggcgcacagcggggcuggaagcccacccugcuuggcuagacuccugggguuucccgccugugcggggcagcccacccccagacguccaggcagggccaaucuaccccagcccugggucccugaagcccggcucccggccgggcacggcgugguuggugggggcgggggugucaaagcaaagcucagggucaggaaagcagagagagccgcgacccaggggucuagcgggggucacgccugaccaaggguggggcgggggucugacccagggccgccuggccggugagggguuugauggagaaagggccugcucuagggggcccgagggcgcagaggcacagugcggggccagcccaggggcgacccuugacucaggaggaccucagugguggagaggaggagcccaccccggggagggggcgcggagggaggggcuuggcugggcagcggggcggagggcgaagaaggcggcugcaggagggaggaggcccugcccgaggggaccaaugcggagaggggcggcggggugggccucgguggggcgggcucggcaggggggcgcccuccgggugggggaggggaggcggccgggagcuguccaaggugagcgcggaggggccggccgggcccggcgggaagggacgggggacgcccggcgaggggccccggagccacgcggggaagggcccggccccaaggcccgggaggcuggggccgggacaaaggagggacgcgcggcggggaggacggccggcugggggcugcgcagggacccccuccccgccccgggccgccuaccugggcccgcuggucccugcggcgccgcggccgcugcuccugcccgcuccgguguccgcuggcgccgccgccccccgcccgcccga

SEQ ID NO: 21476 - RNA, 10007 nt, Homo sapiens
ggaaaagucauaacaaagcucaaguguuuauuaagaauuaaaaauacuguaaauaagccauacaguucauuucacaguaaacuaaacaaaacuuuuuuuuuuuuuuuuuacuuuucggguuuuuuuuuuuuuuuuuuuuucaauuuuuuuuggaagggcaagacagccauuaaagaacaauacagcucagagggaagggagauacagcaaacaauuacacaaacgcaguaugcacgcuccuugccgacagggcugcccagacggcaaaccucuucauggacaucauguuaaaauaaaaggacuuggccugcauuccccagggagacccccuauuccacuguagacagcucuccucacgaauuuuuugaaagaacccaaggacuccccuuucugguagucgaaaccugugcauuccuuggugaccuccggagagagaacaugggccggcaguggggacagagggcaccgggacucugcuggguguagugcuucacauucagaaccgccuggaugcuuugcauaguuaccucugauaucacaagaugcgucaggaagagaaacgacacgcacaccaugagggaggcagcccucaagcagcggauuccuuucaaagaaagacccaggggcuucuccccuccucauucagagcugacagcuaugagcuuuaaccgguucaaaguggaagacaagugagagauaucucauaaaaauuucggccagaacaaaaaaaaaaguaaaauuaauuuuccuuaaagacaacuagaaagaaaaggguccccccaacccaccuuuuuuuuuuuuuuacuugaaaucugccagccagacaggauuucugagguuaaucugcuucuguuaauccucaauuuaagccuuuaucauuuuucucugacuagagacauccaugaaaagccaccuguuauucacaggggcugcgcuucaggaaaccaaccaaaugcagaagcagagaacuuaaauauuguaaauaaguuaacugggcaugaaaauacaaugccuugguguucagguggugacaacugcucuuuaagaggggacaagaaauugggggguaggggacacaugggaaaaaaccacacauuuuuuggucaugagaaauuggacuuuaaauccgcgcccugcacacgcaauucauuuagaccuuuucgugaaucuucuccacuuucacaaacaaccuauccagaucauuccucaggucaucuaguaaacccuuggcugauuccagauuguucucguugguuucuauuuugaccgaguaugcaaccaaacuguccacagcaguccugagcauuuucaaguccgccuccacuuggcugacugaggcuuucagguugucuagagaagaaagucuguccaggaaguccugaggaggcagacgggcggccugggcuugguccugacugagcagcgugugcaccugcuccugcaccuucuggagugauuccacggugcuggggagcucgcccacacuccucuucagcuccuccacgucaccguagagcaccagcugggucucgcccaggcuccucaccgugcuggccaggccauccuggucugccucugaggacccgaggccuuccaggcgccccugcagggcggccaggcgcugcucgugcuccuggcucuuggacaggagggacuccaggcucucggucuggcgcgcagaagccaccugcauggagagcaccccauccuccacgugcuggagccuggaguccagucccugacucuuuugcuggagugccucaaaggcuuccgagugucugaagccuccguccuccuucggcccgugggaaucggacuucagcuggcggagcucuuccuccagucuccggaucuccuccgggaggcgggagacggacuccucagaccugagaagcuucuccgugagggccugcagggcgagccgcuccgugucggccgccuccuugaaagccugcugcuccugcuugaggcucaccagcucgcggaccucgguguagaugucagacuccauagucugaaggguacuucucagggccuccaugucccacucucuggacuuggcugaggucuguaucuccuucacagcuuccuuuaaggcuuucaaauccugcuuguuccccucagauucuuccagggaggcaaccuuugccuucaugucauugaucuccuucuggcuccucuucuggacuucugugaagauggcgauguugucguugauggauuuggugagcuccgucagccgcuccuccaccguguucuccagggacgugaagucccgcucccgggcguccuucaccacauggaucccauccgagaggucuuugagaaucucauucuggaguuucugcagcacuucgcugauccggcugaccucacucuccccuugcuucacagcuuucucugugaggucuuguuuauguugggagcuucucaagauggacucaaaaguuccaaauguggcuugcaaagacugcaccuguaaucaaaauccagacguuaauugcugagaagagcugaugaguuucacaugauacaacuuuuuuugucugcccagccuccagguccuguuuuuuuccagaaugucaccacaauuuuccuuuggagaaacauccuuccacauauaguccauaugguuuuaaggaccaauccuaggguccccuccuagugcuccagggaugauuuauaacccaggccugacuaaucaggcugcacagcacaaugauuaauaaccuggaaauaaauggauuaauaaccauuaaagguggcacauggugccaccuuuaaugcuuuguugcaaaaaaaaaaaaaagaaaaaaaaagggaaaagacagaaaacaagaaccugacucuaucaaguccccaucaugcagaagagacaugucgugaggaugcaaucagccaaacccacaauguggaaaauucuacaggacaaagaaccaggaucuucaacaacuaaguggcauuuuaaaagaaggaaaagcaggaaacuuacagacugaaagaaauuuaggaaauuuuucaaucaaauauaauguguggaucuucuauagauccugauuugaacaaaccagcuguuaaaaagacaucuuugagcugggccuggugguguccaccugaagucccaacuacuugggaagcuaaggugacagguugccuugagcccaggagugccuugagccugggcaacagagugagguucugucucuaaaacaacaaaaaaauuaaaaaauaaauaaaauuuuuaaagccauuuuugaaauaaucaagaacugugauucuggacugggugucagaugacauucaaguaauacuguaaucuuuguuagguaugauaugcuguguucuguuaaaacaaacagggaaaggaguacaaagggaaggaaaggaaaggaacgcuuaucaguuggaaauaaauccuaaaaugcuuuggguaaacuaaaaaugucagccagggauucuuuuuuuuuuuuuuuuuuugagacggagucucgcucugucgcccaggcuggagugcaguggcgggaucucggcucacugcaagcuccgccucccggguucacgccauucuccugccucagccucccgaguagcugggacuacaggcgcccgccacuacgcccggcuaauuuuuuguauuuuuuaguagagacgggguuucaccguuuuagccgggauggucucgaucuccugaccucgugauccgcccgccucggccucccaaagugcugggauuacaggcgugagccaccgcgccuggccucauuuuaaaacuaauuccuaauucacuauccccuggaucugccaggacaacacaggcucuuuagaggcccuaaagcugaacugccaacauuuucugaagcccuggacccacuucugccuaguaaauuuucuggcuucaggacaggacaaccucucugccugugcuauggccaugcaacaccaacagcaucuggagaagaagggagaccaggcugggcacgcauagggcaagagagugguucacagucagacuucuaacuccagccaaaaaaaaaaaguggcagaggggaagagugccgauggaaugaaaaaagaauggcaaaacaucaguaauucuugaaacugagguucauuauauucuuuuuuuguuuacacuugaacacugccaugauaaaaaguuaaaaaauaaaacagcacggucucuggagccagacugccuagguucaaaucauaacuuuaacacuuuccagcagugugaucuuggggaaguuauuuagccuaucuguaccuugguuuccucagcugaaggaugggaaaacaguaccggacucauaugauugucuguaugaagauuaagugaauuaauaauauaucaaguacuuaaacugugcccagcacauagugaacacucaauacauggcagcuauuaucaucgugauuauuucccauuucuucugaagcaccugguaagucugcagauuccuagaaauauccucaacccaugccaaaaggcaggaggauaaacugaagugggaugugaacaacaucccucagcucucgugccagccccaccaguagccagcucuguaagcaugaagagucacauucacuuuccgagucccaggcuccucauccaauagcaaauaggucucuaaagugcugucuagcuccaucagucuguuuuaaggcagauuagaauaagguucucaggggcuccagaauacuagacaauuucccugcccaaccaaauacaaccugagucuuaaaggacacucugugaagguacuggagagagcccaucucugaaacuacguuauuaaaucacacugucugccuguucuaagcauagcacucagaacagaggugugagcaggugagcacaguaccuucaacauggcaggcuuucauccaguguuuuuugauggaaucacauaaugagggaauucaagcaaagccugaugagcugguccaugucuccucugaucccugucagcccugaccugcgcuggcucuucacaaaugguuaggaaggagacuagaacagaaauuauauccaacccccaacacuauaaaaaagaacaugguguuccccuacugaggggacuaugaguugugcaucuuuaugugcaaauaauucauuaucaucaauaugcauuggaaauaucuguucccccaacaaaugugggaugcccacuaagugguaggcaacaggcaagaugccagagaugaaauaauggcuaggauccuugcccucaagguuacacccuaggguggggggacuggguguuagcagugguugacauucaaccggacacuugugauggaccaauaacuauacaaaggacuucagacacaucaucucauuacacccucaccauaaucucaugaguugguaucucccagugaucuccauuuuacuaaugaggaaacugguaagugguaggcucaaacguuaaaaucccaaaaugcuugauuucagaaccugagcucucaaccaguaugugauaugcucaggcaggggcacugacuucaaagugcccugaguaccuggaagagagacugccaacuccugaagcccugacuccuuagccagagaaucuagacaagaaaacaaagaaauaugaccagggagcucacucuuccacaaauagguccuagucucauuaaacugucccuaccaggccuaagccuacuccuaccauugcuuuauaucacgcuggaucugccagggcaacacaggcucuucagagggccuagagaugaacugccaacacuuucugaagcccaggacccacuugugccugcugaauccucuggguaaggacaggccugccucucugccugugcuacagucauucagaagauuugagccauucuccaauaacaagaacaucuggagaacaagagacaggugggcacccaacuccagcuacacaacuuauggucugugugugaccuugaaugaguuacacagccaguccucagcugccccaucugcaaaaugguacuacuaaaugauaccugccucagaggguggcugggagaacagaaaucauggcuauaaagcauuuaauagcauggcugacccauagugaacaguaauuaugaauacuguaaguauacuucccugcuaugaaccaaacuccaccccccaacaaguaaccaagaguuauaaaaggguucaaacuuaggcugucagagaaccaaacacaacugguuccucaaugcaaaauaauuuauuuacuggccaccccaaagauacagacagaguggccacauucuauggcaaaucuaacacuguucuggccauguucugagucucaagucaauggaacauuuauugggcaccuacuauguacuaggcuaaauaguggagugguuaauaguguuccaggaguuagacaacaguuuggauccuagcccagccacuaacuagcuauaucaccgcucaguuacuuagccucucacuuuucucaucugucaaagagggcugauaauaguacuuaccucuugggguuguugugagagucagcagaugaugcauuuucaaaugcuuugcauagugccuggcacguaauaagugcaccauaaauaugacacauuaaauuauaguuugauuacacuacuaaauuaaaagaaaaguggucagccaggcgcaguggcucacaucuguaaucccagcacuuugagaggccaaggcaggaggacugcuugagcccaggaguuugagaccagccugagcaacacagcaagacccugucucuaccaaaaauuuuaaaaauaaauaaauagcuggacgugcuugugcaugccuguggucccagcuacuugugaggcugaggcaagaggaacacuugaggccaggaguucaaggcugcagugagcuaugaucacaccacuacgcuccagccuggugacagagugagacccugucucuacgaaauauaaaauaugaaauaaaaaacagagaagucacuauuucaauuauuuuagagccaugaggauucuuaaaagucuggauggagcccucuucucauugugugggugggaaaacugagccccaaagaagaaagugaucuauauacauagcugugauggagaaggggugagaagcaaaaagaagggacuaagugaggggcagggagaagcacagagaauuaaccuggauucaagaccuucccuauuuuggccucaacuuccaacccacccucucucacaauuuccuacaugugacucugccauuggcaggguagccaccuccucucucucaaacaugcucaaaauagugccccugccacgguguucaucacaguccuucucucaacauuuaucgaucaccagcuagauggcuggcacuacccuggccaccgggauacaggcgaaauuccacacccucccucuucugaacuuucacaggaguuacccucaacugacaccuccuuaugcgcugcacaagugauucgugucuuuugcuccuucauacccucccacaaagccuacacagagccaugcaacugucagacuuuaauaaauauuaugauugacuaguaaguaggaggaugaaagagaagaaacagaggcuagucauuauacuccagcaguaugucuauuuuuuaagaaugguuugacauucaggauaggcaaagcagcacugccuacuuaauucccuuagaaaagucaccucccuuggccugcagcguuuagcaggcugacucauuccaguugcucugccagucuuuuuuuuuuuuuuuuuuuuuuuugagacggagucucacucuguugccccggcuggggugcacuggcaggauuuccgcucacugcaaccuccaccucccggguucaagcaauucuccugccucaaccuccugaguagcugggacuacaggcaugugccaccacaccccgcuaauuuuuguauuuuuaguagacacaggguuucaccauguuggccaggcugcucucaaacuucugaccucaggugauccgcccgccucggccuccuacagugccgggauuacaggcgugagccaccacgcccggccgugcucugccagucuuaagaggaaauuccugguccugcacacucaacaaaagcagagagcaacuuggcaggacagacagcaugcugggaaaaggaggcaguggcuccgggaucagaaguggcgggauuuuuuguuucagucuugcaaccaacuuucauugagcaaugacauaguggagggcgaauaagaucaaaggggcuguacuugguauggaaaaaccacagaaggguggaagcuaagcaccuucgccuugagaguuggguccauccauaccugaaauggaccccuguggacccuugacgaacagggcaguggccuagacauucucgugugucugucacucaccagcuggggacuuugucaacucauuccucugucuaaaccucaauguucugcucugggaaaugaaaucaaaacuguuaguccucccucccaggguaguuauaagaauuagauaauaugugagugaguaagcauucuaaacaccauauaaauguggcuagaaguauuauucaccaguaugaucuaguauuuuuggcccuccucuuccccuaaagcggaaguagggccgggcgcaguggcucacgccuguaaucccagcacuuugggaggccgaggcaggcggaucacuugaggucagaaguucgagaccagccuggccaauacggugaaacuuugucucuacuacuaauaaaaaauuagcuggguaugguggcacaugucuguaaucccagcuacucaggaggcugaggcaggagaaucgcuggaaccugggaggcagagguugcagugagcugagaucguaccacugcacuccagccugggcgacagagccagacucccucucaaaagaaaacccaaaaaagcugaaguaggacuacgucaaaggcccaccugggcaggcugguccaauacaggacaagggaccuaaagauagaugguauuucauuuggaccugcaaaugaguaagaaugccagcuccgggucuauuaaaaaccccgcucggaugucucccacaggcagagcugagguggggccuugccugaggcuuccagggaugcgcuggcuucccuuccaaccuccuuuucagacagcucugcccauucagcgguuccuaaugcagaaagaaugggcuccccggagccugccggcuuccuuacaggucaccgcuaaugcccugugacaggcccuuggcccacccugccaggcgggccugggcauccucgcggcggcccaucccucggggccgauuccuccgcagccauuaacaaagggggucuggggacugccucggaacuagggggccgcguggagugggaugucuaggccagggcccgccaaggaggagcggccggcucccgccuccgggccugggcaggcagcgcuaggggccggucgggaagcacgaaggagcccggccguggguccggaggccgcagucgauggggacaguugcggggccggggguacccaccuucugcucgacgcccugcaagcccuggcccagcuccucccucugccgggagaaguccugguggcugcgccggaccugcuggaccuccuccaggacgugguggacgcaccagcccgagaaagcggccgccgccaccagggcgagguagaagagaaaguugagcgcccugccgagccugcgcgagcaggacgccgaggacgaggcggcggcggcggcagcggcggcggaggcggaggaggaggaggaggacuugccgccgccgccgccgccgccgcgguggccgcccuugccgugcgccugguucugcgggugcugcugcgggugcugcugcgggugcggcgcgggcggcggcggcggcugcugcggcgccggcggcggcuucuucgccacgucauccgcgccgcccgacgggugggcacccuucuccgaggggcucgcggcgccguggccgcccuuggagccccuuuguuuggccgagggcauggcgggcgcggcggcggcucgggccgcgg

SEQ ID NO: 21477 - RNA, 4971 nt, Homo sapiens
aguugugaacuuacacuuuauucauauauauuagauauugauaauuuuaacaaaugaguuacuuuccauuuggguacagucacaguugucaacaauauuuggaagcaccaggcaugaaaucuccugagaugcuauguuuucaucagggucaccugacacauucaaguucugucugacaugccauuaaagcacuggcucagauugcaggcauauuuucaaaccggcaguaacuggauaguaucacuucacuuauaaguguucauuguaucaucaagugaaauaaacacacaacccaugggaucuugcuuagguuggcugccuaguuggccccugagauaaagccuuguaaucacauagccuugccuaauuagucagaaaacaaaggauuaagugagacagucacaggauauaggaauuauaaauaauacauauauuaauagauauucauuuucauuacacaaaaguugcuauuauaaauacuuauuugauugaugagucuaaaaauauauuccccauauaaauaauguuaaauauuaauaaauagauuuagauuuaaaauucaaauauugcaggcaggacaaccauuacugggaugcucuucgaccucgaaacagcaucugacuccuuuuucgcuucccuguuuuagcugcuggcgacaguucagccaucacuuggaugaguucauguauugcuuugcguuggacauucaagucaguuaccuaucgggaaagaaaagagcaaaauuaauuucaggcauauaagccaucaggauauucugcuaaugucaugauggucagugaaaauaaaaguauuccuuuaaaaaauggaccguauuaccuuaauauacaauauuuacuucuucagcaguugaagcuaaaaauuacaauuacauuucuaguugugcuauaaugugguggaguccaucacauaucuuuaaaucuacuucuauagaauucuugaaauuauauagugaaaagacuccugguuguggagucagcauaaaaagguggguuugaaucucaugcaugcaauaauucugaccuugagccagcuacuuaaccucucugaacuucuauuuucucaucuaaaggaggaugagacuguuucuaugaccucucuaucaucaaucuaccaauuauaucacuuuauacuucagucuuuccuguaugcaucaaaugaguaacuauaggucaaugauucucacuguugugcauagcagauuaauccggaaaccugucaaagaccucagagauccaggugcaugaaguggaaggacugugcccugugcauucacuaagcuccccaggugauucugacauccaccuaaguuugagaaccacugaucuagguuagguacccuagaaaacaccaaauccaaaacgagugaaaacuguaauuuuuaauuucucccagauuaggucagucucucaauuuccauaauagauuuuaaaauaaacacccccaaucauauuuauauauggcuuacugauauauaaaguuuaaaauuaagaauugcaacaacuuuuccaguacccugccuucuaggcaagcaaauugaacuacuugcaucuccucacucuaaccaauagggccauuuagaugaugcuucauaaaauguggaccauuuaccuuccucuuggcucugccauuacauuuuuucuaaucuugggaacacuauggcuacucaccacauuucugaggauggcugggggauuacagcuaaagacuaauugucaaagggcauaacaugcauaaaauagcuuagcaacugagccaaagagaauaauaauuaauagagcucacucaagauugcccaucaagaaacaggagguuuguagcuuccagaaggaagaaaccacagauuuuuuuucauuuuuuuaaggcccaguuccugcagaguagaaaaaauuuucgacaagcuguguguuugcaagugacagauuuuacuuuccaauguucaaaucaucaccaagaaacuaagagacuuauccaggacugaacaguaagccaggggcaccacuggauuagaaacaagugcugagugucuaguuuauaaccaaaggagaccuguugccaugucucuccuuucuguuucugggggcuuacaugagaggagugagaggcaggcccagcaauagugaaagcugagcacauauccuaagaacacaaaugcuagcuugaagacccuggucccucucauuugagcccauuuauaucaaagucaaccccaaaggaaucuagaggccuuugucuucuagaaaacauuuugaaaaacaugauuugucuuuaugccucaacguuaucuuucuguuuauagaagccauaacuuaaagauacaaguucaugagguaagacuuaggagucuaaggaguucuccagcugagauauucugaaaguugauagagaguugauagaacaaucuuuucauaagguauaaauucuaucuauuuuucccuaaaaacaaacaaacagcaaccauucuugcuucuaauugggcaguacaaucugauagguuggcuagagacuugcaguggggugucccugguaccuauucaaagacuguagcuuucuucuaucucauucucauuuucuauucuuugcauuguagaguuuuggagcaaagaaggucaucaaacuuauacagugagccuaacaguuuccuuuuaagaugaggaaacugagccccagccagccaugugauucaucacaguuccuugguggcugaguugggaggagaacacacaucuucucagcuccucccacugcucuuuccauuaagacagacagccucucauucaaaguaagagaauuuccaucauaugagcaagggacaaugagagaacugcuucucaguacuccccgcuucuuccucaccuacuuccucuucacuggauuugucaacucaccugucuuuacgcaauaguuacaaugccagcauuucucuacauuacauacuucagcgauucucuuacuggcuuugcaaagucacccaaacacgaauggaaauaguaagguagaguuucagccaugaguugaguucauagcuuuagcaacuguuaaauagcuaaugucuacuuucuggagaauaaaugcuuugcaagacccucggcaaugaaaccaaagaaagaauuuaaauagccucaccgaauaauuagucagcuuuucgaagucaucucguuucuuuuuguugcuauugaaaaacuugacauucaugucuuccuugauggucuccacacucuuuuggaugcucuggucaucuuuaaaguuuuuaaaaaguuugaaguaaaaggagacaauuuggcucugcauuauuuuucugucacucuccuuggaaggaaagagcacaaacagaggaugaugugaauuuauccaucagaaagcaagcaacaggaaaauuagccaaaugggaauauucagcuuaccucuuuccaauucuucaaaaugccuaagaaaagaguuccauuauccgcuacaucugaaugaccugcauucuaaaaaaaaaaaaagaaaaaauugguuuacaauuagcccauaaauugccuuaaaaauauauuucaaguuucauugaacucagaugugacaauauucacugauuuccuuuucaacucuucugcuuaguucuaacaauaaguauucccaaaaggcuuaugugagauauagacaaagacuauuauguucuuuuagcuuuuuuauuucccaauauaaccauuaaauugcaaugucacaaaugagcucaacaaagcugauacuccaaaggucccaaaaacuauaguaagcuaaagaaaguauuuucaagcuaggcuaaaaaauacaaaaacaaaaaacagcaaagccaccccacuauaaaauacugccccccaaugguacagguuucuauuacaucuacugugccuuccuguaggguauuauuauacgagcuuuaaaagauaguuccaaacaugugcgagugugugugugugugugugugugugugugauuugauuuuguguuguaagaauaaaaucaauugugaaugucugaauauuauuaugacagcuauaauuauaacagcuaaguuuuaaacaaauaaugaaauauuuaaaauguaaaaacuuuucauuaaccaucaauaaaauuuuaaaagaaacucaaaaaauucacuuaaaauuuuuaaacauuccuuagccagaaucauaauucuuccaaaaucccagugagcaacgaaguuccggaauacuucacaaguaauauagauagagaagcagaauguugaaaucacuuuuuggagaaaaucaccuaucaguuauuuuuuuaagccaaagcuuuaaggaccuuuuugacuuuaauuuguaaacauuuccuauuaccuuuuuaaugcuaaucuugaccuuagagucugagaagucaaaaacuaauaaccaaucauuuuuuucaaucugcauacuccuugacuaucacaacugaaugaguucccaccacaaaauuauuaacaucauuaugcuucauacccauauuaugcccaucuuuuggaaaauucauaaaucccuuuuaagucucuauacaaacugagcagaagguuaaaacaauaucuagauuauuuagucaaggaacucaucuagucaauaauuaacaaaauaacaccaaaucucaaaaugacugccuacaagagaugacagccuaucagagaugcuacagcaagucgauauucagucauuuucaaccacaaacaaguacuauuaaaaagucauacuuacaaaauauuucuuaagguuuucugcuucuuuuacauauggguccuggcaguaacagccaagagaacccaaaacgaugcagagcugaaaagccaagauauaacuuguauauuucaucguuuccgagagaauuaagccaaagaaguugaaaucaguaguucuuguaucaagcugaucagguccaaaggacuuaacugaucuuucucuucuaauagcugaucuucagaugaucagaacaaug

SEQ ID NO: 21478 - RNA, 4709 nt, Homo sapiens
agcgcuuucuuucgcgagcacccugaaccagaccaugacccagacccucaaguacgccuccagaguguuccaucgcguccgcugggcgcccgaguugggcgccucccuaggcuaccgagaguaccacucagcacgccggagcuuggcagacaucccaggccccucuacgcccagcuuucuggccgaacuuuucugcaagggggggcugucgaggcuacacgagcugcagguaggaagggacgccuuucccgagacagagugcuggggaaacugguuuugacagcgucagaaaggacugacuagugcagagcaaaugugggacagccagagagaacggaugcccaugaaauaaggaaaaggcgaguugaggcugggggcgguguggcuacacucgggcagagcccgucccgacucuuagcagagggcgcugcgaaagcgccuucucgcuguccugagguguggagauccugcagauaaaguacaagugcgcgggagggggaggccggagugggcaguacccuccgccugcuugcggcuuaaagcuacauggguuccuuuucauucacugaggacucguccugagauggacaguccagacauggaacuuuuagagauuucuccucgaccgagaugaucagagagguccugaaugucugccuugcacaaaguuccgguuuugcccaucacacucaaacuuucuagggaugggaaaugagagaggaggaguuugcaguaucaaaggcauacacuaguugggcacccgagaaagagcagaagcucccuauucccaagcccagucaacgcccuuggcgugggcacaggucaagcugaaaguccccgcccagguauccaaguguccgcuguguccgcucccccaggugcagggcgccgcgcacuucgggccgguguggcuagccagcuuugggacagugcgcaccguguacguggcugccccugcacucgucgaggagcugcugcgacaggagggaccccggcccgagcgcugcagcuucucgcccuggacggagcaccgccgcugccgccagcgggcuugcggacugcucacugcgugagucuucucugcccccagaagcccagacgcccugcagcggcccucuccugcugcgggucccgaaacuaucaaucugggggcauggugggaggucggcugucccacucuaccauugggcaucuugggguucccaucccagucugcuucacccacacucagguugagccccaaccucacuccccgccuaccuccuuauccuuugaggcccgaauccugggaacugggggaaccggaggaauugggcuaggguacaaggaucuggauggaaugaauguaagguucugugacucaaguuacccgggaaccccggccccugagggcaggaaaugaguaaagaggaagggggcuggaagacaggcgcaggccggugcagguuuccguaccccaagggggcagacgcaaucccucuccuggccaccgcagccgaacgcgcuccuucacugcagccagucccgucgagccguccccaccuucccgaugcgcacucucuccucaacccugcagggaaggcgaagaauggcaaaggcuccgcagucuccuggccccgcuccuccuccggccucaagcggccgcccgcuacgccggaacccugaacaacguagucugcgaccuugugcggcgucugaggcgccagcggggacguggcacggggccgcccgcccugguucgggacguggcgggggaauuuuacaaguucggacuggaaggugagucccaggacagagcugggcaggcgucgggggcgcccuaccagagccucccggaacccugacggcgcccccucccgacaaggcaucgccgcgguucugcucggcucgcgcuugggcugccuggaggcucaagugccacccgacacggagaccuucauccgcgcugugggcucgguguuuguguccacgcuguugaccauggcgaugccccacuggcugcgccaccuugugccugggcccuggggccgccucugccgagacugggaccagauguuugcauuugguaaggcacaggucgagguggaaaugggggaauguaaagcuguccagggguagcgagguauucacgugccuucuacccacgcagcucagaggcacguggagcggcgagaggcagaggcagccaugaggaacggaggacagcccgagaaggaccuggagucuggggcgcaccugacccacuuccuguuccgggaagaguugccugcccaguccauccugggaaaugugacagaguugcuauuggcgggaguggacacggugagguucucccuccgugcugugagccgguuccagggcuuagccuccgcagacuccggcuccauuuuucuguugcaggggauccauuauggccacguagaccagcuuggcuuagcacccuguagccccagacucuuccauaaucugcacccucugcuggguucucacacccaacaccucucuugcuuucacauguuuuucagguguccaacacgcucucuugggcucuguaugagcucucccggcaccccgaaguccagacagcacuccacucagagaucacagcugcccugagcccuggcuccagugccuaccccucagccacuguucugucccagcugccccugcugaaggcgguggucaaggaagugcuaaggugagggggaaggagaggaggaacaagaggaaaugccaaggaagggcuggggaagcaacuaguggauggaagcagggagauagcagagaaaaauggcccucuacuccuggccaaaaaggguuuggaaguuggaaacaaugagaagggggcugcagccccuagccucaucuuguugucuccauuuugugcuuugcaaccuagacuguacccugugguaccuggaaauucucgugucccagacaaagacauucaugugggugacuauauuauccccaaaaaugugaguaaagccuaugcacccuuucuacugagccauuccucacuaucuugggccccaacccuguucucaaacacucuccuaaaagcccuucaaacacuccccuugaccccucucuaggauaugccuuucuaggauguaauggaacaguggggagauccuuccaaaaguagccccagaaaacuuccccaucacccaccaggaccugccuuugucccugucugaauauccucuucuucaugccugcccuauucugagcccaaacugacaaguuuguuuuccuuugcaccagacgcuggucacucugugucacuaugccacuucaagggacccugcccaguucccagagccaaauucuuuucguccagcucgcuggcugggggagggucccaccccccacccauuugcaucucuucccuuuggcuuuggcaagcgcagcuguauggggagacgccuggcagagcuugaauugcaaauggcuuuggcccaggugagugcucuagauuuuauaccuuccccagacuggagagacccuaacccucuaaaguugugagcucuuuccccugacaagcauaggaaaucauauaagaccugguagaaugaaucuucugaaauaugauaagcccauuauaggccuggaguguaagugaggguauucaaacuauuuuuucccuaccauaaucccucacccuuauuaaccaagaaguccccuacuggccacaggugccacccaaucauugaccauucuaacacuaauaaugcaugcccuuuaccaauuggauuaccaaugaauccccccauuauagauaucuuucauaguaaugcucaccuucuucccuuuccagauccuaacacauuuugaggugcagccugagccaggugcggccccaguuagacccaagacccggacuguccugguaccugaaaggagcaucaaccuacaguuuuuggacagauagucccauggaaagagacugucaucaucacccuuucauucaucauagggauaagauuuuuuguaggcacaagaccaagguauacaucuuccccuaaugccuaucugaccaaacuggauagaaccaccauagugaagugugaggcggcccugaccaaugugugaaguaugcacuuggccugacucaggaagccaggugagaaaaccauggucucucugcuugcuuggcccuucugaucauguaugcaucccccaaggaugaaaucagauuuuaacuaauaaugcuggauggccugaggaaagauucaacugccucucuuuuugggcuuucauaguguucauugaugcugcuggcuaagcauuuaucaaagcauaagcucaguaacugugcaucuggucuguaccugguugguccuucgucuuugcauguaagcucuuugagaggaagggugaagccuuauuuguuuuuuauguccccugccagggccugucucugacuaggugucaccauacacauucuuagauugaaucugaaccauguggcagaagggauaagcagcuuacuuaguaggcucugucuacccccuuccuucuuugucuugccccuaggaaggugaaucugcccuagccugguuuacgguuucuuauaacucuccuuugcucucuggccacuauuaaguggguuugccccaucacuuaguucucaggcagagacaucuuugggccugucccugcccaggccucuggcuuuuuauauugaaaauuuuuaaauauucaca

SEQ ID NO: 21479 - RNA, 4230 nt, Homo sapiens
uuuguuaaaaauaauuguucuuuuauuucuuuggaaaguagugggcccugcccuauggauuuucaggucaaacuaggguaaugaaugcuccccuagucuuugggcuggagcacuauggucccagcuuucccagggcccagaagcaauuccuguauuguccaacccaagcaacuaggacccaaauugucugaaggcuccuaucaggccuucucuccugaccacccacuucccaaucuuuccuggcuuucccucugggcaggguauuuuuuucuucuaaaaccagugcuggaaccugugcugugcagaagagaggacaagacgagggauguucccaaauucccauaagaggacacagccccucagucaguccuuccucucugcuggcuucagucugcacuccucugcaagcccccacugugaggcuugaagauggacaagaggacccucauaaaagggaggugagagaaaacacaccaucccaaccccuccucaggacauacuccuuguagucucuuguccuaguucucaagggagcccuucagacagggauggggaaggcuaggugagugggcaagggcccccugaccccagcccugcgaggcuauaccaggggaguguccauuagccccaucaguguggcauggccgugaugcgcaugcucugggaagcgauaggguaagucaccaugggaguggugguguggcucauugugauuccugccaaggguugggccaucgauacagccacaggggccacaggagccacagauacagccacaggagccauggagacagguggaggugccauucccugggcaauuguuugagccagggcagcugacaguggcgugaucucuggggucaagugugggggugggggugguggagcagcaggaggugcagcauuaguugggggagcagcuggagcuccagcaggggccaccaguucuugcugggacacuggacgaggcuguagagccuggcugcugagaguagugugagucugggcaaugccaugguuaaaaguggcaacagugcccacagugggggccagagucugcucagucgcuggugcaguggagcucaggguuaugaccuuggccugauugcggaacugagcauuuuguuccaguaguaccucauugguggccagcagguugcugaccugcuucuuuaacuccucuacccgcuuccugagcauggcauucuccuccucuagcagucugcacuccaccccucgcgguggagccaaacuauauucauaugacucaaaaugagggccaucaggggggcagcauccaccucgccggcguuuugggccuggcucaugguccucaaagccccugucaggaaggucauagauaucauagagaucaugacgucguccugggaggacugagccuguugagcccccaccagugccuccuccaccccgagcaucaaacucaaaaucccguugcaggugacggaacuugcacuuggcuccucucugacagucacccuugagaaagucacggcagauagggaccuccuccuugccauuugguaggucagccggugaaaggccaaggccagcugcuacuuucugccucagccgugggggaagcucuccugucuucuuauagccauccucauccuccuuggagccauggaugaaacggcaauuugggcggcuacacuccuuguucuggaagucauggcagaagaugaacucguuuuugcucacccccaaguuggacaccucgcucaugucuggguggcgauaucggcaacgcuugccucgcuugcacacauuccucaagaagucucuacagauggcaucugagcuggccccgccacugccuaccccugccccacuggccuccucgcugccaccaccuccagggccuccaccgcugcucccgguaccguuggcauagcugucccggucaggcauccuggucccgcccaacucaggguuuucuuuaucuugccacucuuggugaccacuacaaaagaggagaacuguaucaaacaggaguccuccagggagaucccacucuuccugacuauaaagcagguggcccagaggggcaauggcuuuagagauggagaaucuaagggauaagaauucuggcugaaaugucugacucaucaaaagccccucccaggguuuugugcaccuggucugggucagaaugauucacacuugccuggcuaacggaggagggauaggcccaggacggagcagggaaaaaauaguguuggaauucaucuuuccuuuugagcugaccuuauuaaaguuguggaagugaaauuaaaacugcagucaguaucugaauagucuggaaggaaacugggaauagugcccaagaugggcuacugagcuacuagggcuguagaagaugggacacugguaacaaaacuuccuuaacccccuuuccuuuuccucagguaagggcucuguacacaucaaaucucuagaagccaagaaauccugggugaagagacuggugucaccagcuugaggggagucucaaaaccugucauauuuuaguauucccucccagccaucaucacugucaacggcagagagguaagccccuucuauuucaggauaggaguucuaaguuagagucuccacuucuagauuuccuaggacaaaccauuugugauaaggucaagugggaaggaguuaauuucacaggaacaagugaccuuuccccauuccccacccccuuccuacuccccuaugugaagaucccacugacauccaaccacaccauuccucaacccagaaagauccucuuuauuuauagacuccauaaaagcuuuuuaagucuccuauuucccaagagagcuuuggaaugucaguccacugcccugguucuagcccuccccucucuccacccccaguaagaccuggagucccugcuaccacgugucugaccucccaagccuuuccuaugcgguguucaggcucccccugcugcugaaauaggaaaacuucauauuguucccuuugagaauaagggaaucuuuccuaauuccuuuggccuugaccuacccccaccccacuacugugacuuugccuucagaucucccuaaaaugaacuaaccaaaccagaggccagaguuacaagagaaucuguaagaggguccuccuccucuaaagagagguagucccagaauaauagaagcaaucaaggaaagaagugguaaaagaagauacaaacuuuuaguaaaggggaaugaccaggugaaguacaaaugccaucuauccaagccuggcucacguugcaagucgcaccagcagcagauaauuaguuaugaugcuccuccccaccccacucucccagaauugauaccugagguagcucaggugaaguccggggcuccugugggucuccaccuccacaucacugcuggguucugagcaggaaaaaaacagagacuuggguggaagaaggaguaagaguggaggacuauggggugguugucacaagaaaucugacaaaacggcaaagcuucgagaacgugaggauuuccucaggguucaaacugaacuucaccuguccaagggagaaguugccaguaagaagaguaaaacuaauucggagggacugggaggagggguuggaaaaccagcccugagugaacaaagagugcggggcgcccugccucaagaugaaagaggaugugagggucagagcaccgccaagggcuggaguuaguaauggcuagugaggaaccucaaaaaggcagcgucugacagugcauugggauggccgauuagacuugaaggcagugauugugacgcuucccaacacccuagaguuugcgaaagaaguccuaggaguuuucccgcagcaagucuucuagcuuggcagguuccgugcagugccgccggcgcucagccgugggcuacgugaaugggacacuaagggcgcgcgaagugaagcggggagcuggagcuccaggugucaucaagcugaggggaugggcaggguugugacgucacgaagcuggcguuugcucgcgaugcggggucacucagaaaaggggcacugcccuggggugugaggacgagccagcucgguucuggggggccuucuguggccuggccgagcccagccgcugggccggccccgacuccuccccuccgggcgcggccuccaccuaagucucccgccucccucaccugccgccgccgccguaguugcugcugccgccugccgguccucuagcuucg

SEQ ID NO: 21480 - RNA, 17015 nt, Homo sapiens
cggggugaggagccgacuccagagaagauccagcaggagagggaagcagagggggccuggcccggaagacgauggugucccacugaagaccuggcaaaccuuccagauccggagcggcgugugcaggcacagaccacgguaggcuucucccaggggcagggccggggguagaggccagccuccaaauuuauccuccaccaaagcaaauaucacucacucccuugugggucagggggagaucugguggcccacacacgcuccaggccucaguuuccccuucuaugcaauggacauggugagauaagccccgaacaucucucugaggauguugaggcuaagcaggagagaacggaugcgaaagugucauguggacaugugaggguuuaaagagcaucaaaggguuaaagggcagaggagagagcucuggacaugguggcuggaaggaggccuggauuugaauccuggcuguuugggacccuggaggggucagucaucugggaguuuugaguccuggauucccaagggacccucaaguucucuuuuccccagagcaguacaggggacccagcccaugaagaccucgguuuccuucugauggagaggugguuccuguauaggaggcuccagcguguguggucagucaaguucaaggccccugugcuuuuggccuugggccagugcaggacuugacugcacugugccucacucacuguguaaaauggaucuaauuaugggaucacuguggcgagaaaggaaaaauauagguaaaauccuugcacagagccuggcaugagagggaaaggggcucgaccccaaucuugcuaucagcaacucccgagaccuggggagaggcuuccgaggggauagggaaacugucuccggggugggccaguccugggucuggaugcugggguucccuggcacgcuggggcaggguggggaccugggcucugccccacgugucccugguuuacuugguuuacuuuaccucugugggucuuaauugucuccucuguaaaacggugauuguaauucccauuuggaagaauugucaugaggaccuguaaaugggggcuggggagagaggacguccuggaagucugagggaagugggacgcggcagcagggccaggagagaaauucuucucccccuuccuccucuuccuccucccagaggcuccgccaggcagaggcacgugguccuggcacccccuuguggccgguccucagggcuuccccaggaggugcuggacauggcauaggcuccuccaagacccccucaguggugcccccuucuccagccuuggccuguaucugcccacucuccauucugagucucaggcaucccggcucacuuccucaaauccccaaaugccaucccgccuagcucuaggggaggccccggcugcaggcuggccuggggcuggcggggccguggccgcagggccugcugcccgcugggcaguggggggcgcugcagcccgugguuuggagccgggcuaggugauugggugucuuucauaugcuggucugggagcccuggaccuggacucuccccuagcccugggcccagcuuuccuggggaccugggucucucucucuaucccccaccacugcuccccacaagccacucuucagauaaccuuuucuuuuucucuuuucuuucuuucuuuuuuuucccucuuuuuuuuuuuuuuuuuuugagacggagugcaauggugugaucucagcucaccgcaaccuccaccuccuggguucaagcgauucuccugccucagccucccgaguagcugagauuacaggcauguaccaccaugcccagcuaauuuuguauuuuuaguagagaugggguuucuccauguuggucaggcuggucucgaacucccaaccucaggugaucugcccaccucggcuucccaaagugcugggauuacaggcgugagccaccgugcccggccccaaagaaccuuuucuagacacuuugggacucauggacuuaucuagaaagggaaacugagacucugagaagcuuccuucuggaauucucacaagcaaaucaggacugaaacccaggguuccuagcucucugucugggaguucaagagaggccacuaguccacauacuacugggaaugugccacuaauuugcuguguggccuuggaaaagcgacuuccccucucugggccccacagcuaagauaauaucaauaacacagccuggugcaguggcucaugccuguaaucccagcacuuugggaggcugaggcaggaggauugcuugagcgggggugauugaggcugcagugagcuaugguggcacuacugcacuccagccugggcaacagaaugagacccugucucaaacaauagcaauaucaauaaccaagccauguuuuccaugcuggccagccuuugcagaggacauugcugaccucacagguugacaacacuguuaccccauuuuguggacguuggaacugaggccugagcgaugaggccaccugcccgaggcugcacaguucguaaguggccaaggugggccuggaccuggggucuggcugauuccagagcccacuuagccuccuccccuccacggcgcagccucaucucuucuccgagcuuuuccuuuaccaaguggggaugcugaggccagcaggggccaagaugggcccuaagucccccacccccacccggcagguggggguggcacaggccacuguccucccucugcaggggucuccugcugccagcccucuggcuaggguggacuuuggggagaccucaacagcugagagguucacagagaagcuggcucucuggacagcccaccaugaaugacaccaggccggggcguuggucccacccagaaagggaggagauggaaacaggguccagggguggggugggggcagaggcucggcugggcagaagaucagagcgggauugugucaugcaguccuguggcuuaucagccacugggcggccugguccaggcaggaggggcugccuggggagugacucuguggggacccccccugggccuggcugcucagaccacaccugggccucccggguccuguuuuagggaggcuggggguagggggcugggguggagaccuggcuccauuacacacugugugaccugggacaaaucauuccacucugugagccucaguuuccgagucugucaaaugaaguuuaaaaugccucccucagagaaugcggguuaggguuugagcccauagcggguucuggugagcacuugguaaugcuugguuuuguggggagggggugggagagaggcuuaugaaagccuugggggccugugccccaagaagggcacuacuccgggcugggaggguccuggaggucuagggggacccaagggugcaggacuggugggggacagguauuacgaccccguugcaagacacagagggaagccuggccccuccaaucccagguuccaccagcggcucccccacccggccccaucccuccccucaccccaggaagcucacucuuccuucucuucccagggaagaggauaguccaaccucagccaggucucaccccuccauccuccccacccagugggaugggaccacuuuauucuuuccaugucaucacugucgccagaccggaggcucccaucacccucccacccacaauccucagaacaauccucaggcuccccugggugcugggucgggucaggguggccccagugagcuuggcugggggaggggaaggagaggaggccaggcccacaccucugcacggccaguuucaggcugaauagguccucgggcugcuuccuguucuguuuauggccucugaguccaggaaaucauugagugacacgucccuccuuuaccccccagccccaugauuauuuaauaggggccgcuguggucucucucuuuuggaaaauccagugggagaagaaagcugucagcucgccucugacaucagcuuugucccugugccaagagucaggguggccagggcguuguggagcggggggcuggggcgggguagggaggaagccagcugcugguggccccugugacgugaggcugccacaugguucccaggggcgggggcuggagggugaggagcagggauuguuggagacacacgccggggcacacgcaggccuggaggcucagaaacgcaugcgugcacgcccaggguuaggccuccccccucuccgagccgucgugcccagggauccacaguccuacacaaacucaugcagacacaaggccagacacacagucgcacuggcuucaugcccaugggcacacgcgcacgcgugcgcacacacacagacucacacaaccacacggagaacucacaauagcagccagagaugugcaccgucuagcucgcugucacacaaagcaaacaguacaagcagauccacacacaugcacacacaugcauacaccacacaugcacacacgggaccagacacaggcaugcacagacacagaggcacucacuacacacacaugcucaggcaaaugcccacucagacucagacaaagagacucagccaugucccagggccacagggagcccaagugugcacccucuacugcaggcuguggcucuuggccucaggcugcccugggaagguggcuguggccacuuccucuucccgcacccuguggugaggaugaaagacucccugguggaguacgaaagaaaggccugugacuguccugggcuccacccaggugggacggggcagggcagagagcccagggguccgaggcugcggaagggaguggacagugagagguugggcucuggaaggccuuugucacggcauggcacagggugccgccagguuccccacguugagcaccugcucagccccaccccgcccuacccugcggcaccucuggcccauuccugagcuggaagggaagucaggagccccgugagacacugcugagugaccuugggcaagucacuccucagccccucugggccugcuuucaacaucgauaccaguggcuugcaaauguuuuugacugccacccacaguaagaaauacauugcaccuugcaaccagaugaggaugcagauacugacauacagacaaccggaaaaaaaguuucauggagcaauccucgcccuggcucugggcgaugccaggugauuucgcuauuccuuuuugaaaguguugguggcaacccucuaauugaauucaugacccacgaagaggcagaggccugcagugugaaaacacugcucucucuauaucugccugcaguggucucaggcuaguucgagauucagggagagccugggggagguaaaagugcuugcagagucucaaaggccaugcucacuaaaugcugauggcugggguagacagcaacccauucuacagagcccugggggggaccggccccacgcaacgccacggccaggccucuggcuggcccugccaaugaucaggggcugcugcuucccuugcaauuucuaucagaaaugaagaaaaaaaaugcagucacucugauucaucuccaggggguugauuccugacacagucggucgggaaaugucgggugaugaugggagcaguuggcagaaguccaggguggcuucuggcuucuccuuggcccugaggggauacugcuggucgcugccagagacuggauccgguaagggugagaaggggcaggagauagguccagcgucuggaccucaagagcccccagaagacagcugggcucuccagggcccagagaugggggaaguacugcuuauguccccccacaagguucugagaugcuacccacucucccaaaacccacaccaggcuccaugaacuaagcggacccaggagccaccuccugcccugacucucggacuccagugugcugaccaugggacccagcccuaacccaagccccugacucggucuggaguuugagcuccuucugcggccacaaccagaucuuauuagaagggcugccauguguuagacguuuauccgcauuucccaagaaacauccccaugauggccccacgaggcuguuaugacagcauccucauuugcagaggggaaaccgaggguaugagaaaggaagcccguugucccgggccacauagcugguuguuggggcaggagggauuugaacccacaccacuggggugagaacaguggaggcacgguccgcugguggcaucacacucucacuccucaagcauugaagagugcggugcucuugccuuuuuggccaggaugcccaauuggcugggcugugcccggcauuccugagcuucaccaucuccucuggccacuccucaccagcccugagccugggacccacccucuggccccccgcuuccuuccuaggcccaccugagggcucugcucauuuuccagguaccagggccagaggggauggggaaggaaggagggaggccagccugggcagccgggggugcccggagcgcuguuucugggucgcuggucuuggggaauuccccaaugcccggagagcugcuuaccuggugaguaacugcugcuggcugcccacacagaaugccugacugugaagggaccucccaucucaccccugcccaugccacugacaugcugcccucucuccugagagccccaggguccaggaaagagacagacaggcagggggcuggcccccacccccgcaucccccccccaaccccggggcuuugcagggggcggcuggugauucaagccccucagagcugaguuugucuccuuccuucucacauggggccugggggugaaucagcuucugggggcgguaaggccaggucagcugcuguccucagaucaggcuugggguggggguggugaggggccaggaagggggcucugggggagugagcacacugcccugccagcccccucccacaaccugucugauuuaucuggggcacccuugaagcuggaggcuacguggguaucuugccucaauuuaccaucagcagaggcuugagaggucuugcuccugcccagccuuccccgcucagcacccuggcauggacccaaguuuccccaucugucaaaugaaccccugcuucacagggaggucagcacaaugggugaugauaugcagacagguggcuugcugggugcccagaaccaugcugagcccugagcccucacagcagacccacaaaggcgguaccauuauucccauuuuauaguugaagaaacugaggccaggaggugguagucccuuccccaaagucacucagcucauaacuggcagagccaaaccuccaaccugguugugaaugaggccagaguccauucuucaaaccuucaggccucuccaucuccuuuccacaagagaguuggcacugacaguuuuuggaaacuauaaaaugcuuucucaaaaaauacuuaaccucuauucaugucagaguauagcccugagccaggugcugucuagagcacaagugagucucagaccccauucaaacucucaaagguugaggaauaagacucauccccacuugaaacacgagcaggcaggacauggccgaugugagcuggucggggccaugggaggcaggggaggcuuccuggaggaaggcgacccgagcacuccugccaugcccuucgcccucucagagcaagaggugcugcagggauuguuguggccugcaagacagaagccccgguuccagaccuggcucuguuauuaacucuuuaugugagccccacauaguuaucuucaccucucugagccucaauuuccccaucuggaaaauaagcagcugugauaucccaggagagacuuguggaugggggguaacaaucagcagaagacgagcagcuggguagcugcacgugcuagagggugcacucccuuccuggagagcagugauggguuggauggcacagccaccuggagacagcacuccuggguucuggccuaguaaccucugcucaaugucagggggucccauguggccgggacugucccgcucacccugagaccggucaaauccccagcaggccccaucugcaggagcaggacaggcuguggaugaagucacagcuggaaggggccaagccggggcugccacuccaggguggggccuggggucgugacccugggagccggcagccaagaagggagggugccuuccaugagggagccggccgggggcggggaacacacacacacagcauagagagggagggaagaaaacaaacucccagagaccaaagugggccuggagcguagccugggcggcugauuccugggggccgcagccacguugcaggcggcacacggacuugcggcuccgagacccugcccagccuucccuccagaggcccagagcagguggugccuggacauggacaggagggggaggcugggccuggggcgccgaggggcccagagcacuuggggagcacaaaccaagucagguaccgugagaggaggggaaacugaggcacuggaggggccagucagggcugggguuaaggggccuuagugucagugucuucuagacccuguccucacuuccuguuuccugugggguggggcugagauuaaacagcgauuggggguggauuauagggcugauguggggucuggcuugccagaaggcaugcaagggccuggggguccgcuuggaaggaugcaggggagacugggcagaaugguagauguaggggcagcugcagaacucuugagccuaaugagagacucaggccgggcgacggggguuugauggguggaggccacagugagccccuggucacauggauuugggguccaugucaggagagccaggcugagucagguggcaggggucugggugaugugggaugggacuggggacugguccagagcucacgugcucugaguggucagguccuugugcaggagaugcugggggagguguaagaagaaggguugagcugggguguccugggaugugggguuaccugagccaggccagggcaggugagucuccuaguaguguacgcugaccccagagcaaguguauaggagcaguaagugccaaguggggcccuccauggucccucaaagaagagacaagguguggggugagaggcaggaaggaggaaggagagccaguucgggaagugccagcugggaugggcaguuuuaucaccucacauccgaggcccugcugggagagaauggggggcaagagcguagauaaagcagggugugugugugguggggaacggcagcaggcaccagggcucguccuggcacgaugaaggaggaacccguggcugggcaggucugggauguggcaagaggcaggaacugggggcauggaggaugggcgagggggcggugggggcccgggcgaggcugcaagagcucccuggccuuggaaaaccaacucacacaccuugaucucaggucagggucaggcggaagggcugggaaggggccacaggggacuaaaucaucuccugguacuggggguccccuggcagcuuuagggacggcauggccccagacgcguggccaugcugucuggccggcauucccgcaucucauaggguguauuuauuuucacuuuucuguugcauuucuuggaggugucccugugcucauuuugcccggcuccccacugcuccuuucugcccuuccucauucacaaaucgccuggccucagaagacgccagaacaugugacacugccuuagagccucuagaagcacuuuuuggggaccuccaucauucucugaggcugggcucaaaggggcuuccaaggcaggucuggaagggaccagccacuucucaguuuccccaaccaucaaucagcacccggaggaggaaacugggguacgauuucgccaagccucucucaguccugcuucagaauggaaaugcuggaccgccuucccagaagcaccuucccagagugucccgacagaacugagucagucaccccuacccccaugucuuccuagccccuuccccagccucacagguacaguggucagcagggcgagugcacugguggugucuggaggccugacccucuggggcccugggcaacguguuccccucggagccccuuggggcccaguggcaaugugcagauuggaggaggcuaccucugggguggcuuccagcgcccauguucaguuccacuuuaugaccgucuaaaguccacgccggccccggccccuccuccuggagccuccuucucagccaagcccuagcccuccuccucccacugccccccuaaagccccccaaccagggggcacaggggccagucuccaucugcuaguccagacucgcuaccuccccaaacccaggugagucagggccgucuggggcgcccacugcugggaccccugcugacucggccaggggcccccuccuggcgaugcccaucuucagacaacucccgggacaagccaggcaggaaaaccacagggcguuuugucgaaggcuucauuauaauuuuaucaaucaaauucuuagaagagggaaaaagucuguucuccccacccuccccccucacucguccccccccuucacucucacuuucuuccauucauaauuuccuaugaugcaccucaaacaacuuccuggacuggggaucccggcuaaauauagcuguuucugucuuacaacacaggcuccaguauauaaaucaggcaaauuccccauuugagcaugaaccucugaaaacugccggcaucugagguuuccuccaaggcccucugaagugcagcccauaaugaaggucuuggcggcagguaaauacacccgccccgcgccggcuucgcguccccgcugcggggcgcggcggcaacuuggggcgcuuggcagcgcgagccggacgcccacccgccgcagacacacgaacacuuggggcgcccgcgcagccaccggaggcgcuggguggcggcccggagcgagcgcgggcacauggucccaagcaccgcacgccccgcggcagguuggcggcgagggagggggcgccgagccuuccuccuccuccucuucuucccccucuccuucuccuccuccuccuccucgcuccggacacucgcuggcugcucuucccucugcgcuuucucccagauucacucucccucucucuuuuucuuuucuuucuuucuuuccgcuuucuccuuuccaaccgcggucccgggcugcucccagggaggggcgcgggcggcgagcagcuugcaaacuccggccugggacgggagcaggugccgccuccaucugcuggugucuggaagcguguggucugcgcuaggugagauauagggguguggccccccucccgcagccaccccggggccucagcacugccuugggaugcugggacgaacaggggacccaggagaagugaacuugaggaggccccuguccccgcuguuccagcaugggggauccgggggaggucuccagccucacucgcccgcugaccccggcccccaccaucuucaggugcccuucugcagagcccuggaaaagcgucuaagggggccuggggggagucgggagaacaggccccccugggggaggggcaaaccaggacaugucgggacagcucccagcucuccugucaccuuucacuuuccuuccuccccgcccacccgacugccuaugaccuuuugccuuuucucucuccuggugcaccauuuccucucccucccugagccgguguguguguguuaggagggaggggaaccccugggacaagggacagcggaugagucgggagaaggcauggagucaggggcuguccggagcugggggaacagagaguuuugaaugaugauuuggggauggagaguggggacagccaggcagaaauggggugagcuugagugagauaggggacacuagggaaggaagagauagaggaugaugggggcgggggcagaauugggggcaauuggcccagggagccagaaucaaguggcagguuugggagggagaugagggucaaccgaggacuccuccccacucccccaugccccguggcccccaugggugccuggcuucggagauuugggcugcaaugggccagugagugggaagcgcugcugaggaaccugggccaccacgggaggugggaagagaggggucuccuuucuccuggugccugcugggccuggggccuggugccuuccagccagagggccagggggccuuaggaccuuugccuuccugagggaaagggugggauggcugggagucucuccuggacccugcacccuuuggguggaaauggcuugugucuugcccucaucuuuacgucaucccagaagagagcagggagaacuaagguagagaaagggagacagagaaacacacgcagugacagagugaagacuaggccccaggaagacagcugcagguggugagggggaaccaggaguccucucccaugcggccauuguuggacccccauccggugugccaugaccccaggccacccuuuccugccuuucuacucauggcuucuuccugacuguccccaggaguugugccccugcuguugguucugcacuggaaacauggggcggggagcccccuccccaucaccccugucaacgccaccugugccauacgccacccaugucacaacaaccucaugaaccagaucaggagccaacuggcacagcucaauggcagugccaaugcccucuuuauucucuauguaaguuaccccugggauacugacaggagauggcagggagggggcuuguaaauaucauuaggggcuguccugaucuggguugaggggaccuuuuggggcuggaaggagagaauggggagagggcuugauuaaaccacccccagacucccgccacuuccugcccaagcuuccccagggaagcuuccccagggugcccaguuagcaaggggagaacugagugcaaagguggggaccuggcacuucuuaucuugugauuguccugcugcagggagcgagggauggaggggaaaugggcgugaggcaccagggagaugcgguugagaggcagugggcugugggugcugggcauggaggggcgucccggaacauugugagugcagggauggaaguacuuguguguggugccccagcuagggcuagacaccgaguuuucccuucuguccccuuaggguggugaugaugaugaugaugauaaugaugacugcgugcauggcucagucuuugaucuuuagcaagggcacucacauuacaauuaguuuuggcucucaugacaauuccagaugcuuacagggcaaggaguuggguccucaugcgcuagauggggaaacagacgcaagagcuugcccaaaggguuggcggcagggcugggacacugaccccugacucccacgucaccucccuucugccccucaguacacagcccagggggagccguuccccaacaaccuggacaagcuauguggccccaacgugacggacuucccgcccuuccacgccaacggcacggagaaggccaagcugguggagcuguaccgcauagucguguaccuuggcaccucccugggcaacaucacccgggaccagaagauccucaaccccagugcccucagccuccacagcaagcucaacgccaccgccgacauccugcgaggccuccuuagcaacgugcugugccgccugugcagcaaguaccacgugggccauguggacgugaccuacggcccugacaccucggguaaggaugucuuccagaagaagaagcugggcugucaacuccuggggaaguauaagcagaucaucgccguguuggcccaggccuucuagcaggaggucuugaagugugcugugaaccgagggaucucaggaguuggguccagaugugggggccuguccaaggguggcuggggcccagggcaucgcuaaacccaaaugggggcugcuggcagaccccgagggugccuggccaguccacuccacucugggcugggcugugaugaagcugagcagaguggaaacuuccauagggagggagcuagaagaaggugccccuuccucugggagauuguggacuggggagcgugggcuggacuucugccucuacuugucccuuuggccccuugcucacuuugugcagugaacaaacuacacaagucaucuacaagagcccugaccacagggugagacagcagggcccaggggaguggaccagcccccagcaaauuaucaccaucugugccuuugcugccccuuagguugggacuuaggugggccagaggggcuaggaucccaaaggacuccuuguccccuagaaguuugaugaguggaagauagagaggggccucugggauggaaggcugucuucuuuugaggaugaucagagaacuugggcauaggaacaaucuggcagaaguuuccagaaggaggucacuuggcauucaggcucuuggggaggcagagaagccaccuucaggccugggaaggaagacacugggaggaggagaggccuggaaagcuuugguagguucuucguucucuuccccgugaucuucccugcagccugggauggccagggucugauggcuggaccugcagcagggguuuguggagguggguagggcaggggcagguugcuaagucaggugcagagguucugagggacccaggcucuuccucuggguaaaggucuguaagaaggggcugggguagcucagaguagcagcucacaucugaggcccugggaggccuugugaggucacacagagguacuugagggggacuggaggccgucucugguccccagggcaagggaacagcagaacuuagggucagggucucagggaacccugagcuccaagcgugcugugcgucugaccuggcaugauuucuauuuauuaugauauccuauuuauauuaacuuauuggugcuuucaguggccaaguuaauuccccuuucccuggucccuacucaacaaaauaugaugauggcucccgacacaagcgccagggccagggcuuagcagggccuggucuggaagucgacaauguuacaaguggaauaagccuuacgggugaagcucagagaagggucggaucugagagaauggggaggccugagugggaguggggggccuugcuccacccccccccauccccuacugugacuugcuuuagggugucaggguccaggcugcaggggcugggccaauuuguggagaggccgggugccuuucugucuugauuccagggggcugguucacacuguucuugggcgccccagcauuguguugugaggcgcacuguuccuggcagauauugugcccccuggagcagugggcaagacaguccuuguggcccacccuguccuuguuucuguguccccaugcugccucugaaauagcgcccuggaacaacccugccccugcacccagcaugcuccgacacagcagggaagcuccuccuguggcccggacacccauagacggugcggggggccuggcugggccagaccccaggaaggugggguagacuggggggaucagcugcccauugcucccaagaggaggagagggaggcugcagaugccugggacucagaccaggaagcugugggcccuccugcuccacccccaucccacucccacccaugucugggcucccaggcagggaacccgaucucuuccuuugugcuggggccaggcgaguggagaaacgcccuccagucugagagcaggggagggaaggaggcagcagaguuggggcagcugcucagagcaguguucuggcuucuucucaaacccugagcgggcugccggccuccaaguuccuccgacaagaugaugguacuaauuaugguacuuuucacucacuuugcaccuuucccugucgcucucuaagcacuuuaccuggauggcgcgugggcagugugcaggcagguccugaggccugggguugggguggagggugcggcccggaguuguccaucuguccaucccaacagcaagacgaggauguggcuguugagaugugggccacacucacccuuguccaggaugcagggacugccuucuccuuccugcuucauccggcuuagcuuggggcuggcugcauucccccaggaugggcuucgagaaagacaaacuugucuggaaaccagaguugcugauuccacccggggggcccggcugacucgcccaucaccucaucucccuguggacuugggagcucugugccaggcccaccuugcggcccuggcucugagucgcucucccacccagccuggacuuggccccaugggacccauccucagugcucccuccagaucccguccggcagcuuggcguccacccugcacagcaucacugaaucacagagccuuugcgugaaacagcucugccaggccgggagcuggguuucucuucccuuuuuaucugcugguguggaccacaccugggccuggccggaggaagagagaguuuaccaagagagaugucuccgggcccuuauuuauuauuuaaacauuuuuuuaaaaagcacugcuaguuuacuugucucuccuccccaucguccccaucguccuccuugucccugacuuggggcacuuccacccugacccagccaguccagcucugccuugccggcucuccagaguagacauagugugugggguuggagcucuggcacccggggagguagcauuucccugcagaugguacagauguuccugccuuagagucaucucuaguuccccaccucaaucccggcauccagccuucagucccgcccacgugcuagcuccgugggcccaccgugcggccuuagagguuucccuccuuccuuuccacugaaaagcacauggccuugggugacaaauuccucuuugaugaauguacccuguggggauguuucauacugacagauuauuuuuauuuauucaaugucauauuuaaaauauuuauuuuuuauaccaaaugaauacuuuuuuuuuuaagaaaaaaaagagaaaugaauaaagaaucuacucuuggcug

SEQ ID NO: 21481 - RNA, 17015 nt, Homo sapiens
cagccaagaguagauucuuuauucauuucucuuuuuuuucuuaaaaaaaaaaguauucauuugguauaaaaaauaaauauuuuaaauaugacauugaauaaauaaaaauaaucugucaguaugaaacauccccacaggguacauucaucaaagaggaauuugucacccaaggccaugugcuuuucaguggaaaggaaggagggaaaccucuaaggccgcacggugggcccacggagcuagcacgugggcgggacugaaggcuggaugccgggauugagguggggaacuagagaugacucuaaggcaggaacaucuguaccaucugcagggaaaugcuaccuccccgggugccagagcuccaaccccacacacuaugucuacucuggagagccggcaaggcagagcuggacuggcugggucaggguggaagugccccaagucagggacaaggaggacgauggggacgauggggaggagagacaaguaaacuagcagugcuuuuuaaaaaaauguuuaaauaauaaauaagggcccggagacaucucucuugguaaacucucucuuccuccggccaggcccaggugugguccacaccagcagauaaaaagggaagagaaacccagcucccggccuggcagagcuguuucacgcaaaggcucugugauucagugaugcugugcaggguggacgccaagcugccggacgggaucuggagggagcacugaggaugggucccauggggccaaguccaggcugggugggagagcgacucagagccagggccgcaaggugggccuggcacagagcucccaaguccacagggagaugaggugaugggcgagucagccgggccccccggguggaaucagcaacucugguuuccagacaaguuugucuuucucgaagcccauccugggggaaugcagccagccccaagcuaagccggaugaagcaggaaggagaaggcagucccugcauccuggacaagggugaguguggcccacaucucaacagccacauccucgucuugcuguugggauggacagauggacaacuccgggccgcacccuccaccccaaccccaggccucaggaccugccugcacacugcccacgcgccauccagguaaagugcuuagagagcgacagggaaaggugcaaagugagugaaaaguaccauaauuaguaccaucaucuugucggaggaacuuggaggccggcagcccgcucaggguuugagaagaagccagaacacugcucugagcagcugccccaacucugcugccuccuucccuccccugcucucagacuggagggcguuucuccacucgccuggccccagcacaaaggaagagaucggguucccugccugggagcccagacaugggugggagugggauggggguggagcaggagggcccacagcuuccuggucugagucccaggcaucugcagccucccucuccuccucuugggagcaaugggcagcugauccccccagucuaccccaccuuccuggggucuggcccagccaggccccccgcaccgucuauggguguccgggccacaggaggagcuucccugcugugucggagcaugcugggugcaggggcaggguuguuccagggcgcuauuucagaggcagcauggggacacagaaacaaggacagggugggccacaaggacugucuugcccacugcuccagggggcacaauaucugccaggaacagugcgccucacaacacaaugcuggggcgcccaagaacagugugaaccagcccccuggaaucaagacagaaaggcacccggccucuccacaaauuggcccagccccugcagccuggacccugacacccuaaagcaagucacaguaggggauggggggggguggagcaaggccccccacucccacucaggccuccccauucucucagauccgacccuucucugagcuucacccguaaggcuuauuccacuuguaacauugucgacuuccagaccaggcccugcuaagcccuggcccuggcgcuugugucgggagccaucaucauauuuuguugaguagggaccagggaaaggggaauuaacuuggccacugaaagcaccaauaaguuaauauaaauaggauaucauaauaaauagaaaucaugccaggucagacgcacagcacgcuuggagcucaggguucccugagacccugacccuaaguucugcuguucccuugcccuggggaccagagacggccuccagucccccucaaguaccucugugugaccucacaaggccucccagggccucagaugugagcugcuacucugagcuaccccagccccuucuuacagaccuuuacccagaggaagagccugggucccucagaaccucugcaccugacuuagcaaccugccccugcccuacccaccuccacaaaccccugcugcagguccagccaucagacccuggccaucccaggcugcagggaagaucacggggaagagaacgaagaaccuaccaaagcuuuccaggccucuccuccucccagugucuuccuucccaggccugaagguggcuucucugccuccccaagagccugaaugccaagugaccuccuucuggaaacuucugccagauuguuccuaugcccaaguucucugaucauccucaaaagaagacagccuuccaucccagaggccccucucuaucuuccacucaucaaacuucuaggggacaaggaguccuuugggauccuagccccucuggcccaccuaagucccaaccuaaggggcagcaaaggcacagauggugauaauuugcugggggcugguccacuccccugggcccugcugucucacccuguggucagggcucuuguagaugacuuguguaguuuguucacugcacaaagugagcaaggggccaaagggacaaguagaggcagaaguccagcccacgcuccccaguccacaaucucccagaggaaggggcaccuucuucuagcucccucccuauggaaguuuccacucugcucagcuucaucacagcccagcccagaguggaguggacuggccaggcacccucggggucugccagcagcccccauuuggguuuagcgaugcccugggccccagccacccuuggacaggcccccacaucuggacccaacuccugagaucccucgguucacagcacacuucaagaccuccugcuagaaggccugggccaacacggcgaugaucugcuuauacuuccccaggaguugacagcccagcuucuucuucuggaagacauccuuacccgaggugucagggccguaggucacguccacauggcccacgugguacuugcugcacaggcggcacagcacguugcuaaggaggccucgcaggaugucggcgguggcguugagcuugcuguggaggcugagggcacugggguugaggaucuucuggucccgggugauguugcccagggaggugccaagguacacgacuaugcgguacagcuccaccagcuuggccuucuccgugccguuggcguggaagggcgggaaguccgucacguuggggccacauagcuuguccagguuguuggggaacggcucccccugggcuguguacugaggggcagaagggaggugacgugggagucaggggucagugucccagcccugccgccaacccuuugggcaagcucuugcgucuguuuccccaucuagcgcaugaggacccaacuccuugcccuguaagcaucuggaauugucaugagagccaaaacuaauuguaaugugagugcccuugcuaaagaucaaagacugagccaugcacgcagucaucauuaucaucaucaucaucaucaccacccuaaggggacagaagggaaaacucggugucuagcccuagcuggggcaccacacacaaguacuuccaucccugcacucacaauguuccgggacgccccuccaugcccagcacccacagcccacugccucucaaccgcaucucccuggugccucacgcccauuuccccuccaucccucgcucccugcagcaggacaaucacaagauaagaagugccagguccccaccuuugcacucaguucuccccuugcuaacugggcacccuggggaagcuucccuggggaagcuugggcaggaaguggcgggagucugggggugguuuaaucaagcccucuccccauucucuccuuccagccccaaaagguccccucaacccagaucaggacagccccuaaugauauuuacaagcccccucccugccaucuccugucaguaucccagggguaacuuacauagagaauaaagagggcauuggcacugccauugagcugugccaguuggcuccugaucugguucaugagguuguugugacauggguggcguauggcacagguggcguugacaggggugauggggagggggcuccccgccccauguuuccagugcagaaccaacagcaggggcacaacuccuggggacagucaggaagaagccaugaguagaaaggcaggaaaggguggccuggggucauggcacaccggauggggguccaacaauggccgcaugggagaggacuccugguucccccucaccaccugcagcugucuuccuggggccuagucuucacucugucacugcguguguuucucugucucccuuucucuaccuuaguucucccugcucucuucugggaugacguaaagaugagggcaagacacaagccauuuccacccaaagggugcaggguccaggagagacucccagccaucccacccuuucccucaggaaggcaaagguccuaaggcccccuggcccucuggcuggaaggcaccaggccccaggcccagcaggcaccaggagaaaggagaccccucucuucccaccucccgugguggcccagguuccucagcagcgcuucccacucacuggcccauugcagcccaaaucuccgaagccaggcacccaugggggccacggggcaugggggaguggggaggaguccucgguugacccucaucucccucccaaaccugccacuugauucuggcucccugggccaauugcccccaauucugcccccgcccccaucauccucuaucucuuccuucccuaguguccccuaucucacucaagcucaccccauuucugccuggcuguccccacucuccauccccaaaucaucauucaaaacucucuguucccccagcuccggacagccccugacuccaugccuucucccgacucauccgcugucccuugucccagggguuccccucccuccuaacacacacacaccggcucagggagggagaggaaauggugcaccaggagagagaaaaggcaaaaggucauaggcagucgggugggcggggaggaaggaaagugaaaggugacaggagagcugggagcugucccgacauguccugguuugccccucccccaggggggccuguucucccgacuccccccaggcccccuuagacgcuuuuccagggcucugcagaagggcaccugaagauggugggggccggggucagcgggcgagugaggcuggagaccucccccggaucccccaugcuggaacagcggggacaggggccuccucaaguucacuucuccuggguccccuguucgucccagcaucccaaggcagugcugaggccccgggguggcugcgggaggggggccacaccccuauaucucaccuagcgcagaccacacgcuuccagacaccagcagauggaggcggcaccugcucccgucccaggccggaguuugcaagcugcucgccgcccgcgccccucccugggagcagcccgggaccgcgguuggaaaggagaaagcggaaagaaagaaagaaaagaaaaagagagagggagagugaaucugggagaaagcgcagagggaagagcagccagcgaguguccggagcgaggaggaggaggaggagaaggagagggggaagaagaggaggaggaggaaggcucggcgcccccucccucgccgccaaccugccgcggggcgugcggugcuugggaccaugugcccgcgcucgcuccgggccgccacccagcgccuccgguggcugcgcgggcgccccaaguguucgugugucugcggcgggugggcguccggcucgcgcugccaagcgccccaaguugccgccgcgccccgcagcggggacgcgaagccggcgcggggcggguguauuuaccugccgccaagaccuucauuaugggcugcacuucagagggccuuggaggaaaccucagaugccggcaguuuucagagguucaugcucaaauggggaauuugccugauuuauauacuggagccuguguuguaagacagaaacagcuauauuuagccgggauccccaguccaggaaguuguuugaggugcaucauaggaaauuaugaauggaagaaagugagagugaaggggggggacgagugaggggggaggguggggagaacagacuuuuucccucuucuaagaauuugauugauaaaauuauaaugaagccuucgacaaaacgcccugugguuuuccugccuggcuugucccgggaguugucugaagaugggcaucgccaggagggggccccuggccgagucagcaggggucccagcagugggcgccccagacggcccugacucaccuggguuuggggagguagcgagucuggacuagcagauggagacuggccccugugcccccugguuggggggcuuuaggggggcagugggaggaggagggcuagggcuuggcugagaaggaggcuccaggaggaggggccggggccggcguggacuuuagacggucauaaaguggaacugaacaugggcgcuggaagccaccccagagguagccuccuccaaucugcacauugccacugggccccaaggggcuccgaggggaacacguugcccagggccccagagggucaggccuccagacaccaccagugcacucgcccugcugaccacuguaccugugaggcuggggaaggggcuaggaagacauggggguaggggugacugacucaguucugucgggacacucugggaaggugcuucugggaaggcgguccagcauuuccauucugaagcaggacugagagaggcuuggcgaaaucguaccccaguuuccuccuccgggugcugauugaugguuggggaaacugagaaguggcuggucccuuccagaccugccuuggaagccccuuugagcccagccucagagaaugauggagguccccaaaaagugcuucuagaggcucuaaggcagugucacauguucuggcgucuucugaggccaggcgauuugugaaugaggaagggcagaaaggagcaguggggagccgggcaaaaugagcacagggacaccuccaagaaaugcaacagaaaagugaaaauaaauacacccuaugagaugcgggaaugccggccagacagcauggccacgcgucuggggccaugccgucccuaaagcugccaggggacccccaguaccaggagaugauuuaguccccuguggccccuucccagcccuuccgccugacccugaccugagaucaaggugugugaguugguuuuccaaggccagggagcucuugcagccucgcccgggcccccaccgcccccucgcccauccuccaugcccccaguuccugccucuugccacaucccagaccugcccagccacggguuccuccuucaucgugccaggacgagcccuggugccugcugccguuccccaccacacacacacccugcuuuaucuacgcucuugccccccauucucucccagcagggccucggaugugaggugauaaaacugcccaucccagcuggcacuucccgaacuggcucuccuuccuccuuccugccucucaccccacaccuugucucuucuuugagggaccauggagggccccacuuggcacuuacugcuccuauacacuugcucuggggucagcguacacuacuaggagacucaccugcccuggccuggcucagguaaccccacaucccaggacaccccagcucaacccuucuucuuacaccucccccagcaucuccugcacaaggaccugaccacucagagcacgugagcucuggaccaguccccagucccaucccacaucacccagaccccugccaccugacucagccuggcucuccugacauggaccccaaauccaugugaccaggggcucacuguggccuccacccaucaaacccccgucgcccggccugagucucucauuaggcucaagaguucugcagcugccccuacaucuaccauucugcccagucuccccugcauccuuccaagcggacccccaggcccuugcaugccuucuggcaagccagaccccacaucagcccuauaauccacccccaaucgcuguuuaaucucagccccaccccacaggaaacaggaagugaggacagggucuagaagacacugacacuaaggccccuuaaccccagcccugacuggccccuccagugccucaguuuccccuccucucacgguaccugacuugguuugugcuccccaagugcucugggccccucggcgccccaggcccagccucccccuccuguccauguccaggcaccaccugcucugggccucuggagggaaggcugggcagggucucggagccgcaaguccgugugccgccugcaacguggcugcggcccccaggaaucagccgcccaggcuacgcuccaggcccacuuuggucucugggaguuuguuuucuucccucccucucuaugcuguguguguguguuccccgcccccggccggcucccucauggaaggcacccucccuucuuggcugccggcucccagggucacgaccccaggccccacccuggaguggcagccccggcuuggccccuuccagcugugacuucauccacagccuguccugcuccugcagauggggccugcuggggauuugaccggucucagggugagcgggacagucccggccacaugggacccccugacauugagcagagguuacuaggccagaacccaggagugcugucuccagguggcugugccauccaacccaucacugcucuccaggaagggagugcacccucuagcacgugcagcuacccagcugcucgucuucugcugauuguuaccccccauccacaagucucuccugggauaucacagcugcuuauuuuccagauggggaaauugaggcucagagaggugaagauaacuauguggggcucacauaaagaguuaauaacagagccaggucuggaaccggggcuucugucuugcaggccacaacaaucccugcagcaccucuugcucugagagggcgaagggcauggcaggagugcucgggucgccuuccuccaggaagccuccccugccucccauggccccgaccagcucacaucggccauguccugccugcucguguuucaaguggggaugagucuuauuccucaaccuuugagaguuugaauggggucugagacucacuugugcucuagacagcaccuggcucagggcuauacucugacaugaauagagguuaaguauuuuuugagaaagcauuuuauaguuuccaaaaacugucagugccaacucucuuguggaaaggagauggagaggccugaagguuugaagaauggacucuggccucauucacaaccagguuggagguuuggcucugccaguuaugagcugagugacuuuggggaagggacuaccaccuccuggccucaguuucuucaacuauaaaaugggaauaaugguaccgccuuugugggucugcugugagggcucagggcucagcaugguucugggcacccagcaagccaccugucugcauaucaucacccauugugcugaccucccugugaagcagggguucauuugacagauggggaaacuuggguccaugccagggugcugagcggggaaggcugggcaggagcaagaccucucaagccucugcugaugguaaauugaggcaagauacccacguagccuccagcuucaagggugccccagauaaaucagacagguugugggagggggcuggcagggcagugugcucacucccccagagcccccuuccuggccccucaccacccccaccccaagccugaucugaggacagcagcugaccuggccuuaccgcccccagaagcugauucacccccaggccccaugugagaaggaaggagacaaacucagcucugaggggcuugaaucaccagccgcccccugcaaagccccgggguugggggggggaugcgggggugggggccagcccccugccugucugucucuuuccuggacccuggggcucucaggagagagggcagcaugucaguggcaugggcaggggugagaugggaggucccuucacagucaggcauucugugugggcagccagcagcaguuacucaccagguaagcagcucuccgggcauuggggaauuccccaagaccagcgacccagaaacagcgcuccgggcacccccggcugcccaggcuggccucccuccuuccuuccccauccccucuggcccugguaccuggaaaaugagcagagcccucaggugggccuaggaaggaagcggggggccagagggugggucccaggcucagggcuggugaggaguggccagaggagauggugaagcucaggaaugccgggcacagcccagccaauugggcauccuggccaaaaaggcaagagcaccgcacucuucaaugcuugaggagugagagugugaugccaccagcggaccgugccuccacuguucucaccccagugguguggguucaaaucccuccugccccaacaaccagcuauguggcccgggacaacgggcuuccuuucucauacccucgguuuccccucugcaaaugaggaugcugucauaacagccucguggggccaucauggggauguuucuugggaaaugcggauaaacgucuaacacauggcagcccuucuaauaagaucugguuguggccgcagaaggagcucaaacuccagaccgagucaggggcuuggguuagggcugggucccauggucagcacacuggaguccgagagucagggcaggagguggcuccuggguccgcuuaguucauggagccugguguggguuuugggagaguggguagcaucucagaaccuuguggggggacauaagcaguacuucccccaucucugggcccuggagagcccagcugucuucugggggcucuugagguccagacgcuggaccuaucuccugccccuucucacccuuaccggauccagucucuggcagcgaccagcaguauccccucagggccaaggagaagccagaagccacccuggacuucugccaacugcucccaucaucacccgacauuucccgaccgacugugucaggaaucaacccccuggagaugaaucagagugacugcauuuuuuuucuucauuucugauagaaauugcaagggaagcagcagccccugaucauuggcagggccagccagaggccuggccguggcguugcguggggccggucccccccagggcucuguagaauggguugcugucuaccccagccaucagcauuuagugagcauggccuuugagacucugcaagcacuuuuaccucccccaggcucucccugaaucucgaacuagccugagaccacugcaggcagauauagagagagcaguguuuucacacugcaggccucugccucuucgugggucaugaauucaauuagaggguugccaccaacacuuucaaaaaggaauagcgaaaucaccuggcaucgcccagagccagggcgaggauugcuccaugaaacuuuuuuuccgguugucuguaugucaguaucugcauccucaucugguugcaaggugcaauguauuucuuacuguggguggcagucaaaaacauuugcaagccacugguaucgauguugaaagcaggcccagaggggcugaggagugacuugcccaaggucacucagcagugucucacggggcuccugacuucccuuccagcucaggaaugggccagaggugccgcaggguagggcgggguggggcugagcaggugcucaacguggggaaccuggcggcacccugugccaugccgugacaaaggccuuccagagcccaaccucucacuguccacucccuuccgcagccucggaccccugggcucucugcccugccccgucccaccuggguggagcccaggacagucacaggccuuucuuucguacuccaccagggagucuuucauccucaccacagggugcgggaagaggaaguggccacagccaccuucccagggcagccugaggccaagagccacagccugcaguagagggugcacacuugggcucccuguggcccugggacauggcugagucucuuugucugagucugagugggcauuugccugagcauguguguguagugagugccucugugucugugcaugccugugucuggucccgugugugcaugugugguguaugcaugugugugcauguguguggaucugcuuguacuguuugcuuugugugacagcgagcuagacggugcacaucucuggcugcuauugugaguucuccgugugguugugugagucugugugugugcgcacgcgugcgcgugugcccaugggcaugaagccagugcgacugugugucuggccuugugucugcaugaguuuguguaggacuguggaucccugggcacgacggcucggagaggggggaggccuaacccugggcgugcacgcaugcguuucugagccuccaggccugcgugugccccggcgugugucuccaacaaucccugcuccucacccuccagcccccgccccugggaaccauguggcagccucacgucacaggggccaccagcagcuggcuuccucccuaccccgccccagccccccgcuccacaacgcccuggccacccugacucuuggcacagggacaaagcugaugucagaggcgagcugacagcuuucuucucccacuggauuuuccaaaagagagagaccacagcggccccuauuaaauaaucauggggcugggggguaaaggagggacgugucacucaaugauuuccuggacucagaggccauaaacagaacaggaagcagcccgaggaccuauucagccugaaacuggccgugcagaggugugggccuggccuccucuccuuccccucccccagccaagcucacuggggccacccugacccgacccagcacccaggggagccugaggauuguucugaggauugugggugggagggugaugggagccuccggucuggcgacagugaugacauggaaagaauaaaguggucccaucccacuggguggggaggauggaggggugagaccuggcugagguuggacuauccucuucccugggaagagaaggaagagugagcuuccuggggugaggggagggauggggccgggugggggagccgcugguggaaccugggauuggaggggccaggcuucccucugugucuugcaacggggucguaauaccugucccccaccaguccugcacccuugggucccccuagaccuccaggacccucccagcccggaguagugcccuucuuggggcacaggcccccaaggcuuucauaagccucucucccacccccuccccacaaaaccaagcauuaccaagugcucaccagaacccgcuaugggcucaaacccuaacccgcauucucugagggaggcauuuuaaacuucauuugacagacucggaaacugaggcucacagaguggaaugauuugucccaggucacacaguguguaauggagccaggucuccaccccagcccccuacccccagccucccuaaaacaggacccgggaggcccagguguggucugagcagccaggcccaggggggguccccacagagucacuccccaggcagccccuccugccuggaccaggccgcccaguggcugauaagccacaggacugcaugacacaaucccgcucugaucuucugcccagccgagccucugcccccaccccaccccuggacccuguuuccaucuccucccuuucugggugggaccaacgccccggccuggugucauucauggugggcuguccagagagccagcuucucugugaaccucucagcuguugaggucuccccaaaguccacccuagccagagggcuggcagcaggagaccccugcagagggaggacaguggccugugccacccccaccugccgggugggggugggggacuuagggcccaucuuggccccugcuggccucagcauccccacuugguaaaggaaaagcucggagaagagaugaggcugcgccguggaggggaggaggcuaagugggcucuggaaucagccagaccccagguccaggcccaccuuggccacuuacgaacugugcagccucgggcagguggccucaucgcucaggccucaguuccaacguccacaaaaugggguaacaguguugucaaccugugaggucagcaauguccucugcaaaggcuggccagcauggaaaacauggcuugguuauugauauugcuauuguuugagacagggucucauucuguugcccaggcuggagugcaguagugccaccauagcucacugcagccucaaucacccccgcucaagcaauccuccugccucagccucccaaagugcugggauuacaggcaugagccacugcaccaggcuguguuauugauauuaucuuagcuguggggcccagagaggggaagucgcuuuuccaaggccacacagcaaauuaguggcacauucccaguaguauguggacuaguggccucucuugaacucccagacagagagcuaggaacccuggguuucaguccugauuugcuugugagaauuccagaaggaagcuucucagagucucaguuucccuuucuagauaaguccaugagucccaaagugucuagaaaagguucuuuggggccgggcacgguggcucacgccuguaaucccagcacuuugggaagccgaggugggcagaucaccugagguugggaguucgagaccagccugaccaacauggagaaaccccaucucuacuaaaaauacaaaauuagcugggcauggugguacaugccuguaaucucagcuacucgggaggcugaggcaggagaaucgcuugaacccaggagguggagguugcggugagcugagaucacaccauugcacuccgucucaaaaaaaaaaaaaaaaaaagagggaaaaaaaagaaagaaagaaaagagaaaaagaaaagguuaucugaagaguggcuuguggggagcaguggugggggauagagagagagacccagguccccaggaaagcugggcccagggcuaggggagaguccagguccagggcucccagaccagcauaugaaagacacccaaucaccuagcccggcuccaaaccacgggcugcagcgccccccacugcccagcgggcagcaggcccugcggccacggccccgccagccccaggccagccugcagccggggccuccccuagagcuaggcgggauggcauuuggggauuugaggaagugagccgggaugccugagacucagaauggagagugggcagauacaggccaaggcuggagaagggggcaccacugagggggucuuggaggagccuaugccauguccagcaccuccuggggaagcccugaggaccggccacaagggggugccaggaccacgugccucugccuggcggagccucugggaggaggaagaggaggaagggggagaagaauuucucuccuggcccugcugccgcgucccacuucccucagacuuccaggacguccucucuccccagcccccauuuacagguccucaugacaauucuuccaaaugggaauuacaaucaccguuuuacagaggagacaauuaagacccacagagguaaaguaaaccaaguaaaccagggacacguggggcagagcccagguccccacccugccccagcgugccagggaaccccagcauccagacccaggacuggcccaccccggagacaguuucccuauccccucggaagccucuccccaggucucgggaguugcugauagcaagauuggggucgagccccuuucccucucaugccaggcucugugcaaggauuuuaccuauauuuuuccuuucucgccacagugaucccauaauuagauccauuuuacacagugagugaggcacagugcagucaaguccugcacuggcccaaggccaaaagcacaggggccuugaacuugacugaccacacacgcuggagccuccuauacaggaaccaccucuccaucagaaggaaaccgaggucuucaugggcuggguccccuguacugcucuggggaaaagagaacuugagggucccuugggaauccaggacucaaaacucccagaugacugaccccuccagggucccaaacagccaggauucaaauccaggccuccuuccagccaccauguccagagcucucuccucugcccuuuaacccuuugaugcucuuuaaacccucacauguccacaugacacuuucgcauccguucucuccugcuuagccucaacauccucagagagauguucggggcuuaucucaccauguccauugcauagaaggggaaacugaggccuggagcgugugugggccaccagaucucccccugacccacaagggagugagugauauuugcuuugguggaggauaaauuuggaggcuggccucuacccccggcccugccccugggagaagccuaccguggucugugccugcacacgccgcuccggaucuggaagguuugccaggucuucagugggacaccaucgucuuccgggccaggcccccucugcuucccucuccugcuggaucuucucuggagucggcuccucaccccg

SEQ ID NO: 21482 - RNA, 7502 nt, Homo sapiens
auugaauuucauuaacuuuauugaaagguauaucccuuaguacuaaaacauaaugguaguugguuaguuuaccucugccaacucaaaauuaacaaugauguauucaaaauauugaaauuuaucagccuuuugggaaaacuaaaaaguuacccauaaaacaugguuuacaaaaguuaagaauaagauauacugugguucuuugguuuuucauuguguacugauccauaacgugaugucaaauuggauauagccaucauggauagacucaggcuauacauugcacugaguaacuguuuacaacacuuuaacacuguacuucuuacauucacuaacugccauggaggauccuaaacacuacuucagcagcuucauucauaguuaugaaggugucuacuugcuuuucuuaagauuuuuguuuuggcacaguaagggcaucaguggaaguauauucucuauuuauaaaauugccaucacuucuaacuuaaaaacagucuguaguaaaaaauucuggaguguucaaucuagucugaacuuaccuuagugugggaaagcaaguuuucgaagugauaauuuauuuugaguuacuaauacaauagaaacuaguuuucuugaugggauucaguuugaggcaguagguucuguauaaaaauuuuuaucguagauacaaaugucaccuguuuucuagaaaaaaauauuaaaagauaacuuaaugaauaugccaaacuuuauaggucuguauuuuucuuuauauaaaaugcccucaaauuuaaauguaauucccauauagcaauaaaguccacaucucuagauuaccuauuacuugcauuaugggguguguuuauacugccuagaauguuaacccuuauuaugccuuaaaaguacauuugugaaauguugcuuuugacauaaaccucauaacuuaaaauuuaaguaggaguaggauuagaauaaugacagugauugaagcugugggaagacugauaguugauaguauuagugugacuccuccaauagcauuuucaauaccaccuaaauauauugauccaauaucuaaaguuagaucaaugauagaaaugaagauucacaguuuaccuucucaggcuugucauuagcauuucacauuuaggcuuuuagcuuugauuugaaugcuucacagaugaauucaaaucuaaacauaauuccacuacagcauaauauuaggcaguuuucccaagucugagaccaucaugcuuaucucgugauguuuugaggcuucauagcuuaaauccauuguaacauuauggaauccauagaacaagguuguggagaaaggcuucagagaaguuuuuuggugcuguaauaauccuauuuaaauaaagaaaacaaacaaaauccaacuuaacagaagccagucugccuaaauacuacuaagaaaauugaaauguucauaucuaauauucauaaucacauguagauguauuaaauguuaacauuuaguuuugaguagaauaaaucaucacugaguuaggaaauuuauauggcaagaauguauaucacauaugcagaaagcaaguuuacauuuuuuaugcauauaacuacuuugcaguaguccagcugcuauagcaaugauagguuaguauaguguugacacacucuggcaguuuccagauacccaauguagagaccaucuaucauauccuacuuuuuuucuuuuuuuuuuuuuuuuuguggcggagucuugcucugucgcccaggcuggaguguaguggcgcgaucucagcucacugcaaacuccgccucccggguucccgccauucuccugccucagccucccgaguagcugggacuacaggcgcccgccaccgcgacuggcuaaauuuuuuuguauuuuuuagcagagacgggguuucaccauguuggccaggauggucucgaucuccugaccucgugauccgcccgccuuggccucccaaagugcugggauuacaggcgugagccacugcauccggccuacuuuuuuuucuuuuaaguacaauauccaaguucauauugauuuugcuuauaagcuaacagucucaaauuaguucauacuugguucagacuuuuggugcuguuguccugcucagcuuauguaauuuuaaaucagucagauacauacagcaagaucaugugcaauuaaaaaaaagcaugauuuuagugcuacaaggaggaugcuguucucuaagcugaaaauuuaaugaaauggcuaacguauguaucagagguuggauaauuccuuacuccuaagauguuguaccuuguauauaguaaaggccuucaaauauuagcugacuagaucagugaugucaucucccccuuuacuauuccaacuccauuuuguuuauuuugaagauaauuacucuucuuuaguugaaaauuauggcauuggaaaauguucucuaucuggagaauaauaacggaccaaauuuaccaguuaagggaccauuucaggaauuguuggaaggugaguuauucuguaguagcuaugcuucaauugccgugcaguacgcccagaaacaauccauuucaacuucugaacauuugguuuggaacacuuauuugaugaauauucaguuaaacauuuggauacaagcucuugccagaaggucagaucucugccauuuaucuguacauacauaaauuuuaaaaaauuauuacuccaaguaagucccaccuuauuuaacuacauuaauaaaugcaauccuaugaacaugugucuuugcucauuaaaaacauuugaggauagcuacuuaaguuucaaauaaacauaugacaucucauuuuacuucaggagauagaagggguuuaguuucuuuuacagcuguuaauaggauuuaggcuauguccuucacauaccuuggaauguuucugaagacauucuauuccuucuguuaacucuacacacuucugugcuuggaucucuaaugcaaugauagacaaugccaacacagaaggcuaaaagagauaaauuuaaaguaaaugccaaauauaaaaacagaucauaucaauaggcauaaucuuuauaaaauauuuaccuuugcuuuagaaaauaugauccugcaaugacaugccuucaguugagcuucuagucuuucaaaauuaaugcuauuucuccuuuaaaaagaaaaugguauuacuuuuauuagguaauacuacaucuagucaaaagauguuuuuagaaaaacauugaagucaauuuuuaaaguaaagcuuaugcacacuuaacauagcaaaugaacuauugaaaggaauuccccuuccaucagagauacuaacuucuaaaggcaccauaugggaguuuuagaugauuugggccaaaaaauuaaaaugaauaguacuaugccacaaauacaagauuuauuuucuuuuaguuuuaauaaauauuucaacauccacugaagguccuuuuuuuccauaaauuuguguuagaugcuuuccuacuagguucuauaaagucaaaauguacuuuaaucccaagaauuagcuuuaacgaagcuauugacaauggaacauuuucucacuuaugauggacauuaaaguucaaggagccacagcugucauuuuacuuauuuuuauuagaauucuaugaggauacugauuuuaugcaauauccauacaauaccauucugauuuccaaaugucucuuguucaaaacaaaggucacuuaccuuucaaguggcaaguucucuugaaggagugaauaauacaguugcagaaauugaaaggcaguaguagcuuugacuuuccaacacaccuucuccaauacaaucuuuuccauucucaucaagucugaaaccguaaaccuauauugacuuauucggaucaagucaguugccaaugggacauuccuuuccucuucuauugauuuuacagccaaauaaaagcagcucaguccaacacacccaaggugcuugggcuguaccuaaaaaaucaaaaacaaaaccaguaagcccaugacucuaccuuauuucaauuaaaacauaaaggauaaucuagaacuccgacccaacauuuugaaaauguauauuugagguuuauuucucagcugugauggacuuaacacaauccacucauaccuaaacuauagccugucaacacuauggaccccacuuagaaccaauuuuugaguaacuggacugaguuucaguauaauguuuggcucagcauagaaaaaguguguuuuuauuaaucacuguagaacuauaaguaaacauuguucuaguuugaucaaauaaguuaacuagucaaagauauaugaggacugaaauacuuuauggcuuauuuacaaaauaagccauuucuuugcaggauguuguauuuuuuccaggcucuugucuuugugggaacacauauaaaacaguuuuaaaauacuauggcauauacuguuuacucugccucuaagaguucuauccacuacuaaucuuuaucauuuaauuuucugaaugucugccguaugagacacagucaaaacuuuauccaguuuacuuccagcucacaugaaacuaagcuuuuaccaguauuaauaucucugugcucucucucuucuuguaaacucuucagcaguacacuuaugccucuuuaaaggcauaauguaguuauuuuucuuauuaugacuuguacauaagagcaacgaucuuauucucacauaagacugaauuauaccugaggaauagcuguauauuauucauuugugcaacauuuacagauucaaagguaaugacuacaugugaaaugucuaaagagcuuaauuagucuguugaagcaaauuucuugaaucuucaacaaauauugaaguccuuuuuuaugaugcacuguguuagauaccgaggacuaaaauaugaguuuccuuccaauugucacaucaucuuauuuuccuccagugaccauggguguacaggaaaggcagaugcauuuguaacaguuaagcucugaaagugacagucuuguuuaucuaguauaggaaaauaguugcuccuccuucagacacacucuccucccuacugcauguacacugaagcuggaaaugccaagcauaagcaagucuugacuaggucuaaggcuaaaacauuuacaauuuuauauauggguagugauuaacaaauauaucuuaauucuuagccacaauguagccucuaauaaauuucugccacuaauaaauuuguuuauaucuaaaaauaguaaauaaauggacaaauccaaccuaucaagaaggguuuuuuaaaaacagccaauuuucuuacuaggaaacugcaauuuguuacuugauauuagacuauuuuucauuucagaauuuaagucuaauaccugauguacuacucuugauuaugauaagaaauauuaaugcuguaguagacaaaauuaauguuuuggcuacgugcugaaaaaaaaaaggucaaguuuaugaauaccagccaaaagguaacaauuccaucuccaaaacacacugagcaaaauuacaaaaauguagcuucaaacauaccuucauuuuagacaggaaucuguccaguaaauucacagcuagagaaaaugucucugugucaaagccaaagaacugaguuagacuaagaagaucuuuuacuucaaagucccuuagucuugcagucauucugaggccauuaucgugugcagacucaauuagucucaaaccacagaccuuuggcugacaucuagacuccuguuccaacagggcauucagcugguguagcaguuucugagagucaguuguugucaguaccucuaucaucuauauauagaaaaaaagaccagcaaggaguguaagaguaguccuuccugcuuuccuuggccaucuuugcacugggccaagaaaugauuuauaagccucccaucccccaaugcggcuagugcaucuaagucauugcaaagugccaucuguuauuuauuucccuucuacaaguuggucacauccuaaauugaguuccuagagggaaggaaccaugcuuuuuuuuuuuuuuuuugagaaggagucucgcucuguugccaggcuggaguacaguggcacgaucuuggcucacugcaaccuccgacucccugguucaagcgauucuccugccucagccucccgaggagcugggauuacaggcaugcgccaccgcgcccagcuaauuuuuauauuuuuaguagagacgggguuucaccauguuggccaggauggucucggucuccuggccuugugaucugcccgccucggccuuccaaagugccgggauuacaggcgugagccaccgcgcccggucggaaccaugcuuuuuagaaaaauaaaaugcaaaucuucaagaaauacuuguucaaguuauucacugucaauagauaaccacgaauaaacaccguaagacaggauaccgaaagugaaaagcagaugguaguuaaguauucugccacauauuaacaaaaugaacuguucaaguuacuuaauuguacuuaguuccacauugauaaaguagggauaagguuuaugaccuaccucacagauuugugaguuaaaaugaaaucacguaaagagcuuagcacauacaguagacgcuuaaaaaacacugaacaauaauaaugagcuugagcuucuuucuagauuuauaaaaugaggguaacaauaucugucgcugaaugugaagacugaacaagaugauucaccacuuaaagaguauagcacagugcuuggcacacaauacucaauauuacuuaacuuuuauuguuguuaggaaaggaaacuuaaaaggugacauuaggagcacguauuggggcgggggggugcgguggguuguugcuaaccuagucugaaagaugaaccugggaauuccauugauuuaagugugcauaacacaaccaugucccgggcacaagcuaagcccuggauacauggaaggucccucccacaccaacuaaagacaggaaggcaggaggucuucagagcuagucaugugaggaaccucuaacugcagggguuccauucuuccuccccaggcuagucccugggacugggucggcagacacgaaaggcaccucaggaggccggauccggcuccgccccuccagccucggacuagccugggcuugugcucacaacagcgguagaguuuaguguggaaaagggcgcgggccagaccuacuccucgccccgcgcccccaacccagcuccccacccgcaccuggcggucaacucccgcgcagucccacucaccuugacagagacugcagcuccucagcgguaaccacccuccccgggccugcucaccucaccccacgauaucagauccgagaggccuacgaggagaggggacucguaggcaagaggagagaggcccggggagggggacuguccuggguggaggccucggcagcgccgccgagacaacucggcccugaucagggucagcucggagccgaaggggccgcgccugcccuaacgaggaauauauuggagggcggggcuuucucgcgagaagggggcauuuucgccgcugauuggu

SEQ ID NO: 21483 - RNA, 1402 nt, Homo sapiens
gcugcucuuaaccacguuuauugagaggggccgggggaaggggauggacgguccuccccgcggcgggguuuucagcccucgcgggugggcagcgucuuguccucagguguagaugcuccagucucggcucagccaaacacugucagggcccccuggaaagcagaagccgagcuugagugcccccagcccugccaccaagaacucaggcgggggcgcggcagcggccggcucuguggggagcgggagcggggcgguuccgcuggcgucuccgggggacgcgcacccgcgcggggccaucuccgccuuccccgccccugcagcucggaugcgccccacccaguucccacccggagacccgggcuucucccagggacagggcuuggaggggcaggacgggaaacagcccugacguagggccgggacaccucuggugcaguuuugaggcuggccgggaagggaugcccgcgcaggaagggcacccggggugcccacuuuaccagcagggccuucagggccuucacggcccccacggccuggggacccagcucagccacacacuucugggagcccucuaugaggugguucacggggaugcccaggcugcucagcaggagcuucagcggguugagggugccgaggggguuggccagggucccggccccggccuccgccgccgacuccagcgcagcgacaggcugggccacaggcuuggccgagcccacuaagaaagcagcagcugcaagcgaacagggaggggucaccgccugcgcgccgggguccccagaaggcagguccaggacgcgcccccgcgggaggcgcccaggaaccgucgcgcccugcccggcuccccgaccgccccucccuccugcgccgaggccugccaggugcgagcccccgggacacaggcgggucuggggaggcggccccgccaggagacgcugcagggucaccggaguggccugaggguggcggaaggaccggugaacucugugcaggguccgggacaggcccccaagggaggggacacucgcgcugcgccuugcaggaugaggagccggucuccagacggggggcagacggguguccccaggccaggggcggccuccaucccggcacgaggcuggagacagcccugagagggggaggccgcgggcugcaggcgcggggccccgggguggcggagcccucugggcgccgggcgaggcuggaaggaccugggauccacgaucggcgcaggcagcggcgggggcgcagcgggcgccgaggccucaggccccaccgugcgcgccaggagcccggggcgcucaccggagcugcaggacagggccacgcagagccccaggagggcggcgagcuucauggcgcgggggcucggggcgcgcggggaaccugcggcugcccg

SEQ ID NO: 21484 - RNA, 8483 nt, Homo sapiens
ugcaagggucucggcuuggccgcggauuggucacacccgagggcuugaaagguggcugggagcgccggacaccucagacggacgguggccagggaucaggcagcggcucaggcgacccugagugugcccccaccccgccauggcccggcugcugcaggcguccugccugcuuucccugcuccuggccggcuucgucucgcagagccggggacaagagaagucgaaggugagugagccuccgggccgggggccgggagaaaaaaccuagccccucgguguccagcgcucagugcaaugcaccccuuuucccaggcuccccgccagaugggcaauccccaggugcgagagaccuccugaaccccuuuugccgcccccuccgccgccgggaccccgcccccgaccgucgucgucucguaguuccaucuguuggagagccgagaccuggugcuucaggcgggcagaaugacuaagggaggaaggucucucuccccgagcucgcacuuucuccccacugccaccucgagggucgccuugcuacaucuaugucaccuccgugccugagcugcuccccuucaguagggccuaagagggagggcgucacagaaaaaaaugcccagcgucugggugggcugugcaaguucccagggagagagacaaggagaaaggagagaggcagcugggugguccugguccugaagaacugcuguggggggcucuucuaccccaagaaugauacaggcagguagaaauggccacuuggauucagggcauugguagaagaggcagagaucugugcuagaaagagcucuggagugacagugcagaacacucaggacccugaguccuuaccugcuccuggacccccguuucuccaucugcaggggagaguuugggggugggagugcauggggcacaaugaagcugagggccucagaggggaugcuuggagaagcugaaaaauccacaagcuguucucugaaauuuccuccccuggggcagccucacuacccaggacccacuguccucauuagccugaggaaaccugguaguuggagaaagcuggggacugcuaauucagaagaagagguagaauucucuagagccucagucuauuuccagcagguguguggcccacaccuggaguggggauacugaggccaggagugggaugacccagcaugcuuaucuccuuugacaguauguacuggggugggcucuguagaccucuccucuacccagggagugggaguggguggggaaggaggcagaagccagguguagggauagacucaaagcgagcgauuucugucuccaacuucccaacaugcauaacucacauuuuugcaagcucugagcuuuuguuucuaaaauccucugggucuucacuuuaauuaaguucuuaugagucuaggauuccguuuccaaaauucuguccacuucucaggaagcccauuggaagcacaggguuccuuccauguuacucaccccuuuucgguccucagccuaaauccgauuaaucagccucuccuuggagucagucuaaauggaugugaagccacuucguccaaguccccuccuuuuuauccaucccuguucauaauccccaacucagaaggcauuuuccaggucaggaaugggaucgauuuucaacauugagguuuggggugggccauagacaggccagcaccguggagucagucccaaccuucaguuuuggaaaggucaaagaagauacaauugggcccugccucaagaaggcuaguggggagaacguggacuccaugaauaacucaucauagcugugucuucucugcagcacucuggggaaggauaaauggacucagagagaauaggauggggauggucuagaaaaguuuuagggugaggugugaucauaucacauacaaccagucaggacuugcuggcuaaugaaagccugggcaugcccaucucugcucccaaguucuuagaguucagaugucuuagcucuggguuaggacccaaccacucaccuuacccccaaccccaggguaaagagauaggguuauggggcauguggagaauggaauggacgaaaggugacucagccccagagagguguuuuccuccuaccaauugaaagggagaugcuagggaagagaccagguccuccucuucuugcugcgucaccuccccaguccaacuucaggcugcccacgcuccuugucucuacaaaaggacugcagaagccggaaagagugacaacugcugacgugcacgggauccuaguaacugcugguuucuaggugacuaaaccuggcagagagaaucauggaaccacaggcugacagaguuaaagggcccuuaagacagcccugaaccugacuccaucuuacaauggaggagcuggagccccagcaaagggggucacauggcaucagagacacagcaaagcccagcacucaggucuccugacucccagaccacuucucacagcaucauauugauaggaguaauaagacgggagaggagaaagacacaagaccagcagccccagccagccagaguccuggcugagucccaucauccaacucucaagccauuggaacccucuucucuugcccggcugugggaggauucaggcacccucauggccucuccccuuaucuccucuggccacuguuucagaugcggugcucugggauuccacgugcccagagaagggaagggggcucauagaggacugaguugcagugaucaguggugagcacagccguggcucuccacccaugggccaccuucugacccccacuaucccuugacaugagauuucguuccaagagacuccaggccuguuuugcucugccagcagauucccacaaccauuuugggcagcagcaugcuuaucucccuggacauaugcccagacaguguaagugacuugcucagggccacacagccagcaaaaaauagaaccuaaugaaauaggguucuccuugccacacccccaagcugaaacugugcccagaagcugguccuucuguuuacaaguucccauuauuaggacaaccuguaaucuuuuuuuccuccaugucucagaguucauuuuuggaucauggcagaguuaaaaaaguggagaggcuauagacaugccuggcuuucuggccacuagaucuuuguggcggucuaggguguauuuguugugccccaguuugucugcauuuuaaggcggaacuggcccuggcugggaacgaggagguccaggagcaguaggaauguugaucuuaggucuugggccugccuccagcacccaccaaaagucaccggauguggaauauuagacucauguaaagcaggaaguuugcaccagagccaagaagagagcuugcagcugccagggaauggccuggcggaggaagcgcagccucgcccagcucagcagaccugcuucaugacagaggcagcucuucugcacucuacuggggccacgcccugccagcauauaucacucccuucaccuggucaggcccagguaccuugccucaacagcaaguucuccagaauugaggggaagagagggagugaauuugcuucucuaacuccagccaccugucucugcccucuccuggucuauaaugcuacuuugcauuccauuuguuuauugucugcccaccucucaaaggauaucagggccacaaaggaccuuaaagaccaccuuauacaaugguuucaagguuucuccuuucccaucacgaccagcccaccugccaaauugugucaaugaugcaaugacauccuuucaagaauagucucagaauuuuguugucugugucacgggcagaguaggcucauaggccacauccuacuagccagcagugaccccaauccccucucucccacugaucaugauccuaucaagccaucaugguugaccugguuggagaguugguucaguucaagguucucauuuuauaaaugaggaaacucagguccgaagaaaagaaagggccaguccaagaccacacagggaguuaauggcaaagggacauggagcccaggucucccagcccacaguccacugcacucugucccuccuuguccuggaggcugacugugagcagcagcuggggagggaggaaggcauaagggucaucaccagccugcucagacccggaacauuaacacaugcagguacuguugcuuuucccuaccucaccacagcccuuucccccaugccuggcucucaguccugcuucccuauuugguaacaacagcuucaucuuuccuguccugcagauugggagccucugaaucaccauguccauacggccucuuccuccuuucuguucaguuuuuccuucacacuggccuaguucagguucucauccucaauugccuggauuauuccaacagccacccaaccagucuccaucagcccgucuaggaacccagucaucagcuuuagggcagucucccugagagcccaguaaauguucugaaauugacaugugauguggaaguaauuagcaaaauaagucauucuccaggguuccauagcacucacuuauuaagugcuuaauauuaauaagugcuuauuaggugcuuaauauuaauaagugcuuuuuaagcacuuaauauuaaguacccgaaaagcacuuauuaagugcuuucauaaucauuaucuuaaacaaggaauuaggagacgucagugcuaguccaguuccaauucucggugauuacuuugagaaagucacucucucuguugggaucuuucauucuuuugaaaacggagauguccaaguuccuuuccagcucuaacugcuccuuuuauggccuguguuccagauggacugccaugguggcauaaguggcaccauuuacgaguacggagcccucaccauugauggggaggaguacauccccuucaagcaguaugcuggcaaauacguccucuuugucaacguggccagcuacugaggccugacgggccaguacauugguaagagcccacccuuccucccugcuuuauuuggggcuguauggcauauuucaaucacaggagcuuuucuggugcaugggggaaagggugauggcaaucacgagaguccaagccccuuuucucagcuccacuguguuccgugguuuugugaagaugauuauauaagccugaggucugauugccuuuggacauguucuaggagauuccuaguuauccuucuucaucucugggcaccucaacaacccuaaaggcagagggauagagauuagguuugugcuuagagcucccuuuggcuggagcaugagaugguaacugaagcuccaucuugcugagaauaucuuauuuucccucagccccaucugcuuuggugcuucucuuggcagcucucuggaaagcaggcaauugccucgaggccccagaguguaugcgugguguagcgggaugaaggagcaggcuacacuucuaaugcccauucuaaaauaaacuuugaagaugaucuaguuuagccuuccccucuucucaaucuacacaugggaaaccaagacucagagcgaagauacaacuuaaacagggucacaaagcuauuagcgguggaauggggcauuuggcgcagguuucaugaucuccugauaugcuuacuccuuucucccuagcugggguagaauacagaggcuaggggaacaggcaaccaaaggcaagcgacagcacccaggggaaaacgcuuuggggcugagcagucuacuggcagggggucagggaggcaagggcaauuugacccuccaugcucugccuggcaaucacaggcgaauucccggaagugaaaggacggcggucacguggcccaguggcugugagugcuuuuucugggaugcuucucucuagccuuggaacagagcagagugcguuugggcaagagaugggcugggugcugcugcaaaagagaccaggggacacugaggaaacuggggagcugggccagggccucaucuguguuccugauuugccaaagauuaugggaggguuguaaccucaccccaaagaaguucucugccuuguauccagggauggauaguucuugcuccagaaaacucaauccugaggguucugaaugagugcucuagcuggcccagguggagggccuuggcaaugggcaggugacugacagcugacuugaggaaggguauuauucuuguccuccaaaccuccaauccauccagauuagagucaagaggauaggaccugagucccagcauugcugugaacucacuggugauccugcgcaagucccucccuuucucgggccucaguaguuccagcggcacagcgggugagccgggggagugguguggaugagacagggcuccucgccaggauacucccacaucugcucuuucucuuuggcccagaacugaaugcacuacaggaagagcuugcaccauucggucuggucauucugggcuuucccugcaaccaauuuggaaaacaggaaccaggagagaacucagagauccuuccuacccucaagugaguacucacucagcauccugagaaagcuccucucacauggcccacaucuuguuaucaaccccaaaucaugguggacauuuaucggccaccaagaacuacucuccucuucuaggauccccaguggaaugagggaagggaagggacaagagagggagaaggacagggacaacugguugugaugugcauccgcagggagcaccaagguugagggacacugaaaagggaccaggcuagaaaggaagaccguggacucacauuaugccuaugcccacugcacauucacuggcuccugcugcccacugcagaauaaauccagacucccaacacccucuccccuguucugucccuuccucucauuucugagcccugugcccaccuccuugggacccaccuaagaacauuucucaacagguauguccgaccagguggaggcuuugucccuaauuuccagcucuuugagaaaggggaugucaauggagagaaagagcagaaauucuacacuuuccuaaagguaagugagcugccaccugugcuggcuggggcugcagccccuccuggcuccagcccacagcgucagggcccaugccaccuccccugcuccugggcucuuggggaauuucuuggcaccugacuauuguuccaacuagagggcucugcagacccugacuagggucucauuggcccauuuuacagaaaggcccagaaggacccagagugaacauacuaagggucucacaaucuucuagagccacagcuggcgcuggcagucuucuaacucccaaacuggggcucuuuucucagggccaggcuauuccccaggaaggccugggaaggaagagggucagggggccucaagcaagguugacacuccucuuaucccugcucuagaacuccuguccucccaccucggagcuccuggguacaucugaccgccucuucugggaacccaugaagguucacgacauccgcuggaacuuugagaaguuccugguggggccagaugguauacccaucaugcgcuggcaccaccggaccacggucagcaacgucaagauggacauccuguccuacaugaggcggcaggcagcccugggggucaagaggaaguaacugaaggccgucucaucccauguccaccauguaggggagggacuuuguucaggaagaaauccgugucuccaaccacacuaucuacccaucacagaccccuuuccuaucacucaaggccccagccuggcacaaauggaugcauacaguucuguguacugccaggcaugugggugugggugcauguggguguuuacacacaugccuacagguaugcgugauugugugugugugcauggguguacagccacgugucuaccuaugugucuuucugggaauguguaccaucugugugccugcagcuguguagugcuggacagugacaacccuuucucuccaguucuccacuccaaugauaauaguucacuuacaccuaaacccaaaggaaaaaccagcucuagguccaauuguucugcucuaacugauaccucaaccuuggggccagcaucucccacugccuccaaauauuaguaacuaugacugacguccccagaaguuucugggucuaccacacuccccaaccccccacuccuacuuccugaagggcccucccaaggcuacauccccaccccacaguucucccugagagagaucaaccucccugagaucaaccaaggcagaugugacagcaagggccacggaccccauggcagggguggcgucuucaugagggaggggcccaaagcccuugugggcggaccuccccugagccugucugaggggccagcccuuagugcauucaggcuaaggccccugggcagggaugccaccccugcuccuucggaggacgugcccucaccccucacugguccacuggcuugagacucaccccgucugcccaguaaaagccuuucugcagcagcugagccua

SEQ ID NO: 21485 - RNA, 19240 nt, Homo sapiens
cggcggcggcgggcgaggcgccugcagccgggcgcaagaugaugaaguuucgguuccggcggcagggcgccgacccgcagcgcgagaagcucaagcaggagcuuuucgccuucaacaaggugcggcggcggcccgggcccgggcucgggcgggagggggcgggacgggggccugggcugggggcccggggucggagccacgucgggcccggggggcgggggcuggcaugcagcgcggcgcggggcggggccgggccgggccgcgcacccccucggcgggccccgcucuggcucggacucugggugggucugggucuccggccgacuuuccgugucugcuccccgagucucugcgggccgcucuggcccuggcucugccagucugugugugugggggucugucucugagacucuuugccugucucugggucucugucccucuuucuccgccgcugaccggcugucucgccccaguugugccuguguguguggugggggugucucugccucugccccuuccuaucucugccugucucccuuuaucucucugccucucauuucucuugcugccugugcgucucugagucuucuuugccugucucucccugcgugucucucucucugucucuguggagucucucgaccucugucgcucacuucugucucuuuauccuuuuucuuaggggcuccauugcgucccugcucggcccuugggacagcccuggggcccgguuuguuuugugcuuuggcacccaggagggugagagaguuagugggggcgaggcagcuguggggggugcggcugggaaaucccuucaaggagccucuccuuccuucccccacugcuccaggcucugccuugcccugcucugcccugcccggggcuccgaguccaggggacaugccuggcuguguacuacacugcacuucgcaucguggggccucaguuucccuagcugugaaaugaggcuacuuuucuccauacugugggcccuggcucccucugccacaugggccagcuguccugccuuucugcaccaagguggagugagguggaggcuuuuccuuccuuucccggagugggacacuaggggccagggaaaggggccgccucagcccccgccucccucugcacugauguuagagcagggccucagcccacuccuggcucacugcucuggggacguugguuuuguccucauucuuaccccagagcccacugauggcagagccucucagugcucuucgaaauuagaguuaucuucaaaauacaggugagaaaauugagguucugagaggggugacggcuugcccggagucagagugagcugcaccaauaucuuucuugaguucuugugucagugggguuggauuuuagccuugaggggcagggauuuuuccaaggggcugcugugguccugggccaguguugugccaggcgcccugggcugccuugaggagacacuugucuuggaggaggcucugggacggcuggaccuggaguaguggaggcacugggaugucucaggguuucccugccuaggucugcagugauugccgaugagagcugccaggacccucacacgguggcugagaaccugcuaggaaccugagaggggcccagaagggaagcuggugcuccgugguccccagauggcaccuauuuucugugccggggaggcugugagggugaggugagaggagaauggcccuucagggaaaggcagcaacaggcacagggcuaaaugucacuuuuuuuuuuuugaaauggggucucacucucacccaggcuggagugcaguggcacaaucacaguccacugcagccucacaacucccuggcucaggugauccucccaucucagccuccugaagcugggacuacaggcucgugucaccaugcccggcuaguuuuuguauuuuuuguagagaugggguuucaccauguugcccaggcuggucucgaacuccuggguucaagcuaucuauccauccauguuggcuucccaaagugcuaggauuacagacaugagcugccaugccuggccuaaaugucauuucuucagccagugaauuggggugugcagugggggcuggagacagaugggggugaagcucagcccacucuggcuagccuugggguggcggaaaguaagggcccuccgcugaggaugaagcgugggcagcagugguggaaagugggguggucuuggggaagggacuuagucaccuaaguggguaauaggugaucgcuagggaauaggccccugauuccugagcuuagggggugggagacaggucaggagugagcagggacuuuggacucugagucuuggguucaaaucccaguccagcccacacaucgccuguggaaugugccuucucuguuaauacugagccccacugugugugaggucuccaaggugcuggggacaacaguaguuaccaaaaaggacaaauaccuguuaacucagguggcugauauaguugugcaggagacagugaaaagccaaaacaaaaaaguaaaauagacuguaguugggaugguagccagugcuguggaucaaauaaaguagggcgagggggugagagguguggccagggcggcugcugcagccaggguggccuugggaggcuucucugaggagauuacuccugagcgacaggaagugcuggaggaagugcguuccaggcagaggggcaguaggugcaaaggcccugaggcacaagccucccuuagcugggagccccaggaggauccugagcaggggagggacaaggaucuggcuguggcuuucauaggaucccucuggccucugugggaacagacuguagugaguaccaauccaggcacgugacgguggggccuggagcagggagggaggugacuucuguguguuuugaaacugaguugauggggcucagaaauggacuggacgugggguaugagggaagcagaugcuggacagugcauguaaccuccuuuccucguuuguaaaaugggaaggcuguggggauuugcgaugcagugucccgucucuggacccugguuguagcgagggacuggcuagacaaggucaggugcagcaagggcgugguauuauuggugggagagagaagccccagccaaaucgccaacucuguccuuaggugggcuuacugucccaagggcccagaugagagacugaagcuuggagaguacugagucuuggagaguacugugacuugcccaaggccagacagcuaggccgugaccaaaccagcugcccagagggcucaguccccaccuggaugggcagaggcaggcagggagggagguucgcguuacaggcugggaacugggguuucuuacaaaugugcaucuuccugaggcagugggucaggaauuaccagugguaaaagugaaaaauaaauaacaacaacaagauaaaaggaguuaccaguggcccacguggguguccugcacugguguucaggauggggcuggagcucagcugugcaggcuucccagggagggcacagccaggccaaagacaggagacuggugcagaaagggugugcugugaaaggggcaggggagcggguggggagcuguuucaucgacacucugggcacacagacccccuuaacaccaucuccgccccugaugguuaugggagucauguugcccagcuguuggcagguggggaggugggaggaugccuucgggguccaggcagaaagcuaccccucucugggccucugucucccugugucugggaggagucaaaagccucugccuagcugauccuggauguugucccuugaccucugaccuccacucaggccuguguuuggggagugucauggucaucuugcgggacuccuccgcaagcuuuagucugugccucuaaaaauggggugcagagcccuucauggagcagguggggccucaucagugccugcaccucugugagccuugcuucaccuguuuguugcuggagccuccaugcaguggggcccacaugagccugugugcauugaggggcacaggggcuuggcaaagggcgggccucuguggacuaugcacgcgguacagucaugguggaggcuagggguuuagccaccuccccaccaacuggaggcaugauaacccauuucacaguugaggacgcugaggcacagagcaaguagaccugccuccuacccccagugugucagcugcagacccuggaggcugccuuggggugggccucagggugggccauggcagaggugccugggagugcuuacccccagcagcccuccccuccuugcagacuguggagcauggcuuccccaaucagcccagcgcccuggccuucgacccggaacuucgcaucauggccaucggcaccaggucuggggcugucaagauguauccuuugcaggacagguguucagggucuguucaggaccaccugccuguaguucccugugcucuggggucccagucuuggcaguguccagcucgagaggaggacagaggugcucugaugggcaguagugggggcuucugcggagguuggcguggcuucuguaccugagacaacugugcagagaugaugggguccuuuugcugagagacgggugguggggggucaguuugcaguagcacagcugucccuugcuacgugucagccagccaguuaccuaggcgacccugccaucgucccagcaacucuggggaggccaggcagaaggcugggcuaugauacccauggaggguggcaggugggcugggggcccuggugagcugaugcacacaugugugaaugugaagacacauguguucagcaaaggggccugggggcagugccaggcucggcauggugagcacagcacggcccccaccuggauacuggcugcugcacaaugggcugugugagccacacaaagcgggcauuuucccugcaggccuggggugggggugggggcaggccggcagcucagugucuccuugccagcccuggagaaucccaccccaacugcucuuggggaagccgaggugccagggucuggcugauggcggcuuggugaggggugcugaccccuaccccuccuguguggccuucuggguuucaguauccugguuucagacaucaguucccagaaaaugugucagugcugggaaaggggagggugugggaugggggucuccucaccccaggacugggggcacugaucaggcagggaugggacucugagccugugguuugugagcucuuugccuacucuggggaguguggaugggcugagauguccccuucucucccauggccccagcggccucuguuggugaguguggcagugcucugggccccacaugcuccgcugccuggccugcugcucccacuccugugggugcugcgcugcgugcgcacaugugucccugcagccuucaggugucccuccuguguuggggucuccagugcacuuguccucaggcucaaaaagaaccugaagugcagaugaggagacugagccucagaaaggaggcuggagcccgggguccucuucccuuuuuccccugacugccacugccuggagccccuuggguugggaaacugaggcuggagagggccagcccuggucacuagaagcugccccucccccugccaggccagccccaucuccuugacgacccugguucccgcccagcugcuccuguccccucuuuugucccuucuucggaguuucucgccaggcuccuguagggaaucugagcucaagcuccaggcaacggcuccuguguugucaccggggcaacguugcugacuccucccugcacccucugucauggggcccccucaggcccugcuguccaccaucagcccuggaguugccgggacucaggcacugacacugggcacuucaagcaggucauccacccccuccaagucugugugcucaucugugaaaugggcaggcuggagucucuccucccucaugauggcaguuguuggcugccugcuuuggagggagguggguuuuuuuuguuuuguuuuguuuuuuugagauggagucuugcucuuuguugcccaggcuggagugcagucgcacaguuuuggcucacugcaaccuuugccucccggguucaagcaguucucugccucagccucccaaauagcugggauuacaggugccugccagcaugcccggcuaauuuuugcguuuuuaguagagacgagguuucaccaucuuggccaggcugguccucaacuccugaccuugugaucuaccugccucggccucccaaagugcugggauuacaggagcgagccaccgugcccagaggagguggguuuucuuacccauggcugaaguuuggccugaagcugugggaaaaggcagccuggacucuucugcccccuggcuuucuuguccaggccuggccuugcaccucuggccugccugaucccauccggcaaggcgcagcucccagaacccauagacacacggagcugaaguggagcggagccccauccucucaccaggcugaggccaagccugcuggguguguuuauucucacuugaucugcaacaguccuguaaagugggagucacuggcccaauuuacgggaagugaagguccuauagcagcaccugacuugcaggagugaguggagccugcacacugaucuuggggauacuguaggggugcagagugggagcuuuagggagggggccuccguucuucagggaggacuccuggauggucaggcccaugccggggcccacuggaauaguccgggucaaggaggagccuugggugucuuccucacugugguuugcuggucuaugccuauuuccaccuugaccugccacccucagcuauggugcaccuggcguggaguucacaggccugcaccgggaugcagccacugucacacagaugcacuucuugaccggccaggugagccucugcuucccacuagccagcucccuguggcccccauaucuacucaucccccuaggccagccuaguuuucaucucugcucacacaccagggccgccuccugucccugcuugaugacagcagucugcaucucugggagauuguccaccauaauggcugugcccaccuggaagaagcacucaguuuccagcugcccagccggcccggcuuugauggugccagguacuggagaacuuggcuggggccagccaccgggcagggaggaucugggggaggcugugggaaccugcugugcaaaggcagcauggagaugggcagcgguucagggcgggaugccuugagcugggccugggucccaggcugcagcuguuggacccugcuuuacugagguauacucugaacuuuucagguuaaaugggagguuuggguugaguccgacgugagcagguaauuaacauugugagcagcaggagguacaugcauuauaugccaaacuucuaggaccugaggccuggcacuacacuuacugcaaugaugggggugucuagggguuuggggcagggccuaagccaguuaguaacaggaaggguccccuggccucuucaguugugggugggagacaggccuuucugugcauaggcaggguugagggcaaggagggucccaugggcugugcuugguaaggcgcuggcagcaugccccagcugagugagaguguggggcaucucucuccccagcccugccugaaauagcuggaaaaggggaguaccaacccagggauggauuccugaugccucccagcuucugcagauggggguaucuggggcccuccugcgaagucaggagaugucugagcgcuggcagcgggauuccuaggaggggcucagcggggagcuccugguccuggcuugggcagugcccugguuccugcuguccucuccuggugggugggaggagcugggagcccagucugcaagaccuagggacccuauuuuuauccaucucccugcugacauccugaugaauaauugagcgggcugaugaugaugcaugucuuccugggguggcucuguaaguaggcccuggugagugcuguggggccagugaugaguuaucagcaguggcccagccccucacaccccaccugagcagguggaugggcuuguacccucacucccuuccccuuguucccugcagugcuccgcucagccuuacccgagucacagugguccugcugguggcugccagcgacauagcagcccugggcacugagggcagcagugucuucuuccuggauguuaccacccugacccugcucgaggggcagacgcuugccccaggcgagguucugcgcagguaagaggccggugggcuucccagcacccacugugugcccgggaaguucugcuggcucaccugccuuccuccacagcgugccagacgacuaccgcugugggaaggcacugggccccguggagucacuccagggacaccugcgggaccccacaaagauucucauuggcuacagccggggccugcuggucaucuggaaccaggccucgcaguguguggaccacaucuuccuggggaaccagguauguaggugaggccuguguccccucagccugggccccuugugcaugcccaccauggcucaugccugccugccugccugccccugccugcccgcagcagcuggagagccuaugcugggggcgugauagcagcacuguggucagcucacacagcgauggcagcuaugcugucuggucuguggaugccggcagcuucccaacgcugcagcccacgguagccaccacaccuuacggugagugcuggggacaccuuagccagaggguggugaugggagggggcaccacugagccaagccaaacuggcugaggagggacuuccccgaggggguggucugggggcagugugucucccgccgacuucccggggaggcaggaggcagcuguaagguagagagcaguggagggcagagcaggaauggcagaauugcuaagaaccaccagugagucuggucugacgcugucccaccccucaggccccuuucccugcaaggccauuaacaagauucuguggcggaacugugaaucuggguaggucgagggaguggguguccgaugugaguugggucuggcuagggggcuggaagggugggcucucccuagguugugcaguaugugcucuggacccaagugguucauggcucgcacaccucccucugcacauaggggccacuuuaucaucuucagcgguggcaugccccgugccagcuauggugaccgccacuguguaagugugcuucgagccgagacauuggugacgcuggacuucacuucccgcaucaucgacuucuucacagugcacagcacacggcccgaggauggugcgugcccugccguacccuacccuuucccagccccaccuggugcccucugccaccuauggcugugcucaccccauacucccuccgucccacagaauuugaugacccccaggcccuggcugugcugcuggaagaggagcugguggugcuggaccugcagacuccuggcuggccagcugugccugccccauaccuggccccgcugcacuccucugcaaucacuugcucggcccacguggccaguguccccgccaagcugugggcccgcauugugagcgcuggcgagcagcagagcccccagccugucuccagugccuuggugugugcggcgaucaggggggucuuacaggguggagucuugaggagggggagaguuucaguucuaagcccggaggucagaaugugccauacucggggugagagggagaagauguucguccuaaccuugugcauacaucucugccacccccucccagagcuggcccaucacugggggccgaaaccuggcccaggagccgucacagcgagggcugcugcugacgggguaggugugcgugcuuaugugggugagugggccccuugcuguugggggagagcccauccugggccuggugggugcagaggugccaggagacucaggccuggccccuggugggaccagguaguuccuccuugcccaaggugguuuggaaugaaaccucccuggaccuugguucaaggugcugcccugaucugccuuuuggccuggaacugagcucuaccaaaccccagggcuccacccgcccagccugccugcccugggacuggaaaaucugggcuggcccacgcugagcugcccagggaaggugccagagagcccagcgugggccuggcgggcgcugacgugcccagugacucaggucucaacuuccugcccugcccccacucccgccugugcugggacccucaggccucugacucuggugugcccuucccugcugaagagcuugccguggcuuucagggcugcuggaaugagucucaaccacccccacagucacacaccucucacgcccuggcucugggcuuucaccaccgccuggggcccugcuuggacucugcagcugugucccaaggcugcgcccuagauuugucuacuccuuccccugcccccucccugcuuucucccggccucuguagucuuccugcuccuccaccuacguggcugccuugggccccaugcagcuccucccccgggaugccccaugcucuguucugugacugccuuacucuugaucaccucugauggcugcuccagugcaggcagaacccccaaaguccucuguucucuacaugucccccuuugccaccuccuguuaaucaggguggucauuuccaccuuguuugguuuaaaggcuccaggugcauauggugcauguggccuggccuauaacaggugcacaguguaccugugcugucuacaguaggugccuauuguuuuuuguaaaaguaggauuccggucaguguuuggcacgugcaguaggugcuuagugagugguuaucagaugagugaauggaggggcgugcaggccucccaggaacucggguagcccugacaucugcccucccugcagccaugaggacggcaccgugagguucugggaugccucggguguggcgcugcggccgcucuauaagcugagcacagcuggccucuuccagacagacugugagcacgcugacagccuggcccaggcugccgaggacgacuggccacccuuccgcaaggugggccccuccccuggcccugaugagcugguccugaccccgccuggacucauuacuccuucccaucccucuaggugggcugcuucgaucccuacagugacgauccccggcuuggcgugcagaagguugcucucugcaaguauacagcccagauggugguggcuggcacugcaggccagguagggcuggguguccccuggguuggagaugucagggagggcuuucuggaagagaugagcuggagggucugguggaaagggagauggacuggcacaggcaaaagccaaggugggaauagggcucuggguggggcuggcuggggugaggacagaugggaagugggccugucgcugggggaaccacaguguugagaggagggaacucaugucagugcugugcuccggcacucacaugacauacaggaggugcucaauguguccuuauugcuaaaugggagauagaggcucaggguaaggguggacacuuugcccucagagggcagggacuagugugucuuggucaccacuguguuccuugugcucagccagggccuugguauacaguaggcauucagugagugcuuguuuagcugaugaacugaagacaguccuagaaccaccuuggugguggcuggggcugcuucagaggcuccaggcugaguggggcccagggcggccccuccccugcgcugaugcucccccugccuggcugugggcucaggugcugguacuggagcuuagugaugugccgguggagcaggcggucagcguggccaucauagaccuccuccaggaccgcgagggcuucacauggaagggccacgagcggcugagcccacgcacggggccgcugcccuggccugcuggcuuccagccccguguccuggugcagugccugccgccagcugcuguaaccgcugucacacuccacaccgaguggagccucguggcuuuuggcaccagucauggcuuuggccucuucgacuaccagcgcaagagcccugugcuggccaggugugugggguggggccggcugggcaguuggagcccccagcgagauggggucugggcuuccguuuccaccucuaguguuugguguggcaaaggccacuaaccuccauugcccuauaagaaauaaccuggcagcuccaagaaggacauucucaguaccaccugcagcuggguccauaggacugcgccagaggggcugugacucccugaccugggugccuccacaggccagcaggagugugguggcugccccaggaggcugcucuauagcacgacuggacccugucuucccccaggugcacucuucaccccaaugacucccuggccauggaggguccgcucucccgggugaagucucucaagaagucacugcgccagucuuuccggcgcauucgcaagagucgugucucuggcaagaagcgggcugcuaaugccagcagcaaggugagcuggggugggcugcacaggagcugugccuguguccugugccuuggccuggcucuggccugggaccccuggggccugcuuagcucagugcuccucccucggcagccccugggcccuccagagggaugggugaacuaagcugggugguagaggaaugguaacagaacguagggcgcaaagcaggaugcaagccacuggggugcuagggagacaguguucaggagcccccgcccggcaguugcaggaagccaaugcacagcuggcugagcaggccugcccccacgacguggagaugacgcccgugcagcgccgcauugagccccgcucugccgaugacuccuugucgggugucgugcguugccuauacuuugccgacacauuccuucgagaugguaaggcaggggcaggggcagggacagggcaaggguugggggggcuggccucaauuggccaccugggagaugggugguggcaagggagguggugggacugcaccuuccaggagguggcugggcacgguggcucaagccugugagugaucccagcacuuugggaggccgaggugggcggaucaccugaggucaggaguuugagacccgccaggccaacauggugaaaccucgucucuacuaaaaauacaaaaauuagccaggugugguggcgggcgccuguaaucccagcuacuugggaggcugaggcaggagaauugcuugaacgugggaggcggagguugcagugagccgagaucguaccacugcacuccagccugugcaacagagugagaccuucucagaaaaaaagcuuaccauccagcucucccagggggacugcugggucacccccagucucucugggggagcuggaugguaaaggauuuuugagugagcugggugggccucucagaucugagccaggagaagggagguugaggccugguggaugacggugaggggcaccagccagugcccaggccccgagccgggcaugugugugggcagcugcccagccacuuggcuggaguggagcaggugagggucgaggugugugguucagggagauacugcugcuggccagaggcugaggaccuggcuuugauucucaguggccugggagcccugggaagguccuggauuuguugauugagucacugauugauuuugaacuuguacaaugggagaguuucaaacauacacaaaaauagagaggugcaaaguugucccacauaccucacaugccugccaccagccaugugccccugcggauucugccccccuccuccacauucuuugcuguuuuuuuugccgggguauuuuaaaugaaaacccagauacaaguacuucagcauguuccugacagaugucacugacagccacugcucacaucaugcccuguagaaccaaugugaauuccugagugucaucugcuuggucuacgagcucagcuuucugaugccauuuauuugucgagggucuuugugcaguggauuuucucacugucuggauguggcgggugcagcugggggugggggguucuuugacuuuuuguuuuuuuugacuacaaagaccuagaagaggagagccugggguuuuuaacuuguuccacuggcccgagaaggccgauggguucauguucauggccggcugggguuccuguugggcauguuuugaguugugcagacacuuaaugccucaggauccaucgggucaucagggagcaggugccgagucugcucuugcuucugcugggcugggcucugauucuccacuaaagcuugucacccagagguucaguucacacaggcagagcagggucgauggauggucguccuagguguccccaggcuuggcggcuuccucuggcugccacguagggagcacacugaagacagugggggugaagcagggcuaagacaaggcacaccugucgacaggacuagcaaggggacgcagggguggagagaggagucggggucuuguggggcuuggggccugagugaugcuaggauggagcugcguuuacugagaugggggcugagggugcagugggauggggcuggaggucugguuugggugcccaucagcauucugugcagaugcgcuacagcuguucgggccucugcaggagggcugcauccugggcuccgacugcagucagcagcauagagcuggggucucaggccucgaggcuggaggucaccagggaggcauggggcaggagggaaucagcccugagucccagggugucauaguuaggaagcagggcuacaagagaggcagggagggaccugcagucugugggaagaccccaggggagaugccuggcccacagggagcacccuccuacgcgcuuguuuucugcaggggcccaccacgggcccaccaugugggcuggcaccaacucaggcucuguguucgccuaugcacuggaggugccggcagcagcaguggguggugagaagcggccugagcaagcgguggaggccgugcugggcaaggaggugcagcugaugcaccgggcgccugugguggccauugccguguuggacgggcguggccgcccacugcccgagcccuacgaggccucacgggaccuggcgcaggcaccugacaugcaggguggucacgcugugcucaucgcaucugaggagcaguucaaggugagccacugugggcugugggggacucugggggacuccccuccaggccccaaccucauggacaccauuggacccucaagaaacccuuccugccuguaucccccacuguugggacccuaauucccuugcaccccagaaaacacucccagccagcagagaacuccuacccaagaacccugaugcccccucagccugcugaguuccccugggagggcaggaaucuaguccuaucucacugugccacacaaggcuccuguacugggcccagaccccugagcccaguccccaggggcucugccucgaaagaacucgagguuugauggggauaccagcugcauaaccuuggcauaacucugugauugauuuugucacagaucgagagagggccugggagguuucuggaguacagugugaagucuggaguuuaguggggcagccagguguacaggcacgggaggccacguagcaugcagcugggcuuuguggugggggcuguugggucagcagccacgagggugaggggcccuggggacgaggacagggccaggcuuugugcucaccagccaccugcugucagguguucacacugcccaaggugagcgcgaagaccaaguucaagcugacggcccaugagggcugucgugugcgcaagguggcacuggccacguuugccaguguggccugcgaggacuaugcugagaccugccuggccugccucaccaaccugggugacguccacgucuucucggugccuggccugcggccccaggugcacuauuccugcauccggaaggaggacaucagcggcaucgcuucgugcgucuuuacgcgccauggccagggugaggcggggcagaggccgaggaggccuuccucaggcgagcgaacugagugggaccaguacugcuugggagcaggaagggcacuccaggugggcacaggcccaggccacggaggagcugugguuggugguaucuucuaacugcacuccucauucuucugcccacccaggcuuuuaccugauauccccaucagaauuugaacgcuucucccuaagugcccggaacaucacagagccgcucugcucucuggacauuaacuggccccgcgaugccacccaggccagguguguggaggggcagcuccuagccugggggaccugugcccagggccaggucucaucccacccccgagaucugccuucccugggcucaggagugggagggcaaggaucuagcgugccagccucaagucauccaccuaugguccccaucauggccccaucucugcaguuacaggauccgagagucacccaagcugagccaggcuaacgggaccccaagcauccugcuggccccacagagccuugauggaagcccugauccagcccacagcaugggaccuggugaggggggcaugaaagggguccagacccuggccccacggugcccugggggagggagucgggacucacauagcucagggaucgggcaggcuucuguaggagaugggugguugugugcucacuggugccaccccucaccaugggcugccuuaugggucugugucccuaggcccccaggugcagagggugcuaaggguccugguaggggcugaugacuugcucccuguagacaccccggagccacccgaggcugcacucucacccauguccaucgacucagccaccagugcugacaccacgcuggacacgacaggggacgucacaguggaagaugugaaggauuuccuggggugaggcuggugggcagguccacagggggggcugcccuguccccuaggccuccguccccagggcugccaggggcucccccgcccccaccccugagcaccauccccaucucgcagcuccucugaggagucagagaagaaccugaggaaccuggcagaagacgaggcccacgccugugccauccugaucaaaugaggugcugcagggguggggcccugguccucaccacuggugacguccacccccuucagcccgucuggguaccauuuggcccuggucuucuaccugagacccuggcaggcccaugugauggcacucucugaaaccuggcugccuuccauggagugccucaauuggggacuucuggugcucacacagacaccagugucaugguuggguauuagaaaagcagggccagccccucagcccuugcaugugacagguggugguuaggacaagaccagauuuguuuuguuuuguuuuguuuuguuuuguuuuugagacggagucuugcucugucgcccaggcuggagugcaguggcgugaucuuggcucacugcaaccucugccuccuggguucaugccauucuccugccucagccuccugagcagcugggacuacaggcgcccgccaccacacccagcuaauuuuuuguguuuuuaguagagacgggguuucacuguguuagccaggauggucucgaucuccugaccucaugauccacccgccucggccucccuaaguccugggauuacaggcgugagccaccgcacccggccaacaagaccagauuaaaccacuuagagguggcaguaguuuggggcuugggagcugguuuggccagccuguuucauagaugagaucacugaggugcacgaggucaggucucaucgguugggcccagcaaguggcugacuuaccccugccugagucuguggauccucaccuagauguggggcccauagaucugcccagcgcauuugcugccucauguucccaggcaccugacuguaggccauagccucacccugcacaggacauggacaccucccagcucuuugucuggugccucucccuggccucaguggggcauauguggccuggcgcuuggauacccaucuggagacucagcaagcccaucucagguggucacugaagggccaugccugcccugcagaggagacaguggcagcaccuguguggucuggccgcuguggcaauccaucugcccuuuugcccucccucaccuucugcugauaccucuucucucccucuuccaggaaggccagaacuaucccgaccuccaccugcccugcucggagcuggagugcuggaucccuggcaccugccuggccccuuaacauagaaccacgccugcuaaccuguaggcuccacugggaccugcuguccugucccgccugacccugggcccuggagcagcaccagccccagggugugggccugggaccugggccagaacugagcccuccugcaggcauuuggcugcccugggggcccacugccuagggaagaggacagguggggcccagcaccugugccaccucccccccuccacacaccauccuucccccucacuuugcagaguauuuuuccuuuuuuuuuuuuuucuuaaagacggagucuugcucugucgcccaggcuggagugcaguggccccaucucugcucacugcaagccccgccuucuggguucccgccauucuucugccucagccucccaaguagcugggacuacaggcgcccaccaccacgcccagcuaauuuuuucuguauuuuuaguagagaugggguuucaccauguuagccaggauggucucgaucuccugaccucgugauccacccaccucagccucccaaagugcugggauuacaggcgugagccaccaugcccagcccugcaaagaguauuuuucuagcgccugggcuggacaguuguuucuaaaacuaaacuauuuugguaccugcuucugggccaguccccagccugucaugagugugugugugcgggcauggaugugacugggagcucugcugggcacccacaucuggggccuagucagguguguguguccggcggggggggggggcaggggggggggucaagaugaguuucccuguagauuguaccuugggguuuuuuucugucguuuuguuaaaauuagcgccauuuuaauauuaaaaauacugauuuuuaauauugaaaauaaaagcauuuaauaucucuuaaagggcaucca

SEQ ID NO: 21486 - RNA, 19240 nt, Homo sapiens
uggaugcccuuuaagagauauuaaaugcuuuuauuuucaauauuaaaaaucaguauuuuuaauauuaaaauggcgcuaauuuuaacaaaacgacagaaaaaaaccccaagguacaaucuacagggaaacucaucuugaccccccccccugccccccccccccgccggacacacacaccugacuaggccccagaugugggugcccagcagagcucccagucacauccaugcccgcacacacacacucaugacaggcuggggacuggcccagaagcagguaccaaaauaguuuaguuuuagaaacaacuguccagcccaggcgcuagaaaaauacucuuugcagggcugggcaugguggcucacgccuguaaucccagcacuuugggaggcugagguggguggaucacgaggucaggagaucgagaccauccuggcuaacauggugaaaccccaucucuacuaaaaauacagaaaaaauuagcugggcgugguggugggcgccuguagucccagcuacuugggaggcugaggcagaagaauggcgggaacccagaaggcggggcuugcagugagcagagauggggccacugcacuccagccugggcgacagagcaagacuccgucuuuaagaaaaaaaaaaaaaaggaaaaauacucugcaaagugagggggaaggaugguguguggagggggggagguggcacaggugcugggccccaccuguccucuucccuaggcagugggcccccagggcagccaaaugccugcaggagggcucaguucuggcccaggucccaggcccacacccuggggcuggugcugcuccagggcccagggucaggcgggacaggacagcaggucccaguggagccuacagguuagcaggcgugguucuauguuaaggggccaggcaggugccagggauccagcacuccagcuccgagcagggcagguggaggucgggauaguucuggccuuccuggaagagggagagaagagguaucagcagaaggugagggagggcaaaagggcagauggauugccacagcggccagaccacacaggugcugccacugucuccucugcagggcaggcauggcccuucagugaccaccugagaugggcuugcugagucuccagauggguauccaagcgccaggccacauaugccccacugaggccagggagaggcaccagacaaagagcugggagguguccauguccugugcagggugaggcuauggccuacagucaggugccugggaacaugaggcagcaaaugcgcugggcagaucuaugggccccacaucuaggugaggauccacagacucaggcagggguaagucagccacuugcugggcccaaccgaugagaccugaccucgugcaccucagugaucucaucuaugaaacaggcuggccaaaccagcucccaagccccaaacuacugccaccucuaagugguuuaaucuggucuuguuggccgggugcgguggcucacgccuguaaucccaggacuuagggaggccgaggcggguggaucaugaggucaggagaucgagaccauccuggcuaacacagugaaaccccgucucuacuaaaaacacaaaaaauuagcugggugugguggcgggcgccuguagucccagcugcucaggaggcugaggcaggagaauggcaugaacccaggaggcagagguugcagugagccaagaucacgccacugcacuccagccugggcgacagagcaagacuccgucucaaaaacaaaacaaaacaaaacaaaacaaaacaaaucuggucuuguccuaaccaccaccugucacaugcaagggcugaggggcuggcccugcuuuucuaauacccaaccaugacacuggugucugugugagcaccagaaguccccaauugaggcacuccauggaaggcagccagguuucagagagugccaucacaugggccugccagggucucagguagaagaccagggccaaaugguacccagacgggcugaaggggguggacgucaccaguggugaggaccagggccccaccccugcagcaccucauuugaucaggauggcacaggcgugggccucgucuucugccagguuccucagguucuucucugacuccucagaggagcugcgagauggggauggugcucaggggugggggcgggggagccccuggcagcccuggggacggaggccuaggggacagggcagcccccccuguggaccugcccaccagccucaccccaggaaauccuucacaucuuccacugugacguccccugucguguccagcguggugucagcacugguggcugagucgauggacaugggugagagugcagccucggguggcuccggggugucuacagggagcaagucaucagccccuaccaggacccuuagcacccucugcaccugggggccuagggacacagacccauaaggcagcccauggugagggguggcaccagugagcacacaaccacccaucuccuacagaagccugcccgaucccugagcuaugugagucccgacucccucccccagggcaccguggggccagggucuggaccccuuucaugccccccucaccaggucccaugcugugggcuggaucagggcuuccaucaaggcucuguggggccagcaggaugcuuggggucccguuagccuggcucagcuugggugacucucggauccuguaacugcagagauggggccaugauggggaccauagguggaugacuugaggcuggcacgcuagauccuugcccucccacuccugagcccagggaaggcagaucucgggggugggaugagaccuggcccugggcacaggucccccaggcuaggagcugccccuccacacaccuggccuggguggcaucgcggggccaguuaauguccagagagcagagcggcucugugauguuccgggcacuuagggagaagcguucaaauucugauggggauaucagguaaaagccugggugggcagaagaaugaggagugcaguuagaagauaccaccaaccacagcuccuccguggccugggccugugcccaccuggagugcccuuccugcucccaagcaguacuggucccacucaguucgcucgccugaggaaggccuccucggccucugccccgccucacccuggccauggcgcguaaagacgcacgaagcgaugccgcugauguccuccuuccggaugcaggaauagugcaccuggggccgcaggccaggcaccgagaagacguggacgucacccagguuggugaggcaggccaggcaggucucagcauaguccucgcaggccacacuggcaaacguggccagugccaccuugcgcacacgacagcccucaugggccgucagcuugaacuuggucuucgcgcucaccuugggcagugugaacaccugacagcagguggcuggugagcacaaagccuggcccuguccucguccccagggccccucacccucguggcugcugacccaacagcccccaccacaaagcccagcugcaugcuacguggccucccgugccuguacaccuggcugccccacuaaacuccagacuucacacuguacuccagaaaccucccaggcccucucucgaucugugacaaaaucaaucacagaguuaugccaagguuaugcagcugguauccccaucaaaccucgaguucuuucgaggcagagccccuggggacugggcucaggggucugggcccaguacaggagccuuguguggcacagugagauaggacuagauuccugcccucccaggggaacucagcaggcugagggggcaucaggguucuuggguaggaguucucugcuggcugggaguguuuucuggggugcaagggaauuagggucccaacagugggggauacaggcaggaaggguuucuugaggguccaaugguguccaugagguuggggccuggaggggagucccccagagucccccacagcccacaguggcucaccuugaacugcuccucagaugcgaugagcacagcgugaccacccugcaugucaggugccugcgccaggucccgugaggccucguagggcucgggcagugggcggccacgcccguccaacacggcaauggccaccacaggcgcccggugcaucagcugcaccuccuugcccagcacggccuccaccgcuugcucaggccgcuucucaccacccacugcugcugccggcaccuccagugcauaggcgaacacagagccugaguuggugccagcccacauggugggcccguggugggccccugcagaaaacaagcgcguaggagggugcucccugugggccaggcaucuccccuggggucuucccacagacugcaggucccucccugccucucuuguagcccugcuuccuaacuaugacacccugggacucagggcugauucccuccugccccaugccucccuggugaccuccagccucgaggccugagaccccagcucuaugcugcugacugcagucggagcccaggaugcagcccuccugcagaggcccgaacagcuguagcgcaucugcacagaaugcugaugggcacccaaaccagaccuccagccccaucccacugcacccucagcccccaucucaguaaacgcagcuccauccuagcaucacucaggccccaagccccacaagaccccgacuccucucuccaccccugcguccccuugcuaguccugucgacaggugugccuugucuuagcccugcuucacccccacugucuucagugugcucccuacguggcagccagaggaagccgccaagccuggggacaccuaggacgaccauccaucgacccugcucugccugugugaacugaaccucugggugacaagcuuuaguggagaaucagagcccagcccagcagaagcaagagcagacucggcaccugcucccugaugacccgauggauccugaggcauuaagugucugcacaacucaaaacaugcccaacaggaaccccagccggccaugaacaugaacccaucggccuucucgggccaguggaacaaguuaaaaaccccaggcucuccucuucuaggucuuuguagucaaaaaaaacaaaaagucaaagaaccccccacccccagcugcacccgccacauccagacagugagaaaauccacugcacaaagacccucgacaaauaaauggcaucagaaagcugagcucguagaccaagcagaugacacucaggaauucacauugguucuacagggcaugaugugagcaguggcugucagugacaucugucaggaacaugcugaaguacuuguaucuggguuuucauuuaaaauaccccggcaaaaaaaacagcaaagaauguggaggaggggggcagaauccgcaggggcacauggcugguggcaggcaugugagguaugugggacaacuuugcaccucucuauuuuuguguauguuugaaacucucccauuguacaaguucaaaaucaaucagugacucaaucaacaaauccaggaccuucccagggcucccaggccacugagaaucaaagccagguccucagccucuggccagcagcaguaucucccugaaccacacaccucgacccucaccugcuccacuccagccaaguggcugggcagcugcccacacacaugcccggcucggggccugggcacuggcuggugccccucaccgucauccaccaggccucaaccucccuucuccuggcucagaucugagaggcccacccagcucacucaaaaauccuuuaccauccagcucccccagagagacugggggugacccagcagucccccugggagagcuggaugguaagcuuuuuuucugagaaggucucacucuguugcacaggcuggagugcagugguacgaucucggcucacugcaaccuccgccucccacguucaagcaauucuccugccucagccucccaaguagcugggauuacaggcgcccgccaccacaccuggcuaauuuuuguauuuuuaguagagacgagguuucaccauguuggccuggcgggucucaaacuccugaccucaggugauccgcccaccucggccucccaaagugcugggaucacucacaggcuugagccaccgugcccagccaccuccuggaaggugcagucccaccaccucccuugccaccacccaucucccagguggccaauugaggccagcccccccaacccuugcccugucccugccccugccccugccuuaccaucucgaaggaaugugucggcaaaguauaggcaacgcacgacacccgacaaggagucaucggcagagcggggcucaaugcggcgcugcacgggcgucaucuccacgucgugggggcaggccugcucagccagcugugcauuggcuuccugcaacugccgggcgggggcuccugaacacugucucccuagcaccccaguggcuugcauccugcuuugcgcccuacguucuguuaccauuccucuaccacccagcuuaguucacccaucccucuggagggcccaggggcugccgagggaggagcacugagcuaagcaggccccaggggucccaggccagagccaggccaaggcacaggacacaggcacagcuccugugcagcccaccccagcucaccuugcugcuggcauuagcagcccgcuucuugccagagacacgacucuugcgaaugcgccggaaagacuggcgcagugacuucuugagagacuucacccgggagagcggacccuccauggccagggagucauuggggugaagagugcaccugggggaagacaggguccagucgugcuauagagcagccuccuggggcagccaccacacuccugcuggccuguggaggcacccaggucagggagucacagccccucuggcgcaguccuauggacccagcugcaggugguacugagaauguccuucuuggagcugccagguuauuucuuauagggcaauggagguuaguggccuuugccacaccaaacacuagagguggaaacggaagcccagaccccaucucgcugggggcuccaacugcccagccggccccaccccacacaccuggccagcacagggcucuugcgcugguagucgaagaggccaaagccaugacuggugccaaaagccacgaggcuccacucgguguggagugugacagcgguuacagcagcuggcggcaggcacugcaccaggacacggggcuggaagccagcaggccagggcagcggccccgugcgugggcucagccgcucguggcccuuccaugugaagcccucgcgguccuggaggaggucuaugauggccacgcugaccgccugcuccaccggcacaucacuaagcuccaguaccagcaccugagcccacagccaggcagggggagcaucagcgcaggggaggggccgcccugggccccacucagccuggagccucugaagcagccccagccaccaccaaggugguucuaggacugucuucaguucaucagcuaaacaagcacucacugaaugccuacuguauaccaaggcccuggcugagcacaaggaacacaguggugaccaagacacacuagucccugcccucugagggcaaaguguccacccuuacccugagccucuaucucccauuuagcaauaaggacacauugagcaccuccuguaugucaugugagugccggagcacagcacugacaugaguucccuccucucaacacugugguucccccagcgacaggcccacuucccaucuguccucaccccagccagccccacccagagcccuauucccaccuuggcuuuugccugugccaguccaucucccuuuccaccagacccuccagcucaucucuuccagaaagcccucccugacaucuccaacccaggggacacccagcccuaccuggccugcagugccagccaccaccaucugggcuguauacuugcagagagcaaccuucugcacgccaagccggggaucgucacuguagggaucgaagcagcccaccuagagggaugggaaggaguaaugaguccaggcggggucaggaccagcucaucagggccaggggaggggcccaccuugcggaaggguggccagucguccucggcagccugggccaggcugucagcgugcucacagucugucuggaagaggccagcugugcucagcuuauagagcggccgcagcgccacacccgaggcaucccagaaccucacggugccguccucauggcugcagggagggcagaugucagggcuacccgaguuccugggaggccugcacgccccuccauucacucaucugauaaccacucacuaagcaccuacugcacgugccaaacacugaccggaauccuacuuuuacaaaaaacaauaggcaccuacuguagacagcacagguacacugugcaccuguuauaggccaggccacaugcaccauaugcaccuggagccuuuaaaccaaacaagguggaaaugaccacccugauuaacaggagguggcaaagggggacauguagagaacagaggacuuuggggguucugccugcacuggagcagccaucagaggugaucaagaguaaggcagucacagaacagagcauggggcaucccgggggaggagcugcauggggcccaaggcagccacguagguggaggagcaggaagacuacagaggccgggagaaagcagggagggggcaggggaaggaguagacaaaucuagggcgcagccuugggacacagcugcagaguccaagcagggccccaggcgguggugaaagcccagagccagggcgugagaggugugugacugugggggugguugagacucauuccagcagcccugaaagccacggcaagcucuucagcagggaagggcacaccagagucagaggccugagggucccagcacaggcgggagugggggcagggcaggaaguugagaccugagucacugggcacgucagcgcccgccaggcccacgcugggcucucuggcaccuucccugggcagcucagcgugggccagcccagauuuuccagucccagggcaggcaggcugggcggguggagcccugggguuugguagagcucaguuccaggccaaaaggcagaucagggcagcaccuugaaccaagguccagggagguuucauuccaaaccaccuugggcaaggaggaacuaccuggucccaccaggggccaggccugagucuccuggcaccucugcacccaccaggcccaggaugggcucucccccaacagcaaggggcccacucacccacauaagcacgcacaccuaccccgucagcagcagcccucgcugugacggcuccugggccagguuucggcccccagugaugggccagcucugggaggggguggcagagauguaugcacaagguuaggacgaacaucuucucccucucaccccgaguauggcacauucugaccuccgggcuuagaacugaaacucucccccuccucaagacuccacccuguaagaccccccugaucgccgcacacaccaaggcacuggagacaggcugggggcucugcugcucgccagcgcucacaaugcgggcccacagcuuggcggggacacuggccacgugggccgagcaagugauugcagaggagugcagcggggccagguauggggcaggcacagcuggccagccaggagucugcagguccagcaccaccagcuccucuuccagcagcacagccagggccugggggucaucaaauucugugggacggagggaguauggggugagcacagccauagguggcagagggcaccagguggggcugggaaaggguaggguacggcagggcacgcaccauccucgggccgugugcugugcacugugaagaagucgaugaugcgggaagugaaguccagcgucaccaaugucucggcucgaagcacacuuacacaguggcggucaccauagcuggcacggggcaugccaccgcugaagaugauaaaguggccccuaugugcagagggaggugugcgagccaugaaccacuuggguccagagcacauacugcacaaccuagggagagcccacccuuccagcccccuagccagacccaacucacaucggacacccacucccucgaccuacccagauucacaguuccgccacagaaucuuguuaauggccuugcagggaaaggggccugaggggugggacagcgucagaccagacucacuggugguucuuagcaauucugccauuccugcucugcccuccacugcucucuaccuuacagcugccuccugccuccccgggaagucggcgggagacacacugcccccagaccacccccucggggaagucccuccucagccaguuuggcuuggcucaguggugcccccucccaucaccacccucuggcuaagguguccccagcacucaccguaaggugugguggcuaccgugggcugcagcguugggaagcugccggcauccacagaccagacagcauagcugccaucgcugugugagcugaccacagugcugcuaucacgcccccagcauaggcucuccagcugcugcgggcaggcaggggcaggcaggcaggcaggcaugagccauggugggcaugcacaaggggcccaggcugaggggacacaggccucaccuacauaccugguuccccaggaagaugugguccacacacugcgaggccugguuccagaugaccagcaggccccggcuguagccaaugagaaucuuuguggggucccgcaggugucccuggagugacuccacggggcccagugccuucccacagcgguagucgucuggcacgcuguggaggaaggcaggugagccagcagaacuucccgggcacacagugggugcugggaagcccaccggccucuuaccugcgcagaaccucgccuggggcaagcgucugccccucgagcagggucagggugguaacauccaggaagaagacacugcugcccucagugcccagggcugcuaugucgcuggcagccaccagcaggaccacugugacucggguaaggcugagcggagcacugcagggaacaaggggaagggagugaggguacaagcccauccaccugcucagguggggugugaggggcugggccacugcugauaacucaucacuggccccacagcacucaccagggccuacuuacagagccaccccaggaagacaugcaucaucaucagcccgcucaauuauucaucaggaugucagcagggagauggauaaaaauagggucccuaggucuugcagacugggcucccagcuccucccacccaccaggagaggacagcaggaaccagggcacugcccaagccaggaccaggagcuccccgcugagccccuccuaggaaucccgcugccagcgcucagacaucuccugacuucgcaggagggccccagauacccccaucugcagaagcugggaggcaucaggaauccaucccuggguugguacuccccuuuuccagcuauuucaggcagggcuggggagagagaugccccacacucucacucagcuggggcaugcugccagcgccuuaccaagcacagcccaugggacccuccuugcccucaacccugccuaugcacagaaaggccugucucccacccacaacugaagaggccaggggacccuuccuguuacuaacuggcuuaggcccugccccaaaccccuagacacccccaucauugcaguaaguguagugccaggccucagguccuagaaguuuggcauauaaugcauguaccuccugcugcucacaauguuaauuaccugcucacgucggacucaacccaaaccucccauuuaaccugaaaaguucagaguauaccucaguaaagcaggguccaacagcugcagccugggacccaggcccagcucaaggcaucccgcccugaaccgcugcccaucuccaugcugccuuugcacagcagguucccacagccucccccagauccucccugcccgguggcuggccccagccaaguucuccaguaccuggcaccaucaaagccgggccggcugggcagcuggaaacugagugcuucuuccaggugggcacagccauuaugguggacaaucucccagagaugcagacugcugucaucaagcagggacaggaggcggcccuggugugugagcagagaugaaaacuaggcuggccuagggggaugaguagauaugggggccacagggagcuggcuagugggaagcagaggcucaccuggccggucaagaagugcaucugugugacaguggcugcaucccggugcaggccugugaacuccacgccaggugcaccauagcugaggguggcaggucaagguggaaauaggcauagaccagcaaaccacagugaggaagacacccaaggcuccuccuugacccggacuauuccagugggccccggcaugggccugaccauccaggaguccucccugaagaacggaggcccccucccuaaagcucccacucugcaccccuacaguauccccaagaucagugugcaggcuccacucacuccugcaagucaggugcugcuauaggaccuucacuucccguaaauugggccagugacucccacuuuacaggacuguugcagaucaagugagaauaaacacacccagcaggcuuggccucagccuggugagaggauggggcuccgcuccacuucagcuccgugugucuauggguucugggagcugcgccuugccggaugggaucaggcaggccagaggugcaaggccaggccuggacaagaaagccagggggcagaagaguccaggcugccuuuucccacagcuucaggccaaacuucagccauggguaagaaaacccaccuccucugggcacgguggcucgcuccuguaaucccagcacuuugggaggccgaggcagguagaucacaaggucaggaguugaggaccagccuggccaagauggugaaaccucgucucuacuaaaaacgcaaaaauuagccgggcaugcuggcaggcaccuguaaucccagcuauuugggaggcugaggcagagaacugcuugaacccgggaggcaaagguugcagugagccaaaacugugcgacugcacuccagccugggcaacaaagagcaagacuccaucucaaaaaaacaaaacaaaacaaaaaaaacccaccucccuccaaagcaggcagccaacaacugccaucaugagggaggagagacuccagccugcccauuucacagaugagcacacagacuuggaggggguggaugaccugcuugaagugcccagugucagugccugagucccggcaacuccagggcugaugguggacagcagggccugagggggccccaugacagagggugcagggaggagucagcaacguugccccggugacaacacaggagccguugccuggagcuugagcucagauucccuacaggagccuggcgagaaacuccgaagaagggacaaaagaggggacaggagcagcugggcgggaaccagggucgucaaggagauggggcuggccuggcagggggaggggcagcuucuagugaccagggcuggcccucuccagccucaguuucccaacccaaggggcuccaggcaguggcagucaggggaaaaagggaagaggaccccgggcuccagccuccuuucugaggcucagucuccucaucugcacuucagguucuuuuugagccugaggacaagugcacuggagaccccaacacaggagggacaccugaaggcugcagggacacaugugcgcacgcagcgcagcacccacaggagugggagcagcaggccaggcagcggagcauguggggcccagagcacugccacacucaccaacagaggccgcuggggccaugggagagaaggggacaucucagcccauccacacuccccagaguaggcaaagagcucacaaaccacaggcucagagucccaucccugccugaucagugcccccaguccuggggugaggagacccccaucccacacccuccccuuucccagcacugacacauuuucugggaacugaugucugaaaccaggauacugaaacccagaaggccacacaggagggguaggggucagcaccccucaccaagccgccaucagccagacccuggcaccucggcuuccccaagagcaguuggggugggauucuccagggcuggcaaggagacacugagcugccggccugcccccacccccaccccaggccugcagggaaaaugcccgcuuuguguggcucacacagcccauugugcagcagccaguauccaggugggggccgugcugugcucaccaugccgagccuggcacugcccccaggccccuuugcugaacacaugugucuucacauucacacaugugugcaucagcucaccagggcccccagcccaccugccacccuccauggguaucauagcccagccuucugccuggccuccccagaguugcugggacgauggcagggucgccuagguaacuggcuggcugacacguagcaagggacagcugugcuacugcaaacugaccccccaccacccgucucucagcaaaaggaccccaucaucucugcacaguugucucagguacagaagccacgccaaccuccgcagaagcccccacuacugcccaucagagcaccucuguccuccucucgagcuggacacugccaagacugggaccccagagcacagggaacuacaggcaggugguccugaacagacccugaacaccuguccugcaaaggauacaucuugacagccccagaccuggugccgauggccaugaugcgaaguuccgggucgaaggccagggcgcugggcugauuggggaagccaugcuccacagucugcaaggaggggagggcugcuggggguaagcacucccaggcaccucugccauggcccacccugaggcccaccccaaggcagccuccagggucugcagcugacacacuggggguaggaggcaggucuacuugcucugugccucagcguccucaacugugaaauggguuaucaugccuccaguugguggggagguggcuaaaccccuagccuccaccaugacuguaccgcgugcauaguccacagaggcccgcccuuugccaagccccugugccccucaaugcacacaggcucaugugggccccacugcauggaggcuccagcaacaaacaggugaagcaaggcucacagaggugcaggcacugaugaggccccaccugcuccaugaagggcucugcaccccauuuuuagaggcacagacuaaagcuugcggaggagucccgcaagaugaccaugacacuccccaaacacaggccugaguggaggucagaggucaagggacaacauccaggaucagcuaggcagaggcuuuugacuccucccagacacagggagacagaggcccagagagggguagcuuucugccuggaccccgaaggcauccucccaccuccccaccugccaacagcugggcaacaugacucccauaaccaucaggggcggagaugguguuaagggggucugugugcccagagugucgaugaaacagcuccccacccgcuccccugccccuuucacagcacacccuuucugcaccagucuccugucuuuggccuggcugugcccucccugggaagccugcacagcugagcuccagccccauccugaacaccagugcaggacacccacgugggccacugguaacuccuuuuaucuuguuguuguuauuuauuuuucacuuuuaccacugguaauuccugacccacugccucaggaagaugcacauuuguaagaaaccccaguucccagccuguaacgcgaaccucccucccugccugccucugcccauccagguggggacugagcccucugggcagcugguuuggucacggccuagcugucuggccuugggcaagucacaguacucuccaagacucaguacucuccaagcuucagucucucaucugggcccuugggacaguaagcccaccuaaggacagaguuggcgauuuggcuggggcuucucucucccaccaauaauaccacgcccuugcugcaccugaccuugucuagccagucccucgcuacaaccaggguccagagacgggacacugcaucgcaaauccccacagccuucccauuuuacaaacgaggaaaggagguuacaugcacuguccagcaucugcuucccucauaccccacguccaguccauuucugagccccaucaacucaguuucaaaacacacagaagucaccucccucccugcuccaggccccaccgucacgugccuggauugguacucacuacagucuguucccacagaggccagagggauccuaugaaagccacagccagauccuugucccuccccugcucaggauccuccuggggcucccagcuaagggaggcuugugccucagggccuuugcaccuacugccccucugccuggaacgcacuuccuccagcacuuccugucgcucaggaguaaucuccucagagaagccucccaaggccacccuggcugcagcagccgcccuggccacaccucucacccccucgcccuacuuuauuugauccacagcacuggcuaccaucccaacuacagucuauuuuacuuuuuuguuuuggcuuuucacugucuccugcacaacuauaucagccaccugaguuaacagguauuuguccuuuuugguaacuacuguuguccccagcaccuuggagaccucacacacaguggggcucaguauuaacagagaaggcacauuccacaggcgaugugugggcuggacugggauuugaacccaagacucagaguccaaagucccugcucacuccugaccugucucccacccccuaagcucaggaaucaggggccuauucccuagcgaucaccuauuacccacuuaggugacuaagucccuuccccaagaccaccccacuuuccaccacugcugcccacgcuucauccucagcggagggcccuuacuuuccgccaccccaaggcuagccagagugggcugagcuucacccccaucugucuccagcccccacugcacaccccaauucacuggcugaagaaaugacauuuaggccaggcauggcagcucaugucuguaauccuagcacuuugggaagccaacauggauggauagauagcuugaacccaggaguucgagaccagccugggcaacauggugaaaccccaucucuacaaaaaauacaaaaacuagccgggcauggugacacgagccuguagucccagcuucaggaggcugagaugggaggaucaccugagccagggaguugugaggcugcaguggacugugauugugccacugcacuccagccugggugagagugagaccccauuucaaaaaaaaaaaagugacauuuagcccugugccuguugcugccuuucccugaagggccauucuccucucaccucacccucacagccuccccggcacagaaaauaggugccaucuggggaccacggagcaccagcuucccuucugggccccucucagguuccuagcagguucucagccaccgugugaggguccuggcagcucucaucggcaaucacugcagaccuaggcagggaaacccugagacaucccagugccuccacuacuccagguccagccgucccagagccuccuccaagacaagugucuccucaaggcagcccagggcgccuggcacaacacuggcccaggaccacagcagccccuuggaaaaaucccugccccucaaggcuaaaauccaaccccacugacacaagaacucaagaaagauauuggugcagcucacucugacuccgggcaagccgucaccccucucagaaccucaauuuucucaccuguauuuugaagauaacucuaauuucgaagagcacugagaggcucugccaucagugggcucugggguaagaaugaggacaaaaccaacguccccagagcagugagccaggagugggcugaggcccugcucuaacaucagugcagagggaggcgggggcugaggcggccccuuucccuggccccuagugucccacuccgggaaaggaaggaaaagccuccaccucacuccaccuuggugcagaaaggcaggacagcuggcccauguggcagagggagccagggcccacaguauggagaaaaguagccucauuucacagcuagggaaacugaggccccacgaugcgaagugcaguguaguacacagccaggcauguccccuggacucggagccccgggcagggcagagcagggcaaggcagagccuggagcagugggggaaggaaggagaggcuccuugaagggauuucccagccgcaccccccacagcugccucgcccccacuaacucucucacccuccugggugccaaagcacaaaacaaaccgggccccagggcugucccaagggccgagcagggacgcaauggagccccuaagaaaaaggauaaagagacagaagugagcgacagaggucgagagacuccacagagacagagagagagacacgcagggagagacaggcaaagaagacucagagacgcacaggcagcaagagaaaugagaggcagagagauaaagggagacaggcagagauaggaaggggcagaggcagagacacccccaccacacacacaggcacaacuggggcgagacagccggucagcggcggagaaagagggacagagacccagagacaggcaaagagucucagagacagacccccacacacacagacuggcagagccagggccagagcggcccgcagagacucggggagcagacacggaaagucggccggagacccagacccacccagaguccgagccagagcggggcccgccgagggggugcgcggcccggcccggccccgccccgcgccgcgcugcaugccagcccccgccccccgggcccgacguggcuccgaccccgggcccccagcccaggcccccgucccgcccccucccgcccgagcccgggcccgggccgccgccgcaccuuguugaaggcgaaaagcuccugcuugagcuucucgcgcugcgggucggcgcccugccgccggaaccgaaacuucaucaucuugcgcccggcugcaggcgccucgcccgccgccgccg

SEQ ID NO: 21487 - RNA, 5801 nt, Homo sapiens
auacauacacagacauacaaacacacgcacccgagugaaugacagggaccaucaggcgacagauugaagggcagagggaggcagcacccuccgagaguuggcccggacccaagggugggcugagaccugggccaggggcagccguuccgagggguuaugccugagcaguuuggagaugagguccugggcucccaugggcacggaagcggggaacuuuagguccaccugcaggugugaagagauggaagggcugcauuaguuucacccuggcuacaucuuccuugacuacccauucuguuuggaguuacuuagggccaugcaaauacacucugcccacccccagccccccagcuccuggcuucagcagcuggcacgaagcccaggccgcccucccaccuugacgaugcggcgauaggucucguugugugaugcacucucaaaggguggguuccccaccagcagcucauagcaaagcacuccaaugcaccacagauccaccuucucauugugcaugcgccccucaaucaucucugggggcagguaguccagggugccacacauugucuuccuccugggagggauaaggggcgugggcagggguccuagugacauaggaacucuccuuucccugcugccugacggcugggagccaaaagaccacgggauguaccaggggagagguccagccaggcaaggccacuggagugggggugggguuggggugaugauauaucccaaagccccagaggugagccugcacacagcccagcaacuccacacugaaggauauaucuuaauaagauacccugauaugagggcaguguucauuuggaguucacuggggacaucucuaaugcccaucaggcauguucugguuaaauaaaucagcuacuaugugauacuaugaaaccauuaaaaagugaugugggaggaaaaaaggccacugcuccgggcuuuuuuugagagaguccaggcuggagugcaguggggcgaucuuggcucacugcaaccucugccucccggguucaagugauucucaugucucagccucccgaacagcugggauuacaagugugcaccaccaugucugcuuaauaaauuuuguguuuuuaguaaagaugggguuucaucauguuggccaggcugguccgcuggucuugaacuccuggccucaagugauccacccgccuuggccucccaaagugcugggacugguaggcgugagccaccgcgccuggccaaaguuuuaccauuggccccuacagggaucaaaccugcgaccuugggguuauuagcaccacacucuaaccauuuuuuuuuuuuuuuuuugagacagagucucgaucugucacacaggcuggagugcaauggcguaaucucggcucacugcaaccuccgccucccagguucaaacaauucuccugccucagccuccccaguagcugggauuacuggcguccgccaccauggccggcuaauuuuuguauauuuaguagagacaagguuucaucauguuggcaaaucuagucucgaacuccugaccucaggugauccgcccuccucggccucccaaagugcugggauuacaggugugagccacggugcacggccccuggagagguuuuaauggcccagccucacacccaggucuggccucccaggccaccauaccucagggagggcgcaugcacagaccagccgaagucagcaaucuucagcucucccuugagcccuaagagcagauuuucuggcuuuaugucucugugaaucaccuucuucccauggcaguacauuagagcaucugccaacuccuccaugaucugggaggggcaacgacaggcaaucagacaaggauggaccuccagcuacaagcagcacacccucagccucgagcccccuacuggcgccccaggugcccacccgcccggaccguggcuguucgcugcucgucaaaugugcagcucuucugcagcuccuuguagagcuccccgcggggggcauacucuagaaucaaguagauccuccuccggucauaaaaauaguuguagagacgcaggauguugggauggcugggggaagagacagaggaggccucaggccaaaggcauaaaagagcuggaaaagaugauaggagcaaacuggggucagacguggcccaggccggggacaccagggcugggagugguaaggggaaacuggaggcagauuucuggauucaaggcuugccaggacuaagagcuaaauggggcucacuagccauagcuacagagaaagcaaucuggaugaaguggggcugaaugaggagcugggggugagggagcagaggggcuucggcucagggggcaucaacccauacugcaggugggccuggauuucgaucucucugcgcagcugaugcuccacgcccuccuucucuaucugggacuugaagaggaccuugagcgccacgaugaaauggcuuuucuucucccgagccaaguacacguuuccaaacuugccuuugcccagaggacgcccaaucucaaagucaucaauugugaagugccgccugcuuagaaaguggaggaaggcaacucagaaccgguuuugguuauuaagagguuugcuuucucucugcuuccucaucccauccuguccuccgccccacuugucuucaucccuacuccucccgugcuuagguuuuaucuccccgacuuccugccuguucauuguccccucacccccguccacccccaggcuuggggcacuuacguuaagaugucgggugucccacugcuauucuccaucaccuucuggccaggggcagcuaaggagagaacagguagguugaaugcgaacagggaugaccuucucaucccuaaacccucccacagacggucaucuccccagcucaguccucucccccuugcgccaguuaccugugggcuggacauuggagcggcucaugaggacaagugcagauggggugacaggcucuuuccggaggacucgcuggggcagggugcucaggccagauggagccugagaaggagcaggggguagcucugagggugccuuugucugaugaccgggguggaaugugcugcaagcaguauuucagccccuugcuaaagagccacccacccaccuacccccaauucaaagagaaacacugaugugacaguuuugcuucccagccucugcucauagucccauauuaaaauggguuauuaauaaacaaccuagggcugggcgcaguggcucccgcagucaggaguucaagaccagccuggccaacauggugaaacgccaucucuacuaaaaauauaaaaaauuagcugggugcggcugggcgugguggcucaugcuuguaaucccagcacuuuggaaggccgaggcaggcggaucacaaggucaggaguuugagaccagccuggccaacacagugaaaccccaucucuacuaaaaauacaaaaauuagcuggccgugguggcacgcuccuguaaucccagcuacucaggaggcugaggcaggagaaucgcuugaaccugggaggcacagguugcagugagccgagaucguaccauugcacuccagccugggcaacagagcuagacuccaucucaaaaaaaaaaaaaaaaauuagccaggugugguggcaggcgccuguaaucccagcuacucgggaggcugaggcaggagaaucgcuugaaccugggcggcagagguugcagugagcugagaucgcaccauugcacuccagccugggcaacacagugaggcuccgucucaaaaaauaaauaaauaaauaaauaaauaaauaaauaaauaaaaaauaaauaaccuaaguaggccuaagauaaggggcaaaggacucacaccaacaccuaacauuucacuucuuuggcccuggcccacacuuuucaggcaugaagcuguucaaccuguauaaguccuguccauaacaacacagucauucauccagccccucacuuacaccacaguagagagcugcgucaaugaacacccacaauucaagggguuuagcacagagguauucucaaagucuccuaaaaagcuuaguuuauuaaggcuuagauaagaugcuugaggccuugaauguuauagcaauaaccaggauuuacacuuuugcaagaacaggcuuuaaggacacuaagagcuacccugauggcccuggaccacuucucacuuucaacuucuucauuuuuuuuuuuuuuugagauggagucucgcucuauuacccaggcuggagugcaauggugccaucucggcucacugcaaccuccaccucccagguucaggcaauucuccugccucggccuccugaguaggugggauuacaggcacaugccuggcuaauuuuuguauuuuuaguagagacgggguuuuaccauguuggccaggcuggucucgaacuccugaccucaggugauccaccugccucagccucccagugcugggauuacaggcgugagccaccuaccuggccucacuuucaacucucaaaauaauagguacauuuucuuuuaggagugacuaagguaaaagugacaaugguuucucauucagacuccauuccugacagccucacucagugcuccaugagggagggagcugauguacaagggaacagacagacucuccaggaagcaagagcuccaaaaacagggagcaaagccugugcagggccccuuccuucuucugcagccaagagaagaaagccccuaggccccaaauagugauauugguaccaaucuacaaauaagcaaguugaauaaaauacaguccagaaauagacccacauauaugugggaauuuauauauauaauaaagguggcauuucaaaucagagaggaggcccuucaaugaaaucugucuggaccauugggaaauaagucaauuuagauccauuuagauucuuaccucaauuuagucauuaauuccaaauuguaauuuagacuugcccugggccuuuuaaacuguaacuuuauauccuuuuagagucuauuucuauuugcugucuaguuuuuuuuuuuucaggauauggauugggaaucauggccugaaggccaggcccugccugcucagucccagauaucauuuguaugugacgagcccugcagagguccucaccagcugggagucacuggcuggucagauucacguuggcagcaccugacaggauguggcuacaaaugaccagagcggguucugucgucaaacuugggacccguacuuuggagcauaacggggaagaaagugcuuaaaggauugcucauugcaggaucucaaguuucccagcaggaacucgccaugcggggucaugggggcgcagggacggagggaagggccuuaccgucugucggccguagggccagggguaggaguucuccuucugggccauccuuagagagaaagggggaggagagcugggcggagaagggaaacagccgugagaagcagagaaaaagagagagagagggagggguuggaccgaucgagccggaagcgcuagcccgagcugguaaaagggagcaggucagcacacuagccccaaucugggcgcuggucucaccgcccccgcccugcuaucgucccuaccuccuuccagcccugcggcgugcgcgcaggccagcccaacggacccucugaucuaccugaucaucugcccacucccggcgcaaggccugcgacaggaggccagcucaccugggguccaaggcacugcuacucucccggccgcccgcaaacaacugaaucugccacgccgcgcccuggccaaggacuuuucaaaucuccc

SEQ ID NO: 21488 - RNA, 2787 nt, Homo sapiens
uuaggccacuuccugggggcggagaggaccucagcggcugcggcgacacccagggaaggcggcgcggccgggucccgaaacuccuggcuguuuccaucagagcccucggacacucccagcccgggcugagcacgcaucgucgcuccccggcggauacaagggggcuccgccauccgcucccgucaguucggccuccaucuccugggacccgcgccggcagccaggccaggccucugaguggccccagagcccuggcuggacucguccacggcggcagcgaucugcccggggucucggaggccaucccuucagagucggcccugugcucgccaccgucaccugcugguuggauuccggaaacccacugucugaagaccacagaggggugucgcugaccaccccaaaucggauacguccagaccucaagcucccuuccccucucuggcugcccucugcucuuuucaucucuucucucaaccuuuuggggauuucuguguccugacaccaccuccccauccaccaccaaaguagccggggugagccccaaaccuuacugggugugcuccaccugugccuccaacccagcgaaucugacagcuucgacccaauucugcacacacccaggaaguucugccuuuucuuuucuuucggugucuccuguacuucccaaaauuucuccuccuccugugcccucuucgccccccuccuuugggggccccgugacccugaauguggggggcacacuauauuccaccacuuuggagacccugacccgcuucccagacucuaugcugggggccauguuuagggccggcacccccaugccccccaaccucaauucccaaggaggcggccacuacuucaucgaccgggauggcaaggccuuccggcacauccucaauuuccugaggcugggccgccuggaccugccccguggguacggagagacagcgcugcucagggcagaggcugacuucuaccagauccggccccuccuggacgcgcugcgggaacuggaggccucucaggggaccccugcacccacagcugcccugcuccacgcagauguagaugucagcccccgccuggugcacuucucugcucgccggggaccccaucacuaugagcugagcuccguccagguggacaccuuccgagccaaccuuuucugcaccgacucugagugucuaggugcuuugcgggcccgauuugguguggccaguggggauagggcagaggggagcccacauuuucaucuggagugggccccccgccccguggaacuccccgagguggaguaugggagacuggggcugcagccgcuguggacuggggggccaggagagcggcgggagguggugggcaccccaagcuuccuggaggaggugcugcggguggcucucgagcacggcuuccgacuagacucugucuuccccgaccccgaagaccugcucaacuccaggucucugcgcuuuguccggcacugaggaugcuguucucaguuugacuguggggaggagagagaaugggguacuagcaccccugaagccucuuuccagcucugcuucaggagcuaugagagucgggacucuccugcaccugacuggagcucagaugugggcaggaauucccaaaccugagcccaccaaggacucacaagugguccagaaggucucaaccugugcugacccugggagggguagggaagguucucucagcuuguucuugccuaaggcugagcaccuccagucucuccuugauuuggagcucaguguuuaagggcuuggaaaaggggggaacaucucuuuacccagacuagaccuagcaaaacccuggaaggauauugaggucuggggaaaagggaggacuuugcauuuucccaaugcggucucuuggaccauggcuucuacuccugaagcuggguggccuggccuggccugaccaaugagaggccagaacacucuggaacaucggaagaggaguucuuugcuauguuccaagccaucuacugagggaggcagaaaggccacaacccacccuagguugauguaugggagcuaggacaguccccauggcaauggggcuggagcaucccucaucuggaagaaucccauacugauggcagggcuggccagggggaagaggguaguaucuguggguccuggccuuucuucaugugugcgugcauaucagcccguguggcugacugauguauaggucccuggcauccugguucauaucuguguugcugacuacagugucugugauguccgcauguccaggccuguuugggguugccuagcgacucuucuggcacagggugugucugugguauaccugugaggugguugacaauuaguaguuuaaucacaggguguguguguguguguguguguguguguuuaugugcacgcauguauaugcaucaccacguagccaggaggggccuguugggguuugagucacugggaucuuccuggugagagguaagagaagucacugggcuuagcugggccucugaggccuguauggaacucuugguugcugaggcaaccauggaccuguugcuaggagauagcuggggaaggcccaaggccgcccagggcagagagaggagacgaagaguuugggacagugggggaggagaugggaagggaugggauuucugggucccagagcgggugggauacucacgcacagcuucuucacuggugggggguggggcacacauuauuucucacuggucaugauuuacaagaagaaaaauaaaacugcuuuuggaaccac

SEQ ID NO: 21489 - RNA, 10846 nt, Homo sapiens
cagggaucuuggcagcgggcgaggaggcugcgagcgagccgcgaaccgagcgggcggcgggcgcgcgcaccaugggggagaaacccgggaccagguaagggagguggggccacgcggcggggcaugggcggcggcucggggcgggggcugggacggucccagacgagggcgcagcggagaggaucugggggccggacgccugggucccuagggacagccauccggggccgcacgcgcagguccucgaggauaaugagggugggggggaaaugcccgggccccugcagaaagcgaggccugagggggaucagaaaaaccggugucgggguucucgcagggauguggggccagacuacugggcucucccgugcaggcugcgaugcagggauggaggaaggaggagcagguggcuggccccgaggggucguguacggggaggcuggaugccgggacgggggggauccacuccagacucgcgccaagccaauggaaagccuccuauccaauaucccccagguagucgcgcugcccacaccugucccgagggccggguggcuccucacccaaacuucuaccuucccuuggguugccaggagcaacagcuucaucuugggggagccgagugcguggcgacccucccugaaacuagaucguaucccucucucugggggugggggaggcaguauucacccugggcgcgcguccacuccccggauguuuucugugcaaucgaggcucuuuccuuccacugauaccccgaguucucuuuuuuggucucuagcaaaauccacuuccuguugugacucaacacccccaaggggcaagggguggaugccugagucgcaggggagcgggagcaaaagacgaaaagguuggggcuguaggccucaacucagaggguaucaggaauagggaauugguccugagcucuggcuugcucugcaaaacaucauaucaaccccacuuccaaccuauagaguaugagaacccggguuucugagcaucaaguagacgagcaucagaaagagaucaucagagagaugauccgucuccuggaucaggguuuaaacaucccagagaaaggggaaguugcugacuugugggaggccccugauuuccgucaugugguucagggagugggacggauggaccaaaggagacugcuaacuuggcacaauuucccucacccccaugaaauucugggccacaggaaauggagcgaauagcaggaagugugaaaggacaucugcuucagcuaccccugcucccacugggcaccucccuggucauccccacacucugccuccuuggccagccuaguauaugcacgcugcuccuccccagccuggcaggagguggcuggguuaggauccaaagggcaagugccuugcagcugcuccagggcaauugccccagaaccacacuccaguuggcccacugauuguggcugucacagcccugugccagggcuccuaaugggaggacacccugggacaaagaggaaaaccagaagcaaaggggagggagagccuggaugaugccacggcacucagcucccaaguugggaugaaagauaggguguuuauucuagcggcuaccauaucgauguguauucucuuuuauugguuaggaauaccuggggcccuccauacccuuugccuuacaaccuuuggacagcuuggcuuucugggaagaaggggcaagugaaguuguagcagaaacugggccuaugguagaaaccauguagggccaaaggccagggucauugcucuccuauaugcuccagcugucagagcuggagaccagauggaaagaugguuaggucuuacccagacacugugguaaccugcccauugggguccucugggaauggggugguagacuuggaagagggaugggcuaguuggcaggauuucacguuucugcuaucuaucugaggauccuuuccagggaucacugcugaggcagaguggauuggaaggaguaagguggugcuucaaagaacaggcccacaauuggccagaucacugggguugccaaacacuuccuuacccucccagcaauggguggaguccaggcuuaaauuguuucagcaacuggaaagcaaauaaccuucaauucaacaaacuauuuaugccaacugcagagacagauaguguaauauugaucgagaggauggacucggagccagacugccuugguuucuauuaauucccaccauuuacucccucugugaccuugaaacacuugaccucucucugccucaguuuccucaccuguaaaacagagauauuaggagcuccaucacugggugguuuuauuuaauuuaauuaauuuauuuauuuauuuauuuuuugagacaaagucuugcucugucacccaggcuggagugcaguggcucaaucucagcucacugcaaccuaaggccgggcacgguggcucacgccuguaaucccagcacuuugggaggcugaggcggguggaucaccugaggucagaaguuggagaucagccuggcuaacauggggaaaccucgucucuacuaaaaaaauacaaaauacaggccagacacagugacucaagccuguaaucccagccuucugggaggcugaggcgggcggaucacuagaggucaggaguuugagaucagccuggccaacauggggaaaccccaucuauacuaaaaauauaaaaauuagcggccgggcgugguggcucacgccuguaaucccagcacuuugggaggcugagacagguggaucacgaggucgggagauugagaccauccugacuaacacagugaaaccccaucucuacuaaaaauaccaaaauucgccgggcgugguggugggugccuguagucccagcuacucgggaggcugaggcaggagaauggcgugaacccgggaggcagaggucgcagugagccgagaucgcaccacugcacuccagccugggcgacagagugagacuccguuucaaaaaaaaaauuagccaggcaugauggcaggcaccucuaaucccagcuacucaggaagcugaggcaugagaaucgcuugaacccaggagguggagguugcagugagcugacagcgugccacucuacuccagccuuggugauagagugagacuccaucuccaaaaaaaaaaaaaaaauacaaaacauagccgggcaugguggcucacuccuguaaucccagcuacucaggaggcugaagcaggagaaucacuuaaaccugggaggcggagguugcagugagcugagaucgcaccacugcacuccagccugggcaacagagugagacucugucucaaaaaacagaguauuacaagagaugacacauuugaaacacuuggaacagugcugggcauggaguagucacucugaaauguuagcagcauuaccaucuucaugauauggcuggcauugugcuggagaugccuaaauuaauaaggccucugaggcucacagucugaggagggagggagcuaacuauccuugugugcuaccacaccacaaguaaaacauaaacaaggugugacaggaacccaaaacaaggagcgaccagggucugggcugggucagcuuccuaaaggcugggccuuaaaagacaaauaggcuuuuaagcucuugaggucggaguuggggacaguuggaggugaguagagucgaacuuggguagggccugugguagaaacuaucugagggccaaaggccagggucauugcucuccuauaugcuccagcugucagagcuguagaccagauggaaagaugguuaggucuuauccagacacuguggcuaccugcccauucggguccucugggaagagccugggugguuccuagggcaaccaguggccauuacuggggagggaaggggacgaaugaggguggacaagacaaggggcauuuccccuugccaccacguuagaaauaggaaggaccuuccgggaagaaggguuccccuugccaccacguuagaaauaggaaggaccuuccgggaagaaggguuccccuugccaccacguuagaaauaggaaggaccuuccgggaagaaggguuccccuugccaccacguuagaaauaggaaggaccuuccgggaagaaggguuccccuugccaccacguuagaaauaggaaggaccuuccgggaagaaggguuccccuugccaccacguuagaaauaggaaggaccuuccgggaagaaggggaaaggggcagagcugggcaaagccccacagccucaggcaggaggccugggugagcacugcuucucaggccugggagggagaggguccugguguggggucccugcugagucugagggaggcagugggguuucccuuucuguuuuguuagggucuucaagaagucgagcccuaacugcaaggugagucuccacagcacuuacccuuuugacccucccugggccccaacaaagcccagccuuccccuagacgauccccaaccuacccaaagaugauccccaaccccuagcuccccacuuccugugacagcuaagcgccgacuuccuucccuccugaagccccuugccgcagaggcugcucagccugagccagccacagggcuggguggggcaggcuuggguccccaagcaagaccacagaggaggaggccaaaagcaagccaugugccuguagcccuccuaggagccaacccaaggugcguggggcugggaaaaccuaacagcccccgggcuauggccuauuuauccuagagccccuugaggggaccuagugaggguggcagcugcucucuagcuggcugguugggcugaguucuccccgaggauccaaacacacacacacacagacacacacacacauacacacauacacacacaccuggcugguugggcugaguccucccugaggaugcaaacacacacacacggacacacacacacacacacggacacacacaaacacaccucgcugguugggcugaguccucccugaggacacacacagacacacaugcacauacauguucacacacacaccugacugguuggcugaggacacacacacacacacacacacacacacacaaacacacacacaccgggcuggugggcagaggugugcagagauaaaggagcagcucaaaagccuaaagguccacuagucugagaaacgccaccacccucacuuuccaacacuauugggaggaaaccuggaacaacuccuuccugauagcccagccuggagauccccgggcagggcagccaguuuugagggcuccgaugcccugucaccauccuccccaaucuccccugugaccccuugacauccucagcucaccguguacuugggcaagcgggacuucguagaucaccuggacaaaguggacccuguagguaaguuuucccagaaagggacagcucguuccccaagaggggaagaaguucccgggcccaggaaagcggggagcggcccuuucaggaagugagcuggugugucccccuccuagauggcguggugcuuguggacccugacuaccugaaggaccgcaaagguacuggccccaaguccagggggcccagggaaagugggggcuagggaagugaaaugggcuggccuuggaagggcgccccagagagauggaggcuggagguggaagccaggaguaggguucaggcaagucuuaugcugcugagggaggagcagcggcugcuaggugccaggggacuggggaaguggggcuccugaccacucaucucacccucccuugccaguguuugugacccucaccugcgccuuccgcuauggccgugaagaccuggaugugcugggcuuguccuuccgcaaagaccuguucaucgccaccuaccaggccuuccccccggugcccaacccaccccggccccccacccgccugcaggaccggcugcugaggaagcugggccagcaugcccaccccuucuucuucaccgugaggaugccccugcccucugagggccagggggcuggggcugggacugugucugggguggggguaaggcacugcugugggcagaucuggaagaaacagugaggcagggacccuagauccacuucccuucagggucccagugcauucaggaagcccuugauuaucugccuccucucuggggccccuuccuucuucccuucucauccccaggaguccuuucuccagccucuuuuuuguuguuguugagacaaagucucgcucugucgcccaggcuggagugcaguggcacaaucuugguucacugcaaccuccgccucccagguucaagugauucuuaugccucagccucccgaguagcugggauuacaggcacgcaccaccacacacgacuaauuuuguauuuuuaguagugaugggguuuugccacguuggucaggcuggucuggaaccccugaccucaggugauccgcccaccuuagccuuccaaaguguugggauuacaggcaugagccaccacacccagcgucuccagccucuuagguugagauuuggaggaagaucugggggcuuucuggaagaacugaagucuucuccuuccuccgccacagauaccccagaaucuuccaugcuccgucacacugcagccaggcccagaggauacaggaaagguacgggaggaacagcucugagggcuccuagggcaggacaugggccagcaggagccuggaggcacagcugagccagagggugaacugucgagaugccaggguggggccgaggguaggccagugucccccguggaaguggggcguaugugguggucauugugcacgcaugacacugccuccugcucuguggacccgcauggaucuggggaugggggcuccccuugcacuaccaugaccaagccucugccagguucugggcuuuggagaggaagaagacuuaguccccagggucgugagaccacaaugaggcaagagucccugcccgagaggagggaagggggaggaagaaagggcagugaugguggcgggagccuccgguaagauguggccuuuucuccccuccccgaggccugcggcguagacuuugagauucgagccuucugugcuaaaucacuagaagagaaaagccacaaaagguaagggaagugaccuccucugugguguaagaggaggcuuuccuccccgcuuccaggagcccaggccccgugcgggggaggaguaggguuggggugugugaggaaugaccccuccugccccuacucugaucccaggaacucugugcggcuggugauccgaaaggugcaguucgccccggagaaacccggcccccagccuucagccgaaaccacacgccacuuccucaugucugaccggucccugcaccucgaggcuucccuggacaaggagguggggcgugagagggugacacggaugccacggugcaguuuagacccugggggaggggcgaagccacacaucaagaggacauuuguaaaggagguugccuuggcuggguguggacaguugccgugggcuuggguuugaggggagggggccagaacaaugugucuguguuuggggacacacugaugaugggaacagugaaaaccaguuccaauucacaugacccccuccccccaaaagcuguacuaccauggggagccccucaauguaaauguccacgucaccaacaacuccaccaagaccgucaagaagaucaaagucucugguaggaggugggguuuggaagggggucuucggggagggcguuacugcacagguggcuccuggugugaucucagcccaggccauuucccagugcgggagacccaccagggcucaaagaauuuagguuguuccauaaugauacggggagccucgguguuuacugcuucaguggggagcaugggggggccacgccacggggucuggaguugugguguggugguggcuugugcuccauccagagcugccugaccccgucccaccccacagugagacaguacgccgacaucugccucuucagcaccgcccaguacaaguguccuguggcucaacucgaacaagagugaguaucgggagagacccauguuccaaucuaggggagaagagcaggaucaggagaaugugagguggaggaagaauucuuccugagccaucuccaccuuuuuuuuuuuuuuugagauggaguuuuugcucuuguugcccagccuggagugcaauggggcaaccucugcucacugcaaccuccaccucccggguucaagcgauucuccugccucagccucccacguagcugggacuacaggcaugcaccaccauacccggcuuauuuuuaauagagacgagguuucaccauguuggccaagcuaguugcgaaccccugaccucaagugacccacccgucgcggccucucaaagugcugggauuacaggcgugagccgccgcgaccggccaccaucuucacuuaaaaggguauucccuccacagccaggcuccaggcuguuaauuuucuugagcacguugagccaaaaccuacucccuugugaccugugcccaaagaaacaagggacuagugagggggagaugcugcuugggggucauaggccgccccuugcccagcccagcgccccuaagcaucuuguucucuuguccccacccccagugaccagguaucucccagcuccacauucuguaagguguacaccauaaccccacugcucagcgacaaccgggagaagcggggucucgcccuggaugggaaacucaagcacgaggacaccaaccuggcuuccagcaccaugugaggguggggcuggggcggguccccugcaggccaggggccagacgucgguucagugcucuauccuagugugccagggauguaucagugaacagaagagacaaaaagaacucuuacauucuaggggagggaggauagccaaaucugaucaguggucacuguacagcagguuuagugacaaguaugaaggagaaaaagccaggcagagaaggaagggauggggggcagugaggugcgaaggugaauucggaguaaggacccagcggaaguaagcaaugugggugagcaggaaaggaggguucugggcagagagaaaacaaagacucagagguggggcagccugggguguuggaggaauggggaggugccaucgugcccucgggcaggagcagcccuggagguccccagcuucacaaagggcuggauuucaccucuccggaugccuuuguucaggguucucacugcacagccacacacagcaggcccggagggcaacuuagggagaagaacuaaguaccaggagaggaggaggaggugaggucaggggcuaauggagagccagacggugcaaggcuguuagcggagaaggacgucagcuuuuccuggagaggagccaaggaggcucugagcagggagugcagugcgcacuguaccauaaccgcacggccugggcugcuggggcccugggggccugugcgaguuugugguccugcccagaguccccgugggaaccccacggugggccaggugacagggugauaggcccuggucugacuccaacacccucaauugcagcgugaaggagggugccaacaaggaggugcugggaauccugguguccuacagggucaaggugaagcugguggugucucgaggcgggugagugucaugggggagccugggugggggucacacuggcucucucuagucccaugucgucguccucuucacgaugccucuccccuuccccagggaugucucuguggagcugccuuuuguucuuaugcaccccaagccccacgaccacaucccccuccccagaccccagucaggugagcacacuacccaccccaagcccucagagggagggccugaagcagggccaguggaggaaaacuggcccuuccagcacccacccccacacccccucuucccguccccccagccgcuccggagacagaugucccuguggacaccaaccucauugaauuugauaccaaguaagaaacucauuccccuacuugacccucuugggacaaagauuccuauaacauucaaaucugcccucauaccucuuccuugcuuuugguggggagaagcggauuguagcaucaaaucaagaugccuuagccuugugaggcugccucuugcugccuuuucuuugucccuuccuguaaauaccucuggucccacugcuguucgaacgccucugucccagaggccuagcuucggggagggcagggagugggaggcugggacaagagucagaagcccucaccucacaacccucuuucccaccaccaagcuaugccacagaugaugacauuguguuugaggacuuugcccggcuucggcugaaggggaugaaggaugacgacuaugaugaucaacucugcuaggaagcggggugggaagaagggaggggaugggguugggagaggugagggcaggauuaagauccccacugucaaugggggauugucccagccccucuucccuuccccucaccuggaagcuucuucaaccaaucccuucacacucucucccccauccccccaagauacacacuggacccucucuugcugaaugugggcauuaauuuuuugacugcagcucugcuucuccagccccgccguggguggcaagcuguguucauaccuaaauuuucuggaaggggacagugaaaagaggagugacaggagggaaagggggagacaaaacuccuacucucaaccucacaccaacaccucccauuaucacucucucugcccccauuccuucaagaggagacccuuuggggacaaggccguuucuuuguuucugagcauaaagaagaaaauaaaucuuuuacuaagc

SEQ ID NO: 21490 - RNA, 3354 nt, Homo sapiens
uccccaauauuucuccccuucucucuacuuucguccucaauaaucccaagcagcugggguguacaagucguuuucaccucuugggaccgugcuaaagggggcagccuaugauuaccaugaggguaugggagcccugaacugcaaaucuaucauuuccagagaagccagaaaucugaaauuuucugugcaauuucugaaacuuuaaaucagaauuuuuucuaaaauucaaugggucagauaccacagucuguguaaucaauccauuccaaagucuccuccuuuugcuaaaggagaagauuccuuaaaacaaggcagaagccaacugaagcaagggagaaccaccucccaccccuccccacacacacuuuccacacccaguaacuaggucucugggcggauaauucuguuuuguuuuguuuuuuuuaauuuuggacagcuaaucucuguagugaggaacccagaacuuucgguaauguaagggauauuagucugguugucagaaaaaugggcuggaguauuugugcugugucccugaccauaauuccugcucaguugcuuagcucccuggcaacuaugucugagggcuaaacaggaguuggugugaucuuccagaaaaagaacaggcuucuugucuugcagaggcaggaagucagaaaacaagagugugugugugugugucaggggguggggggugucagguggcacuggaaaugggagggaacucauuaagagugggcaauuggccaggugagguggcucacgccuguuaauuccagcacuuugggaggccaggacagguggauugcuugagcucgcaaguuggagaccauccgcacaacauggugagaccccuucucuacaacaaauacaaaaauuagccaggcauggugauuugcgccugcagccccagcugcuugggaggcugaggugggaggauggauggcuugagcccgggagguggaggcugucaagauugugccacugcacuccagccugggugauagagucagaccuugucuuuaaaaguaaagaaaacaaaaaaagagugggcaauccuagguaggugcaguggcucaggccuauaauccuagcacuuugggaggcugaggcagguggauuguuugagcuaaagaguuuugagaccagccugggcaacguggcaaaacccuaucucuacaaaaaaauauagaaauuagccaggcgugguggcgcaugccuguaacgccaccuacucaggaggcugagacagaacugcuugaacccaggaggcugagguugcagugagccaggaucuuggccacugcucuccagccugggugacagagugagccugucucaaaaaaaaaaaaaaaaagagugagcaauccucaaaguauccaagaacaacuacacgccccaaggggaaaaccagcuggauugcuuaggccuuggcuguagucacuaaagaauggcaucaaucucagaaacccucaagauggggucaauuuaggaagaagcuguuuauucuguacugucuuuggccuccaccuaaggucuggcaucgacccacccuucaggcucauaguucagcgagguuagagcacuuagggagaagcagguaacacauccaggguuugagagaagaccagcacacaacucucagugaucuggauagaggaagacuaaauuacugugguucaggcagccuugccaggugaugucuucccaaaacuucucagauguauauuccucccugauugugccaccuaggccuccuucccuucaguuugggacuuaaaacuuccaccaauaacgugaguaugugcacccaugcagcagccuguccgaggacucacaacuggagacaccucccugcuuggcgcugcccagaaaacuauguagauggccaagaaaccgacuuccauuauaaaauguuuuucuguguguaccaggaaaaagaugcucaaaauccaaaucaccacuuuauuauguggcagucaccauggugccagccucugccuuccccaugucacccuccuaauccagggcucuccaaccauauucauguuugcguuuucacaagucaauguccauuaaggccuugugcuccccuuuucuucaguacagggcagggcccuuauaauuugggucucaagaauugauaguugucucuuaacugguucuggugaggcgcacucacagcagugaguggaggguccugggagggcauggaugacggaggcugccccuagaggagcuggauguaggagcagagacauuucuugaucuuucacucugcaaacugguccaagaacuugagguaggccugacgcuggggugcagcugcuggaaugaaguggccaccagagugggugagggugauggcuccgggaaauuggcuggccaguugcacacucuccugagaggggaugacuuugucaguguccccaaaaacauggagcgaaggcaaugacaagggccuuugcaggauggauuccuugaacccaaugccccggggacagaaaccagacaccaagaggauaaaccguggcaaggggaagcggggaucgccugccuggcccagggcacacacaagggcugcuagcgcagccccuuggcugaaaccaagaaggccgucaaaaggccccagccuguucagugccugugccaccauccccagugauuccuccaggccccugcagacggcgggcucuuccaaugcggagaaaacgucggccuccugcucugaaaaccaccagccucgaggcugcuccuccggagggcaggacccuacagcgauaugaggaaaaaggaugggauuagggcaugggaggcuccaggaaggaaagaaaugagaaagggcaggaggguucgagaugacagagagaaaaagggaaucgaggcaaaagucugggggaaaugagaggggggaaaugaguggauuggccugaacaggagacagcggaggaagacggugaaggcggaagccugggaggacaggcugcaguuugagcaaagaggguaugggucgcgagaaaugaaggguguggacugggugggaggaaugcggguggacgcagggugggggaugcugaagggugucgagggggacgaaacaagauggaggaaacugagugcguuuccggagcggggcuugucucaccgaagucugaucuggcgcccucggggcccggggggucggggaccgggugcgggccgcugaggcacacgagcucggcgcgaccccgcagcgccuuccucagcgccccggucuucucacggaagccccgcucgcucugccggaagcccgccaggcacaggacccgcaggggucgcugcgcggccauuaugcccggcaaggagcgacggaagcac

SEQ ID NO: 21491 - RNA, 19706 nt, Homo sapiens
agagcgagccgagccgcggccagcuccggcgggcagggggggcgcuggagcgcagcgcagcgcagccccaucaguccgcaaagcggaccgagcuggaagucgagcgcugccgcgggaggcgggcgaugggggcaggugccaccggccgcgccauggacgggccgcgccugcugcuguugcugcuucugggggugaguguuagccggagggggcccgcucccuuucccgggaucagaacuccgagaagagccgggcgccgccaccaaggaaacagaacagagcauuggggucccagauacugaggguggguggugggaaaggaccucugaugccgggaccacgaaggagggucuaggguucccggagcgcagaggcgacucuccaggguggagaugagggcaagaccggagcacggaugccgguccucagguaccgcagggggcggugggggagcugggaggggucuuucaagagggggcauggggcucuccgaugcccagguucuucggaagaggacacucgaaugccgggaucccgaagggacuuuccccucagcaucucggucucuggagagucgugggacagaaccaaggcgagagaaggagggggaacuggacggggacuagagaugagaggggcgagcugggcuggggcggggagcccgggacgacgggauggaacaauggaggaggucggagggacuggaggcagaggggacccggcaaggacaauggggaccggccagacaaugggggggaggggcgucggagggagagguuggggagcgggagagagguugagaaguggguuagggagggcagaagaggggcgacggcgagggcggcagagagauggaagcagaaggaaaggagacagagcggggcgcggacccugaaguggucggggucccgccugcccgcugagggacagugagacgagaagagagagcagaggcuuggacauuuccagcgccuguccccgcgcuccugcucgcggccucucccagucccggaauuggggcugcggaucuaaggcugggaggggagugcccacuucgccggggcgaacccgcucccgggguucccccacggccggcgggcuccuccgacgcgcguguucucacggcuugaagcagcgcagcggaucgcgagggacggagcgggugugccccuacccgggcuggcgguggcuacgucucggggugcagagcgccggggcgcacuaggcggggacccuuccuggccgcgcgcagcucuggcuacgcaggcgggaggcggcaggcagggggcgcugcggggcgaggcaagugcaguccgccgcugccugccugcgagucuggggcugcgcgccgcuccccaccuagcugcgcgacccgagcgccgcgcccaccgcgcuccgugggcucccgcgccucgaagggucgggauccggucugagccucuccuggcucucggugcaagccgcugggcaccuaacgagacgggggcgcccggacgccucggauucuguagcgcgguaucccgggccaccgacucggcaaaggucggcggguccuccgggugguccgacgagauugucagauguggccugcuuuauggccaugaaccgaaugcccuggaaggucuggcaacggaggaggcgucuucacucuccccgccagcaucuuucaucagagcacugcgccccaaauuccggcuuuacagauacggagacugaggcucugagaguuuaaacgacuuggccaagaucucacagcaaguugggccagagucguggcuagacuccccgaccugauucccagcucgguacucccccaccuuuucagggggcagccgcugucccagcucggggucacggcugcguuucccagcagggcgggggggguugacacuguccccagaguccgucggcgguagagccugcgggugaggugggcagagauucuguccgggugcgggccccagcccgaaagcucagccccaguucccuggagcugucaggaccuguggcugcguccggggauuugggagcgaccgcgggcacgucugcugacuaacgccgcugguuagagacgcugcucagacgcgggugggcgagcguagaccaggagagcggggaggagggaccggaucccagaggggcaacgacuugggcuccgggucugggcaagagcgaggguccccgcgcgaagacccaaggaaggaggggagcugggcguggaggaccugggcgcuugggaagguguaccccgacaggaaccugccgucugcagccccugcggcucccgccuccgccucggcgcgcggcugcucggucugggauggcugugcgcgguccgaguuucuuccugggccgcggugagagagagagggcugaaaccagagcgcgucccggcgggucggcuggcgggccgcgccgguaauggaggcacuuugucauucagacgucuguaaccagagccgccgggcuggcuaaugcgccuaauagggauggaacgagggcagcaaaugggcgugcgugagcggccgggcugagcuggguggaugguggauggggaggcagcuccgcgggggacgggccccuaccgcacuguuccagcccagucuggcucaagcgccucgcuucuucccugggggaccgcguggggaggcgggaauaaucgcaugugcugaguuccuacuaagugccuugcacuucccugguaguuucucuugaauuauuuaauccuuauaagguccuagcaaggugaauuuaguuauucccacuucgcaguugaggaaacagaaccuucuagacuuucaggcccgagaccaggcucccccagugagucagugguggcgucuuuguuggaacccaggaugcuuggccugggauguucucuuuccuacauaugccaggcucccucccgcccccuaccuucuagaucauggaaggagucguggcucugagagauuaaaucgugcccuaugccuuuggccccacacauuuagaucugagccccuucuccacacgcagaggcccugcccccucucaagucucuaugcuacauuaucuuggguaauuagcuccuuuccucccaacuccuccccuauccaaagggagugagggguaugugccagugccuccccuggguuugcaucgaccucaaaaggcccuccagguguuugaaaaucucucccaucccauggcggugaccacggccccauucacuuaagagcucuuugcugaagcuguuggaauggccagggcugauuauacugaaacauucguaugguuucaaauacuuucaacuguuucgcuguuucucucuuuucucuaauuaaaaaaaaugaaaauucuuaaaagucaauucaucuaaggauccuuccaccuuaguuccuuguaagccuugaaauggccaaaacaaaaagauuacaagcguucuuaaaaaugagaugaaaucauucugucaaaugugaaaugacuaaguguaacacauacaaauuucagggaaauuuaucugucaucccuauaaauuaauccuuuuggaucugauuuuggagcaauuagccugaauguuagucaccccucccuacuuggcuaaacucuccccuccugccuggggucuccuuaagaugagaugcuucuuugauaacuaacauuuauuaaauuccuacuguagaccagacauauuugcauaaauuauuucacuuaauucucccagcaauccugggcaauagacauuaucaacccaauguuuuaggugagaaaaacugagguuuagggaaauuaaguaauuuacccuaagcaacauacuauuaagaagcagaucuaggauuuuacaacauagggaacauaaaacaaggacaggaaaugcaugguuacuaauuaucuggccccuacuccaaaugcaguuuuuaagagaagagagaggaccucaggcugcagcagggagaacagguuucuuggcaggggcauuugcacaaagcccccacaccacccaagaccacuguagacagaucuccucagcuguccagagcccaacaaacuggaacacagccaauggccacaaaguagacccuggaggacagaaaagaggggucccaaaguacauaaauaccuuauuuacuuguguaauacuuacagcaauccuaugaugcagguacugucaucauuaccuaauuaugacccaggacaaguguggagccaggauucagaguggcgugagagcucacagauuguauucagaggcuugccuccuccugguucagauccuauuuacauaccuuuauauuuuuuauuauuuuuauuuuauuuauuuauuuauuuauuuugagacggacugucacucugccacccaggcuggagugcaguggcacgaucucgacucacugcaaccucugccuccuggguucaagcgauucuccugccucagccuccugaguagcugagacuacaggcgcccgccaccacgccuggcuaauauuuuguauuuuuaguagagaugggguuucaccauguuaggcaggauggucucgaucuccugaccucgugaucugccugccucggccucccaaagugcugggauuacaggcguaagccaccacgcccggccggcacaugccuuucuaccaaggcgaguuccacaguuucugaagauucaauuagaccuuaaauagauuagcguggugggggaaggguugcuucaggucacacucugguagcagcaagaagugacaacugauaccuugacaggaagggaggaaacagaaaagcuauauuaaaaaaaaaaaaaaggcugacaggagaacucaaaaagacaaaagugugguaauuugggaaaagaacaaaagaguuucccuguauugcagcccagaguaaucgcugguguaaauacagagucccugagucaugggaagccaugaagcuuugcuccagagacagggaagggugcagccaccauggugaaaagcaaaaaugaugagggcagcaaagccuggcagucuggaaucucggcuaaccaacagucgcucucccagaguucugguuaauugaggucauacaguauuuucauguauuucaacuccacgcguguaugcauugugucccuacugcaugccagauaccgcaucaggcccuggggcaauccagcucccucagggagcugacaguccaaugagggagucuauaaaguucaggccagacaaaagcagagagaaccggagaacaggcuggaugcguaacauggcagccccaccuaaucugugagcggugggugcaacaggaccacuuccuugaggaagugacauuuaagcagagcccuaaaggaugaaaagaaaucagaacaggcccuucuggaaucuugccucuugagggaaagccugcaucugggacccugaggcuccuggucugcagauguucccagcacugaguguguugcugcccuggaggaggugcggcaacaccaagguuccaccuccucuguugccugugccuguccugcuggucucaugaggaccacagacucccuccuggguugauccaaccugucuaucccccugacuccucuguuuccuuccccaccaaacccugaugaggccgcaggauauuuuaaaaggcuggagggaaaggagugucuuggccaugaucuggccaauguagaagaagcagaaugcccaaaacaagcuuguaaagcuucccucuggucccacgaccccaaagcccauacuucucagcaucaaaugagggcugcauggucuggagcuagcaaagcaggcuuuggaguuuuauuagacauuaaguuuuuuuuaaaggaacagaaauauaaagcaagccuccaccagccccuuccccuggggaaucugguguuaaauuguuacauccacgagcaaagaugcuucaguggcaggaaccugacuccccuuucccuugguuccagcccuguucccaguggccacaugggggagggggaggacugguggcuggaaaucaaaccguggcagggcagggcugcuggguggugagagcagccacugucccaucauugauaacaguucucccuuucucuccaucuuggugcgaggcuuuugccaaauggcuggccuuuugcccuggcaccaggcuguugccaucucuguagagaaaugaagacucagagggaagaugggcaagcaagacccccaguguagagucaggauucaaacccaagacccuggcccucuccuuucugcucuugggcauggacaucuuccauuuauuauuuaauauguggaauuaaggaccuggaguaaggcccugcuggccuuuguuagaaaaaggcccuccucuggguagauacaacccagcaggugcaaagcuuagcaaauggaguuugggauagguuucagcucuacuugccccguuggcugggagcccugugcaagcuacaaccuguccaaccauucaugacaucccuguugguaggcccuccgcugggccucuggccaccuuccccaugugguauauccuugggauuccaggaguugcuguaaccccaggaugaacuuugcagaaggucagcagcugaagcucugaccucacacccccagcagccugcacgggcacacugucccucacuugccuuuccccugucagcuuugauguuccuaacgccucccuggugagcucaucccagcccaggugguucuaauagaaggcagugggaggaggguguuugauuccccggaagaaccccccccaacccaccccagcuuucucuugccagucugacccuccgaucucccuccauccaggugucccuuggaggugccaaggaggcaugccccacaggccuguacacacacagcggugagugcugcaaagccugcaaccugggcgaggguguggcccagccuuguggagccaaccagaccgugugugagcccugccuggacagugaguagaggguggcgggcaggaggaggggagaagaaugggagggaggagaggggugaaagggaggggcgcuggggagaagcaugcccaguagaggccuuauaagaccaccacuguaaggucaucagaagugggucugacccaguguaggaggcgcuucucccagauucgagaagcugagaauggagaagggaagugugcagagggaggaggggaaccccaugggggaucuccaaggggugcccauucccagcucuggagaaggcagaggcuugguagaagaguguggcugggcagggaggaguagcugaugcuaagaccagcuaaaaauaucaucugcacugcaaaaucaauggcugccacuuauccccgguguguuugggggaagggagaggaggaucaaauccuggcugcccugaaggcugaccuugggggauccuggggguguggcuguuccucccuacaggccaacucuucuccagcuuugaccaggaagcagaguuuucccgaggcagcagggaugggggucagagcgccaugaagacguccuuacuguggggugacagaggggaggggagacggggagcugugcccauuccugccugggauuucuuccuuccuuccuuccuuccuuccuuccuuccuuccuuccuuccuuccuuccuuucucucucucucuuucuuuaccuuucuuuccuuucuuuccuuuccuuccuuccuuccuuccuucaacagaguuuugcucuguugcccagguugggagugcaauggcaugaucucaacucacugcaaccuccaccuccugguuucaagugauucucaugccucagccuccugaguagcugggacuacgggugcaugcaugccaccaugccuggcuaauucuuguauuuguaguagagaugggguuuuaccauguggaccaggcuggucucaaacuucuggccucaagugauccaccugccuuagccucccaaaguguugggauuagaggcgugagccaccgugcucgacccugccugggauuucuuucaggaggggagagaaucucaucuuccugggcuggugggucugggccccuuggccccagucuuguccagggucugaauucccucaugcuuuugagucaggagucucggucccugaucggugcccccaguccucaguugcugccuuugggccgugggcucccugcccuuuuccugacucccugccuucuaccuggcacucgaugcccaccuggagggcucgagggaaccauacucagauuauucuuuaauccggcugggaauaaggggauagagcuggggccucugaacccaccugcggaccuaguguuaccucuggauguccccccugagucuaucuguccuccaggcaaccccaacucuugguguuccccagacacacuguuuucccaucucugugcuuguggauccuguaacaccauuccccagccaagaaaugccugggcguauguguggaggugggacauccuccaaugccuuugccgucuugcuucauggccaccugcucuggcccuggccuaacaggguuuccauuccagggcggggguggccaaccaucagcuaucccagaaccuccaaaucugccucucuugcuuccuagacuccagcccaggacucuccucccaggaccuaaaugaugggaacccuuucccuucagucaaaggaccuucagcaggagguggggcggaggacaccaggagagggaaguuccagaaucucuggaagggaagggaggcaggcagagagguggcuuugagaauccucccuuccacuuccucccuccccuccauuuuccccuccuucccugucucccccuccuccaccuccagcugcauuaacaggcugccuuuacaagcccacuuuaugggacggagaccccagcggacuuucccucuacccuuaaaacguuuccacaaggaaaccuauuaagccccugccuucauucucugccaaaaaagaccacauuuuucacaccaccuaaaacccucucccaggaguuuucugcuaauuuucuguguuuugccaugagcaggcuucuccucuuccccuccugugugacuagacuuacccuccaucacacgccagccagccaggacccucuuguuuguauagcucagacauccugccuuugcuguuuguguuuggacguucuuucugcugucugaccauauuccuaccuccaaaguucaauguccucaucgcucuccacccccauggggcccaaucuuuauaggaucccaacuacgugccaaagcuuuauggcugaauuucauuuauuccucacuacaacccugugacugcagauauugcuccuuauuuuuacagagaaagaaaaagcucagagagguuaaguaaaacacccaaagucacacagcuuauaagcgauggaaauggauuuugaauccagaucugccugcuccuaggaaaagggacacaggguuccucugucagaauucacuugaaacugaagucucccuccaggcccuucuuccugggucuuuucuucucuccucuacccuuuuucuuucuuucuuucuuuuuuuuuuuuuuuuuuuuuugacagcgucucacucugucacccaggcuggagugcacuggugcagucuuggcucacuguaaccucugccucccaugcucaagcaauccucccaccucagcuucccgaguagcugggauuacagacgugcaccacuacacccagcuaauuuuuguauuuuuuauagagaugggguuuugccauguuggccaggcuggucuugaacuccuggccucaagugaucugcucgccuuggccucccaaagugcugggauuacaggagugagccaccacgcccagccuuuguccccaguucugccccuuucacuucucucuggcuuuuccuucuuugccuccucauccccccaccacacccccgaagccagugaccccuugcuccaucuugucucugaugccuuugaauaauguugagaccccccuacaggccucaguuucccccuaauggcgcuuuagccuuucugcuucugcuuccacauucugaacaaucuguccuucccugguucucagguuccuaaaucuaugcucuuccuguccuuggagcaaggauagguccugccagauccaggguggcacagaguuccccacccaaagcuggaaggggugaagaagaucuggcccuguuccuuccccucccuguacaaggaggcaaggacccuggcgugcccagccuccuucuccuuauucuggagugcacauccaguaauuaagaaaacaugagugaagaaugagcuuggacaucucccuugcauccuggccgaaagggcagacgacgcaugugcagaucucaaaagggugaucauauaguugugcagcuuguguacugcucaacaauauccaucugagagagugagugugggcuaagagccagcucucuagcuucaguggcuccugccuuaccugagcccucuugccugcagguccguccccacccucaggauccaagcccuucagcagcauggggguagugccaugggugggaaauucugcugucuaaccccggucacucccauuuaggcugcaucugagcccacaccuguguggagaggaacugaaggcagaugaggcaggaggcucccuaggggaaggccuaccuugccuggaccggguuagcagcccagcucuggcccgcggggagggcugggugggaaccacguucagauuauuccuuaaucaugcugggaacauaguacaggccugggaacucucaaagagaauuugccaagaaacuuagcggcaccagcuggguuaugccggaaagccucccggccggccagugcuucuggagccuggaggaugcggcuccgggccuccucccccuuucccaguuggcugccaccaacuuucacaggcuaggggucagggucccuuggaagagggugggagccgaugagaaggcugaaggaggaagucagcguccuggcaggcaauaggggagggagagacuccagcuccugcgucccgggugcccaaaagagcagacgacuaaaucugguguccgcugcgcucaggcgugacguucuccgacguggugagcgcgaccgagccgugcaagccgugcaccgagugcguggggcuccagagcaugucggcgccgugcguggaggccgacgacgccgugugccgcugcgccuacggcuacuaccaggaugagacgacugggcgcugcgaggcgugccgcgugugcgaggcgggcucgggccucguguucuccugccaggacaagcagaacaccgugugcgaggagugccccgacggcacguauuccgacgaggccaaccacguggacccgugccugcccugcaccgugugcgaggacaccgagcgccagcuccgcgagugcacacgcugggccgacgccgagugcgagggugagugcgguucggggggcggggggagugggggugcgggggugggcugggggcauaaggaagggcgcucucuggaggucgacaaggacccugccuggccugcuggggcagcuuggugaccuugaggcagcgugcaccuucccugagcuucaguccuuuccugguaaccuaagggaggaggucauuccccauccugucucagcaaagaaccccucucuguguuaccuucuuugggcuguuuggaaagugggcguucucagcgucccaggccgcggguacuacauuguaacucauccuccgggacgcauuucucuguggcuucccgcuagugauuagcugaacagcaagcagcucgaagguggccacuacccccagggcacagaacgggagaggucugauccaugaggcaggcuuucugaacuggaagagcagcuugaggacccucaggagcugggacccuuugacucugagcccuggucuagguccaugguggguuuuggcucugggaccugagauggaacccacccuguccuugacugacguuagggaguccacuccugucucugggccucgguuuccucacuggucauauggcugccaggguuguugcggguuagggaauacaguggggcuggcccacuucagcuugcccugucuaggggaggggucaaccguguuccgcaguuuagugaaggaugaggggcaugcagggaacacuaaggaggggcucuguggaagaagaaggaggggaggggcagaccuggggcucaaaagcccggggacaaggcagugcaugcucguggcugucagcuccagggauggaugggagcugggcgugcccaccuuagccaagcacaggccccaaggagauggggugguucuugggaugggagaaggaagccccgugggagccagggcagagcuguuuuggucucugguuggugacguccgucucaggggagacuggugggcuuuuccacuucggggagaggcuggcagugccuuuacauccuguccaucauccuguggccaugcacacauugagcuauuucccuuugagaacuaaccugcauccucagguugccuuuacccugagcaggcaauauaguaccuccuucagugagcccccaguuugaugggagagauagccuucgcccagucuaaugagagagacguggucccagcacuuaguccccagcugaaggagagauagcucucacuuuagagaucccccauucugauggaggcagcagagcuucugccucaguuagcacccagaucuccugccccuggggacccuccagucugauaggggcuccaacccacaccugccuuccaaguccugccaucucuggcuuuaggagcucaggauggggagggcuguuacgcugggcuaaggccagguugagcucaaagcuuccugccuuggagaaggaaugaggaguaggauguggugguucuguuggcaauugcccugggccaggagacaggcaaguggcaucaggcgccaggcagagcgcaggaaggguuucagcagccaggcaucaggcaagcaggcagcucauuucuguaggcaaguccagaccagccagcugggggcggggcggggggacuugggggcgcugcuagagcaaagaaagguggugacugugggaggagcaggcuuugucuuuuggggcauucacagauuccucucagauaccagcccacuuucccagccaccccgaaggaggagggugcuccugagggaguguucauaccagacccuguuccccuuucagcuucaggcucugaaggguuaaaugucagcucugggacaagagaccauuucaggaaauggaauuugauucuugguuuuguugcccccuccccuccagcguaccauacuuuccccgcauuuacuuacguuucaggugucaacauggugacucacccacccucagggcagaagggcuacccgcugccccagugaaauucgguuugaauagggauaaccuggucccuccaugcagcccggaaauggcugucaggaccugccaagggcuuaguagguuggaaugcuaguggacguggccacaucuggaucucauccccccgcccccgucagaggggauuggagagaugagggcagcuccccaagagucagugccgccucuggucuggccacgccuugcuacccucccagccuuccccuaccaugcucugaucucggugauggucucauucauugggcacccggacauguacacuccuucacccucuggcuuggggucagucugagcugagcugugucuccagccucuggacuugggcugccccccagcuugcccaguccccuggcagagcaagagaagacccuccccaguccaaugcuccaccuggggcugccagaagacagggcucugucuccuucacuaccucuggccccucccaggacggagacggggaagggugguuugggugacagauggcagccccucacugcuggcagccagauggauucuagauucacaucugggggcuuugccccucagaaggugcugaaaacgggccuuugaagcauuucaucuugaguggaagaggccagaagauggguggcagcuucuacuccugcuugggugggcaaagugggggcugggagggcagagcugggagccaguuacccuccccuucaccccauuggcauguccugccugcuuucccucccugccccaggcgugggaagugaggagggacgggguaggcaacauugcccagacaaguauccccaggccguccagagcccacaaccccuagcacugccccuggcuguguggcagaauggaaaaucccacccacuggugccaggaagggcuggguccccugccagggaggcuggcaaugcccagcuagcaugagagggucuagguggguggcaagucacagucuccccccgccagcugaggcauugagcuggaccugccucaugggccccuucuccacuggcucucugcuuccugaccaaggaggguuggggcuaccugaugcugucaucucugguuggcaggaucaggcuaggugggagccaggcaagacaggaaacagaggcuggccacuguccaagggcuggcuggagggaggcaauccagcugcccccgcaccccuccuuuccacccaagccuagagccugagacaugaggucaaaaagucggggagugcucucagggagguggugugggggaagcaccucucugaccagaccuguguacccucuucuuuccuuaggacaggagugacuagggucaucaaggacaagcuggggccagagagacauuucccagagugacuccagcucaaggccucccuguggucaggcuucuuuguguguuugcuccuagauaggccucucuagguacucaggagguggaauagaauuccaggaccauagccccagauggaagggagcuuagagacugucucucuuaauagccccauuagauaaauaaggaaaucaagguucugagagaaaagggggcugggccagagucacccagcaagucaguggcgaagcugaaggagaugcagcucugugggcccacaggccuugcucuuuagcaucaugacaucaugcacgcaaucccagcugugcauaacagcugggcacaagagcaccuggagccagggcggggacacaggaagaacacggcaguggguuagagcuaaaagggaggagugggggaaguggguccucacuccuguggccuuuucucccagagaucccuggccguuggauuacacgguccacacccccagagggcucggacagcacagcccccagcacccaggagccugaggcaccuccagaacaagaccucauagccagcacgguggcagguguggugaccacagugaugggcagcucccagcccguggugacccgaggcaccaccgacaaccucaucccugucuauugcuccauccuggcugcugugguugugggccuuguggccuacauagccuucaagagguaagagagggcacgguggcgacagagaggggagauguuugcccucaaggaagacuuugcugugaccuugaccugaaaacauacacacccuuuuaacucaaccccaaaccaagcucauccucacucaucaucugccgccccacuccagggugcagcaggucagcaggaggugaggggagaggauccaccuguccuguccuguccucuccugcccuguccuggcuccagccccucccacucccaugccgcaccacucccugacuccccacccccaacugcuuguguccucauccccaaccuccuucaccccacagucaccugcgugugcauaugucucuuccccuucgcuugucacacugggaaugcuguggcacccacauccaggaauccaggaugugcacgaacucccagaaggcauuuuaaagcuuuaaaugcauuuuccauucuuucuaaaaaaaaaaaaaaaaaaucaucaaaguaacacauccguguuuaggaaaaugcaaacaagaccaauaucuuucaaagcaaaaaguaaaagcccccuuuuaucuccccaaauccuacuucucuccuuauuggaaucuguuugaaauggauccuucccaacuauuuucugugugucuuuuuuuauaaacauguauauaaaccuuuuauaauuacauguaaacauggagggcuuuuuaggcaucagugagaucacauuguacauauucuacagcuuacuuuuuucacucagucucccucaggagaccuuuccucaggaauguagauuagcugaucauuuguaaccacucauucaauaguauggauggaugguaauuuauuuagccaguccccauugauggacauuuguuuuuuuuuuuuuuccaguuuuuuguuauugcuuauaauugcagaggaaauccuuuuauaugucacugcccacaugugggaguauuuuagaaggguagauugggagaagaggaguuccugagcagucacuuuugcugcacugcucauuccaggaacauuuacugaacacuuacagagggccccucugcccucauggagcuuucaggguaggugggggcagaugugcaaagaggagccuuagauggugggguggcgguuauaauugggcacccgccaugccccuggcccucacacggcagagcacagauacucagcugcaucggccacuacagccccucgcccccugaaaccuggccuguccucuggcuccagguggaacagcugcaagcagaacaagcaaggagccaacagccggccagugaaccagacgcccccaccagagggagaaaaacuccacagcgacaguggcaucuccguggacagccagagccugcaugaccagcagccccacacgcagacagccucgggccagggugagcagcggcccgcuggggagcugaggcggagcugaggcugaggaaacagaagcaauuaagauuagacuccaggaaggacugucgggggggcggcagggcuggcucagcggugccccuguagauggauggagaggcuggccgaggggaaugggagggagagguccucucuagaggaacgacuugggaaauggaggcuuuuacaaguuggagcauccagacucaucaagcuaauuguccccccugggggcuaauuauugcccaaaguagcugcaauuagccucuugcccuggacuucuggggaacaaguaguuaaguguguacccuaauuaguggcccauagcccagcuccgggacacuugcuguaguugucuagaacugagaagcccuaucuccuccucugccaugauuaauugcugggggggaagagaggagggauggggauagggauugggcuggagugacaggaggaagggacaacgaguccccccaggugccuucacuuccuggugccccacccaggaccuugucuuggccccaggccuccagauggggaggagcacugccucggcccuucuugggucucaccccagugcccacuguuggggaaaggaguucagggguaggaccugacucuccucugguuucucugcagcccucaagggugacggaggccucuacagcagccugcccccagccaagcgggaggagguggagaagcuucucaacggcucugcgggggacaccuggcggcaccuggcgggcgagcugggcuaccagcccgagcacauagacuccuuuacccaugaggccugccccguucgcgcccugcuugcaagcugggccacccaggacagcgccacacuggacgcccuccuggccgcccugcgccgcauccagcgagccgaccucguggagagucugugcagugaguccacugccacauccccggugugagcccaaccggggagcccccgccccgccccacauuccgacaaccgaugcuccagccaaccccuguggagcccgcacccccacccuuuggggggggcccgccuggcagaacugagcuccucugggcaggaccucagaguccaggccccaaaaccacagcccugucagugcagcccguguggccccuucacuucugaccacacuuccuguccagagagagaagugccccugcugccuccccaacccugccccugccccgucaccaucucaggccaccugcccccuucucccacacugcuaggugggccagccccucccaccacagcaggugucauauauggggggccaacaccagggaugguacuagggggaagugacaaggccccagagacucagagggaggaaucgaggaaccagagccauggacucuacacugugaacuuggggaacaaggguggcaucccaguggccucaacccucccucagccccucuugccccccaccccagccuaagaugaagaggaucggaggcuugucagagcugggagggguuuucgaagcucagcccaccccccucauuuuggauauaggucagugaggcccagggagaggccaugauucgcccaaagccagacagcaacggggaggccaagugcaggcuggcaccgccuucucuaaaugaggggccucagguuugccugagggcgaggggaggguggcaggugaccuucugggaaauggcuugaagccaagucagcuuugccuuccacgcugucuccagacccccaccccuuccccacugccugcccacccguggagaugggaugcuugccuagggccugguccaugauggagucagguuugggguucguggaaagggugcugcuucccucugccugucccucucaggcaugccugugugacaucaguggcauggcuccagucugcugcccuccaucccgacauggacccggagcuaacacuggccccuagaaucagccuaggggucagggaccaaggaccccucaccuugcaacacacagacacacgcacacacacacacaggaggagaaaucucacuuuucuccaugaguuuuuucucuugggcugagacuggauacugcccggggcagcugccagagaagcaucggagggaauugaggucugcucggccgucuucacucgcccccggguuuggcgggccaaggacugccgaccgaggcuggagcuggcgucugucuucaagggcuuacacguggaggaaugcucccccauccuccccuucccugcaaacaugggguuggcugggcccagaagguugugaugaagaaaagugggccagugugggaaugcggcaagaaggaauugacuucgacugugaccuguggggauuucucccagcucuagacaacccugcaaaggacuguuuuuuccugagcuuggccagaagggggccaugaggccucaguggacuuuccacccccucccuggccuguucuguuuugccugaaguuggagugaguguggcuccccucuauuuagcaugacaagccccaggcaggcugugcgcugacaaccaccgcuccccagcccaggguucccccagcccuguggaagggacuaggagcacuguaguaaauggcaauucuuugaccucaaccugugaugaggggaggaaacucaccugcuggccccucaccugggcaccuggggagugggacagagucuggguguauuuauuuuccuccccagcagguggggaggggguuugggggcuugcaaguauguuuuagcauguguuugguucuggggccccuuuuuacuccccuugagcugagauggaacccuuuuggcccccgagcugggggccaugagcuccagacccccagcaacccuccuaucaccuccccuccuugccuccuguguaaucauuucuugggcccuccugaaacuuacacacaaaacguuaagugaugaacauuaaauagcaaa

SEQ ID NO: 21492 - RNA, 9666 nt, Homo sapiens
guuauuuacaaagauuuauuacagcacgggagggguucaggccuggagucagggaagaaggggaaaggggcagagcagcugggggacaaggaaaaccuggcgccccccgcugugugccccaccggggacauaaacuaggcggcauuccuggcaucaaagcacaaaacgcaacaaagaggucucugccaguccaucuuccaggcacccaggaggagcaagggugauuaagggaagauucccaaaauguugaggcuauggagaaaaacgccuuaguccuggacccugguagaagccggugagagaaguggugacuuggaauccuccauaggaaaguggguagaaaaggaucuaaggguaccucaagguucucaggaccuccuuuccccagaucuuaggguccugcccugugggucuccuguguccaggggagaggaucuggggaguagaauugugaagggcaaaucccuguucccgguuuucuggauuuuccaaugugggcugucucacaucccaccucccgcugggugaauggaggaaugacuggcaggggugggcaucaggcagcaagugcccagguucucuggguaucagccaaaggugggcaaacaagcaaacacagaccagccuuagucuucuagaagucagaagccgcagcccuagcaggcgaggggaagagcacaaaacagggugaggauagaguggguuucuggggaacagcgauguccccuccacuuccuccugggagaugcaggcugggugccuaugugccaggcucagagggggaagggcgcugagguuccuccccaggcucugaaaggcaagcagagagggacucagggccuggccccacccaccaagaucccagccccuccuccccauuucacacucccaagccuuaccacuuagugcugggucuuccacuugguccucagagccuccaucucucucggacucauccagagggggugggcgcucccagggcccuuccagacccuggccacagguugucuuuugcccagcuggggaugggaaagaagagauaagaacacaggcucugcguauccauccggcuguccuggagugugagcuaagugucugauggcugagguuaagcuuuccaggggcaucauggaagcauggagagagaacugggcuagaacagcucucccagcaacuagccauauggcuuacguaagucaguuaguaccuuucugaaggaaauagaaagggggaaauuguguagauuaccuuaaacaagauguaauagugaauacccugcccagcccagcgccagcacccaggagccacuaggagucguggugguuuauauugcuccaucauaggacuaucauuugacccggugcccuucugcauuuuuuguuuguuuguuuuuuuuuguuguuuuguuuugguuuuuuguuuuuguuuuugagauggagucucacucuguugcccaggcuggagugcaguggugcgaucucagcucacugcaacuuccaccucccagguucaggggauucuucugccucagccucccaagcagcugggauuacaggugugugccacugugccuggcuaauuuuuguauuuuuauuacagaugggguuucaccauguuggcuggacuggucuugaacuccagaccucaagugauccgcuagccuuggcaucccaaagugcuggaauuacaggcaugagccaccgcacccagccaccugcugcuuuuccugagggaacagucuccucucaccccucuuccacuguuuuggaggggucucagugaggacugauucaggucuuccagcugucucuugcccacaaagggacugaagcccagcaacagcuuuugcccccauggccaaucucuucacugccagauaugcaggcaggaggcccaaggccuuuuguuuguguggaagagcugacagcuucuaguaggggugguugacucuucaguauucccauaaauaaugagacuaaaaagguuaaugggccgggcugguucuugaauuuuaaauucuacaucuaaacacuagagggcacccucccacuccauccuaggaaggaaaaagaggagaaacagacaacaguccuggagagggcaaguaaaugaggcagcccucugcaccccagcagagaccacauccuagguucaaaaauguaggugaaaugcaggugacagggguguuggacucuccugguccuccaucccugaauguccucacgcccccuuacugccauaggugggaaguccucuuuuggcucuagccucaaaccccaaacggccuuggccuuaauucucagggaagagaggaauuauuagggaaaaccugauugggagagggacugagccaaggauggaggaaacccaugucucagguagggcugaguucggggcaccccauggagcgagaagacagggaggccccuguggugucacuacaguuugcguguaugagacacugaacuagaaggggacguccucguauacucaaggaggacccacagcuaauccacaugucacaggccccucagcuuaccagacugccugaugaccuucaggacuucagccuggcuguccucuucuucuuccucuucuucaucauccuccucuuccuccucaucuuccucucuuggauaacccagcucccgaagcucccccagcucauccuccuccucugaggccugguucucauucaaauugcugauagacugcaggugagacucagcaaugcgcugcacagcuggcacagaggagaccgaggaaagcaagggucagcuagacacagcccauggaucuggagauagccuguggccuagcccccagccuccuucccguaggccuggggcagagaauacccccucaggggcccaaguucaaaggccaaaguugacaggucagccugaugggugucagaccagggcagaggcagccagggguagauuugaucauguuuggcucuuaagcuguccuaagaugcuagcccccaggcagcucccccacaccauagggcacuaggcugggcaagaccaggcgggcacagcagcagcuuaacauucccuggcuggagagcuugauuuuccaaguacccaguacgggagacagugucucccagcuucaagcccaggcagaaggcacagggcguaggaaccagggccuggggauuugccacuuuccauuucuugggggugcccagccugcugagggcucacugcuuacccugauccuaccucccaugcgaugcauaguccccacucccuggcacugcccagucauagaugccaauccacauacuccugccccgggcuccaagggacagaacaauuccgaggcugaggacauaauagucugcagccagugcagucugugccgggggaugcggcaugcucagaugcggcccccacaaucuugacccacauccccagguucccagcucccucugcggugaccuagaaagcaacccccccagccuccaaagaccugcucagauagggcugggaagggaacagugugggcagcuggagacaaguuuccaaaagauggaaaggagcaagggguuagagaaaggggccaaggccagggguucugggggauggcagagguugaggggccacugaggagaggcugcaggagcuggcaggaucuuagaacauaugcgacacaaaguucacaggccacagacaagaugcugaggaggggcuggggguggggaauggggaguugcugcaguuccuucuuggucugccaguggccccuccccucagaaggcccagagggguagggccaggcuggaaaccuccggcacagugagcagggugcuaugcuccugccaacucggggacaggcacagagggugcuuuguaugugcccgcugccccacccagcccccagcucccagcccaguaccuccugcuggcucugggcaagcuauccaggcaauaaaagcacaauaaaucacccuacccugaccuuggggacgcggcagagcuucaucuugagccaagugugagagcuccagccuuggagcacaaccccucaagcuaagacuuagugcugugccccucucucuagggcccucgauucuucccugacaagccccaacccugccgggcaccuucccuugcccacaaaaggacugaagccuacaaaacagugcccuccugguagagaaggauccaugagggcuguggggggagguaaggcaggagagcagguggcagcccaggcagcuuccuucucccccagcgggggaggagaguucacuucgugagccacagugacaacagaaggugugugcggugcuugcgcuggugccccgugagccucccucgcuucccccaccucccucaugccuccugggcucucuggggucuccccaucacuccuuccaggcugucuccuucucugccccacucuguggggccccaaacuccccccaccacaagucuuccuucuucaguuggaagguccccagccuugccccagacuggccaccccucuccugaucccuuuccucuucccugccucuacucaccuggacucuccuaagauguggccuaaaggggcaguugagggggugcacaauuuugaccacugcacggugcaugguagcacccuggcccuaacaucuucauccuggccuguucgcccaugcuugcagucaagagccaggucuuccccucacauccacccagccucucccuacccagcccaaggugggagggagagggauuucuuaaauucucuccugagaagaugacacucugucccucaugccugcuuuggggcccuuccacacaccccucuagguggggagguccuuccaggugcugagccacacugcccacuugcugcagcucugacccuucauuuuccuguccuggggaaagcaaaauaaccccuucccuucucuccucccuucccagccucuccucucuguucccaacccuggcaagugggcugacagguauaccuguugaccuuggcuggugcugggaacuuauuaaacccucccccgaaccacuucccagcauacucuuccgguagcucucccucccaaccuccgcaggagcggagggggcuggccgggcaggaagagccccaggcaggaguugaggugggggguugguaggcaacagggcuuagucaggaagaggcccuccuauguccuucagguauaucuccccagcucccugacuagaaacgaagccuccuccagguuggcccagaagucccccucugacucgcaucucuuucucuuugcacaccuucuucccucuucuuggaccugggaugcccuugccugccuguuaaauuccuaugauccuucaaauccaagcuuaaacaucuuuguguaccuuccuugacccuuuucuuuuuuuauuuuuucccgagacaggcucucacucuguagcccagacuggagcacaguggugcgaucauagcucacugcagccucaaacuucugggcucaagcaauccuugugccuuagccucccaaguaucugggacuauaggugugcaccucuaugcuuagcucacuuuuuuuuuuuucuugagacagaguuuugcucuuuuugcccagacuggagugcaauggugcgaucucagcucaccacaaccucugccucccggguucaagugauucuccugccucagccuccugaguagcugagaugacaggcaugcgcuaccacgccuggcuaauuuuguauuuuuaauagagacaggauuucuccauguuggucaggcuggucucaaacuccugaccucaggugaucugcccgccucggccucccaaagugcugggauuacaggcgugagucacugcgcccggcccgcuuagcucacuuuguaaauuuuucauagagaugggggucucacuguauugcccaagcuggucucgaacuccuaggcucaagcaguccucccgccuuggccucccaaagugcugggauuucaggugugagccaccuuacuuggccccucccugacccuuugaggcaaagagccccaagggggcagggaccaaaucugacucaucuuauucugcccaaugcccaccaacuuggccuggcauauacuagguguugaguaagugugcaaaaggaauggcuugcuuuuccauggagaaagggaagcaggaaagaggagaccagugugcagaucugugcaaaugggaugcaaaugggaggggaggccaggggugaagcccacaggagaaggcgcccuggaugagcaggggugggaggugguccaccacaggcuggugaagaggagcugcagguggagucccuuccacgcggaugccugcugguugucuuaggccagccaucucuuuucuuucaagcccacaacccgauguuaaggcccauagcugcccauugcagccucgggacuccuguguuuugcaaggccagacugagaaaaaauuggucuuuacguuggguuguugcgccacgcugacagcgggcuauguguggcgaaacaaucccuccccacugacaaaagcuccccuagcgucugcccaguuccagggaucaggcggacagccaggaaggucgguggggguauaguaccuuucagcgaaggugguguguaggcacagggguugggucucuucgacuugagauggugccccucuccugaggcucucugccaggggaagugccagguuaaaggggcucagcagaggcccuugccuucaccaucccuccauuccaucccacccauggccacccaagcagacugauuuagccacugcuaauggguccugcaccuaggcugagccuccccacccuguggcuuuagggggggccccccauaagccauggccugguucagggcaggacucuagguccaggagguuccacccugagucugagcagaggaggaucugcugguggcacccuggcaugaggcacucucagaggacugcccauugauaugcuaauguguccucuuggguggcaccccauacugguugguugucacugcaggcacccguccaccccaccccaaggggcccaggcaucccuccuuccagcugccccaggaaacucaccugguggggggaggcuuccuccucugaggaaggccaccaaagccaaccgaaccagaaccaagcgaggaggaaaagagaagagggagagagagaaagaauccgaguuauuuuccccagggucucaaucucuggggacagggaaagugugcccucucccuccugcggcugggaggugucaugucaauaaauaaagccaauagaguuggguucccagaccuuauccacuccccagucuccagcuuugacuccuguucaugggacuuuggcagggccccuaggaaggcaucagagcuaggguggggccagggcuaagugggcagggaggggccuaccuggugaggagugcucugagagccggaacagcauggcaggcguuggucuccugcgccggaucuaaggagauggagggaggggugacuggauggacaccugcagcccucccccacccccaggcagcagggaacaaacagugcuuuggaguccccagggaaccuuugaaucaaagucugucagagccaaaaggaacucuguagcucaccuaacccccucauuuuacagaggugaaaaagcagggcucagagagauuuggcaaugugcuuaaggccacacagcacaacaaguccaaaggacgagaaaaaccccagucacugacucccagcccaugccugucccacuccauggcuacuccagaacagacaucucccuuccuaucuucucccaccaaggcccuuccucucuccaguuucugaaaacaucagaccucggaagccaaagcuggcuacagcuccagcugccacggcugggcccucuggggaagaugccccacgggccauggcacccauguggcccugcccaccuaagaucagcucaagggcuucaaacaagcuggauccagcuuuucagaaggagacugagccagcgcacugcaggcaccccccaccuccagcugaggcucagggacccaaaggggccugggggaccucucugggggccuugguuugggcuucuuuuccagucucuguaaggcugcagaacucuucacccaguccuugugagaaaugaaaaguugcccuccuugcuacgugagccaagcagcaacugaccgccccccuccccgccccgccccucagcuuggcaaucagaccaacugucaguuaauuaggucccuguugagcuccagggaaaugcacaaagagaaccaggugaguuaagcugaaacugccaccuccccagccaagcuccccaugacacccucaugacccaaagcugcuuaggcccaggacuguacccccugcccucuaucuccccccauaaugacuuggcccccucaucacugcucaguggggagccagcugcaucucagcucagcaacaagugaccccugcuccacuagggaugggaaguggagcucucugucacagcacccgccagccuuuggaagccccucaacccccaagaaggcccucaggaggacucaguagucugugggaagaggucuggcuuugugaugacuccccaccucucccuccuugggguuggggcucuggggccugacagcaggaggccagagccagguucuggagaccccagcccaggcacacacgcgggauuagagaggggcaggguaguggauucacccgguggcagccucauacuccugcccugggugacaaggucaguguccaccgcugcucacaucugaccagcucugggacagagccaggcggagcggucccggugguagccuaggagacugacuacccuuuggggacugugcugggaccaaaggacgcccccaccccacuccugggcggucuggaaucggccuguccccccacccccgcacccccagccucacugccaggaacucucuugccccgggaucaggaccaaagccgcggggaaaaguugcacgagucuccagcuaacuucacacgcggccccgcgccccguccugaccgaggcagagcccggcucuccuugcgcccccacccccaggccaguccggccggggcagcgccuugggagggcgaagaagccccgcggggugugucggguacgcugccgggguggggcacgggccccuuaccaucuccaccuggcgggggucgagcuggcuagggggcgcgggcaccgagaacuggaucuucuugcgguccuugggguccauggcgcgcggggugggcgguggggcuggggugcgcgacucggggucccggcggcggucugugcugggcucccccgcgcaggcggcgggcugugcggcgagaggaggaggagggcuguucgcgcacggauaaaaauaccgugcccgccgaggggagggcgcgggagcgggaggagggucggcgcccgggcugggcgcgcccccaggcucucgggacucggggcucgccccccgcgcucgcugagccaggucugugccucgcucccucgcgcuccccggccugggugucucugcgucucggugucucuccccuccugagugucucugcgucucggugucucuccccuccugagugucucugcgugucuccucucucugccucucccguccuucuccaccucccucccucagccucuccuccucuccgcgugugucu

SEQ ID NO: 21493 - RNA, 14251 nt, Homo sapiens
ugccccucgccgcccgccgccugccugggccgggccgaggaugcggcgcagcgccucggcggccaggcuugcuccccuccggcacgccugcuaacuucccccgcuacguccccguucgcccgccgggccgccccgucuccccgcgcccuccgggucggguccuccaggagcgccaggcgcugccgccgugugcccuccgccgcucgcccgcgcgcccgcgcuccccgccugcgcccagcgccccgcgcccgcgcccaguccucgggcggucaugcugccccucugccucguggccgcccugcugcuggccgccgggcccgggccgagccugggcgacgaagccauccacugcccgcccugcuccgaggagaagcuggcgcgcugccgcccccccgugggcugcgaggagcuggugcgagagccgggcugcggcuguugcgccacuugcgcccugggcuuggggaugcccugcgggguguacaccccccguugcggcucgggccugcgcugcuacccgccccgagggguggagaagccccugcacacacugaugcacgggcaaggcgugugcauggagcuggcggagaucgaggccauccaggaaagccugcagcccucugguaagguaccccuggccucccaauucccuccugagugcgcucccuucccagcggcuucuuccccauuccagccgcccuggaaggcccuuaaaaauccccuaugaguugaagagaaggcagguacguggcagggcccgacuggcaugggacaggcucaucaaggaaacugcuaccgagucccuagcagccuguugccaccaccaagggagacugucccaucgcuccaucucaaaccuccaaggguugucuguuugauaagggggucccagugggaggccuggcugcuggugcaggaguggcagauuaagguccaguuaagucagcugucuagggccagagaacuggaggaugguggugggguguguguuggggaggaugagggaguggggaaagcuuucuguuccugauccaggccgagggugaaaucccaguggucuggggagccagggccugaacuuuuuuuuuacaugguccagugguggagugggacauacaaauuagagggacuuuggcguugaggggcauuagacuugcccuuccccaaagcccagagccaggucaccuuguuguuugagaggcagugggaagacaggggucccucugccaggccuggacaccucugccugcccugguauacaggcccccuguucuuuucuccaggcagguaggauuugaggugguagaaaagucuuggcuccuagccgagagcugcaggagccucaugugugugggauagggaauagagaaggggccagggcgccaggggagagaaacagagagagagagagagagagagagaaacacacacacacacacacacacacacacacacacacacacacagagacagagagagagagagagagagagagagagagagagagagagagagagagagagacucugagaaggcccuugcccuaaccucauucuuacacuuucuuuuuuuguuucucaguuucuccuuagacucucagucucuuuuccuucuuucucuugcucuuuuguucuuccugauuugucucucaaccucuaguuucacuagucaugcucucgaguucuguuuuccucagugucuucugcccaucgugcguuucuuucuccaccuuauucuguguuucuguuucaguugcucugcuucucucccucucuuucuguugcuguuucucugugucucugucacuguuggucuuucccuguuacuuugggaaucucucugucugucuuucuguaucuaugccucuguuucucauuccaucuccgacccuguuuugcucuccugugccucugucugucucugucucuuuuccuggugcuugaagcuuccauuguugcaguccggaugcugggacuccagccccaagcuuccuguccugggacccaaacccuccacuuccucaauccucugcagcuugucagccgaggagagcaggaugcagggaaaacaggaaggagguggacuccaggggucugggccucgggccucucugcccuuccugccccuggguagggagagaugggucagcagaaaacauucuaggagaaaugccagccuggcacccagcauaucugggaagggggguccugggggagaaagucgcuaaucuuggggcagagaugccaguggcaaugguagaggagggguacugagacugggagggagcaagggccgagcccuuggguucgcgggguacaacagagucacguucccuuugaaucuccauccuccaccagccagaggguaucuggcaccagauaaggauggcugguagccuccuccucucucagcacuuugaaugcaagacagaagagcccucaaagggcuggguaggaauaccucauccucugguuggguaggaauacuccauccuguaguggaggaaaauaagauccccuagggguuuggggagggcauggcaugagaauuuugugguuguccucuggauauaaugcaaacuggccuccaggaauaucuaggggcuggguguggagguucaugcuuguaaucccagcacuuugggaggauugcuugaggccaggaguucgagaccagccugagcaauauagccagacccccgucucuacaaaaaaaaaaaaaaaaaaauaggcaacugcaguggcucaugccuguagucccagguauuugggagucugagaugagaaguucaagguuacaaugagcuaugaucacgugauugcacuccagccugggcgacucuauuucguaaaaaaaaaaaaaaaaaaaaguaggccgggugcaguggcucacaccuguaaucucaguauuuugggaggcugaggagggugaaucaccugaggucaggaguuugagaccagccuggucaacauggugaaaccucgucucuacuaaaaauacaaaaauuagcugggcaugguggugcgugccuguagucccagcuacuugggaggcugaggcaggagaaucacuugaacccgggagguggagguugcagugaaccaagauugugccacugcgcuuuagccugggugacagagcgagacucugucuaaagaaaacaaaacaaauaaacaaaaaaaacaaaaaacggugucuuggaaugggguggcuuuagguccccuuuggaugacacagccaaggucuguaaugccccucccccuuuccuccuugccuuguccuccagccuccagccaugcaauggaugcagguaucuggagagagacgagggaagccuggagguaccuacugagcaagcuaugcccgugcccucccacaccuccuagucaucauagaaguaaucccuugcugugaccugggccacauggcaccauguaaaaggcacucucuagaguucugcugcagcccugcagggucugugggugagauaagacgaccaagccccuacccacccaucuuuuuagccuuacacagucaguaggccacugucugcuuuaggucccaagguuugggcccacuggcccgcgaauagcuuggucgaggguaccugucuauuuuuucugccuuuuccuuuuggggcugagugucagcagguggcugggggaggguggccacuuggcaugcccccuucuuuggcugcuaugguccagcugccuccuguuugccccaggggcagaucuccccuuuccgucuccagccaccccugccugcccuccugucacagcuuuccaugugcuggccagguuguggcuuaacaccacugaggccaccagagaugaggcggggcgugugcaucaaaaguccacaccucugcauccugguacugauccuagacucauggaaucugggggaguggacagcggaaagaucagcguuuggacggggaguuccuaagcugggcucucagucccuuugggacaggguuagggaacaggcaggcuggguuaauuuuuagucaaugcagcaaauucugccccccuacuucaguacugggaauccaguuaugucaugggaacaagggcauucccagaaauucugugccuuguggggagggggagggaggagcauggccgcuucccauuuuuaauuuaguacuggcaaagcuagcaguauuggugccucggguaucaggagucuuuccacuuaaagacagagugcugcagagcuaagucucuccuccuccccuuccacccagucuacuucauuuuccuaauuuuuaaaguggggagggcaacaggaccugccucacaggguuggggcgucuggcaucggguaagagcucaauaaauugaagugaugaggaagauggugaugaagaagcugaugcugggacuuagggaagcgguaggacgagggagcaaauuuggggcaacauucagaggaguugagaggggugggguggccuuuggugcauuuugcugcugucaacaugggaagaacaggccaaguugccuuaucuguuuuuuauucugaggcuggcagcaugacacagcuguugggggugauaccccuugagccagaccucagagaaagggccugguacccagcaccagcggucuuggcuucuccagcuagagucuaggggaagagggaaaagaccuuucuagcaggacaggugggugacccucuggaucacagcugaaacuucuggucgggauggcugggcccacucaguucauagccuaggugucucucgagggccaggggcuggcguuggggagaaauugugaggguaaaaucaggcaacaggaaagaggaaauccucuggcuuucgccacaaacuuugcagccgguggugccaaagccguguggccucuucucuggcgccuucccuuccucugcugcuggagcaaagaccgagguuuccccuauagucagaugucaacuggcuuagcuccaagcugggcgcuguaggaggaccaagccuacuuggaagucccaucucccaaacaagcuuuuuggaggucagacuuuucaggggaauaggucugacuccacuccugcucagaggggaacccacaggcauuggaauuucuccagagggcacuaccaggaugaguagcaccagguggcuggaacucuugugugagcagggaaauagcaaguauuuagccaguuuuggagaugagaagguuaacguuaucaagagacucaaugcuauaacccuuacccccacaaaaaccuggugcuuagggguggauccugggguggcucuucagucugccaguuaagcaggguugggcaaggaaaaguuacagauuacauggaaagucaacaaaccacggugcagagaagcuguugaagucagcgugcccugcccuggcucugugucucugaccagggcagggucagagugcccaagugcauguggguaaggcacauguggaugaaugugugucuggacacgugauuguuuguguacacuugcaguucuugagccugagccugucugugugaguaggcaaauacggauuuacccuguguccccaugagacuaaggagggagcuacucucccuaucuggugggugcuacuccguguagacaugaacuggggauaaguaggauggcuaguggggaaccuaacaagggagaagccaggcaguuugcuggcuuagcuuuucguagguaacccucugaugugacauggggccauaccaacccaagagcauaagccaugccucuggacucacccugugccccaugcagcccuaggcuucagugagcauaccuaauccuccuuaaugguaaacaucccaaauauccauuaauaauccucugaggguuaguuauuugugaacuuugacucguaaaagcucagcacuguggcucacgccuguaauccuagcacuuugggaagucuaggcaggaggaucacuugaggccaggaguuugagaccagccugggaaacacagugacacccugucucuuaaaaaaaaaagaaaaggccgggcgcaauggcucaugccuguaaucccagcacuuugagaggccgaggcagguggaucacgaggucaggagaucgagaccauccuggcuaacacggugaaacuucaucucuacuaaaaauacaaaaaaauuagcugggcaugguagcgggcgccuguagucccagcuacuugggaggcugaggcaggagaauggcgugaaccugggagguggagcuugcauugagccgagaucgcgccacugcauuccagccugggcgacagagcgagacuccgucucaaaaaaaaaaaaaaggagagagagagagaaaaagaaacucagcauggaaagcauaguuguggucaugcuucuauuccauaucucuugagauuuuugaggcugcuaccacccuaauucuccacacuuccagggugggagcucacuaccuccugaaaacucuuccucacuccuugaacuccugaaaaaccuuccucacuccuugaaccaaagaauauucuacccauuuacugagaggaaugaaucauuguacaaaauagugcuugcuuuuuuaaaauuuugagacagggucucacuuguugcacaggcuagagugcaguggugugaucacugcucacugcagccucgaccuccuggguucaggugauccucccaccucagccucccaaguaggugggacuacaccugugcaucaccacaccaggcuaauuuuuuguagagauaggguuucacuauguuuccuaggcuggucuugaacuccuggguucaagcgauccaccuauuucggccuuccaaaguguugggauuacaggcgugagccaccccagcuggccccuaguacuuucuuuuauggucauuaaaagaaagcaaacucaggaaaaacaaaggcuuuccagguuggaagggugcccccugguguuaguguccugggcuguggcaaacaaguccaggugaucuccagcccuacuuaaguaacaggguggggccuuuguccacaucucagcucagccucuguccuucugacauuugguucuaauucuuuaauucuugaauuuuuuuuuuguuuuuuuguuuuuguuuuuguuuuaagagacagggucuugcucuguuacccaggcuggagugcaguggcacaaucauagcucacuguagccuugauguacuggggucaagcgauccuccuaccucagucuucuaaguuaggaccacaggcaggucugacuaauuuuuuuuuuuuugguagagacagggucuugcuauguugcccaggcuagucuugaacuccuggccucaagugauccucccaccucggccucucaaagcacugggauuacaggcgugagcacccagccugguucuaauucuuugaggucuuccauuuccuuuuucucuccacuccccaguuccagcuuacaccccugaaacacggugacuccauccucaagccuuauggcuuugugcaagguggggguguggagggaggugaucacuggggcagcuuagguuucuuuggcuggaggaauuccuugggagggucucaaaggaagggccuggaucccagaucuuucucugguuccuaaccgagggcucaggauccaucuccuuaugguccccuuggcacaguccucgucuucugaaguuuauguuucuucuuuugcugccuaccuuggccagggggucuugcuauagugucuucucuuugguugacucuuaggaacuugauguaggacuggaguccccucuggacuguccuucuugggauuuuaaaugugcagaaggauggauuauaucugucuacucuauuuauuucuucccuuuuauuccucuuuucuaagccagcucuccaccguaacaaaaucuucuuccauccuuggugaauuuuauuaauaaccuuugguguggaagguuauugauaaagacuuucugguuagauuccuccuugccugguuugccuuuauccacauauuucuccccacaccccccaaaccaggagaaugaaaagagaaccaacccccccagcuuuggcuaggcagaaaaauaccauuugacccagaggcagcucugggaucgcugccacgcauggaggaaccugcuaacuccucaggaaaaaaaaaacccugacgcaaaccagauguaaccuccuguccggcugccaacaucuggaaugcuggcaggggcuuugcacucaggccggcagcgagcugccaagccugagcauuucagagguggcucugaucugcagagaggucuuccaaccucuuucuccagcucagcccuguauucugguuuugacugcuuggagggaggagcagugguuacaguucugggacucaagcaugggguuuuucuuuuuuaaaaaaauguauuuuauuuuauuuuauuuuuuuagagacagggucuugcucugucacccaggcuggagugcaguggugugaucauagcucacuguuaaccucgaauuccuggguucaagugaugcucccgccucagccuccugaguagcuaggacuacaggcacaugccaccauacccgguuaauuuuuaaauuuuuugugaagauggggucuugccauguugccuaggcuggucucgaacuccuggccuuaaguaaucuucccuccucagccucccaaaguguugggauuacaggcaugagccacaaugccccauuuggauggaguuuuucuugagcucagauagagccuucaggagaucccacagagggguugaagguccagccucaucacucccgucuccagaucccuggugcccugguucugggcaaccccuauggacuuuggauggagucugaagucuaagaaugggaaacuucgaggugggggacugaaggaaugugugaggcuguucuugugguccuggggccacacagguuguguuacacacacacucacacacacacucacucuuccucaugcaggcggauacacuaacucccacuucucucccacucagccaauggggagagccuuuugggcuagaguucucauugcucauggaaacucugauucaggccauuuggaagagggcgagcagaguccacagcccuggggauccccuggcuggcucagccagacaccgaaaaaaucaggagaggcaacagggagaacgaucagauggagaggggaauggugggagcugaauggaaaggggacaggauccagcagggggucccccugccugccucagaccucccugcagggcccaggggacccuccugccaucugggcagcugcagcuggugacucaucugagcgcuggccugaguggggugagggacaagucaaggacuucaagaggaauauucuccugagagauccaggggagaggggaggagguagggggcugcucuuguuucuucccgcuccccaggcccccugcucuucuccagcgccaagccgaagaauccccaggaaggagaacgugggugggaggcuggguuggugugacgcucugaccucuuccggugcugaccucuccuuaucgcuaccugaauacagacaaggacgagggugaccaccccaacaacagcuucagccccuguagcgcccaugaccgcaggugccugcagaagcacuucgccaaaauucgagaccggagcaccagugggggcaagaugaaggucaauggggcgccccgggaggaugcccggccugugguaaggaccuccgaugcacaaaugugcaugugcauagacacacacacacacaugcccccugccccccacaugcacgcacccacacacaccaucaccaccagaucuggggcguguucauucagcacacauucuagggugacuacugugugcaaggugcaacuagugugagucaucaggacccagagaaagcacucauucccuuccuugggauuccuuuccugcccaucaguuauauacaucggggcagcuuaagugauuauuaaauacugaaaaacuucuauaccaauugguaaaaagcaguuacccaaagcgcccugggguuucuuggccuuuuuuggauuccccaccccagaccuucucaguaaccaaaggguaaugcuggccauagcagggggccugggacccugcuccagggucuggcuaauuucccuucugaaggucuuacaaguugucaguuggaaguuuuaucugucccuucugcauagaaaucacccccucccuggcuuucugcauagguucccacagccccuuuccccacaguguccccucacuucccaccccuccuuugaagaagcucuuuggcucgagacccuuuccuccacgucucuacccucccaguguguccuccagacccaggccucucucuucaccucacuggguccugcccagccccuggggcucaggccuccuuucggggccuucaguucucacuuagcucugaccccaggccugggccuccugccucucuuccuucugcugagcaauuuugucuuccccuccuccagccccagggcuccugccagagcgagcugcaccgggcgcuggagcggcuggccgcuucacagagccgcacccacgaggaccucuacaucauccccauccccaacugcgaccgcaacggcaacuuccaccccaagcaggugggucucugucucccgcuggcuuggcccuggacucagcucuggggcauuuccggccucuccgcaggaugguccuggauggagaucucaggaaggggaaacuccucaaccccaacccaaccccuuggagccucccuaaaccuaccucagcgucagaaccucacucauuuuggagaugaggagacugugauccagagaggaguaaaagcgccgggcuaguccagagucauagaacaaguuaacagcagaucuugccucccuauccagggcaauuucccucaccccuggauuucaccaucuguggugcagaccuagcaacccugacaaccucuggcucccaacacucucucauucacucuacucuauucguaugaguaauuccuccugucacugagugagguuucuucugggaauggagggccaaagucaugaggagucagggaggaaacucagccuaccccucccugcaaggcgaguagcaaaaccaccugggguacagcaagagugaagguaaaaccagauuggacgguuggagacaggcacuuuggguagaagcagaggaaggaguggggcaggagagaagacacaaaggcagcaacuucccuauuccuuccugcccuuggaagcugggguccucugacaagccuccaggaggcugggauggucagcaggguuggccucuuccagucuaucucuggcccaucagaauggguggccugucugggcagggcucuggugugccuccugcuggguguugccuggggaacccuagccuggagcucuuugucgacguagacagacccauuucccugcuccaugagcuauagacaaauccacaauuugagcugccacucugccagcagaagucuagauagaaggacaaagguugcccugagucugugcaucccaggauggcaugaaaaggguaugagugaagggacagagagggcaccccaaaaccaaugcccagccuauuucuaaccuuuauccuaacacgaauuuuauccuugucccaauuuaaaaaacuuuuucucuuaauuuaaaaaaaacaauuaauagcuuuauuuuuuagaguaguuuuagguuuacagaaaacuugagcaagaguacaggguuucaauguacugucauccaccccaguuuccucauuauuaacaucuuacauuuguugcaauugaugaacgaauauuaguauauuauuauuaauuagugguuuauauuaggguucacuuuuuguguugcaaaauucuaugcauuuucuucuccugauuuuuuuuuuaaaggcaggaucucagucucccaggcuggagugcagugaugcgaucacagcucccugcaaccuccacauccugggcucaugugauccuccuaccucagucuccugaguagcugggaccacaggcacacaacuaugucaggcuaauuuuuuuuuuuuuugagacagaguuugucucuuguugccgaggcuggagugcaauggugggaucucggcucacugcaaccuccaucucccggguucaagcgauucuccugccuuagcucccgaguagcugggauuacaguugccugccaccacacccggcuaauuuuuuguauuuuuaggagagaugggguuuugccauguuggccaggcuggucucgaacuccggaccuaaggugauccacccaccucggccucccaaagugcugggauuacaggcuugagccacuagcuucuuccucugauuuuuaucccauugaaaguucugacacuugaacuuuauccccagaccaguucugauccuuaagcuauccuucacuccaagauuaauucucacacugaaauauacauuugcgcccccugaaccuucuacuaucuaauuuugacccaaaauuuagcuuaacuuuaguuauucugaccuugaccucugucuuuaucccaauuguguuuuuaccugggcuuuaacccucacccaacucauccagcucaacuuuuagucauauuuccucauucaacugcaacucuuacccugguccuaccuuaaucccagcuuggauccaccucauaacuauaaucccauucuuaaagucccaacccaaucagaauauguacccaaaacaucuccaaccugaacccagccuuucaaauccagcugugccuuuaaacccgagggcuuucuuaagguccugccuuccagaacucucuggaccuuuccuucuugaccauguucucccugcuccagugagcucagaagacccaugcucaaaaaagagucaccacccucagaggccaucuugaagcagcgaccgucugacuugggggcugggcugggcugggauuggggugggucacuuggggucucuuuuccugcgucggaacugaccccucauguccuucucuuggcagugucacccagcucuggaugggcagcguggcaagugcugguguguggaccggaagacgggggugaagcuuccggggggccuggagccaaagggggagcuggacugccaccagcuggcugacagcuuucgagagugaggccugccagcaggccagggacucagcguccccugcuacuccugugcucuggaggcugcagagcugacccagaguggagucugagucugaguccugucucugccugcggcccagaaguuucccucaaaugcgcgugugcacgugugcgugugcgugcguguguguguguuugugagcaugggugugcccuugggguaagccagagccugggguguucucuuugguguuacacagcccaagaggacugagacuggcacuuagcccaagaggucugagcccugguguguuuccagaucgauccuggauucacucacucacucauuccuucacucauccagccaccuaaaaacauuuacugaccauguacuacgugccagcucuaguuuucagccuugggagguuuuauucugacuuccucugauuuuggcauguggagacacuccuauaaggagaguucaagccugugggaguagaaaaaucucauucccagagucagaggagaagagacauguaccuugaccaucguccuuccucucaagcuagccagagggugggagccuaaggaagcgugggguagcagauggaguaauggucacgagguccagacccacucccaaagcucagacuugccaggcucccuuucucuucuuccccagguccuuccuuuaggucugguuguugcaccaucugcuugguuggcuggcagcugagagcccugcugugggagagcgaagggggucaaaggaagacuugaagcacagagggcuagggaggugggguacauuucucugagcagucagggugggaagaaagaaugcaagaguggacugaaugugccuaauggagaagacccacgugcuaggggaugaggggcuuccuggguccuguucccuaccccauuuguggucacagccaugaagucaccgggaugaaccuauccuuccaguggcucgcucccuguagcucugccucccucuccauaucuccuuccccuacaccucccuccccacaccucccuacuccccugggcaucuucuggcuugacuggauggaaggagacuuaggaaccuaccaguuggccaugaugucuuuucuucuuuuucuuuuuuuuaacaaaacagaacaaaaccaa

SEQ ID NO: 21494 - RNA, 20724 nt, Homo sapiens
uuuuuuucauuuuuuuuuuuauuacauuuggaccuuuaagaaacauauaccaucagauauaccacuauucaguaaaaaucuauucuaguuuuugggaagcuuaugugucacaaacuaucuugcuucuagucuccaagacuuuacuaaguuuaucaaaaaggugggcucuggucuaugggauccugagccuugagguuuggauguucugauuauuguaaaacaauuucaaguggauuaacuuaauucccagcuguuuuucuucuggaaugggcuaaucaguuugaauuaucuaguccauuacaagaauauuaaauuccuugagcuuugugaucuauucugucuuuggaaaaccugguaaaaaaguaauuuuuuuucuauacaauaaggauggauuuaccagaacauacccaguauuaaucauaacaaaaagcaguauagauaauguauaugugcuguguucacuuuaauaaccacuucauaaguaacuacucuaacuauggggacuauuucuggaucaguaagauccaaguguaguuaguuacacacuacacucagcuuaacacaacucuugguaucugacauugauuaaaaguaaaaaaggguaagugaacaaauacauacucauacaugaucacguuuuuaagaagcuacccuuugcagaaguaaacaagagaggagacuuucaggaagcuacugauggggacugggaagguuuaaagcuauggcuuugguaagcaccccagugagcuguaggaaggcauuguaagaguagauucugcagcaucaaaggauaauucucuaaaagagguggguguuuucucaauuaaucuaaauucugaggcuuucagcaguugagggcuagaaacaagauccaaagaaaagagccaucuucacaacacuuaagaaaggugacugacugagccauuaggcucaugaugcuaaaugguccaaaagccuuugguggugugauauggacaagaaaaaaaauuaauacacaaaccacguaacaccauuaaaaccaaaaaacauuuuuucauuaaaaaaaguauuuagaacacacaaaacaaggcaacacuuauucuuuuuucucaucuucugguaugggaucuguugguggcuccuccacuguugcacuguugcucuccgagccaguguuacuaucacugguuccuuccucugccauacugucgacccccuccugcccacucuccuuguccucaggaguagacgugccuucuucaccauucuguuggcucucuguuguuucuucaaggugugucuccucuguaaucacacauuugucacugucaguuccaagaugaaauuuuacucuaguuaugcugacaguauacagcugugcuguccaauauagaagccacuagccacaugugguuauuaaaccccugaaaugaaccagugugacuaaagaacuuuuaagaauguuggaacaauuuggguaugaaaaucuacuuuuuagcuguaaaugaaugaaauuuauuaaauaaaugcagaucaaauacuuccgaugaaaauuuagcuucugaauugagauguguauaaagacuguuuaaaaaaaggaaagcugauuuuaaaaauguuccuucuguguugaaauaauuuuauuuaggauauguugaauuaaauaaaacauauuguuaaaacacuuguuuugcuuaacuuuuaaaaauaugucacuaguagaaaauauaaaauuucacgugacuugcauuuuauuucuguuggacagugaaugagaguuagucuguagugcuauggauuaaacgaggagaaagcaguuguagaaauaauauaagguuggucuuuuagacacuuuguuuaaagucaugcugggcuguuuccuguaagaaauuaaaagcaugagguuuuagcucuaauagucucaaacgauuuucuucagguuuuuuccuugaacuaggacagaaucugaguaaagaccugcaaaccuuaagcauaagacaugccccauucauagaugccaaaacagaggcaaaggacugaguguuugucuaguugcaaaauuagcaaaaaucaguuauuuuaauuuucaagcucguuuuaaccacaaaaaugugcucaugcuccaaauucauuacaauaaaaaacacauucauacaaaacagaaagagacucagauacugaaacuuaaaauaugaccauuucaaauguuaaucugcuggauuaaauuuugcagaaauaccugguaaagauaucuauauuccauuacauguuuuccagaugguugucaucugaguaccaaguaugacuacugucccucccacuucuugcaacgaugcuccaggaagccuuugguuuuguuuuccauaacuacuuuuagcuuaguccuguuuacacaguguacuaggcaguguuaaaacagugccaugagguaaggugaucucaaaauuacaagugacgaucaauguaaucaguacuuuauguaaguuuuauuuauacaaguuauuauuauuauuuuuuaccuugagggaugcuuuuaaucaggaaaaucaguauaccuagaaguaaggguuuuucuaggacagagcuggcaauuuuuuucuguaaagagccagauagaaaauauuuuagacuucgcaggccaggcaguuguuguugcaacuacucaacuauacuguuuuauccccaaagcagccacagacaguauguaaacaaacaaguguggcuguguuccaguuuuauuuacaaaaacaaguggugggcaggauuggcuuacagguauuacuuugcagaaugcuguccuaggacaccaaagacaauuaaucuuaacgguaauaaccacaucuugauaaauaauguaagcauuuaaagguuaaaauacugaaugucaauaucaugucaaauuuaguacugggaaucacccucaguggcagguaccagaauacuugcacuuagaaagaaaaaccuaaauuaaagacagccguacaaagucuuggcacugccucugcguuuguugcuaguggguuaccugucuccaucggaauguucucgucgucuuucuucuccucgccuuuguuagcugcuuguucuuccucaggaacgaugcugcucugacugcgcucagcuugcucugcggccuccuucucccuuuccuccugccuuuugcgggccuguuccucugccugugcaaucucagcugcaauuuucuccauauccacuucuacuuucagaccgcacaacuaaucagaaaaaaacagaacuccguaauguuuuuuccuuauaauuuuugagccagauauauucuuucaaaaguugguuuucuugccuauaaacuauauauauauaucuauacaccuguaugugugugugugugugccaaaaaaaugugguucuaggucuucucugaaacucuugggucuacaagaaaaaacagcagcucuagcaguuguauaauauaggauauuccagagcagcuggugaggcaaaauagugaaaguucugggguauacauaaggcuuccguuuuacauuuugggcuaccaacuagauuuccuugucugaaugcaaagugcaaauuauaaauuacauuuaaugacgacauuugaugaauaaaucacaauaaaaugaaaguaauuaaugacuguaugggaguuuaacauaucagagggcucuagcauuuacaggccuagaagauauguguauacucuaugauauuucaaauuuauugcaauuuugccagagaaugggaacaaucuuauaaaaaaaggauccuacagguuuauaauaaaguuagcccuguuucaaagugaacaacauucaauaaaaacacuauuuuggaaaaaagaaugaggaaaaauaaaguaacagguauagugauaaaaguauaguuaacauauuaaacagauacccuuuuaaguucauuguuaaaugaaucugugcuuuccaggaauuuccucuucuucuccuggugucguuccucuauuugaagaaguucagcuucuaguuuucgcugcaagacaggaucaggcuucauaauugugucucauuuuuuaaugguccauacuuucaaacaguguaccaaauaauguuuugaacuuuagaucauuuaucacaugagucuagcuaagauuuaaaaaauacaaaaugcagcacaaagaaaugauuaugaucaauagguaaauguuaaagaauacuguuucaggccugagcaauuccuugggaaaaaauauuuagcauagcaguaaagauugauaggaugccucaaaauucuuaaguucacacguauuucuuaacgaauauacuuuccauuacaagguucuauauuauaguuuuuaaugacaaacuuauuaaacaucugggaaagguccacuuccuuaaaccucuucuccaaaucaggaacagguuagauugacauauuuaacagguagauuuaggcaugguguaggaaucauaucaccugggauuugugguauaggcacaucuuauugaaaugaauguuuuaugacuuuaccugaugaaccauuaaggacuggaccugccguuugaggaccugcauucuagcuguugugacaacugaccgaacgucuggcaccacacucucacuaagaauuucacugaugaggcggugguuucucuggaaacgggcgguggcuguaugcuucauugaaaagccaucaucauaaucuggagugaacaaauuguucuggaaaucaggucaccaguaaccauaaaaaggaguguaacaauguuaacacuuaauuaccaacgaacuauggcccucacuggccuaacaaguggaccugcccagcgucaugggagcacuggggcaguuacuugauaaaaaccauacagaggacguaauguguucauuggccaagguaguaauuuaucucacagucuuuaagugauaauguugugucugagaaggauuuggcuaaaacauaaacgagauacaacaugucucuucuggcuucggaaucaaugugaaggcuguaugugauggcaguaauugaaauucugcccaauguuucacucucuugguaguaacuuaaggcauuuaacaacuaaugaacaacauaugaacugggcagugacuuugucacuuguagcacuuuaaaaaugaaugaaaaugcccauuuguaaaauuaugacagcagagaauacaucaccucuaacaauauucaguuucccaggcccucaaguaauuuuauagaagaaaaauaaaugucugauuccaaauuuaauuuuugucaguuuacacuuagccagcuguugucaguguguaaugguaugacccaaguucauacaguaugggucugguuuauaugcuucuguuucguuuugagacagaaucucccucuuguuacccaggcuggaguacaguggcccagucucagcucacugcaaccuccaccugccagguucaagugauucuugugccucggccucccaaguagcaggaauuacaggcgcaugacaccacgcccggccaauuuuuguauuuuuaguagagaugggauuucaccauguuggcuaggguggucuugaacuccugaccccaugugaucugcccauccuggccucccaaagcgcugggauuacaggugugagccacugcacacacacuacaggcuuauuuuuaauagcuaucuaguguuuccuuaaucucagucuuugcucuaucaccuucauaguuuuucauauaucuacuaacagccuguacuaucguuuacuuaauauuuuucuuuaaacuaacucacuuaaaaaaaaaaagagcuuucucuuuaguaauacauauuaaaacaaacgcuccucucugaaccacuuaaucaccucagugacccaccagacagggaggaaccacacuuaagaaaaccuuguuacaggggaaacccuguuacagaggccuauguugcgcugcuaugucaguuuagcaccucccuuauugucuggcacuuaaguaguuccuaaaauucucauuauuauaaauacuacagcuaaaaacuguuguuuuuguaaaaaguuaaaaaaauuacuuuuguuuccuuuugaguaauuucuuuaggaaauaaacuucugaaauuaaaacuacuggguaagauacaguuuuuuuaaaacucuguaaccuuucuacuuuuuaagaguuuuucaccuuuaggguuauauaugguacaucugugcuacaucugucuaaguuaucuguuuuuguuguuagcuuuuguuuucuucuuucauuuauauggccccaguguugaccacagauggggacauaaggucuaagcaauuugggcuuguucuucuuugcauguuagucgucugcuuccuuuuuugggggaauggcuucucugguuaugaucuaauugaacagcuauuuauccuaugaugaagaggcucucacugaauaaaagccuucauugucuuguguggauaauugcacaugcccucuuuuuuuuuucuuuuuuuugagacugguuauugcccugucauccaggauggaggacaguggcaugaucauagcucacugcagccuugaacuccugggcucaacugauccuccuaccucagccucagcuggaguagcugggacuacaggcacaagccgccaugcccagcuaauuuuuaaguauccuguagagauaaggucuugcuguguugcccaggcuggucucaaacucuuggccacaaacgauccuccugcuucaguuucccaaaguauugggauuacaggcgugagccauggcgccuggcaaugucuaucuuuugauaguccucuguuaaagaagucaguagcuguuguacuucaugcagaugccaccuuucuguuauguacauuugacauacauuuccaccucccaaguauuccucuuucuaaucauuuucguacugguaugcuaaagacauucucauauuggcaucuuaauugcuaccugaauuuacuagcaacuuuaagacccaaucugaaaguuaaaaacaucauaggcccaaguuucagacuguuucugagugaaucucuuuaguccuucucaguguucaugguguuaaugaaagcuuuaguuauuuucuacuuacguugcuagccuuuguuuccucuuguacugaccuccauccucccaauaucuguagacuggauugucuucugauuuuuaguucuguauguuucucuugcauuaaucaccccauuugaguaauuaaagugugaggaugcuagugugucuuuagcacugcugauucugcuuaacauucaauacuguuucuauuccauauucuauucucuauaguauuacauuccacugucuguauuuaugagaacauuugacaauauuccaguacauuauuuuuaaaaaugacuucuguuuuuccccacuuuuaucaacuuauucuugucuucagguacuauuauugcuuccucccucauugauauugucuuuaaaguucuuauagccuuccucuuuguuacugcuacuuuaagaugggaucuuaaaucauuuuccugauguucuugucgcuugcagcuaaagcuucuaaccuuuugcacaucauagcaguauacagagaaacuauuaauguuuauacagcacacuagauaugugguugaguguguucacacugcagguggcuaucucugggucuccucgcagcuucagacccugccuggcugcacaagaccagaacaaucagaacaccugcuaacuacucauacagaauggcaauuaggaagcucugccauucgugugcauguauacaauuuguauggguauacccucauguacacccauacaaauaguagcaugagcuauauuuauacauucuuauuggauuucugaauuaaauggaaaggaaacuucauguuuccacauacucauuagcuucucccuuaagagccuuuaauucagcgaauuuagugaaccaauaagaaaacaagauauaauuagaaugcauuuagcuuuuuaaaagcagaugaggcaaaauccugauugugauuuaaaaaccuuucgugcauuuugaguacaaagauuuugauaaacaaucaauaauuuuugcuauuuucugcacugaaaaggauauuucuuuuucuugugggaaauucacauacaaaucuuacucaauauaaccaaaauacuaagacgauacuuaaauuauacuuucuuuuccauuuaggauaagaaauaaaaacuuauacuuaagagauuucucauaucuuaacucacagagaaagcauaaacaaaaccccacuuuuuuucuuuuaccaucuggaucuucagcaggcugaaugcucauguacgguucuccuuucuccaugcgagauugucucugucgacuuucuuccucuaaagcagcuucugcacgacuuuuugcauuuauguaagcaagguacgcgggggaauuaugauaggccuucauagauucauuguacucuaucugaaauucaaauguuuuuugguuuuauaauuaacauuuugcagguuauaaugcagaccuauguuaucucacuugaauaucaaaagauaugauguaaacaggguguugggauaauuaucuccuuuuuacaggcaagaaaucugaggccuugagaaacugacuugacucagguagacagagccucaguacugcaucaguguucugaccaaaucuuauguuacuuuuauaaauaguaagccaauguuuuauguacuuuacacauuaucuaucccacugugagccccuacccuaccuuuucugcuucguauucguuuaaauauucuuguuuuucuucaucagugagaucucgccacaugccaccaauaaucuugccaaucucccacaacuuuaggucaggguuggaagccuuuacuuggucccagaccuuaaaaagaaaacagaugaaauguuaauacugaugucuaaacguauagaccuuuaaaaauaguuuuuaauguggaaacuuuucaacauacaaagcagagaaaacaguaucaaauuucuagguacucaucagccuacuucaaaaauuaucaagaacuggccaaucucaaguuaucuuugcccuacuggauuacuuuaagauagaucucagacaucacgucacucacuuauaaauacuucaauuugauaagcaagaauaucuccaaucacuacagacacuuaggaugaguuacuucaauaacauagucuacgucucuaaaaguucaugugaauuuagaagaaaagugcuuaauuugcauaacacgguacaucauauuaucaaauacaaauauaauagucaagaucaaaagguuuaacauuucuagauagugguuauaaugcucugccuuuuaauaaagauauuggcuacuuuuuuuauuuuaagaguaauguaggcucaucaccaaaaaaaaaaaaaaaaaaaggaaaacuugaggaaaagaaaauaaaaacuaccauaagcuuacugcuuagagauaauuauugucuucuguguuuucccccuucaaacuaacaugugguugcuauuauuuuuauaaaaaugagauauuaauucauguagucuugcaguccuccuucacuuaacauuuuccucacgucauuaaauauucuccaaaagaaaugacuuuaauggcuauagaacauucuaucuuaaggauuuuaacaguuuauuuaaucacgcuccucuuguuggauuuuaguucuggaauuuugaaaucagaacuaauugcuuuaaaaaccguauuuuuuuggaccuuuccucugaauaugcacagaaaagcuggcuaagccgaucuaaaguuggauguuaagcaaagaagcagcaaagacaguguccucacuccuuaccagguccuaagcaccuaccuuucugcuguaccucauguagggcaucagcggcuuaucugguggcuuuggggguuuuggaaucgugauaccagaggaugccuacgaaagaguuaaauacauucauuauucaacuguaaggaguucacuggcaaacugaaaagagagucccuuaaaaaauucuaaugcgccuuucuucuauucguccaaauauuuucuucacugaaaauagcuaucacugcaaauucagaaauguucaaaagaaaaugacuuuaagcacauaauuuuuaaauguuuuacuuagcaguuuauugccaaugcuuugacaaccuggcugcaagaacaaauaaaauauuacacaguaacccauacauugaaaauauaugguuauauaucaaccgucucaaguucaggacauuaccugguacccucuuauucugcucaauuaccauuacacauacagucaacacuugauuaucugcagcaggaucugaacccuuaacacuuaccauucucacacugucuacaggggccuuaaccuauuagcacuaggaauguacucccaacaccaccacaaaaacaacuucccagguucaaaaacaaaaacaauuagugaaauaacaaaccaccuuaccuccuuugccaggcuagagauuuuauuucucuuaagguucugucuguuaccuagugguuuucuuguaaaggggaaugagaagugugaauuaaaagucacacauuguuuuguccugaguccuaaucacaguguaaaagcaaacaaguuuaucaggaacagagaaguggcagauaucgggccugauuacguuauuuuugaggucuuauaucaagaagcuccauuccauuaaaaauguucaguuuuaugggaaagacagaggaaaaggaaagaugugauguacaggaaaagagagacagaagaaaaggaggcggagggaagacugaaaaauauuuuuuaaaaagguaaagcaaaaauaggugaaagaaaaaauaaaaaaagaaggaaagagaaagauaaagugaucaguuuuuccuguggcuuaaagucuaggugagauuccagacagccucugguagaccacccagauaacacccaucuaaaaguaucuauuucugaacuuuuuagucuccuguuaauauacaugacugcauuugauuaaagacccagaauaagaaaaaucauugcuauuucagacaauuugcaaauuuucaggagaucucugauauugacucucccugcuaggcuggagaaaugaaguguuggcuuuauuuuaauuaucgaaagacaggauuggcaaauccuuauaggaaaacuaaaguaacauuuuguucgcuuccccuucuguuguugcuaugauaaaaccccagagauacuccuccacucugggcugggaccccaaucauaaccuuauuuuucauuugagggcucagggauuagcauguuuguguccuuuuccacuaugaucaagaaauguuuccucuuccuacaagggucucucuccaucccuauaacucuacuucuucaaagcauuucgccuuggaagcaguauuuccucucuuuccauuccucccaugcauucuugucacaccucaugcuagugcccagguagacagacacuguuuuuggccagcaguggguaagagagugagauggccaggggcauggaaacugucaaaagugguaggaugggcagccaauacagggaaaccuguaucagggucuauaguucuuucaaggggaaagagaauuccuauaagacuaaccuuauggauucagaggaacagacacacacaagucugcuucuucacacauaaaguuacuagaaaguauuuccaacucauauccaacacaaaccuucagaauuccaugaaauggauuacaaauaaaguuggaauugugcccauaacugaggugguaagaccacugucaaaauuuuuugaaauuaaagagguaaagaauucuaaaaugccuaugcuuccgagcuuuaauaugaauuaaaacacuuuaaaaacacaguaguauuugcucuuugauauuuuucaaagaaucacauuuuauauuaauggaauugcuauuuccccuccuuucucccaaagaaagguacacaaaucaucuguauauugagaccagucaacuuacaacaacaacaacaaaaacccaaacuaaaaaaacaccccaaaacaauaauaaaguuaaauuccagaugguuuucaggauaguaaagauuuauaucauuacacaccuccaauuuauuuaacgucucagacagacaucuuucuacaaugucuuaaacauuucuuuaaaaaaagcugaacauacuuuagacccuuucuggauaagauucaauuagaaacaaccacuguuuugcugugcuguaacccucugucagaugucaaaaucuguuguugacucuuucaacggccuaggggcuaugcuuuuggagaauguguuuccauuuuugaacuguuucuuuccuugcuacuaucaggaaacccaccucuagcagcaacucucuuuccaauuuucugcuuucaauuuccaauggggaggcggguagaacugugcuuacagaagagcaagguccuaggaaaucuccuaugaauaaaguucaugguuuugugaaauuuaucuugguuacucaguuuuuuguuguuguuucuuuugcaauucucagcuguuucucuagcaagaacuuauuuaagagcuuucuucuggggcagaauuucuauuaauguacagaaauaggcuguuuuuaaagacauuuuugucucaauguguuuucacaccuguacuuaagagaauguuaaucaucaucugaaugaagaacugacuaggagugaauuccaucuuguagcuaucauaagcacuccaaaaggucucgacaugcuauacaaaguauuuacugucugagaacuacccaaguauacuggagucaucagggaaacccaauguucucuacagccuaccacaagcuacuggacagggcuucacagauucguuccuugaaaaccacuaaugcaaucugcgcacaacaauaccauacaggagcuuccccucacccccaaaaguaaugcauaacuagggucauaguaaaaucaaaaugcuuuuauuauggucaaaaucagagccauugaguccuaacagcuuaaacuagauauagaaagcagggcaaguaguguaaaaccuccacauuuucuaggcccuucuucauauagcaguuugauuauacuucaauuugguguuaagaggacaauaauacaaaguaaauguccacaaaggaccaaaacaccaaauuuuccauguccaacaacucucuauaauuaaucuacuauguagcuaguguccacgccaaauguucaguucuuaacauucgccaagaaggaaugggaagaaacagaugagugacuucagauagggaguacacuuucucuuccuagucuccaucgaacaaucucacuuuuuuaacugagaaucccccacagcuacauccaaguuaagagcaaaauacuuacacaaaaccaaaagacaaauuacuguaauauuauaguuaucauuucuauuccauuaacauagauaaucaagaggugacuguauagagcuauuaaaugcaaucauucuuguuuacugcccgugaaaaaauugcugcauuaacauuaagauccaugauugauuccguucauuguuuaaacugaaauguucuuuaucauuugaaaaccuugccauccauuacacuugugaaacaacauguuuaggccagggaaaaacauguauugaugcacauaaaaauuguaugcauugugaaaugcauacauacacacacuuugucagaauucuuuuucagauaccaugaaauaugcauggcacauaaaacuugauaugcuuaugaaguacauauuaugcagaaacaaugaaaaauuuagacaaacaaaaccuaucaagcuaagcaauaugcuuaucaagauagacauucauuugauagcuacaagcuuucaguuccagcuugacuacagggugagagggcuuuuuugaaguuacauuaauagaaggcacuuguuauuuaugaauacagcaaacaaaaaccagguauuaaaaacuuuacagccauucuggguuguauaaauucucaccaacacuacauuccaauguaguauuugacuuuuggauuuuuuaucuuuaguaagucauuuuuauaauuauuggcauuuuuuggugcuuaaacuuuuuugaaugaaauuuaagaugauucuaaacuaaaagauuugaaguguaucauccaauuuugauaucuuaggcugaucacuuaaaugaaacaugcuaaguuucagaaauccuaucucuuauacuaaggauuagaaaugcacuucucguuguacauaucuagucugauacuucaaauuaauuucauucaaccuucacucugcauuucuuugaggugacauuaaaacguuuuucucuuuuucacuguagagaaaugagucuuaguuagaaggucaacuacuaaauccaaaagacaaauaacuauggguagcgauucaaacugguguaccagccaaaagcuuuccagcccugaaaaagccaggucugaaagaccagccucuacuagaaacucaauccuugagacuaaugccaaucaccuuauaaaaaugaaaaauacucuuuaugucaaaaaggauauuuuuaccuuaagaaauucuguuuguuuacauacaguauaagcaucaagugcucaaggcuuuaacccuaccaaccaccaaacagaauggauuuuucuuuucuucuauauacauuccagaucucacuauuuauuuuuucagugugagaugcuacaacgaauguugaaaauacucaaaaagcuagguuaaaaaauuuuuuuuaaauggcugugcuuaugauucaaaaagaccuaauucugaaggcauuucuggucaauuccaguuguuugccggaugcuguaauaguugauucuccuaccgugacccggcuguuggugcccggguucccucccagccuguaguuguuguaggcgagaugacuguauggauuguaucccacaaacccuggugugcugggcauuugcugauggaaacaaaugagacaaaaacacgaaugagaaaugagcucaaacgaggaaaacacagaaaugaaaaaugaucugcauauggcaugcaaaagcaaccugaauuuaaacaagcaaugauguguuguaauuguucuuuuuuuccacugaggaaauuaaauauuuuucuuucauugagaaaccugucugcagugucuuuugguuguuuuucucuuucuuuuuugcaggggcuggggguguuugugugacugugaauguguguuuuguuuuuugagguaagcaacacacugaaguguuuaaaacauucaggauuacuuuauggucaacaauaggauaaaacaacuuagcaauauaugaagacugaaauaggaaggcuugaagugugaucaacuagaacucugaaaacacuacaugcaaaacaaaauacaauuuauuugacauguggaugccaccaauguauuuaucuacuaaaaacaaaaaaaagaaauggaucugauuucaacgacaguuuuaaaucauuuuauauaaugugagaaaugaguagagacucaaaucgggaagccaggauuugucaauugaaaagaacauauguuggauuugauggaugucacauacaugauuuaaaacaaagacuuguaagaaaugcauggauuucauucugggguacuaucugaucuuuuuaacccagucauucuuuuauaggauuucucuuccauuucuucuuugauccaucuuccacuggucaaucaugaaaacauuucugcauuuugucucaaugugaacuacuuuucuaguuuauagacuucuuuuuucaucuaguuuccugauagcucucacccuuucaaaauacaacugcucauuucagcaacagaacccuugguuuuugugaauuauguguugauguaaucacaaaugggcucuuauauagcaguagccuuggggcuaauacaaugacacucaauguucaugagaaccaaggcauaaugcauagaaagaauauaguagagagagaccaaaauuaggguauuuuaccuuguaaaauucaaucaaaauaugugacaauuucauuuuuacaugcaauuaacaauaucgguccuuaauuguauaauguaaaauacacuuaacacauuccaacuaagcuguagcuguuacaaaauaaacacaauuuccuaaaacaugccgcugcacauauccuuaguacccaaaagaaagacauuuaagcagauauuacauuugauacucuuuaggagaaaagagaacggcugaucaauuucuagucuauacaguuagaaaagacgcaaauaaagcauauuuaaguaggcaaaacacaguugaaguaucaaaggcaugaaagaaguguauauuacuugcagcgguacauuuggguggcagaggugauaguggugauaguguugguagugguggugaugguggugguggugguagaaguaauggaaagaaaaaaggaagaagaauaauucauuuaguauccauucuguuggauguuuuaaucccuagucuucuauauuuuguguguuaaugugaaacuauaaugacacaaaaauauaacuaaagaaaggcaaaaaaaauuccuuuuuaugcauaauaaauuauaaggggacacuugguuuuugaaauauuuuaaucucaaaaaaucaaguuugucaagaugaugcauugucagaggcaguauuuuugucaaaaugacaccuucaaagguagcauaaauaauaagaaucacuguucaacauuaugaggcaauaauguuauaaaaauaagggaacuaaaaaaaaaaaaauggaaagcaaaacauuauaauuauaccauuuccaaagcugaaguacaugguuagcucuuugaggucagaaucucaauuguucagcuccaccuguauagccacuagcagaaugccauggagauggucauaacaaauguucuucgauuuaagaaagaaaacaaagcaagcauaggacuuuauagucuacuggaauuaacuuuagagccuguauaugacauaaauugaaaugagaacauaugguacgguaucucuuuucuaaaguaucucacuaaagaaaaacaaauuguugauaaauguaacuaaaauauguaucugaggguuaguaaauaugaguaguuuuuuagcggagaaaacuaaguuacacaaggaccuaauuaguagugaaaaguagacuagccugaaauuuaggugguggggguauggaaggaaggauuaauauuaaagaacuaauuuuguagaauuuggucaugcuaacaguguuuuuuuaaaaacaaacaaaacccccccucccaaaaaaccaacaaggaagccauuucagcaagaccugaacaguuacugcuaaaucuguuuuguggguuggaaaauuauuuuacaugcugaccaagcugggccagagcuuccugggugaaaaaacacguucacaacuacuuaaaacauauauacuuccaaaccaauaaaauauaauuuauggaguggaauaagauucaauagcaagaucugccccauagauaaugaaaucuuuacuugaacagcuugaaaauauuuacaaugaguaguuucagaagcuuuauuguuuaauaugaaaauuuuagagagagacaagaaaggagagaaaaacauaaccaguugaagguuagguuuaacaaaauagccagaaugagcauucacucaguaacaacuuaaagacucuuaauagugaagauuaauaagaaagaaaugguaaaacuuucacuuauuucccauuuacaaagaaaaaacaaaacaaacugagcacaggagguuggaguuuuacaguacuguuucuuuaaauguugggguugguucaaggaaagaugcaaauaauuauuuuauuuaguaggaagugcuuuuuuuuuuuucuuuuaagcugaauuucauccuguugcugugaugauugagugacugucacuggaagacaucuggguuuuuguaucaaggccagaguuggcuauuacauuaacaagaaaauuaaaacuuacuguugcaggagcuggggugggagguggggcauaagauggucuuucuguuugaaagaaaauaaauaacuucuuguaaacaacugagauauaauacuaugcaacaaaacuaccaaugguccuguuuugaagaaaaaaaaaugagaguauuuuggaauucccacuugcuagggcauuagucucuuauuaacauagauugauaaauauaaaaauugaaacuuacuugacauuuuggaagauuaaguucucaguuccuuaagaaugaaucugagacacuaaaauaaaaaaaaaaggaaaaaaaaaagagaaucaaaacucagcaagcauacgagaauguuuuccuaaugaauaggguaauuuaauugguauuucugaguaaaauuacuucaccuuaauuccuaguaauuaagccuuuuguguauuuuaacuaguucuuauaggucauuugguugauuagaauuaaaugacuaaaauaaaguacuggggauauuuagaaauguacuuucagguuuuuucuugugauacuaagcuaccucuuguauggaaaacauuuugcugacgccauguaaacauuucaucagacugauacaaggaugagaauagaaagugauguauuaucaggguccaacgcaacaaggccuaccagauacugacagcucccugaucagcaacuguaucaugcuuuugggauaacaauuuuuauuaaaauuaggcagcauuuuauuccuggaagcagugcaaaagguaauugguaugacaaugaacuucacauucucuuauaaugguaaauagcuucauaaaugcugggaauaaauuuugagagucuaccugaaaaacuuuuauucaucauucacagcccauuucaaaauuuuucuccucaagggaacuuucuugauacauuaccugggcagaauuaacugcucccccaucuguauuccuauacaguuuacacagaucuauauuauuauaacuuuuuuuuaacuuaucaauauggcuagauuguaugcuacuuggaaagagggaccaugucaggaccuagcucaauucuuaggaaauuuuuuccuaguauuaccagcucacaacauaaccaggcacaugugagcuuguucuuuacaucaacauacaucacaaauagugagguacaaaaagacaaaaauucaucuuuggaaagaaggcaaauaaacuucuaugacuauuggagguauuugcaaccaaacauguggaauagaucugauuuuucgcuucuauuauuaauuuuaaggaaauucccuggagcauaaggaaugaguccugguguggaaagaaacagcucauuuucucaaugguccaaccugagucuuucccucuuaaagaacagccagaaaccuuugacucugguguagauuuccuuucugcucacauuaagggagcugucaacauccagcaggccucgcugcaggggacccugacaacuaacauaagcucccuguacguuauacuucauuguuaauacuuuaaaauuauugcucucuuuugcuagaauacaaaauuuaagagugggcuuguacauuuguccaccguuggauccaucuuuggugccuggcauaaaaauaaauacccgauaaauauuuguucaagaaauacuuuauacgggguacgcuuaugacacuauuucgcuuaacacucacaaguacuuuauauguacagcuauccccauuuuacagaugaaacaagggagucucggaaaguuuaaacaacuugucugaagccauaugcagccaggaagugccaaaguuggguuucaaacccaggccaaacuauuucagagcucugcucguccucaagucgcugccugaaccaaugggggaaccuucugcccggguggggggugaaccacggaccugccuugcccacggcuuccugaggucgcucucuuugucuuggagaauguacuuuacuagcaacuccccuaaaacgggguauucacaggugcuuugaccaauuucgggggacuggccuugccuccaaggagggggccccagaugggacucccucccaacccucgcucugcuaggccucaaggaggccucaaccggcuccuggcucuggccccacggccaaggcugaaccccagcaacccccgggaacucggggucuagccaagcggggacaccacgacuugcacccaccgacccgguccgucccacuuggaaacacucacccgcgggcagaaaaagcgcccgcagcuccggcuucgcuucccuuugucccgcgcucgccccgccccucgcguccggagcuuccgcacucgcacuuuccacacucuucuuaauuuuuuuuuuuuuccgggccccacccgacccucuuuagaaaaacuaaccuucuagugaagaugcggugaugcuuagcacacucagggauuuuuuucaggacccauuggauccucaaaacuccccgaauuuugauacuuucccagccgggcgcugauucgucacggcgaagagggccgaggaggcccgaccuaacacagaauaggccuggguuuagcggcugugaggagccggagccgccgcagcgaccgaggaaguggcgggaggugccgagccuugcggaggggcggugggggccgcggugggagacggcggauggcgcucagcgcgaggccgcggaaccacuguggcagcaagcaguucggccagacucccgcugagcccgcuccuggaggggcccuccccgacuccggucuugcuuuccuuuaggcugugggucagagucuacacuucacuaaaccugggauggaggcguggaggacuugcuucgcggcguuugcguccucgcaggcgccucgcagggcuuccugcccucacggcgggggaguagcu

SEQ ID NO: 21495 - RNA, 24487 nt, Homo sapiens
caaauuuaugaaaaaaauauuuuauuccaaaacacuguuuacacaaauguguggucuuuguacaaaguacaaaaaaaccccucuucucauccccaccucccuucagagaaguuuaaaccuugggcucucaaucuuccauggucagcugccccugacugcgaguccuacagccucagagggaggagcgugugggguugggagcaaggccucaccagaacacagccaguuacgcaacagcgcaaggccugcuccaggccccaccuccagcggagucaaaccagaucagcuuuuaccccucacuccagauuccacaggcacgcagcacauggcugauuugcagcuugucuuucacugcaguuuuuuguuuuuguuuuuuccaggaggcaagaggaccaacccuccaagucccggggccccuguccacccaccauauccuagacccaaucuuuucuaccucuuugucgacaagguuacaaacagagaggcaagcaaagaaggcuggggcccaacggaggggagagaauauauaucccgggaaacgugggcaacagcaucauagacuugaaugaagcccaaggccaagcagccaagcaaggacuaauucagagcagcucagaaacccucacucaaaccggcggccccccugugcuaaggacauggccgggcccagacgcgcucucauaggguucacagagagucuggaguccacguucacuaaaguauaaaauacuacucgaaaaugaaccccagccucccuucugagagaugaaucgguuacaucaacacaugaggacagaugcauuuacauagacccacacacucucucuuucucucucucugucucucugucucucucucuuaggagggcaaagcuucucacuccggagugaaacuucagcuuacagacguuaccugucuccccuccccuucugaaucaucucauucaaauagcugcugagcagaugaggggcccaggaggaauaggucuggcugcauugagugccugcagugacagaggcucggucucuaccaugacagagacagacucggcgcacucuuggaugccaugaucugaaaagaggccaccgcugcugcagccacaucccaggacugcacaggggaggcaggcguagcucaugcacaaggacacacacacacacacacacacaagcacaugcaugccugcaaaggugucaguguacacagccuuacuaaacucacaacacgaccgcuucacauugcauauuguuuccaaagagaagcgugggauucaaacauucaugagagggagccucuggcagaggugaaaagaccggcagggggcgagaggcgggagucaagacuguccauuggucggcguaagaguuccuccacgugccuggccacauccauggucucauccaggucgaauucuccauccugaucgaguacauggucagggcugguaaagacagggggaugucagagggagcuggcaugucucacagccucaagcucccuggggacagccuccagccugcucuccacucaaacccgucucaugagaacaggaccaguucuggcuggaugcccccaccccaccccaagcuggguagcagucagcccacuggcuucugcagacccccacucuauucgcaucucuugcuaacucacugaauaaucuuagggaauucauuuccccucuccguguccucaucuuaaaaccagguggcugacacagugggcucugcccaccugcaaugaugcucagcugcaaugguaggcaccgccccguucacugagcacuuagaacagcugaaucuuuucacugagcaccuagaacagcugagccuauugagcacaugacuccaauuuuuacagccaacuggagaguggguauugaccccguuuuauagacgagaaaaccaaggccauaucaggaagcuugcucugggccaccuggcugggaggugguggaguccggauuggaaccugggaucuucaguggucccacuggaaggugguaccucccagacauccagcccuggcuauccacagugaggaagggaauuaauuaucuaccuuguucccaccagacucaagaacaaccaccccauucauagcuacccuguaucaagcccuuccaagccccucccuguggaaaugcuucacccacacugucucaguuuaaugcucaucccauucucaugaggcaagcauucuugccuccguuuuacacauaaggaaacuugagcaucagagaggcucaaucauuuucccaagaucacacaguuaguacuagagugaggacuugacccugcuaugucuagcuucaaaaugcucuguuuuccuggcugaucucacuccuccuggacuugggccuaaccagagcucuggauccuuugcccgccagcccuccaggaguccagccuggggccaaguccccaguucuuccccugcggaccccaugagaacaccaccuacuucuguggguacauguuauagggagccugggggcacacagcuggggagggggccugguccauguacguggcgcugcugcccccagcaucugcagaugcauucacaaaccugcagaaggaagagaacagagcuucagccaccagggaggccggggcagcugacuuggggaggggaccgaggggcauguuugucuuucucgggguguagacggacaaagugccccacucggcccuggggcuccagcuacaggagaggggacucccuccccagggcugagacagguucccugggggagcggaaagcugggcccaggaucaggaugggaggcagggucugggggaggaggaaagaggcagaaggagagccacagccaccuggacacuuacucagggaccacuugcuugaucugugguuucacauauccaucaacagcuuuagcugucaagggaagaacaguggugagaaccaaagucucugggaacucccaagugggguggaagcccacgccccauguagucucccuccugcucacaucaccuuguguucucagcugggaugagauuucccaaggacccccaauaaacaccagcugaugaauccugccugagggucacugagaccccuggcuugaaucccauuccuucugguucuuuuucuggccaucugauuucccucucccugcucccaccccugucaaagaaugagaaucaacaagcaaacccaaccaauggauuuggggcagcuggaagaagagagacuucucccuuuugcugccugcacuccacucgggggaagguuugugagcaggguguggagagcagcuggugagguggggagcggagcacuaucugugggcucgaaugaucccggccacucccuacagugcugccaccccuuccuccgagggugcagaagugagaauccaugcagcuuucacuuugcagagaagagagcugggacggguuucucguucccucuccucauuugugagcccugaaauccucuccaccaccccaugggccaaaacccacaggggacauggccccuaggcuccuccuggggaaguccccacggcgcagcccaaggcuuugucuaugggcuggggaagagcccgggggagucagccggcaggguccuggggcaguacccacccagcacaggaguguaguacuuggagaagaccucauccuuggggcggucaggaaacacauagaugagauagcucaggucccccagccggucagccagggaccugauggagaaaucccgcguggugaaugguuucagguuccacagguugcguuccgcugugaaaagaacagccucauucccauaauccaccagcagcaggaggaccaagguuguggggcuuuagggcaggcuugcaagagaaaucugggcuuuuauauaguagcuugcgcugcagccccagccuguagggaagaaagccgaugcgggauguucuacucagcaaaccagaugagcagauaccaacaaggcugggucguggcagagaggggagagcgugaaacugcaggaggacucgcccagccguccuggagucuauggggcuggggacuucagguucuccaaaauggaaaacaauagaaagagaauacauuuccaagccacagcccucucauacuaagcuucccgcuggguaccuucuaaggacacaggcccgauggagggugggguggcggggcaagggaacaagagaccgggccuuggggcuggagugugggcaaaacgggcacucacgggagucaaacuuccaggcgauggugaugcccccgauuucugagucacuaaagcgcaacaagaaggucccgucgggcuuguugaugagcaggucgugggccuguugcuuauucacaaaaccuaggauggcccugggugcacggagcauugagcgucaccacugggccacagccacagucucucugcgcccacagcuggccccugacccugcagcccccguuccuuacccaucauuccaguggggcuuguggugcuucuucaacaccuccaucaccccgucaaaccacugccagaagguguaguuccagcccggcaaguucuccugagggcccaggaacccccgagucagggcuggugccccaggucacagguggcccaggaaagucagggcccuccugcccccacccagucuucucccaguucuucaccccugcuugccaccacacuccagcagaccauaaagugacacagcccccaacuuguacccuaggaaaacagagaggaaacucacuucuaagacacagggguccaagaccagcccaagggugggaguaagagguguaaagaauaaucuaggcuggauggggccuccaaagucauuccuccaaagucauccccucauuuuacagguggggaaacugaggcacagagaauggaugggucuucaaaaauuagcaaggagagaggcagaaggagagccagagccacaggcgugguggcucacgccuguaaucccagcacuuugggaggccgaggugggcggaucaccugaggucaggaguucgagaccagccugaccaacauggugaaaccccaucucuacuaaaaauacaaaaauuagcccagcaugguggcaggcaccuauaauuccagcuacucaggaggcugaggcacgagaaucacuugaacccgggaggcagagguuacaguaagcugaaaucacgccacugcacuccagccugggugacagaaugagauucugucucuaaaaaaaaaaaagaaaauuagcaaacacaucuaggcccagaacccaaggauccugacucccagcccugggcccuccgucaucucgcucuuggcuucacaacuaagcacaacuccuauagccccugccugcauuucuugaggcuaggggcccccaucucuccugguuguaggagagagugguuggggguggagaguggggugcuagccccaggcaguaaccugucugugagguggaggagcaacagaccccggugggcccuggugggcggcuggcagcugggccccucacccuguugaacugggaccaggacacggacaggccacuguaguccuccagguggcugcugcuguuguugaacaguuucugcgccaggaacacgagguucuccuuggucaggccccgguugcucugcacuucggccuugaauuucauguugagcgccucacacagcugcggccacagcacuuugucaggcacggcaaauggcacccugcccugagagggagacaagagaggggaaaagguagauugagggaguuggaaauauucacacacacacaagauacacagacaccuagagacagaggagacugagacagauccagaaaggugacacaaaugcaagggcaggaaaugcggcggcuuuuauauacuagcuugcacuuuuuuucccagccugcagggaagaaaaccgaugcagggggugggggcaugcagggacagagaugcagaccaggaaacagaaaacagagagcaaggacccaagccaucugccaaaggaggaucccagaccaggauccaaagaccaagcucacaguccucacagaccccaguccaggaaccuggaacccagagugccaaggccaugguggaaggcaggcgcccagcaccccagcccuucuggccucaccucaccucugggcuggcccuggggugaggaaggaccacucagcaggggcccaagggguggggcugaccccaggugaguccuagggccugggggugcugggguagggcucccacggggacucaccggcucagcaaaggcauugucccacagcacaguagccguggcauugugguccuggcugccguggacgaugacaaccacagguagggacagagucuacaggagucaaaggaacccaaguugauggggcgugaccaccacgugcccucugcuuaggcaacaugcccaaucugcuuuauuuuuuuuuauguauuuuuuuuuuugauauggaguuucacucuuguugcccaggcuggagugcaauggugcaaucucggcucaccacaaccucugccucccggguucaagcgauucuccugccucagcuucccaaguagcugggauuacaggcaugugucaccacaccuggcuaauuuuguauuuuuaguagagacgggguuucuccauguuggucagguugaucucgaaccccugaccucaggugauccacccuccuuggccucccaaagugcugggauuacaggcaagacccaccacccauggccgcaaucugcuuuauuuucuucgagacagggucucgcucggucgcccagacuggagggcaguggugcaaucacagcucacugcagccuugaccuccugggcucaagugauccuccugccucagccuccagaauagcugggacuacaggugcaggccaccaugcccaacuuuuuucuuuuuuuuguagauacggguucucacuaugcugcccaggcuagucuugaacuccuggacucaagcaguccucccucuucugccucccaaaaugcuggaauuacaggugagagccaccacaccuggucccaacccacuuuccucacccacaguuccaaacacaagccccucccagcaaaauguaggcacaagcaaacaaacaaaaacuacaaccgacuucuucuuagcccauugccuaaauugucuggguuagucccagauuauaaccuaucaaacagggacccacagagucaaagcaggcuguccgauggcauugcugccaggaguccugaggcaggccccuccaccucuugggugaccuggagcagugggggcaggagggcugggggucucaccuucaccuggaacacaagcucauugcugccaacacugaacugagacucaaacaggacugugaacuucuccucugucacggacucugcaccccgccggucagcacgcuugauccucuucagugacugcagggugggaggugacaggggaacagggagauggcggcugcuuacaaggacucagcucugggcagaccugcccuccgagggugggccccguccucaccauguuccugaagugggcacugagggugcccguggcuuggugguacuccaucacgcagcaguuguucaggaucucaccacugcacucgcugcaaaggagaggggggucccagcuccacaugggccccaggccaggagcaugguccuguccacaccucgggcuggggucuucgcucaggucagcccugccagcagccccugccccguauccccuaagaguguuucuuggcgucuuucuggguuacugacuucuccaucaaccuggugcccagcacccaaggcaaggucuccaguggugaggucuggaucuaucauuagaaauuccucgauaccaagauugaugugagggcuuuggggacuuccaauagcuucuaaugcacuuaagauaaaaaucacaaccacagucucugaggaucccuauggucaacaccuacccaccccccuggccucacugaauuccucuccccucacucaggacaugcaagccccguuggcccuggcugucugcugaacaugccaggcuuggacauuggcccuugcucuuccugucaccccaaacacucuuagccuucuccuccuucaggucucagcccagauagcuccccagaaaggccuuccuggaccacuuaucuggagaagcuuaccaagcugaccuuuccucacccccgccuuaaacacaucuccaacgcuagcagauugcucuuuuuucuuuuuuuuuuugagacagagcuuugcucuuuuugcccaggcuggagugcgauggugcaaucucagcucaccacaaccuccaccucccagguucaagugauuccacugccuuagccucccaaguagcugggacuacaggcgcacacaaccauaccuggcuaauuuuuguauuuuuaguagagauuggauuuugccauguuacucaggcugguuucgaacuccugaucucaaacgauccuuccaccucagccucucaaagugcugggauuacaggcgugagccacugugcccagccuagauugcucugucuuaacuucuuuuccagugucuaucacugguuggcccugccugaucuuuuaaaguguauuaucaucagucuccccagcugcaaugcaagcucaaaggcagugagaaggucauuugucuucaucuucaccccagaucacaugguaggaaaucaguaaacuuuuuuuuuugaaacagagucuugcuuuuguugcccaggcuggagugcaauggcacagucucggcucacugcaaccuccaccuccuggguuugaggaauucuccugccucagccuccugaguagcugggauuacaggcuuccaccaccaugcccagcuaauuuuuguauuuuuaguagagacgggguuucaccauguuggccaggcuggucucgaacuccugaccucaugauccgcccgcuugggccucccaaagugcuggaauuacaggcgugagccacugugccuggccuuuuuuuuuuuuuuaaacagagucuugcucugucauaggcuggagugcaguggcacaaucuuggcucacugccacguccaccuccggguucaagugauuuucuugccucagaguaguugguaguuaggacuagagguccaaguagcuggagcuacagguguacguuaccaagccuggcuaauuuuuguauuuuuaguagagacaggguuucaccaugguggccaggcuggucucgaacuccuggccucaagugaucugccugccucuaccucccaaagugcugggauuacaggcgugagccaccucgcccagccucaguaaacauuuuuaauuggaugacaagggauggggccaugucuuccacaucacucauucacucauuuauucauccccugcauacgcuguggguggccugcccugacacuggacacuacuucuccacucucugcuacacauaaugucucuguacucuucccucaggauguggcacaugggcucugccugaaaguccucccucucugcuacuucccucccuaucacuagcuaccuccaauuccaccaggagccuaagacugucauuucuuuaauccugcaagaagacccccuuucucggugcccuacacaucccccugccacauggcuacaccaucaggcauuucccagcaucugcugccugcucugcugcucaaggggcugggcgagaagacagcccaguucuguugggaucacaguuuuguccucagugcguagcacagguucuagaacacagcuacaacaccauacuuugugugauuuuuuuggagacagggucucacccuguugcccaggguagagugccauggcacaaucauaccucacuguaguaucaaauuccuaggcucaaaugauccuaccaccucagcuucccgaguagcugggacuacaagugcgugcaccaccaugcccagcuaauuuuaaaacuuuuuguagcgaugagggucucccuauauuguccaacucaaacuuuugggcucaagugauccuccgaccguggccucccaaagugcugggauuacagggguaagccacggcaucuagccuagcaccaagcuuguugcagggacagggaaggcaucugaguaggaggaaggcaguguaccaucugucccagauuuaaugaugguuugacaugauuguuugaauuuacaauggugugaagcaauacacuuucaggagaaaguggugugauagucucucacaaugcugggcaguggcagugagccucagcucuccggcagccacaccauccccaggguaaagaacggauacucggcugggugugguggcucacgccuaucaacucagcacuuugggaggcugaggugggaagacugcaugaguccaggaguucgagaccagccugggcaacacggugaacuaggggacaagacauagcuggaugcaaggacaaagcggggggugcaggucccccacaccuaagcuugggcaggggaagggagaggcacaauuacuugcggguguucucauuuuuaagcagagacuuggccugcugcucacugaugaugguggccuucaccugggggggauucaugugcacguucagcuucccgcccaccagcaggcguacgguggcugcaaacuuggucugggucuucaggaccugaggaggcugcuucucaaugaugaaugugcugcaugggacacagggacagacacacgaugagggguuggcgcaggggaaagggcucucagucccucugugguggggguggggcugccucccauggggcucaggaggugaugagcucgggcacaaccucuguucccggggaagcugugagaguccagggagaggauggagaggggagugagauaacacagcagcuggcaugggcugcggcccaggguaucucuugcaguguccacaggagaaacugggcaagggcggcaccuagcagccacagcaacuggagauggaguugggagggaugagaggcaggaaguggaucugcuggucuggaaggcaccugcagcuccccccacgcaggcaggagcugccccaagcuccugggcauggcaaacaggcagcagucaccuggucaccagggcugagauaauguccgugaugguggcguugaccucggccagcaucuccuccacugggccggggaugggcagcugcuggcagaggugcucagcccugcggaucugcugccgguucugccagaugaucucggccaacuucucacaccugcacgagagccccaaggccaacaggaggacaauggcuucuccucacagacgccaggccccaagacacagcucccguucccccaggaaggcucugugcuuucgccacacuucccacccaugggaagagcagagcucccugccucccagaauuagagacguacacaggaggggcgacccugacuaggcccaaacagcccaagcaucaccccacacacccgagccccaucccacccccaggacagcagcccccuuccugggggaggugcacaggauggggaccaaagucugauugaggaaccaggcucccuggagaaacaagagcugucccaggauggagggggccugcugcaggagccagcacaggacgcagaagcagccgggguccccaccagccccuccugcccugcccgcuggccgccccacaccauuaccaggacuguagcacguccaggcugcccucggggggcccgccguucccggccagcugcugccgccgcuuccacuggaucagcucgucauccaggaugauggucugcugcuuccgcagcagcugcagggucuucuggugcuucucggccagcuccugagggaagggaggagagcagccccuucugggcucccagagaacaccgcagggccucgcugggaaauggcagggcagggcccaggccguucccucuccccaagcugcucugccucgcaaggcccccaggaaaaaaggccuccugcccucccagguucugcucucaugcuggucccagcccucccucggguccccagagacugacuucauggcacccacgcccaggagaggcccaggaccccacucaccacgcgguacugcugcagugucugugccucacgcugcaaccaggccuccagagacaccugcuucugcuggagggccgucucccggcucagacgcuccugggggcucagcugggccagcugggcaaacugagcuagaggagagaagaggaaaccaugaccaucaccuccuaguguccaacaggaggccuagagaagcccacucaccuguucuggagcgagacccucccaggcucagacacugcaucaagagcaagucgggguuccugacagccaggggggccaagaugaauggcgccucaggaggcgccucugggcccugcucaccagccuccugacucugagccguccccucugggggcacacgggugcuggggcagcuggggaggaggccugccugccuccugcccgccugccucacagggcugccagcccucuucucgcgucccagcauggguccaggcugucugggguguaagugugcccaugcccuugacugcaggugaaccugggcaaaucgcuuuccuuuccugugccucagcuuccccacguguaaaacgggagauucucagcaccugccucaguggggugcuugaagauuaaauacaugaggacauggaagaugccagaaagcugccugacaugggugagcucugugugagguucgugcuucuugguuaacggggaacaggacagagagaagaggugacagagacaagcagcugcucggccccaucccucccgcagcaaggccucuucagggaaccccagccccggcggcucugucucgucccugagcacagcagucccuccucaggggaggaugagauucuugaggggcuggaaggggcccagcauguuuguccaggugggcucacugugagcccagccgaccaaccaggggagacagacagauagacagaccgcagagggagagcguguccagggccacuggggaugcagagccaccaagauucucucaggaaagggaggccgaagggaggcggcuucccuccacaccaucugugaggagucucauugauggcgggacagggaauaagucaggccucacuagcuuuuaaaaaguauccaucauggggcugggcgcaguggcucacgccuguaaucccagcacuuugggagacugaggcgggcagaucacgaggucaggugaucgagaccauccuggcuagagaccauccuggcuaacacagugaaaccccaucucuacuaaaaacacaaaaaauuagccgggcaugguggcgggugccuguaguuccagcuacuagggaggcugaggcaggagaauggcgugaacccagaagguggagcuugcagugagccgagauugggccacugcacuccagccugggcgacagagcuagacucugucuaaaaaaaaaaaaaaaaaaguauccaucaugugccaggcucgguggcuuacgccuguaaucccagcacuuugggaggcugagacaggcagaucacuugaggucaagaguucgagaccagccuggccaacauggcaagacccugucucuacuaaaaauacaaaaauuagcugggcaugguggcgcaugccuguaaucccagcuacuuaggaggcugaggcaggagaauugcuugaacccgggguuaaagguugcagugagccgagagcaccacugcacuccagccaaggcaacagagcaagacuccaucucaaaaaaaaaaaaguauccauuaugaaauacguaagacacaggggauguggaacacaagggcgccuguguaucaauaacccaggcuaagaaaguaaacauguccacaguuacaaccaccaccgcaggcccaccccacccucccagcgacagcccgucuccaccacacugggacuauuaaucccuucccaucaccuucucaacagcccagcguccuugcuugagcugagucagaagaugcgcgcaccagcaugucuuggucgagcuccuggcuggccccugagggccacgucacucugaccccagcccugacccaugggaugcacaagcugggacagacaaaagcaacucuauguagccaggaacagcccagagcuagaacucagaaauauggcuccaaucucacugcagguaucgagcaggaagaggaucauccaggcacggacagauccgaggugucugcacggcuaccucggguauccugcccagccacagggagggugguggugaucccaacaccugggcccagccuuccuaugcaagggacccacuuagggcucuccuggaaauuugcagaagcuuuuaggaaggaggccagggagacgggaagcaauuucccuacuccacuggaggcagcugagccuucccuggcaaaagcagaucaauagucuguguuucugcugagugaacuugacaaaugggacugagaagacacugcaugauagauccaaacccaaccugaauccaaaccuaauccgccaccaugcacaggaaacagaaaagccaggcacgggaucagaaauacugucgacagucuaaggacuuggguaggaauaaccgcccaaaaucuuccguuuccauucucagaaggagcugcccuucuucuagggccagucugggauagauucagaugaggggaaauucucuuagaauuauccugucaguauuggcugggcaccguggcucacgccuauaauccuagcacuuugggaggccgaggcaggcagaucacucgaggcuagagguugcaaccagccuggacaacacggcacaacccuguaucuacuaaaacuacaaaaaaaaaaaauuagccaggcaugguggugcaugucuguagucccagcuacugaggaggcugaggcaugagaauaguuugaaccugagaggcagaggucgcagugagaugagaucgugccacugcacuccagccugggcaauaauaaauaaacaaacaaacaaacaaacauuuagaauuauccugcaaguauuuacauaauagcugcaauauucaggcauugugcuggucucaguguacacaaagcacugacagugcaggguuaggaagagagcuuaaauagcuacaauagaauucuaaaaaaaucagcugggcgugguggccugcaccuguagucccagcuaugcgggagacugaggcacaagaauuucuugaagcugggaagcagaggcugcagugagccgaaaucaugccacugugcuccagccugggcgacagagcaagauugucucaaaaaaaagaaaagaaaaagaaagaaaagaaaagaagaaaggucuaaaaucaaugaccuaaggucuaccuuaagaaaucagauuaaaaagaguaaaggaaaaagcaguuugacaccccuuguucucacuaagaugagguguuacauuucuggggucagucuggaaugggacauauuaauagaugggccaugucccaugacuccucaaauuguaccuggggauaguuccuuucaagcuaauuugauuuuuuaauuuccccacaucuuuaucaugggagccauuggcgaacuacagaccuaggauacaggagaauuuucuacugucaccccuucccccaggcccacauccuauccgugaggcucaagaaggcccacuuuggaaguuccaccucucccagccugguucaaccagaagacuuccaauccaaguccucccucugguuagggagcacuguucauauuuaccuauuugugucgauauuuacagaauacauaccauuaaggagagaauacugguuaauaaaguacaggaguuuuaugauauaucucuaguugagauccaguucuguaauuuacaggcaaccuaggccaaguuacuuguucucuuugaaccucacuuuuaccaucugcaaaaggggggauaacacaacuguucacuucauaggcuuguugagaggguugaauuaaauaaugugugccaagugugacccacggcaggggcucaaucaccgggagccauugcuucuaccaggcuuugggcaaagugcugaggagauggacacugacccagcucuacccucuaggaguccauagaauguuccucacucccacccuccggaugcacacugccuccaccgcgccucaccuuggauccucaggcucuccugguacuggaugaugaaguacuccugagucugcugcaguuucuucagcucauucucuguguccugcgugaccagucgcagcuccucaaaugucugguugaucugaaggugcuucugggacauggcgucaaccaggaucccagccggagagcugcacuggagacagauggaauggaaauaacucggggaagagaggaugggagaagaccacaggcauuaggaaacaccaauacuacagaccccaaaccccaaaccccaaacuaggguaagaagggaaacuagggcaagaaggaaggaucauuugcaucagaaggagucauuugccagaauugggauagaaaagggaaagagaaaggagaaacaggugaccuggcagauaacggcagauaguaacaccuucaaaguccaaauaucuaugucagagcugcccuccacuagaguauuccaaacaggguccaucuaauuuccucccagggacuagaacucaacacgucccaggugucaccuggguuuucccacuaaugaugaugaccccucgcucuacauuuauuugcugacucaauaccauggacugcaguagauccuagggacauagggaggaacagggcugugugaacacacaccaucucacuuaagacccccuugugacugaaggaagagggaagaggccgaaacucucacaggcauccuggagaccccgaaaugaaguuagaggggaggcaucaacaagcuccccuuggauccagccauuccuucagcacauucaggagaaucgcuugaacccaggagggggauguugcagugagccgagauugcgccacugcacucuagccuuggcaacacagcgagacuccguuucaaaaaaaaaaaaaauagagagagagggguagaaaccaggucacaaagggagggagcacauggaugaagaggaacaaguccucagaggcuuuccaaugaacuguucucagaauaaaauccaaaccccuucccauggugucugcuggccauagcccugccuaccuccaaccccagcucgcugggaaugugugcuuucuguuucuguuccuugaacacacaggcauguuccugcccuggggcccuugcacuuauuguuccaacagucuggaacauucuggcaucagauccuccugaggcaaagcacuuuaacugguaccauugcagaggggucaucucugacgagccaauucacaguaguccuaucuaaaaguguguuguucuuguauuugcuuacauguuucugucugucucccugcacaaggaugugagguucccaagggcuaggaccuugccuuuccugugaacuacagaauccccaagcccuagaaugccagggguguucaggaacaguuguaugguuggaggaaggaaugagcucccagaccaugacagcaccagcaccauggacauggauuugucaaugaggcugaagucauuuuuagguuugcagauagcucugugauggcaacaagucagggacacaggggcugugcuggaagacccuuugugaccugguuucuaaccccuauuuuuuuuuuuuuuauacagagucucgcucuguugcccaggcuggagugaaguggugcaaucucagcucacugcaacaucccccuccuggguucaagcaauucuccugccucagccgcccgaguagcuaggauuacaggcgcccgccaccacgccuagcuaauuuuuguauuuuuuaguagagacuggguuucaccauguuggccaggcuggucucgaacuucugacgucaggugauccgcccaccuuggccucccaaagugcugggauuacagaugugagccaccacgccuggcccucucuaucuauuuuuauccauggcaacuccccacuugguuccuucuccccaguuacacugaccacuuacaagucuuccaaugugauaagaagauucaugcccuccugcucucgcagcugcugucuuuucauuagaaaauucaucccuccucuccugccuuucuccacuguagcucagacaugccuguccacaggacgcuccccugccagccugccccaaucugaguugggugcuuuuuccaccuaggcccccuuagcacucagcucaucucuagagaauccaucacugccagaauuccuuccaggcaagaaccaggccuuuauguguuucucugaugauagcccagcaucggacacacaguaagaccucaauaaaugucuacugaguaaauccugaaauccauguccacaacaauaaauacguaauaggccgggcgugguggcucaugccuguaaucccagcacuucgggaggccgaggcagguggaucacuugaagucaggaauucgagaccagccuggccaacagggugaaacccugucucuacuaaaaauacaaaaauuagccgggcaugguggugggccccuguaauccuagcuacuugggaggcugaggcaugagaaucucuugaacccaagggguggagguugcagugagccgagaucacgccacugcacuccagccuagaugauagagugagacucagucucaaaaauaaauaaacaaacaaacaaauaaagaaagaaauaauaaauaugaccugugcuccggucacuguucuaagauuucugucacgucauguugugaaauucauuuugcucuauugcagauaguacagcacugugccauuguccauguagaugcccagugccuuuauuauuucagaacuggggagaugugucccuguuaccccucccugggccucacuucucugagccugccuguguuaguucuucugacacagauagguaugauugcuaucuccauuuuacaagaguaggaacaggccgggcacgguggcucacgccuguaaucccaacacuuugggaggccgaggcggguggaucaugaggucaggaguucaagaccagccuggccaacauagugaaaccacgucucuacuaaaaauacaaaaaaaauuagccgggcaugguggugggcaccuguaaucccagcuacucgggaggcugaggcaagagaauugcuugaaccugggaggcagagguugcagugagcagagaucacaucacugcacuccagccugggcaacagagcaagacugcaucucgggggggaaaaaacaguaggcgccaagcgugguggcucacgccuguaaccccaguacuuugggaggccgaggugggcggaucacgaggucagguugagaccauccuggcuaacacagugaaaccccaucucugcuaaaaauacaaaaaauuaaccgggcaugguggugggcgccuguagccccagcuacucgggaggcugaggcaggagaauggugugaaccuggaaggcagagcuugcagugagccgagaucacgccacugcacugcagccugggugacagagcaagaauccgucucaaaaaaaagaaaaaagaaaaaagaaaaaaaaacaggaacagaggcucagagagauuaagcaacuugcucaagucacacagcuaguaagugguagagccagggacuggauccagggggucacuccaccccggcgugcaaugcugccaccucuuacacuugcccacgucccucaucuucuuggugcucuccucgugcugcuguuuuauauaaacacaguuguuucuggagagaaaggcauauggagggacuucucaacacuccuccccauccccaagggacacucacauuguuggcuucucggaccagccucuguucauuguacagaaugugccggaugcagcggaccagcuccagggggcagcggucauauguuuucugaaagaauccaacaguagccuccagcgccauccucugcuccagccaugccagccccaugcuaugcccagcccuuccucuccuucagccucugccucagcuuuucccagggagccucaggaacuauccccagacaccucuauaucucuguuccucauccucaucuuccccuccaagaucuucauaucugguuuggagcgaauuaaaaacccacaguuuaugaggcacuuucucuuuuuuuuuuuuuucuuuuugagauggaguuuugcucuuguugccuaggcuaaaggugcaauggugugaucucagcucacugcaaccuccaccucccggguucaagcgauucuccuuccucagccuccugaguaguugggauuacaggcaugugccaucacgcucggcuaauuuuguauuuuuaguagaggcgggguuucuccacguuggucaggcuggucucgaacucccgaccucaggugauccacccgccucggccucccaaagugcugugauuacaggugugagccaucauacccagucuuaugaagcacuuccaaucuaccguaucuuuugacuguaacacaggggucccaaaccccugggccauggacugguacaggucgguggucuguuaggaacuggaccacacagcaggaggugagcggcggugagcaagugagugacgcuucaucuguauuuacagcugcugccuauugcucgcauuacagccugaacucugcuuccugucagaucagcaauggcacuggauucccauaggaaugcuaacccuauugugaacugcacaugcgagggaucuagguuaugcacuucuuaagagaaucuaaugccuggugaucugucacugucucccaucacccccagaugggacugucuaguugcaggaaaacaagcucagggcucccacugauccuacauuguggugaguucuauaauuauuucauugcauagcacaauguaauaacaauagaaauaaagugcacaauaaacgugaugcucuugaaucauccagaaaccaccucccugcccaaucccgguccauggaaaaauugucuuccaugaaaccggucccuggugccaaaaaguggugggggaucaaggcacuaacagcauggaaacucuaggacauaagcagaaacuaugauccccauuucacagaugagaaaacugaugcucagacauuauguacucguccagacgcaaccaagugagagagcagaugacuccagacucagggcaucugaugccaaggucaagguacuucccaccauccugccccuggccuccuauauugcuuccccucaggcuucuccuguuuucccccucuucugggauggacuuguauuucccuggcacccugcugucuguauugaagggcucucuaggaaacauacgugaguuccaauaagugcuugacugucaucacuacccacaccccuuuccugcuuccacaaaaacucccucucuuccuccauacccacuccccucaaguaaagaagcuacaucuuauuucuaaacccucaauucaaagcccuuguguccagcucuugucucugggauggcuccucucucaccuuuaaaagaccccaagagggaggucugguggccucauuucuagagucugcuggucuucccuucuccaacauaggaauccugacucagucucccuccaucccuucugcugcuuccauaaggccaguucacccaucucucucuguuggcaacaaacaccucccacccuugcuuugcaauaugcuaaagaaauccgacaggucgaauuuagaaagagggggugggggaaaucgaagaaaaguucccaauaaguucguggucacauggugagucaguggccaggccaggaaaaaacccagggguucugaugcuggaacaagaugaugcuuccuccccguagguggcccagagccuacacccaccuggagcugcguggcguagugccccagcuugaucuucaguaaaaacccaucuucccccaccuggugcuccgccuucuucugcagcuccugcaccaggcccuccaggagcuggguggcuugggcucuguccuggggauuguccaagucaauggcaucccuuggggcagggcagaagagaaaaaccuacuguggcaccuccuugggcaaggaggucagggagcuggaauaaaguggaaaccccaggcucaugaccgagggcacuccagggcccacaagacuuguucccagcagcuccacagacauccgagucuaaaaacauucucuguccucccaggcuuccccuuucccaggggcaccaccccuuccgcacaaagaaggacaggcaggaccagagucacaccaaaccaccaugaguaaaacuagaggccaaagggccuggaugguagggacccucugaggaggggcagggcgggacgugccuaccauggcuggcucucaauccacugggccaaguagugccggaccucgauggggaagugcuggccguacagcaccugcaucuggcgcagcgcgucucccugcagcugcugggccuggauccagcccgccauggccguucaccuagggcgagccgagcgcugaagcgcucuccucugcagaggccaaggaaccgggccugccccuggccuugccaugccuaccuaucccuggaccgcggccaggccaggccccuccccucccacagauagcuuuccugugcgggaacagagauggugaggaguggagggccgcccauccccuccaacaaggaacccgcugaaggggaggggaaggugcucugcagaggcaggugcccuccccgucuuccucuccccucgccccaccggagcuucccuagugagggggacggccagaaacugaaagagaaacuugacggcgggaggcccacaggcccccuggagagggcugcaaggaucccccagcccaccucgggcccgguuucugggaaggggagauauuccaacccgaaguuaggccagcgccacgacggcucccacucgacggcuagggcuuuucgggcacguggcuggggcuguucaggagacagggcugaggacuugggcgcuccccucuucggcugcucccccaucugugcacuagugccuccccggguccagcccgacaggugcucccucuccgaggcgugccaggacggcgcccucccuggccucugccuuucauccccgaccccuguccccacguccccccgucccucgucugcgcugggccaacucccucgcagugccggggacugauccccgcgcugcgcccggccgucgagcuccgggugccggaggugccggggcggcaguagaguguccccucucggcgcgccgccgaggacgcgccaccgggucacccaccugguggggccgcaccguccggcagccgggccggcucugcgccccgcggcucucgcucccggccgggguuccuggcggcggcggcagcggcggcuguuacuacaggaaggagcggagagcagcgauuuccuccucaaaggucagcugccugcgauagaccauacacagcgcgcgagcccgcgccagcagcccucccagccccgcuugcucccucccugccucgcccucagucgccggcuccccugcaagugcgcaacagcggcggccguucccggcgggcggcgccgggcgugggggcugccccgacggcggggucccccgggagucccagcaggcccucggcggcggcucccagggagcgucccggaaccggggcgggucagaauagccgggggaaugugguugucgggcguugccgggaaaucccgggcucuggaaaucccaaaccugggccucaguuuucucauccgcaaaaagggaggagggaaaaguggaccaauuggcgacgccuuccagcucuggcgcgugucaucuuuugagccccuagauuaaaaaauaaauguguggggugugugugugcacgcgcgugugugcgcaugugugucuugggggccacagguuuugugaccucagagacaaaacuguagagaggggaagaacuggggauucuagugaagccaagaucacccccaccaccgcagcaccucccuccuucuuuuacuccggccaucuaaacucaacccugacggaggaacuggaaagaaucuuggcagucauguguuucagcccucccccucuccacaauuuugcagguaagaaauggaaguccugagagggaaaggggcuugcccggggccacccagggccacacaguaggcacguggccucaccagccgacugugauccauaaacuagccagcgcccccguucacccagccuaguuacuuaugaggcugguucuaccuucagaaaaguccagggagggaccgucuugaguccuccuaacuucgaaacucucuacaggccuugccacagcagugaauauccugucuagagccucagucccccucuccaagaggccccuucccacgaggcccaagggguuugguaaggucgggcuggacgccuuccauccccu
